United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 11

SEQ ID NO: 40691 - DNA, 201 bp, Homo sapiens
tacgtttttctattttgtctgaactagccaaggtctctggagtttgctgttatattgcttcagagaaattagtgacattgaaaggctgttgtcttttttaktgtacttttggttgttaggagaaatttacaaggccatttttttctcccgtctctgcagttcaggagattatattagaaaatattctatacaaaaaatatg

SEQ ID NO: 40692 - DNA, 201 bp, Homo sapiens
tccatgacactggtctgcacaatgagtgtttttgtatatgaaccgaaaaacaggtagcaaaagcaaaaatagacaactgggattacaacaatctaaaaaayttctgtacagaaaggaagcaatgaacagagtgaagcagcatcctacagaaagagagagaatatttgcaaaccacacatgtgataagggattaatattcaa

SEQ ID NO: 40693 - DNA, 201 bp, Homo sapiens
acagtgtaaaattagtagaagaaaacaaggaggaaagctccatgacactggtctgcacaatgagtgtttttgtatatgaaccgaaaaacaggtagcaaaarcaaaaatagacaactgggattacaacaatctaaaaaatttctgtacagaaaggaagcaatgaacagagtgaagcagcatcctacagaaagagagagaata

SEQ ID NO: 40694 - DNA, 201 bp, Homo sapiens
tttatgattaacttatatctggtcctttagacatttagattttttctgttttatctctctctctctatatgtatatctatatatatatttatctatatctrtatagagatatatatatatatatataataatgaatgaaatggactgtttgcaacctcagatgtatttctaggacttagagtgattagcttgaggcgatgg

SEQ ID NO: 40695 - DNA, 201 bp, Homo sapiens
aagaaaaataaaacgtggtgaacgcccatgattgcaactaggagactgttatgcttatggttgttaagattagaaagaaggaagctttaaccctatctctratttcttacttttctctgtctatgtagaagttgatgttgatacgtgtctacataaatatttactaagggcttgcattagtcttgggaccaaggatatagt

SEQ ID NO: 40696 - DNA, 201 bp, Homo sapiens
agaaggaagctttaaccctatctctgatttcttacttttctctgtctatgtagaagttgatgttgatacgtgtctacataaatatttactaagggcttgcmttagtcttgggaccaaggatatagtattaaacgaaacagaatccctgccctcataggcttaccttctaggtaggaaaaatagaccataatcaagtttaat

SEQ ID NO: 40697 - DNA, 201 bp, Homo sapiens
actgtaaatgcacgagtattgatcacaattattccgtaaacacatcttacaaattccctcagtgcacgcgccatctaaattaatccaaattcagaacaaasctctcttggaaaaggaaagagcatctctttcaggagcttccctcttggacattaaatcttccataatctgtgctagttcggcaaagaagccccaacgtcc

SEQ ID NO: 40698 - DNA, 201 bp, Homo sapiens
tcataaaatgaaactggcagtgagctcatatggaagaggcatcacgggcaactcggcttggctcaccagcccctgagctgcccccgagtgaccgctccagmcttctttccttccacctctccctcttggccaacttcatgcttcagccaaagtgaactgagctcaccaggctgagtcatctgtgccagctgtgccctctcc

SEQ ID NO: 40699 - DNA, 201 bp, Homo sapiens
cgcttaaaaatgtgtttttatagtgccattcctatataacatcgtctgataaatgtatttgagacgaacaggccaaatgaaagaaccttccataaggggaygcagcacagtttgaatataagtgttccctccaattcccatgttagtgctttactatgagtattgaccagtgttaaagagtgagcgcacaggagccttctc

SEQ ID NO: 40700 - DNA, 201 bp, Homo sapiens
gcactttgggaatacgaggtgggccaatcactgaggtcaggagttcgagaccagcctggccaacatggtgaaaccccgtctctactaaaaatacaaaagtkagtcggggttggtggtgtgctcctgtagttccagctacttgggaggctgaggcaggagaatcacttgaatccgggagccagcggttgcagtgagcttaga

SEQ ID NO: 40701 - DNA, 201 bp, Homo sapiens
cttggctgtgtactcctccttgttggccctgtctcccttgcccaggttgcagatgtcatggggcagcttgttcatctgagtgtccccagtgcttggcaccyagaagccataagatgagcccctgtgggatgagtaaatgaatcaccttgggagggtcagccgcaggcttctgtgggtgggtgggtggtgcactgggcccca

SEQ ID NO: 40702 - DNA, 201 bp, Homo sapiens
aataaaaaataaaataaaaaaataaaaataaaaataaataaaaagtagttgggcgtgtgttgtggagcatgtgggggtcccagctacttggcaggctgaascaggaggatcgcttgagctcaagaggttgaggctgctgtgagctatgatctcacctctgtactacagcctgggtgacagagtgagaccgtgtctttaagt

SEQ ID NO: 40703 - DNA, 201 bp, Homo sapiens
gcagagccagagagtggcattcattcagcttgtgaattctggaagaatttctggctctggagaattaaagggacatttccagcagcagagctccagtagcytttgcagggacggaggcaagctcctgagcgggcacttgctgttcctctcacctgtacatctgttggggaaaggctccttctcatccttcagagctgagct

SEQ ID NO: 40704 - DNA, 201 bp, Homo sapiens
atcagtgtggacaacatagggaggtcctgtctctacaaaaaataaaaaataaaataaaaaaataaaaataaaaataaataaaaagtagttgggcgtgtgtkgtggagcatgtgggggtcccagctacttggcaggctgaagcaggaggatcgcttgagctcaagaggttgaggctgctgtgagctatgatctcacctctgt

SEQ ID NO: 40705 - DNA, 201 bp, Homo sapiens
aatttttgctgcccctgctacatacatgctttattgcttggaaacaggattacttggtgaaataatgtgaatctttcaattctcatgatacatgttttcamcttaatatccagggtgcaggaatatatattcccaccaactttatacaagataatacaaatataatagtatgaataaatatgctaatttgatagaaaatat

SEQ ID NO: 40706 - DNA, 201 bp, Homo sapiens
aacatcagtctctattatcaacagtctctattatcaatcagtctctattatcatcagtctctattatcatgagtctctattaaacaacagtctctattatsacagtctctattatgtgttttggctgaaagaaagttctctaaaaccaggaaatcaggaatcagcagttttaagttctccaggttatattttaacattgtg

SEQ ID NO: 40707 - DNA, 201 bp, Homo sapiens
catagggtatttccagataatgtagttaacacctcgtgtaatattaggtgggcagggagctctgctctcaggaccaaaattgctcctgccagctctaatarggaatgtgtgtatttttaaagtctgggtaagcactgtgagtcatttccacaatacgcctccctttggcgtgaaatggggcagaaagtgccccaaacagct

SEQ ID NO: 40708 - DNA, 201 bp, Homo sapiens
ccaccaagcaaggcagactatttcgtgagaaagaaggaagatagactccatgcaacacagtgggtgtggcaccaagcgggaggtggagggttgctacctastcccggctccacctactgtcacctgcattcccctagacaaatcacagcacctcaggatccttgatctcatcatctgtaaaacagagatcagatgaaccct

SEQ ID NO: 40709 - DNA, 201 bp, Homo sapiens
aaccctcccttccccaggtcagcctgcctcccaggtgttggtgctatgattacagtgaccacataatttatcatccacactggcacctttttgagagaggwtggggagcaggtaattatgctgggacaataggcgtatgtcaagatatctggtcaccctatctatgatctgtcacacttagtactttctaaaattctcggg

SEQ ID NO: 40710 - DNA, 201 bp, Homo sapiens
tcctgggctctagcaatcctcccacctcggcctcccaaagtgttgggattacaggcgtgagctaccgtgcccggccttacgtttcagcatctttcaatccrtctaatacgcagtgccagggaaggtttgtgaaaacatttgaatcacagagtcacaaacagtgagaatagctgcagttatgtttgtgatgctctaatgaac

SEQ ID NO: 40711 - DNA, 201 bp, Homo sapiens
atatttgaatgaatgtgccaggacacccaattagaagaatgaatgcttttttagcattattttgtgtgcatacatatttatttagttatttgacctattayattctaaattgatattaataaagaggtatttgagttacagtttttccaaagttttaaatactctatagcaaaaaaaggaaaaatgaaagaaattaaaaag

SEQ ID NO: 40712 - DNA, 201 bp, Homo sapiens
ggtgtggaaatactctacctgggtgaggctctcgtggctttttgtgccaagtgtccgtaaacttcaacttaattgttttaaatcctttgtggtgattatgyggaaggtcaaatctaacaggaagctccatgtccacttgatgtgtacttacttctatttttgcaccttgtgttgtttgttatcctgaattatgccagggct

SEQ ID NO: 40713 - DNA, 201 bp, Homo sapiens
tacgtgggtttcaaaggtactcttttttcttttttgagacagggtctcgctgtgttgcccatgctggagtgcagtggtgcgatcacagctttctgcagcaytgaccttgtgggctcaagcaatcctcctgcctcagcctcccaagtagcttagaaccacaggcatataccaccatacctggacatgtttttaactttaatt

SEQ ID NO: 40714 - DNA, 201 bp, Homo sapiens
ttagtgctttatctccttgtgtgtgtgagtgtgtgaggggatcaattatatacataagacaaagaccacctaggaaatgtttgagaaactgtgcagtgagratgaatcaacaagtaaatatcatgagaatttcttagattgaagaaatattactcctatttggtgtcaactctgtgctggccttttcactcaagttctctg

SEQ ID NO: 40715 - DNA, 201 bp, Homo sapiens
gctctcacagttagaaaacagtgagccttggtcaagtctcataaactgtgtctcagttttttcatttatacaatggccaaaaaaaaaaaaaagaaagaaascacaaaaccataccttctttgcagggttgtgtaaaggaaggttgaactagaataggttgaagtcaatcacatctctaaggcatttggcatgtagtggaac

SEQ ID NO: 40716 - DNA, 201 bp, Homo sapiens
tgcctcatcagttagtggtgtgatgtgtttgcctgacaaataccatctaggaccctggctgcatgagcttgttgagacagctaaattttacaggtagttgrggtttcaccatttaacccagttaactcttctataagtgccgtattaaagcaggtggtgtattttgaaagacgtatgtaaaaacatttgtatttatttata

SEQ ID NO: 40717 - DNA, 201 bp, Homo sapiens
cactcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgt

SEQ ID NO: 40718 - DNA, 201 bp, Homo sapiens
cactgcagtcttgacctcccaggctcaagcaatcctctggcctcagcctcccaagtagctgggactattggcaatgccaccatgttcggctaatgtttttrattttttatagagacaaggtttccctatgttgcccaggctggtctggaactcctgtgctcaagccatcctcccacctcagtctcacaaagtgctgggatt

SEQ ID NO: 40719 - DNA, 201 bp, Homo sapiens
gtcgcattcacagatccctaccattcaactcactatggaagcaatgggatgggaggtaccattcaactcacagattcctaccattcaacccactataaagyagtggcatatgaaaaggatgggaggttgctatgggaatggtctgccccagatgcaggtaaaatggggaagcattttatatagaatggaaaaacaacagta

SEQ ID NO: 40720 - DNA, 201 bp, Homo sapiens
gcagtgagccaagatggtgccactgcactccagcctgggtgacaaaaaaaaaactttacctgggcttagtaagttgcctgacttctcatcctggagttcgkatccccttgtttctagaagagaaatccctcagatgtgaaggtgtgttccatgattttgtcgaacttgccctacatactgttttattatatattctgccca

SEQ ID NO: 40721 - DNA, 201 bp, Homo sapiens
gccctactgcactccagcctgagcgtgagactctgactcaaaaaaaaaaaaaaaaaaattagctgggcgtagtggcaggtgcctgtaatcacagctatccrgaggctgaggcaccagaactgcctgaacctgggaggcggaggttgcagtgagccaagatggtgccactgcactccagcctgggtgacaaaaaaaaaactt

SEQ ID NO: 40722 - DNA, 201 bp, Homo sapiens
gagataaaatgggtaattaacaaatgtaatccctcccacccaccccccacattatttatttatttatttatttatttatttatttatttatttttaccatrtctgttactccatcagtcaggatccagttaggagacagaaactatatcataattttaacagggaagatttaatattaagaattattagctacaacagggt

SEQ ID NO: 40723 - DNA, 201 bp, Homo sapiens
tccaatttttcaagctgctggccagcttgagcgtattcatatgttacctacgatgaatcacatcagtgtcggggccgggaaggtactgcaacatattggcrcctcacgggaggctctcaaaatgatccaaagttttttgttgcagcaaaagctcattcagaagtctttgggccatttggctcagcggaggctgtcatgtgc

SEQ ID NO: 40724 - DNA, 201 bp, Homo sapiens
aaacatgctgtattatagtggcaaagattagaatcagatacatcttatgaccttgggcaagtttcttaacttctttaaacctcagtttcttcatctgtaamatgcacatcataatatctctattcagagatacaggtggttctattaaacacatcaactctgtgtatataaagtcttaacccattgtggaataaattaagt

SEQ ID NO: 40725 - DNA, 201 bp, Homo sapiens
tggaggttgcagtgagccgagatcaggccactgcactccaatctgggtgacagagcaagactctgtctcaaaaataatagtaataataataataataatartaataataataataataataagaatctgactaaggttattaaccattaaggtatgctgtgctaaggagcagggggccccttccatccgtagagggcagaa

SEQ ID NO: 40726 - DNA, 201 bp, Homo sapiens
attaaaaagatacatgacgttgaaatcagtgacagaggcataaggctccttgagggaagaaaccaggtgttggccataaaaaaattatttttcacagcgcycagcaaagggcttgtatgcaaaggaccctcagtataagctggttgttgactgatgtgtttcaagagtaagtcagaaaaataaaaagaaggcagggaaaga

SEQ ID NO: 40727 - DNA, 201 bp, Homo sapiens
actaccttgggaaatgactctgtatcaagcgtttaccatctgctgaaagctttgcatactctgttgcttatcatgacaactgccctgaaagttgggtgtamttgttacccctttccagattaaaaaacctaggggtcagagaggttaagtaacttgctcaagacctcacagtgaactgtggtggaccactgggattagaac

SEQ ID NO: 40728 - DNA, 201 bp, Homo sapiens
tagtcattaaatatattcacaatgttgtgtaaccatcagcattacctatacctaaaatattttcatcacatcttttaaaaaataactgccccttcctcacwtccccaagcttgtggtctctggtaacccctactttactttctgcatctatgaaattgttttcaaggtcaatccatattgtagcatatatcaaaatttctt

SEQ ID NO: 40729 - DNA, 201 bp, Homo sapiens
cctcacacgtttgctaatgtaagaagtgctggctctgctcttagcctgcagtggtgcagcttaaaaattctgggagggtttcatgcagtaaatacttaaartaacagaaaaggactggggaaaagctgatgttgtagctgtatgatcacccatgtaaaactgtttatttagttatttatttatttatttgcttttttactt

SEQ ID NO: 40730 - DNA, 201 bp, Homo sapiens
ggaaggggcactcagctgttacctcctgtcataggaccattcctcactgtgccatcatattatacttccatatcgtgtgtcttgtggcattcctgggcctrcagtgagcctgtggccacctcatagtcttgttggccacagcctctagaaccagggattggaggaacagccatcgctagcatggtgcttggcactgagcgg

SEQ ID NO: 40731 - DNA, 201 bp, Homo sapiens
gacagatatgtcattgaagtttcatccttcttcatttcagagtctgctggaagacccttcatttaccactctctccttcctggaggtgtggaaatactctrcctgggtgaggctctcgtggctttttgtgccaagtgtccgtaaacttcaacttaattgttttaaatcctttgtggtgattatgcggaaggtcaaatctaa

SEQ ID NO: 40732 - DNA, 201 bp, Homo sapiens
ggatgccatgcttggtgagaaatgaattcgtaagtgtgcactgtctgccataaagagccaggcaaggcacagaaaatattcttctgtttctttttctattstaccctctctctgctttttcttctctcactgctgctgaagcagtgagagcctgttgagttaaaataagccagtgaggattttggtggtgtttgcccttga

SEQ ID NO: 40733 - DNA, 201 bp, Homo sapiens
gaattgggtaaggatccagctgattttctccagatgagtagttcattgtcccaacaccagttattgcaataagttattccttccccaggaaatatacctgrgctaattaagaaaactgtgcttcaatgtaattattccaccttaatgcatgaaatattaggttaacatggaaaaaacatggcatcccatgttttagtattt

SEQ ID NO: 40734 - DNA, 201 bp, Homo sapiens
tatgtatgtatatgtgcatacacatacattgttttgtatatatttgtcagatggaggtgtgtgtaaacaaataacagaaatgagttaaaattgacaagttrgcttggtaaacatcttgatttataatttattaaaaactacgtgggtatgtatatacatacagacacacacacttcttcaccacctgaacaaaaatccctt

SEQ ID NO: 40735 - DNA, 201 bp, Homo sapiens
cacagaagagagaattacttgtctaatatataatttcaggcataaggagaaggtgatattgcattgcaaataatagcagttagtgggagttgagagccagstctgcaccagactcgtatcagccacttgacctccattattccttattccttggtacctctgcgccatctgtgatatcagatccttttttctgcaaggaaa

SEQ ID NO: 40736 - DNA, 201 bp, Homo sapiens
acctgagtcttgacgaagaagactgaggaaaggcccccccccccccccaccaaattgtcccgttgtctcttggctggtcttgccagctggcacacagcttyctctgaccaccctgctaggtacaaatcccacatgaaaagtctcaatcacctggctcaaactcatagttttcaggtggcataagccatggcattttcacct

SEQ ID NO: 40737 - DNA, 201 bp, Homo sapiens
cagtgtgtaaaatcatggcggtgccaagagggggtgtgatgggtgtggccgcccccctgccagcaggaggaatctgttttcactgacattgtttggaatcrccaagcatggtgatgataaaaagcagttaaactttggtcacttttattaatacttttaagtccttagcgaacaatgcacccgttattacttgcacctagt

SEQ ID NO: 40738 - DNA, 201 bp, Homo sapiens
gaaagcagtagagggatggagaagaagtgggtcaaaacctggtttctgcctgtgggaaaatacaaaacaacacaacagcaaagcagactagcatggttcamagcacacattgaggtttttggtgtgccattctaatgcatgagctcattttgagccaaggatagctttttggtgtagaattttgccagtcctacggtcaat

SEQ ID NO: 40739 - DNA, 201 bp, Homo sapiens
gcccaggctgtaggagatgtcatcagggcctgcagagggcaaaacctcacagaggcttctgttcatacattgttgtacctcatgtgtgcgtcatattgtcrtatatcaatggcagtagccaagaccaacagccaagaccaatgtattctgcccacaggaaagtgaggcaaaggcagggagggaatgataattgtgaacaaa

SEQ ID NO: 40740 - DNA, 201 bp, Homo sapiens
tttttagtatatacggggtttcaccatgttggccaggctggtctcgaactcttgacctcaggtgatctgccctccttggcctcccaaagtgctgggattayaggcgtgagccactgcacctggccagtagtagacttttgatagggtttttttttctcaaggtgtaggtttggctaggaagtcatagaaaatgctcttttt

SEQ ID NO: 40741 - DNA, 201 bp, Homo sapiens
cattgccacagtcagttttcttacctgaaggagaaagcctgcaccccatattttttacctcccattctccacttcaactcttccccagcctctgcgaaccsctagtctgctcttcatctccatgcgtttgtatattctggacatttctcattaatgggctcacacgatatgtggttctttgtgagtggtcctttcactttg

SEQ ID NO: 40742 - DNA, 201 bp, Homo sapiens
tggaattaacatagatttcccacatggggaaggttttgggtgaggatttagaacaaggcaggttcttgatcctcggaagagattcttatctgaggggggawttgagaatggcattgcagagtgggaggcgctgctgtgtggaaaaatgaactggaataattattagaacagttctcagaatttacaggatatttgatcata

SEQ ID NO: 40743 - DNA, 201 bp, Homo sapiens
cgagactccatctcaaaaaaaaaaaaaaaaaaaaaaggctgtgtgtggtgactcgtgtctattgtcccagctacttgggaggctgagacatgaaaatcacwtgaacctgggaggtggaggttgcagtgagctgacatcgcatcactgcactccagcctgggtgacagagtgagactgaaaaacaaaaaaacaaaaaaaaac

SEQ ID NO: 40744 - DNA, 201 bp, Homo sapiens
gcatggaaaaggctttgcttttaaatgcccgtgttgatttcttaatattttcaacttcctcttctgaagccagttccccccgaccatcagtcatgagtccrttcttttaaccttgttcaggtggcgtggggcggtgtgtttggtggggagtgatgggtgcttgcctggaagtgcgagcaattgatcagctgatgaggggta

SEQ ID NO: 40745 - DNA, 201 bp, Homo sapiens
ggagaccaaggaaatgaccagcacgtggctcactccctgtctgtccagtagaggacaccaaggcacgatgaccgcagctcctgtagtagttatggtcactsactccgggttcagacggacttggggttcagtcctagctctggcgcttaccagttttctcaagtgactttgagcatctttactcaaggctcttggtctcag

SEQ ID NO: 40746 - DNA, 201 bp, Homo sapiens
cataggtaggaaaggtaaaaaaacataaatctgccaatagaaaatagcatcgtaatgagtttctactatatttgtttgggctttgaaaaatatgccgccamaatatatcaatgtatggtcccaacgttttaggaagttgcatttaaaaaatcttggatacctgttttgtacatattatatatagcatcccgtgtgaatatg

SEQ ID NO: 40747 - DNA, 201 bp, Homo sapiens
gcaggccatacaggaagcccagttagggaggcgtaaggaaacttaaaatcatggcagaagatgaaagggaaacaggcatgttctgcatggctggagtaggmggcaaggagcgaaggaggaggtactacccacttttaaacaaccagatctggtgagaactcactcactgtcatgagaacagcaagggggaaatcagccctc

SEQ ID NO: 40748 - DNA, 201 bp, Homo sapiens
tccacctgggcacccagcctggtgaacagggtgcaggctgggatttagccctaccttgcttttggaccattgagctactaagttggagcaacaaggcttgrgaatttttctttgatcataggtaggaaaggtaaaaaaacataaatctgccaatagaaaatagcatcgtaatgagtttctactatatttgtttgggctttg

SEQ ID NO: 40749 - DNA, 201 bp, Homo sapiens
tgccattgcactccagcctgggcaaaaagagcggggtaaaaaaacaacaaaaaaatgatgtaggaatgaacagatgaacaaccccacacaacctaaggacractttgaatcaattcttctaagctggtagcagaagccacctttccatttgacttgtatctcgctctttttttctttcttttttttttttttggagacaga

SEQ ID NO: 40750 - DNA, 201 bp, Homo sapiens
cttatggtcaccattctgtaatgattatcatttgtacatttaaaatagaaactgttaggccaatgtgttattctagaataggacttgacagactttttttwaaataaaatgccagatagtgtttctagctttgcagttcagatggtgtgtgttacaactgttcagctctaactttgtatgaaagtagccataggcaataca

SEQ ID NO: 40751 - DNA, 201 bp, Homo sapiens
agatgaggttcttgagtactttcaattaggtttaccactgaccccatcagtgtgcagacgaagggagatgagagatacagatggttaatgggatttttggrgtatcttccagcctttgtgagcacagaggtttcgctacattttgaaaattaaaattcatttcattcgcattacagattttaaatcctagctcctttttaa

SEQ ID NO: 40752 - DNA, 201 bp, Homo sapiens
gtgaacagattcttccaggtcttcattgtggcggaagaaagtgagatcagagatcccgaggaagggcttcagtttcaccagtagtggagctagggagtagsggggcagaagccgcaggaagtcagtgcaggacgccggaggccactcctaattgcttcatgtgttgttgccgtgctgatgaccttggaggcgctgctggtc

SEQ ID NO: 40753 - DNA, 201 bp, Homo sapiens
cagatgaggttcttgagtactttcaattaggtttaccactgaccccatcagtgtgcagacgaagggagatgagagatacagatggttaatgggatttttgkggtatcttccagcctttgtgagcacagaggtttcgctacattttgaaaattaaaattcatttcattcgcattacagattttaaatcctagctccttttta

SEQ ID NO: 40754 - DNA, 201 bp, Homo sapiens
tcctgctatgtccttacatgacagaggaagagatcatctttcttcagcctcttctgacaagtccaccagtctcattcatgagggttccactctcatgactkaagtacctcctaaaggctccccctcctaataatatcaccttggagattagggtttccaaatatgagtttggggggacacattgattccacaacactgacc

SEQ ID NO: 40755 - DNA, 201 bp, Homo sapiens
atcaaatggtagttctacttttagttcttcaagaactctccacactgttttccatagtggttgtactagtttacattcccaccagcagtgtagaagtgttscctgttcaccgcattcacgccaatatctattattttttgcatttttggtaatggccattcttgcaggagtaagatggtatcgcaaatgcaacaaaaacaa

SEQ ID NO: 40756 - DNA, 201 bp, Homo sapiens
gccgtgtctcttttctgtgattcgggagcacattgatacccttcttttggagcagagaagcttgtctttcatgatagaagtaggtcatgggggcggttagytgacttcatcagagagtagcatgcagatcccacctgtgaggctatggtctgccaaggagagttcagcgggctggatcagagagagcagagccatgctggc

SEQ ID NO: 40757 - DNA, 201 bp, Homo sapiens
gcatttgtacaggagaactacttaatggcacagtttgttattacatggaattaaatacaacctatttaaatcatgtaccgtgaaaccaaagagctgtgtayggaaaaagcctcatataacccagtttgccaggtcctaactcccttcatacatatactaacatgcaaaagacctcctaccttttttttccccttctgtttc

SEQ ID NO: 40758 - DNA, 201 bp, Homo sapiens
aggagagagttactattagctcccagtttataggtgagtgatatggtttggatgtgtccccacccaaatctcaacttgaattgtatctgccagaattcccrcatgttgtgggagggacccagggggaggtaattgaatcatggggcccagcctttcccatgctattctcataatagtgaataagtctcatgagatctgatg

SEQ ID NO: 40759 - DNA, 201 bp, Homo sapiens
tttgtgtcattttcaaacaaagcatcctcgctgcagtgttggattttgtaggatggtgaccgtttacagaaacctctggtccgtgagccaatttggagaawattgaatcattctctgtgcctttcggcttgcatcctaaaagcctgcacaaacactttgggcaggcttcagcaacttcacatcaagggctcaattgcagct

SEQ ID NO: 40760 - DNA, 201 bp, Homo sapiens
cttggggatgatgacagtatttggatcacaagattgttgtgaagatgaactgaagtgctaatgtgaaatgttcatgatggtacccgagtacttgcggtggyacctagcgtgtgctttccaagtgctggcaaagaaaagaaaagaattgcttggggctctgcctacctgtctaggctcctgtctggccattctctttcttgt

SEQ ID NO: 40761 - DNA, 201 bp, Homo sapiens
ttttagagatagtatatattttagatgtataagtggataaactggaggtatggaaggtctttatttaaggagaataaatagcccaccccatcaacatgatrgcccttggaaaggactcttttagcctccgcgagttccttttccgcaccaggctccacttacgaaggactgcaaaaacttgctaacgtcatcagtctgaaa

SEQ ID NO: 40762 - DNA, 201 bp, Homo sapiens
catccacggagcctcaaaggctaaaaataatcatccctttcaatagttcctgttgtgaggaccattaacaaattataagagaaagcattcctcacttgtakaaactccatgaaaacagacatgtgtttacttatctgcaaccctgtgttaggaggagggtgatgagacactttactgtttgaatcaggaagtgctgacagt

SEQ ID NO: 40763 - DNA, 201 bp, Homo sapiens
aattgcaggttaagccctcattttgatctctgggatgagagcaagcaccgtttcattgacatgtcatcagctatgatctgagggagcacacagaggtgccytttggggaaagaggggcatcttgcacttgtctcccacattgaaagggtttattgcacagtgagtgtgtgcaagtgaacaaatagcagatgggttagaatg

SEQ ID NO: 40764 - DNA, 201 bp, Homo sapiens
tgtgttggggggaggcatgtggtatgtggggcgggtaaaatacgagcctcatgcctgtctaagctggtgacttggcttggaaaagatgatcattcgtcaaygcatcacaagtcacagggcttatctccattgttctgaacgatctgtagctaaacaaaaagataaaagctattaatattattaatagttgtagattaccgg

SEQ ID NO: 40765 - DNA, 201 bp, Homo sapiens
ggaaaggattaagtgcagtgatcaatcagcagcaaagtcctggaagaaacccatttgttagtctctgggcctccccaggccttatcagggcttagccttckagcagtagcaacacttgcacctgcagttactaattcctgtggaatgaagtaggcgggcccgaaatgtacagcccttatccagtgaattctcataggagca

SEQ ID NO: 40766 - DNA, 201 bp, Homo sapiens
ccccattcatatttaaataaagaaaacggggcagtggggcttgttcctatgttgtggaacagcacacagatgtgatctacctcattcacatccttatgtgmattatacactggtgccctcacctcttaagacaagcacctatcgttttcctgtgtattccaagaggccagtgtggctggtggaataagatgttttcctgtt

SEQ ID NO: 40767 - DNA, 201 bp, Homo sapiens
tcttggaatcatgtctttatttttaaagtcatcttcactttgtttgtcttatgaatgaaagcatgagcaagtccattattattcacgcatttgtttgtagytcattgtcagtgtcatctgctttattagtcaggggtttgagaatgtttcttcctttaactcatttattaagaaaaataaaacgtggtgaacgcccatgat

SEQ ID NO: 40768 - DNA, 201 bp, Homo sapiens
ttgtttttctttcttttttttttttttttttgaggcaggccttaggtctggcacccaggctggagtgcagtgacgtgatcaaggctcactgcagcttccamctcctgggctcaagcaatcttcgtgtttcagcctcctgagtagctggaattacgggctcatgccaccacacttggctacttgtttaattttttgcagaca

SEQ ID NO: 40769 - DNA, 201 bp, Homo sapiens
tactgctattgttagtttctaaaggcacttgtcatggtgtgactaatattagaagcagacacagccatgatgagcaatactctttttttgtttatttttgwtgttactgctgtaagccactttcttctccctctccgttaaaatgcaacttaattggtaaagtttagttgactagagatttcatttatttatttatttatt

SEQ ID NO: 40770 - DNA, 201 bp, Homo sapiens
agtagatattggaaatatgaacccaatatgttcttaacatctccatgtcgtaattctaatttaaaatcaaaatctcatcaaattacattttagattaaagsattgtacctatcgaaagaagagaatcgaaaatgcgaaagtccttcattttcagtgtggcctgagattgttgaaggatttgttctattgcatgctgataaa

SEQ ID NO: 40771 - DNA, 201 bp, Homo sapiens
aaactgtgtgattctgtctgcagttgagaactgtaagaaaaagatcaagattaacattattattattggtgttacctcatgtctgtacctttttggacacktgggtctgtttcccgagaaatcatttttcctcctccttgaaaatagtgaatttcaagtggttttaattttaactgcattatttgtttgctttatatagtt

SEQ ID NO: 40772 - DNA, 201 bp, Homo sapiens
ttcaacacagttctcttgtctctgttcatgatataacagtaaatccaagttgctttaagtagatattggaaatatgaacccaatatgttcttaacatctcyatgtcgtaattctaatttaaaatcaaaatctcatcaaattacattttagattaaaggattgtacctatcgaaagaagagaatcgaaaatgcgaaagtcct

SEQ ID NO: 40773 - DNA, 201 bp, Homo sapiens
ttttccaatgagagtactgatgacataaaaggttatacattgaataaccacccaaattagcagtgtttcatatttacactgttcaacacagttctcttgtstctgttcatgatataacagtaaatccaagttgctttaagtagatattggaaatatgaacccaatatgttcttaacatctccatgtcgtaattctaattta

SEQ ID NO: 40774 - DNA, 201 bp, Homo sapiens
cggaggttacagtgaaccgagatcgtgtcactgcactccagcctaggcgacagagcgagaccctgtctcagaaacagaaaataaaacaaacaaaaaaatastattccatagctgactattttctgaaatgattttgttacttttctaatgagaaaaaaatagatctcgtgtgtggagggaattgaagatgtaatttcagac

SEQ ID NO: 40775 - DNA, 201 bp, Homo sapiens
aaaagaaatctgttagaaatgcatattttctgttttcaccccagaaatcctgaataagaaacactaaaggggagtgggcccagctatttgtgtttttggargaactcctgttttaatttgttttttcggaagtcctccagtttgagaaccaatgataaggacatttttccgggaatccagttgttttaggaaaggcccagt

SEQ ID NO: 40776 - DNA, 201 bp, Homo sapiens
tttaatcacataattacttaaatggcctggcgagccgccttacctagctggccaggaattccaggagtcaggcttcctgatctaaatctgtcctggtcccrtcttggctgggtgccaccagcagcaacggcacactccagcttaaatatcagtggggataattctaggccgtttgtctgcctggttcttccaggatagagg

SEQ ID NO: 40777 - DNA, 201 bp, Homo sapiens
agatcttgcttttcagtctactggtatctccacttctctctgcagcgtgatgtctagtcagagtttccattctgtttttatgaccctgggaggactgggasagatctgtgaggtcatcttgtccaccctcagccagggcaggagtattccctaatggtagagtcaagtgtttggtttggtcttgtttctaatgactcaagt

SEQ ID NO: 40778 - DNA, 201 bp, Homo sapiens
agccaagagaaagacagttcaccaaatctatcgattaatagaaatcatccagcagcagtgccactgtaagatgttcaatacgtagcacctttctgtccctyctcctctagccagttgggacaggattagcaagccaaagactttctgaaataatccttagctatattcttggtattcaccaaggaatttaccaatatgcaa

SEQ ID NO: 40779 - DNA, 201 bp, Homo sapiens
taaattactttgcaccttttccatttcatagaacttgaatgtttgtgttcaaagcttaaaacccaagacagtgagctattaagcctccatggccacgtcawttttctgattgcatctgatgtaacaagtgctagaaaaactgatgctgttcattgctttaaaacgtctttctttattttcttggtattattaggtttacat

SEQ ID NO: 40780 - DNA, 201 bp, Homo sapiens
aatactctggagtggaatgggcagggtggtccgtatagggctatgtataactttttaagaggttggcaaatacttccctaaagtggtcatcccattttacrttcttgccaacagtgtttaaggatccacttcctctacatccttaataatacttgatattatcggtcttctaaattttctgtttgggtacatagtggtatt

SEQ ID NO: 40781 - DNA, 201 bp, Homo sapiens
gtaaggtttagtcaagaagttggaaattaatggggaaggaaggttttgggttatgtgtggatttcatttatccatgctatctcttccctccattagcatgkttaattaagagttgtcaatacatctttgttggagtatttgattattttttcaacagggaagattagaatgaagtcttcagatctggcaagtgtcatggga

SEQ ID NO: 40782 - DNA, 201 bp, Homo sapiens
ttgaccgataagtgtaccagatttccttacctgtcccagggcaagatagcaagagtttcttgatgcatttaaaaaatgcatttagtgttggcaaaaggctkgcaatttattattaagtggaataagcagtttaaaaacagtatgtacagggtggttttctggctatataaacacacaggcatagaaaatagatatacataa

SEQ ID NO: 40783 - DNA, 201 bp, Homo sapiens
agctgccgttgagtgtgtgcatgtacaactgcttgaaaacagcttgtgagttcactattaggtccatgaaatttttctccttggcaggttttcactattartttgcttgacaaaggatagatacattttccatgtgtggaggtaaaagcagtgcagtgagctaaaaagttagcaaaggtgaagtggtcctaatctgcggcc

SEQ ID NO: 40784 - DNA, 201 bp, Homo sapiens
cctgggaaatatagcaagatcccaaccctattaaaaaattaaaaatgaaaataaaattttaaagaaaggtatttctccccttcacggtaatttggagccartacttcttgcaccattcatttgtccacagcatgggacaaaggataatgccttaatgcctgctgcaaatagaacagtggtgcttagcagctttagataatg

SEQ ID NO: 40785 - DNA, 201 bp, Homo sapiens
cagattttaatatctttcctcccacacttgctttgactccctcctttagtaattagataattatgtataataagcacattaattatgtgcaacagctgccrttgagtgtgtgcatgtacaactgcttgaaaacagcttgtgagttcactattaggtccatgaaatttttctccttggcaggttttcactattaatttgctt

SEQ ID NO: 40786 - DNA, 201 bp, Homo sapiens
atacttgaaggtagccagtggacacgtggggccatttcaagctaaattaaattttaaataaaattaaagattcaatctctcactcacacattacaagtgckaaacatccggacacatctagtggctcccactgtgggtagcacatacagaaagaacgtttccgtgacagtagagtgtcccattgcacagtttgggtatgga

SEQ ID NO: 40787 - DNA, 201 bp, Homo sapiens
cttgatgtcggagtgttctctagacctcacacccagtccctattcttaggttttatttctcaaaccaggttttgcctgagaaattacagcaaatgattcakagcacaatgatgttgctcatttttgataagtagttgaaagctgatggtgccctccatttcaaagcaacagaagaaacgctggtggtcatggagaaagagt

SEQ ID NO: 40788 - DNA, 201 bp, Homo sapiens
ctgttcttgtactcctgggctcaactgatcttcccagcttggcctcccaaagtgctgggaatacaggtgtgagccactgtcccaggccagttttaactcasaatgatttcataagaaatccacatctgagagtcccagaaggtaagatattcccctttcttctaaatatacttgaccaccaccattcaggttcttctatta

SEQ ID NO: 40789 - DNA, 201 bp, Homo sapiens
ttagccaggtgtggtggcatgcatctgcagtcctggctactcagaaggctgaggtgggaggattgcgtgagcccaggagttcaagaccagcctgaacgacrtaaaaagacctatctctacaaaaattagctgggcatggtgtcacgtgcctgtagtcctagctactcgggaggctgaggtgggaggatcgcttgagccccg

SEQ ID NO: 40790 - DNA, 201 bp, Homo sapiens
atcgagaggtaaagcactgtgcagaaatattggccagaagctatgaacagttgccacagctgggctgaagagttacctgtgagccttccaggggtgtaagycaagagaaagacagttcaccaaatctatcgattaatagaaatcatccagcagcagtgccactgtaagatgttcaatacgtagcacctttctgtcccttct

SEQ ID NO: 40791 - DNA, 201 bp, Homo sapiens
taatgaaaagtgagtgaatgggctgggtgtggtgggtcacacctgtaatcctggctactcaggaggctgagacaggaggatcgcttgagcccaggaggtcraggctgcagtagggtatgagcgggccactgcacttcagcctgggcaacagagcgagaccttctgtctaaaaatatttatctatattgagtgaataaatga

SEQ ID NO: 40792 - DNA, 201 bp, Homo sapiens
tttctcatgcttccatttccatattctcaatcaatcactgatggccagctgtcaacaggcatcatttttggtgggacctgaagatgtatatcccttgtttkcagattcctcgcctctcatcatgtaaggtgatgctctgagctgggtcttaaagcttctgggcacagccccccttgagtcttcattatggcaaatctagtg

SEQ ID NO: 40793 - DNA, 201 bp, Homo sapiens
cacaggtcaaacatcctgagcctgttctgtggtcagttactcattagcagcctctgctctaggaggaatagttatgggtcctttcagacatgcaacccccmaaactccatgttgtttacagtgtgggacacctgactttcaccttttatgatacctgcctggggcatgcatgtggtgactttttccatctctggtctctat

SEQ ID NO: 40794 - DNA, 201 bp, Homo sapiens
ggtcaggcagctgtttgacaggattcttgcaaatgtttttggtttctctgtctactcattacgtacactctgccagaggttgaaaactcaatgttgagatyacatacatcctgaaaacactgtttaaataaaattttggcctgcatcctgtttttgaaaacttgcaatggcttgccaacgttttcaagttgagaagtttca

SEQ ID NO: 40795 - DNA, 201 bp, Homo sapiens
ttaaaaaaaataaattaaatttttaaaaacatgactttctggccaggcgcagtggctcatgcctataaccctgcacttagagagggcaagacagaaggatygcttgaggccaggagtttgagaccagcctgggcaacatagcgagaccttgtctgtactaaaaaattattaaaagaaaatatatatatttttttaaatcat

SEQ ID NO: 40796 - DNA, 201 bp, Homo sapiens
aagcaattgtggtttttgccattaaaagtaatagtaataataatactcggttggtgcaaaagtaaatgtgttttttgctattaaaagtaatgcggttttasttctgcagtttttttgccatttgccaattacttttgcagtttttgccagtacttaaaagtaatggcaaaaactgcaaaagtaattggcaaatggcaattg

SEQ ID NO: 40797 - DNA, 201 bp, Homo sapiens
tcggtagatttgtttatgattttaatggctgcatagtattctatcatatggatatattctaaatgtaataattcctcaatggtatatttagtttactttawatttgctgctttagtttgtcacaaacactgtggatagccttgtatatatttattttgttgtatagttcttattggtacagtatgatttttcacaagtata

SEQ ID NO: 40798 - DNA, 201 bp, Homo sapiens
ctgtaaacaaaaacaacacagccatctagctgcaagacgtagctaattgctctgcagaacagggttggccagcctggccttgatgtcggagtgttctctaracctcacacccagtccctattcttaggttttatttctcaaaccaggttttgcctgagaaattacagcaaatgattcagagcacaatgatgttgctcattt

SEQ ID NO: 40799 - DNA, 201 bp, Homo sapiens
tatatgtgtatacatacatagaagtatatatataaataccagtactagtgtctgctaataggtggcgccactttttatctgtgtgtgttgggggtggaatkagcatgtagaggttggcaaaggggacaggagactgtgggatgattagtatattcttatttggcctgggagggaaaaaaaatctttcatttccaacaatat

SEQ ID NO: 40800 - DNA, 201 bp, Homo sapiens
gcggaggttgcagtgagctgagatcgtgccactgccctccagtctgggtgacagagtgaaacccatcccccaaaaaaataaataaataaaaattaaaaaayctaacactggtacgagaagaaattatgctctaaatccttctttgagcagtggcttacagacctaaatttatcaaaggtggtggcagtaatagtaataatt

SEQ ID NO: 40801 - DNA, 201 bp, Homo sapiens
ataaattaattttttagcattaatattagggaagataatctgacatttaaaaatacatgtctatatgtgtatacatacatagaagtatatatataaatacmagtactagtgtctgctaataggtggcgccactttttatctgtgtgtgttgggggtggaattagcatgtagaggttggcaaaggggacaggagactgtggg

SEQ ID NO: 40802 - DNA, 201 bp, Homo sapiens
gtgaggtgagatcagtagaagagtacaataaaacaggaattttcagagcatgtaatttcttcttggaagtgaaaggcactggagaatggtgcagaataagyactagccttagagagaggatgccctgccccagtctctttctctgagtagcagagagctggctgtgctaggaaactcttcgcctctctaacaccacgttta

SEQ ID NO: 40803 - DNA, 201 bp, Homo sapiens
ttctatggattttcactaaaatagaatcatcgccttggtgatggatagaaaaagtaaagcaatacatcctgataaatgctgtgccttcctccttcgtctcyctggcggtgaccttgtgcaatccataagagggcaaggctgagagccccggccaccgccgccgtgtgtcagaacttggaaatttaagtagctttgaaaccc

SEQ ID NO: 40804 - DNA, 201 bp, Homo sapiens
aacagagcctgcaagcatttctcctgcagaacccccagaagggactcagcctgcagacactcagatttcaaacctctggcttcctgaactgtgaaagaatraattgctgttgggccaggtacagtggctcatgcctgtaatcccagcactttgggaggctgaggcaggtggatcacttcaacccaggagttcgagaccagc

SEQ ID NO: 40805 - DNA, 201 bp, Homo sapiens
gaagctttacccctgagaagagcaggcatcagatgggctttggaatctacatgggtgtttgtaggtagaccatcctggaagttgagtgatggggaataaarggaagaaagtgcattctgaacagagggaatagcaggtacagcagctcagacatgggcaccttcagagcgtgtctgagtcttcctgatgagacacgtggtg

SEQ ID NO: 40806 - DNA, 201 bp, Homo sapiens
gacagcagggggtgaggataagaaggaggaagctttacccctgagaagagcaggcatcagatgggctttggaatctacatgggtgtttgtaggtagaccaycctggaagttgagtgatggggaataaagggaagaaagtgcattctgaacagagggaatagcaggtacagcagctcagacatgggcaccttcagagcgtgt

SEQ ID NO: 40807 - DNA, 201 bp, Homo sapiens
ttaagattaaattattgatactgaaatattaggttgtgcaaaagcaattgtggtttttgccattaaaagtaatagtaataataatactcggttggtgcaawagtaaatgtgttttttgctattaaaagtaatgcggttttacttctgcagtttttttgccatttgccaattacttttgcagtttttgccagtacttaaaag

SEQ ID NO: 40808 - DNA, 201 bp, Homo sapiens
gcatttggctgcacagcaagttctaagttactcaccaggtttcagaggagagatgggaatttgatgatcttataagaaacctgtactctttggccagacayggtggctcatgcctgtcattccagcactttgggagaccaaggcgggcagatcacctgaggtcatgagttcgagaccagcctgggcaacatgctgaaaccc

SEQ ID NO: 40809 - DNA, 201 bp, Homo sapiens
agcctcccaaagtgctgggattacaggcgtgagccaccgtgcccagccttcttgttttaatcttttagacaactggacacaggtttgtctttgaaattgtmctggtttttcttgatgttttagtgctcctggatgtccaatgtcattcttgggctagttgaaggaaagttttggctacccagttgttagctgctgaagttt

SEQ ID NO: 40810 - DNA, 201 bp, Homo sapiens
cagagtcttgctctgttgtctaggctggagtgcagtggcaccatctcggctcaccacgagctctgcgtcgtgggttcatgccattctcctgcctcagcctscggagtagctgggactacaggcactcaccaccatgcctggctaattttttgtattttttagtaaagatggggtttcaccatgttagccaggatggtctcg

SEQ ID NO: 40811 - DNA, 201 bp, Homo sapiens
atttccattttacttctatttggtagtctcagaacttggcttttattggccagtatattcaatgattcacttgcacctttaaccttgtgttgttctaatcyttttttttttttttttttttttttttttttttttgagacagagtcttgctctgttgtctaggctggagtgcagtggcaccatctcggctcaccacgagct

SEQ ID NO: 40812 - DNA, 201 bp, Homo sapiens
atccaactcaaaggctgttgaaaggctccttctgtttaaggtaaagcctgtggcagcctttaacttcctttctcttctcctgctgccaccttggtccacartttatctttgaaaatgctgggttttaatgggcagggtatagtgcagaaaccagatggttttaactcacacctgtgaaaatgctggggatctgcgaaacat

SEQ ID NO: 40813 - DNA, 201 bp, Homo sapiens
gtcactacgtattgcgtatatttggttggaattttatttttgagcaattcatttacccagattgtgtttctggagattaaagcatctcactgtatttttakttttttctacattgcaatttcaaaataatccaactcaaaggctgttgaaaggctccttctgtttaaggtaaagcctgtggcagcctttaacttcctttct

SEQ ID NO: 40814 - DNA, 201 bp, Homo sapiens
tatggatttcttcctcagtttatttcttctttgattttttcatgtccaggtcactacgtattgcgtatatttggttggaattttatttttgagcaattcayttacccagattgtgtttctggagattaaagcatctcactgtatttttatttttttctacattgcaatttcaaaataatccaactcaaaggctgttgaaag

SEQ ID NO: 40815 - DNA, 201 bp, Homo sapiens
agaagtttctgtatcaactggaaaaaaccatggtgcttgggacattcaaggccgaaacttggtccctggatgggagaagatagctgtatcattggcagagstgccttggtcatgtaccctctccagactagacactagatagtgggtagggtgggacagttttatgtcctctgccaccttatctgggactcttgtcccctg

SEQ ID NO: 40816 - DNA, 201 bp, Homo sapiens
aagtaacagaaccataggccttatctttatctgagttcctgtagcatgtgcactactcctgattaaccaagtgaaagagaaaatgagactaatctctaacstcagcttccttttctgccaaatggaagatcatctctaattaataatgagttagaatacctaggacagtatttggcacacagttgatgaggatggtgtacc

SEQ ID NO: 40817 - DNA, 201 bp, Homo sapiens
cttacatttaaatacaggcctttcccatttcacagtgtttctagctcccctttccaatacatctctctctctctttctctctctctctctctctctctcamacacacacacacacacacacacacacagccaaatcagacaccaacataaactgtagagttaacattctttttccaccctcacactttttttagctccgat

SEQ ID NO: 40818 - DNA, 201 bp, Homo sapiens
gcacatatgtgtgtgtgcaaattgtacttgcagtggctgcctgggaaatgaaatttctgcaccttgccagagcatgttttccctctaaagagaggcagctsataattagtaatgctaatgtcggggtgagatgcaatagataatctaacaccagcaatgatgcccagagcatttatctttgatgctgggaatgcgttcatt

SEQ ID NO: 40819 - DNA, 201 bp, Homo sapiens
ccgattctcttccacgtgtggacagattggcacatatgtgtgtgtgcaaattgtacttgcagtggctgcctgggaaatgaaatttctgcaccttgccagarcatgttttccctctaaagagaggcagctgataattagtaatgctaatgtcggggtgagatgcaatagataatctaacaccagcaatgatgcccagagcat

SEQ ID NO: 40820 - DNA, 201 bp, Homo sapiens
ctcctgctgtgatgccacttctaatctcaattttattatacaatttgttaaatacagaagtaaatggaggcaatagtgatagtaaaaagaaccatgtgaaytgggcgtggtggctcatgtctgtaaagccagcacttcgggagtccaaggtaggagggtcacttgagcccagcaattggagaccagcctgggcaacatcat

SEQ ID NO: 40821 - DNA, 201 bp, Homo sapiens
ctcctatcccctttcagctcctgctgtgatgccacttctaatctcaattttattatacaatttgttaaatacagaagtaaatggaggcaatagtgatagtraaaagaaccatgtgaactgggcgtggtggctcatgtctgtaaagccagcacttcgggagtccaaggtaggagggtcacttgagcccagcaattggagacc

SEQ ID NO: 40822 - DNA, 201 bp, Homo sapiens
ataaagttattaaaaaattaatgttcccttcccatgatttttctgcagaatttatgcatccatgatactgcagaagttcataaataatggcttgtattgcygctttagtattgctttatgcctacgaaatataatgttaatttgtagcaatgctaatgtgttttcaggaaggctctttgtttattgcctttattttcccca

SEQ ID NO: 40823 - DNA, 201 bp, Homo sapiens
cttgaacctgggagtcggaggttgcagtaagctgagatcgccactgcactccagcctgggcaacagagcaagacgccatctcaaaaaaaaaaaaaaaaaaagtgtaatgcaagtagaaaagggcacacactccaggtgtatatctcaacaaatttgtacacactgcatgcacatgggtgacccgcacccacatgttataca

SEQ ID NO: 40824 - DNA, 201 bp, Homo sapiens
agatggcattttcctggttgcccctccactgagagttggctgaaacaaagaatttgtcctgtatggaaaacaggagactttgtacagtggcctctctaaakgtgcaagatattcaaaagagaaacccgcatacatttggatattaagaaataattctggggattcttccactcctgaaatgagttgatttgcagataattc

SEQ ID NO: 40825 - DNA, 201 bp, Homo sapiens
cttccacatacaaagtctgggacacagtacgctctcataagagacctcttctcaacaggatccatgtttgatccgggggaataaagctagagttgctttcwtccttgtaatatgtataatgactcatgagagaattccccactgtcttccccacctgagacctgagaggaggagaaggaagcttggagtcgctgccctgtg

SEQ ID NO: 40826 - DNA, 201 bp, Homo sapiens
gcttccacatacaaagtctgggacacagtacgctctcataagagacctcttctcaacaggatccatgtttgatccgggggaataaagctagagttgctttmttccttgtaatatgtataatgactcatgagagaattccccactgtcttccccacctgagacctgagaggaggagaaggaagcttggagtcgctgccctgt

SEQ ID NO: 40827 - DNA, 201 bp, Homo sapiens
gagcttgttttattttgcttgggctgctgtagaaataccacaggtcaggtggcttaaacaacaggaatgtagttcctcacagttctggaggttgggagtcmtagatcaaggtgtcagcagggttggtttctctctgtaccattgtccctggcttggagatgaccatcttctctgtcttcacatggtcttccctctgtgtgc

SEQ ID NO: 40828 - DNA, 201 bp, Homo sapiens
aaatgccatggactgaataatatataaacaacggaaatgtatttctcacaattccggaggctgagaagtccaagaggaaggcactggcagattcagtgtcyggtgaggatttgtttttgatctcataggtgtccatcttgctattttctcaactagcagaggcaactctctggggtatcttttaaaagggcactaatggcc

SEQ ID NO: 40829 - DNA, 201 bp, Homo sapiens
gaagaaatgctgttttaggaaatcaataggataatttttttttttttttgaggcggagtctcactctgttgcccaggctggagtgcagtggcacagtctcsgctcactgtaagctccgcctcccgagttcacgccattctcctgcctcagcctcccgagtagttgggactacaggcgcccgccaccacactcagctaattt

SEQ ID NO: 40830 - DNA, 201 bp, Homo sapiens
ataaataaatacataataaataaacagtagtggttgaaagaaagggaaggaagaaatgctgttttaggaaatcaataggataatttttttttttttttgargcggagtctcactctgttgcccaggctggagtgcagtggcacagtctcggctcactgtaagctccgcctcccgagttcacgccattctcctgcctcagcc

SEQ ID NO: 40831 - DNA, 201 bp, Homo sapiens
ttctctcattccattggctgaagcaaatcatgtatacaagccagaagccaatgagctataggaagggtagcaaagaacagaacagccatacagcctagccsacagatggggtcaagaagattcaataggcattggctgaagacttaagacttctcaagcaagttggatcctggtgtgcacctggcatatcctttaggattc

SEQ ID NO: 40832 - DNA, 201 bp, Homo sapiens
ttcagtgacatgccatcagatttgttccatgtagaaggacgacactatcagttagatgcttattttgttggcaaatttctatggcacttctgcttggctayttcaaaccaaccatggaagaatagataccccaatgcgatgtttcatccctattcataaagaaactgtactttgagcaatgtaggtatcccaggcagcatc

SEQ ID NO: 40833 - DNA, 201 bp, Homo sapiens
atttcagtgacatgccatcagatttgttccatgtagaaggacgacactatcagttagatgcttattttgttggcaaatttctatggcacttctgcttggcyatttcaaaccaaccatggaagaatagataccccaatgcgatgtttcatccctattcataaagaaactgtactttgagcaatgtaggtatcccaggcagca

SEQ ID NO: 40834 - DNA, 201 bp, Homo sapiens
taaaaatgtaaaatgtttcaaataaacacacactaaatatcttcttttatatcttataaacacccagcagtcctttagcacgggcatcaaggtggcccagytggaaaatttcagtgacatgccatcagatttgttccatgtagaaggacgacactatcagttagatgcttattttgttggcaaatttctatggcacttctg

SEQ ID NO: 40835 - DNA, 201 bp, Homo sapiens
tgaggattaattgaaataactcgcaaaaatatccagctctctgtttccctgctaggggctcttgtcataggagccattgttgtagccttagaaaacatacrgcattattttagggggagaggttagagtagaattttaaagagtgcatttctcttccagtaagcaattctgcatcgataaaaagtggagaaagaataagtg

SEQ ID NO: 40836 - DNA, 201 bp, Homo sapiens
agatagatgaagggttaggaagatgtaacttgtcctaaatcacgtgtcttctaagcggtggaactgattttctcactgactatagatgttgagcccattamtgtgatacctactgccttttaattttaaaagttctcattgttttatcgttttcatcattatcatatgatttacctcttctcttgtgtcttataatccgat

SEQ ID NO: 40837 - DNA, 201 bp, Homo sapiens
gtcttttttttttttttttttttcctccttttttgagagagagagtctcactctgtcacccagactggattgcagtggcacaatctcaactgactgcaacstgcacctctcaggttcaagcaattatcaggcctcaacgtcctgagaagctgggactacaggcatgtaccaccacactcagctaatatttgtatttttagt

SEQ ID NO: 40838 - DNA, 201 bp, Homo sapiens
tgtaatcccagccacttttgaggctgaggcaggagaatcactggaactgggaggcggaggttgcagtgagctgagatcgtgccattgcactctggcctggrcaacgagcaaaactccacctcaaaaaaaaaaaaagagagagagagaataaggtcagagggggaaaagagagaaagtgaaagcaacagtaaggaagagaat

SEQ ID NO: 40839 - DNA, 201 bp, Homo sapiens
cgtggcctgttataaattgggtggcatggcagggagtgagtggtgggcaagcataggaagctgcgtctgtgcttagagccgctctctgtcactctcattastgcctcaggtcctccccctgtcagatcagcaacagcattagtctcataggaccgtgatccctattgtgagccacacatgcaagggatctaggctgcatgc

SEQ ID NO: 40840 - DNA, 201 bp, Homo sapiens
accagcagtaaaaggtagccctgccaagaccattaagcttcctgcaactccttctggatcccacaatttgaaggggaaatctttcccaccgcacatcactrtttggtggactaaatggctccccgatgtcccgaaagagcacagcttctggaagtgtggtatgtggtccctgagatgaagcagcagccacaggaacccatc

SEQ ID NO: 40841 - DNA, 201 bp, Homo sapiens
gtgatggcttcttctgttctctttatttccttaactgaacatctgtctaattgttcacctccatcgctttagtgctttcctcatgctttctctctttccasacaataaactttattttcttcataagaattcagtctacgcaagggtattaggcagcttgtttgcaccttttaattgctggatgttttccagaaaggctgt

SEQ ID NO: 40842 - DNA, 201 bp, Homo sapiens
atcatgggggtgggtctttcccatgctgttgttatgatagtgaataagtcccatgagatctgatggttttataaagggcagttcccctgcacaaactctcytgcctgctgccatttaagacatgtgtttgctccacattggccttctgccgtgattgtgagactttcccagccatgtggaactgtgagtccgttaaacctc

SEQ ID NO: 40843 - DNA, 201 bp, Homo sapiens
aatgtcttacatttatagagtgttcaaaaggtgccagatattgtgctaagtgctttgcgggcattatgttattcacacttcacagatattctctttctacmtgtaaggaaaaaaaggcataaatactttatataatttactcaggattttaagtagagggtagattttaagtccaggcagtccaaccccctgaaagctgac

SEQ ID NO: 40844 - DNA, 201 bp, Homo sapiens
tgtgtcaattaataatctgactaaggtggccgggtgtggtggctcacacctgtaatcccagcactttgggaggccaaggcgggcggattgcctgagctcaraagctggcgaccagcctgggcaatacggtgaaaccccgtctctactgaaaatacaaaaattagctgggtgtggcggcatgcgcctttagtcccagctact

SEQ ID NO: 40845 - DNA, 201 bp, Homo sapiens
acgcaattagataatacaaaaataacaaaactataggaggttgaggatggggctgggggccaaggagattacttggtttgaaatgaataaattgtctatcstaagggaattctttggtgcattttattgtgtgaaatgagcctggtcatatgactgccctgcctccctggaggcctccctgccctcctccttcccacagac

SEQ ID NO: 40846 - DNA, 201 bp, Homo sapiens
tccttctcatatgtttaggcaagcgttgatgacatcaacctagccttttattttaaatcccctgtcaacgcaattagataatacaaaaataacaaaactayaggaggttgaggatggggctgggggccaaggagattacttggtttgaaatgaataaattgtctatcgtaagggaattctttggtgcattttattgtgtga

SEQ ID NO: 40847 - DNA, 201 bp, Homo sapiens
tgggggaaaaaaccaatagaataatgttttattacatgtaaaaattgtatgaaattcaaatttcagtgttcataactaaattttaaaaacttttattgaarttccagagagatctgaagtagttttattggaacacagccctacacaccttcatttataagctatctgtggctacttttgcactatgccagcaaagttgag

SEQ ID NO: 40848 - DNA, 201 bp, Homo sapiens
ttgtatttacaaatgtggcattaagtagaacaacgtattcttgcaattaatgacaggaagcctacaatttctcattaagcacaggacagtgagaacgaacrgaatttcagagacatgtttcttaacattaaaaacaacaaaaacaacaacaacaacaaaaaaccaagtaggaagcaggcagagttgcaatatgaagaacaa

SEQ ID NO: 40849 - DNA, 201 bp, Homo sapiens
gtagttttattggaacacagccctacacaccttcatttataagctatctgtggctacttttgcactatgccagcaaagttgagtagttgggatggagactrtatggcccataaagcctaaaatactctctgctcctttccagaaagcttggcaacccctactatcatctccacgtctgcctttgttcttcttatttgtccc

SEQ ID NO: 40850 - DNA, 201 bp, Homo sapiens
tttaaagcgatagtcctattttctaagtaaaagtccaggcatgtgacttaaaaaagaaaaaaaaaaatgttttctggtcaagtcacatgcctctgaggttkttttttttctttctttcttttctttttttttctttttcccagactcctcatacccctcctaggagacagtgattccctggcttcaccaggcaggctcttg

SEQ ID NO: 40851 - DNA, 201 bp, Homo sapiens
taggtagaaatttttatgtcacaggtgggcctaattaaccttgattaatgttctgcaaacccggatagactggagactcagaaagggacgcaaaagctagyctggttcccatgttagtccctgctctgtgagcagctgccacacagtcatgctgatggctcctgcagcagccattctggtttgactgtgctcgtgctgccc

SEQ ID NO: 40852 - DNA, 201 bp, Homo sapiens
tgagagtgcctgaaacccagagaggtcgtacgttgaccatgccacggggcccttcctggtaaatctaagcagaaatacaccatgcatgagacagaacaaaraaaagaactgtgaaaatacactcaggaccaggatgctgatacagtcatgaggttcagcttaaaaggccagtttctctactgcagaataatgaggtctatc

SEQ ID NO: 40853 - DNA, 201 bp, Homo sapiens
tgtggagtatgcatttaattcacatttacaaattggtttctgtttttaactaaaggtactttttcagcagaaatgatgtgtatgatgtcatatctaacttktgatctcactggtatttgatgttaagcctcaaaatcatcaaattttttttacggcactgaaaaaaatacataaatctgcttgattggttcatagaaaaag

SEQ ID NO: 40854 - DNA, 201 bp, Homo sapiens
cagctggcgtaagaggagtgactcatttgttcttctttttttttttttttttggctgtctacagagaaggaggatataggggcccttaagagaaaaactgkagtagggtgtgtgtgtgtttgttttggtcaagggcagagtgtgctgtgtcagggtgtttcattgcattttcatatttgtcatttctctttggagcgtgtc

SEQ ID NO: 40855 - DNA, 201 bp, Homo sapiens
ttgaagacacaaattcagatgcatgtggatgggcccaaaatactttgtttacatgtactccaaatgtaactcctggggcacccttccttattttctctacsacaccaatgccttcatggtcttacatcttgtcctcttaaccctgacttctctagccctcatgaatgctttagtgtggcagatgttactgtacatgggccc

SEQ ID NO: 40856 - DNA, 201 bp, Homo sapiens
tttctaaaactttaagtttcagggtacatgtgtaagatgtgcaagtttgttacataggtaatcatctgccacggtggtttgctgcagagatcaacttatcrcctggatatgaagcccagcgtccattagctgttgttgctgatgctcttcccaccacctgcaagccccagtgtgtgttatccgcctccaccgtgtgtccat

SEQ ID NO: 40857 - DNA, 201 bp, Homo sapiens
aacccttctactacaagacatagaagaaaattagttggccatggtggcacacacctatagtcccagctactaaggaggctgaggcggtaggatcgcttgakcccgggaggtggaggctgcagtgagctgtgatcacgccactgaattctagcctgggtgaccgagaccttgtctaaaaaataaataaataaataaaattag

SEQ ID NO: 40858 - DNA, 201 bp, Homo sapiens
cttgaggccaggagttcgagaccagcctggccaacatggtgaaaccccatctcacctaaaaataaaaaattagctgggcgtggtggcagccacctgtagtmccagctactcaggagactgaggcaggagaatcgcttgaacccaggaggaggaggttgcagtgaactaagattgtgccactgcactccaacctgggcaaca

SEQ ID NO: 40859 - DNA, 201 bp, Homo sapiens
cggattacttgaggccaggagttcgagaccagcctggccaacatggtgaaaccccatctcacctaaaaataaaaaattagctgggcgtggtggcagccacytgtagtcccagctactcaggagactgaggcaggagaatcgcttgaacccaggaggaggaggttgcagtgaactaagattgtgccactgcactccaacctg

SEQ ID NO: 40860 - DNA, 201 bp, Homo sapiens
atggacataaagcctggggtggtgatggtgctgcctctgtaaccaggctcagctgtgtgtcttcgtgagcctccttgtggaccctcaaatgtgggaaggakataggggcaggaggaattggggaaataggaaccttagaaaccctgaagaagtggaaagagaaaaggaaggtcagtcattcattcaattgcttaatttgct

SEQ ID NO: 40861 - DNA, 201 bp, Homo sapiens
ttgaccaggcttgggtgctctcctgcagggcattgcaatctttaggacaccttcattacccctcctaaaaggagattttataatgagcgccaaccagctcwaacaagttaggatctcctaacatgtctggtgaaaatacaggagtatttttcatcatctctggaaaagttgctatcatgtccttcaataacccagtctaac

SEQ ID NO: 40862 - DNA, 201 bp, Homo sapiens
acttgtctaagaatcctcatcttaaccctgtgctagaacaacaagcttggaaggagccagccaacaggagaaagccagagcaagactctgtgctggacaaraagtcctgagcactggggagttgacttcatattggaggcagagaagaattacctgccgatggctgttggcccatggcaacaccctagatcgttgcatttg

SEQ ID NO: 40863 - DNA, 201 bp, Homo sapiens
gggaaaatggaggagaatgatgacgaaggaggaggaggaggaaaaggtgacttgcctctagctgatgtggattatttctcttttttaatttccatgtctgygtagcttcatcatagatctcagcttaaggacaatgaaagtcgtttattgagtacttagtatgtgctggttgcagagccaagtcttttttttttttttttt

SEQ ID NO: 40864 - DNA, 201 bp, Homo sapiens
acagacagtgtaatttccctggaaactcaattttgattcagacgtccacagcatctcatttctgcctttaaaaaatttcaagagtggcattttggcatgaytggactcacaggtggagaaggtatgacaaacattctggaaatcttggaaggtgaaatatagggaagatggcccctatggaggttcattgtcccccacctt

SEQ ID NO: 40865 - DNA, 201 bp, Homo sapiens
cgtcctcgccctcagcatacttgctcattgtttgtttccatctctatcatctctgtgagccctttgaggatggatgtgtgtccatcttgttaacagttggmtccccagtaaccagtacagtgccagatacagagtagtaaccctacattctagcgtaggcaaatattctagtatttgccaaaactagaggatgaatgagtg

SEQ ID NO: 40866 - DNA, 201 bp, Homo sapiens
tgtggaaaagggacatggcccagggaaccagagtggtttgggaaagcactttgtcaagaggcttggggaccccagggtggaagctgccatgcgcatgaggytgtgttagcagaggcagtggcagaagaagacattgcaaacctgcaaaagcaacctctgaggatgggtagacatatacttcattgcaggcagctgctgctg

SEQ ID NO: 40867 - DNA, 201 bp, Homo sapiens
catcttacaaatgaatcaatatttagtggtttgaaaatatgttgtttaatttggggcgattcaatatcaaattaagatttttaggtttatttatcgatctytagaattacatcaacattaagctaattactttaaattgtgtttttaagtaaccaagaatacatctgtggacgctgttctgtgccatcttgagtcacgttt

SEQ ID NO: 40868 - DNA, 201 bp, Homo sapiens
taaaacgtggatgttccaatttatgtatagccgcataatacattaccccaaaacttagaggcttaaaacaacaaccattttgttttatcttgtgatttctstaagttagggctcagtggagtgactcttctgccccttgtggtgttgactggggtcagtcagtggtgctatgctggaggatgaattggactggcacttcag

SEQ ID NO: 40869 - DNA, 201 bp, Homo sapiens
tggatgttccaatttatgtatagccgcataatacattaccccaaaacttagaggcttaaaacaacaaccattttgttttatcttgtgatttctctaagttrgggctcagtggagtgactcttctgccccttgtggtgttgactggggtcagtcagtggtgctatgctggaggatgaattggactggcacttcagctggtcc

SEQ ID NO: 40870 - DNA, 201 bp, Homo sapiens
atgaattggactggcacttcagctggtccaggatggtcacccatgggtctggcactttcacgaggatgactgggatgcttggctcagctgagggactcttrcccagagccctacacatggcctttcctgcatggcagatatagggccatcagatttcttacatggtggctcagggctcccagaggattccaaaagaaagta

SEQ ID NO: 40871 - DNA, 201 bp, Homo sapiens
gtgtagctccaattgccttcatccttagaagacctttaatgatatcctatgccaaacttcctagcctccacctgtaccctgaattggccctagcctagttktccaaactttatccccaggtggttgaactttctaagtttccccaagctgatcagtgttttggggtggtatggaactcagaatagatcactttttttattg

SEQ ID NO: 40872 - DNA, 201 bp, Homo sapiens
tcaggtggtgactggaggagccagaaggtccctttgggcctgtcctctcaccagcatcaactgcaccaaaaagatctcattctgattatcagggatgaacscccccactgggtgatcaggcaaactacatgcattttaaaaaactatatcctgctgggtgcagtgcctcatgcctgcaatcccagcattttgggaggttga

SEQ ID NO: 40873 - DNA, 201 bp, Homo sapiens
gcactttttctgtttttgatgggatttatcacttgaaaatgcatattatagtaatttctgaattcatcctgattctcctactggtttctaaactcttcagkttagaattcctgttggatatccctctggcccgaaattcctgaatgagttaagcaggacacctagaactatgcagaggtaataccttccttgacctgtccc

SEQ ID NO: 40874 - DNA, 201 bp, Homo sapiens
taactgcaatcagatgttttatttgtttatttatttttccttcttgcgttgctcttaagcccccactcttgggcaaggctctgtgctatgctgttttatgsacatcatcttctaacagcttctctgccacacctggagaagtgccaatatcattttcatggcacagataaggcattggatgctcatagtttaagtcatcag

SEQ ID NO: 40875 - DNA, 201 bp, Homo sapiens
tgatgggatttatcacttgaaaatgcatattatagtaatttctgaattcatcctgattctcctactggtttctaaactcttcaggttagaattcctgttgratatccctctggcccgaaattcctgaatgagttaagcaggacacctagaactatgcagaggtaataccttccttgacctgtcccttttctgggtcagttt

SEQ ID NO: 40876 - DNA, 201 bp, Homo sapiens
tttatatttttagtggagacggggtttcactatattggccaggctgatctcgaactcctgcccttgtgatccacccacctcggcctctcaaagtgctgggmttacaggtgctagccaccacacccggcctcttctcgatagatcttatttggctgacaacgaaagctgttgtgctggtagcatcatccctttgcatgcaaa

SEQ ID NO: 40877 - DNA, 201 bp, Homo sapiens
caaagaggatttgagattgtttatgtaggggcccgtgtataatacctcaagagaaaaagacacagatgaggctattgggattaagggaaaatcaagtaaaycgagaggtaaagcactgtgcagaaatattggccagaagctatgaacagttgccacagctgggctgaagagttacctgtgagccttccaggggtgtaagcc

SEQ ID NO: 40878 - DNA, 201 bp, Homo sapiens
cttgaaaatgcatattatagtaatttctgaattcatcctgattctcctactggtttctaaactcttcaggttagaattcctgttggatatccctctggccygaaattcctgaatgagttaagcaggacacctagaactatgcagaggtaataccttccttgacctgtcccttttctgggtcagtttgcccttcatgatttc

SEQ ID NO: 40879 - DNA, 201 bp, Homo sapiens
ggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagt

SEQ ID NO: 40880 - DNA, 201 bp, Homo sapiens
agacatagaaattcttgggctttattccacacataatgaatcagaagcttatggggtggggcctgcagtctgacgtttattttttctaaaactttaagttycagggtacatgtgtaagatgtgcaagtttgttacataggtaatcatctgccacggtggtttgctgcagagatcaacttatcacctggatatgaagcccag

SEQ ID NO: 40881 - DNA, 201 bp, Homo sapiens
tctggctctgcagctgaaattgggatcgcatggagaaaatagaaagtccagtgtttgtagctgtgatctctcagttgcttgcatgaattgtgctttaagaytgtaaaattttagcccattaaaaataaaatctgttgctttccacccacacctggcaatttggtgagggacgggggctaggatatttaatgtctgaaagtt

SEQ ID NO: 40882 - DNA, 201 bp, Homo sapiens
tggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatag

SEQ ID NO: 40883 - DNA, 201 bp, Homo sapiens
aagctccgattttcttgttgaatagccgtgtttcctcagcattctgtagatttttggccaggtttgtgtaagggatgaacgactctctataaaatgatgtmaggatcctttctttcctgcccattgccatttctagcattctctccttgagggaagttgcagttttctccctctgtgtattcatccttctgacctgtgctc

SEQ ID NO: 40884 - DNA, 201 bp, Homo sapiens
atggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaata

SEQ ID NO: 40885 - DNA, 201 bp, Homo sapiens
agagtggaatattcataatcagcagaagtcttttctctggaaggaacaaaggattaagttagggagacagtaatggtattgttagcaggctatttcaatgrttttctctgcggaagagtagggaaaggtgacattccaactgggaatattcgactctgcagatccctactcggagtttttcagccctgttttaagtgccga

SEQ ID NO: 40886 - DNA, 201 bp, Homo sapiens
ctcgttcagtttccacataatacctggggcagggatgtaaataccctgattttatgtgtcaggccttcaggactcagggtgtataagtgacatggctcctsgcacagcagggatggagaggcaaacccaggttggcctctctgccactcatatagaactcctttatcaccaagattcctttcttcttcagtgccacctgcc

SEQ ID NO: 40887 - DNA, 201 bp, Homo sapiens
ctggtatctccacttctctctgcagcgtgatgtctagtcagagtttccattctgtttttatgaccctgggaggactgggacagatctgtgaggtcatcttrtccaccctcagccagggcaggagtattccctaatggtagagtcaagtgtttggtttggtcttgtttctaatgactcaagtgatgaggcctggggacgtcc

SEQ ID NO: 40888 - DNA, 201 bp, Homo sapiens
cactgtgcaggtgactcacgcctagaatcctctgcctatcgtgacagggagaagcctgtgtgaccctgtggccatctcagtctctgcagggcatctgtagytttggaggtacctgggcaagagactgcctttcctactagagcttctgccatccctctgtcactatttaaagcattgcctgcaccctcaacctcgttcagt

SEQ ID NO: 40889 - DNA, 201 bp, Homo sapiens
atccactggcatgagtcatctttcccattggtagattgcagagcaaacttctggacagatttgcccttggctcatgtatgattggacctgcggtctgtccmggtgtactcagagtggggaaggggagcggtggcaggtaatacaaaacccacctaagtagaaggacctatgaaccatgagggttttccttagcagggagtg

SEQ ID NO: 40890 - DNA, 201 bp, Homo sapiens
agcacaggaaagacttgccctcatgattcagttacgttccaccggggccctcccacaacacatgggaattgtgggagcgacagttcaagatgagatttggrtagggacacagccaaaccatatcacagggtcacctgtaggttaccgtaaataagagaaacagaccaagtagagactcagcatagctggagggggggcccc

SEQ ID NO: 40891 - DNA, 201 bp, Homo sapiens
actttgaacactttaaatgggtgaattgtatggtatatgaatcatatctcaacaaagctgttaaaaaattgtatgaaaactgtgatgggattcaagtagtstaacgctcaaatttcccaagtgccctcatttaagtctggaccacgacaggaacccagatgtggcctgagtagcacatcgtggaatgggcctgtcacctct

SEQ ID NO: 40892 - DNA, 201 bp, Homo sapiens
tgaacactttaaatgggtgaattgtatggtatatgaatcatatctcaacaaagctgttaaaaaattgtatgaaaactgtgatgggattcaagtagtctaaygctcaaatttcccaagtgccctcatttaagtctggaccacgacaggaacccagatgtggcctgagtagcacatcgtggaatgggcctgtcacctctaccc

SEQ ID NO: 40893 - DNA, 201 bp, Homo sapiens
cggtgttggctctcagttagagactcagatttatccctgcccgaatcattttctttgattctctgcccttccccactacagtgtaaactccatttggactytctctagttcactgtgaatggtttttgaataacatcaattagcataacctcatgcccagcatcgtccttattgttgagagcacagcagtgacaaaggtgc

SEQ ID NO: 40894 - DNA, 201 bp, Homo sapiens
caaaagggagtatgttggttcatgtaccaggaagtcttggagtgatggcttcaggcacggctggatccaggggctcaaaaatataatcagatgatttgttygcttctgtcttttgctatggtggtctctgttttgcttacttctgcagcagattttctctacctggtgggagaaacagctgccagaaaatccagattccca

SEQ ID NO: 40895 - DNA, 201 bp, Homo sapiens
agatctcactcactgtggtgaagacagcgccaagccatgagggctccgccccagtgattcaaatacctcccattacggacatgtttcaacatgagatttgrgcggggacaaatatccaaactatatcaggatcccagcagactgggtgggtggaggttcagggatatctgggaaggactaagaatagctttttcttttagt

SEQ ID NO: 40896 - DNA, 201 bp, Homo sapiens
tctcactcactgtggtgaagacagcgccaagccatgagggctccgccccagtgattcaaatacctcccattacggacatgtttcaacatgagatttgagcrgggacaaatatccaaactatatcaggatcccagcagactgggtgggtggaggttcagggatatctgggaaggactaagaatagctttttcttttagtaga

SEQ ID NO: 40897 - DNA, 201 bp, Homo sapiens
tagggttcctttttttcaagttaaagcattgagtcatgtctctgataaatcgcccccccaccccgatccccaccctctgccgccccggccttctttttgtrctgttgggttccaaactttacctgaggattttcacatgcacatctgttaaatgccatttaaagagaacactaacaagagaaagctagttcatttttcttc

SEQ ID NO: 40898 - DNA, 201 bp, Homo sapiens
tgcaagagtcagcaaagtttctctgtgatgggatatttaataaatattttggggccttgtagtgtttgttgccaactactcaactctgccctcatagtgcraaaacaggcataaacgatatgtaaaggagcaggcatggctgcgagaaactttatttatggatactggaatttgaatttcatatacattttcatgtgtcac

SEQ ID NO: 40899 - DNA, 201 bp, Homo sapiens
tttgtgctgttgggttccaaactttacctgaggattttcacatgcacatctgttaaatgccatttaaagagaacactaacaagagaaagctagttcatttytcttcctgggacctcagtttcctcatcagcagaatcgggatattagtgcagaccttgcaggctctttatgaggatccatcgggagcctcaggcgcacact

SEQ ID NO: 40900 - DNA, 201 bp, Homo sapiens
ttctctgtgatgggatatttaataaatattttggggccttgtagtgtttgttgccaactactcaactctgccctcatagtgcaaaaacaggcataaacgayatgtaaaggagcaggcatggctgcgagaaactttatttatggatactggaatttgaatttcatatacattttcatgtgtcacaaaatattattctttccc

SEQ ID NO: 40901 - DNA, 201 bp, Homo sapiens
tgtttgtaacattgaatacttaagacatctgctcagagtctcgcattataaatgaatggaaaggatccaggagggctttattggatgggagccgtgaagtsagcgccgtgtatttcaaagcaggatcttaatcagacattatttatatctataatattttacaaattaaaagcagtagaaatagtcactggaaggaagtca

SEQ ID NO: 40902 - DNA, 201 bp, Homo sapiens
acagccgtgtttggcccagcggttatagtttgccaacccctgcttagagtctagctttattcagagcttaaatatgtcatcgaggtcccctctttatttawtcccttagttttgatgatcttttatgggttatattcttcaaagggaaaattctctccgaatggggctgccactggcagacgagcactgtcccatcttggc

SEQ ID NO: 40903 - DNA, 201 bp, Homo sapiens
aacattgaatacttaagacatctgctcagagtctcgcattataaatgaatggaaaggatccaggagggctttattggatgggagccgtgaagtgagcgccrtgtatttcaaagcaggatcttaatcagacattatttatatctataatattttacaaattaaaagcagtagaaatagtcactggaaggaagtcagcaagca

SEQ ID NO: 40904 - DNA, 201 bp, Homo sapiens
cagacattgaactgaatctccaccttgggcttgagactctgcaaagtgcattaaatgggaaggaaaccaaagggcctgctgccctgcccccgccatagccyaaggctgtggccatggctggggaattggcctgtcagttcaatcaggcagcccctctgactggtgtttttcactaagctggccccatggatggccctggtc

SEQ ID NO: 40905 - DNA, 201 bp, Homo sapiens
attcagagcttaaatatgtcatcgaggtcccctctttatttattcccttagttttgatgatcttttatgggttatattcttcaaagggaaaattctctccraatggggctgccactggcagacgagcactgtcccatcttggcttgttcccccagtgacaagaagctgttttccccactacccttggcccaaaagccacag

SEQ ID NO: 40906 - DNA, 201 bp, Homo sapiens
catgtcaggaaggtgtccgatcagaacctgaatgccagctcaagctgctctcagctaaactccaggggttgctgatggagacttcatcccctcctccagtyccgggatcaagacagaaatgtaaatcacctccaagaatgggtctgcgtcttgcacattttccttttgagaaagaggaaaattctcagctggtctagcttt

SEQ ID NO: 40907 - DNA, 201 bp, Homo sapiens
tcgaggtcccctctttatttattcccttagttttgatgatcttttatgggttatattcttcaaagggaaaattctctccgaatggggctgccactggcagrcgagcactgtcccatcttggcttgttcccccagtgacaagaagctgttttccccactacccttggcccaaaagccacagggagaaccaggattggcctag

SEQ ID NO: 40908 - DNA, 201 bp, Homo sapiens
cactgttctaaacacatgacaccaatagctcactcagattcccgcctctcaacagggaaactgaagcacaggaagtttcagtgatgcacttaggcaaccaktaagtggcagggtcggcattgaggtcaagactggttggacccctaagtttgaacaatcaaactggactttggggctcacagtttgtttcatgtcaggaag

SEQ ID NO: 40909 - DNA, 201 bp, Homo sapiens
tttaggcagacacctatccctgaatcagtcatgtccccggatgatgcggttctctgcagcctgggcagtcaaggctggagataattctctgcttctccacrgagtctgagaggccccgttccctaatggaaaaatgaggtccaattttgcaaaaggaggcacctggggaaacattctggacacacaaatctatagcttcta

SEQ ID NO: 40910 - DNA, 201 bp, Homo sapiens
gccagtgactacagtgtgcctggaaaggtcactggaggcatttttgtctggggcagcccctggagtcttggcttttgtgcttggtgagaccttatctggcytcttcattgtccccttcatacaaatagatagcttttagtgagcagctactctgcctggcactgttctaaacacatgacaccaatagctcactcagattcc

SEQ ID NO: 40911 - DNA, 201 bp, Homo sapiens
catgtccccggatgatgcggttctctgcagcctgggcagtcaaggctggagataattctctgcttctccacagagtctgagaggccccgttccctaatggwaaaatgaggtccaattttgcaaaaggaggcacctggggaaacattctggacacacaaatctatagcttctaccgtcaatctgctatgatccttttatggt

SEQ ID NO: 40912 - DNA, 201 bp, Homo sapiens
gcaaacgttttgaaaagaaatctcctttcaaaaatcacagcactggttgaagcaggagcatctctccccttaaatgcaaaaggagttaatatgccagtgaytacagtgtgcctggaaaggtcactggaggcatttttgtctggggcagcccctggagtcttggcttttgtgcttggtgagaccttatctggcctcttcatt

SEQ ID NO: 40913 - DNA, 201 bp, Homo sapiens
aattttgcaaaaggaggcacctggggaaacattctggacacacaaatctatagcttctaccgtcaatctgctatgatccttttatggttctgacgttgcarttttatttttgcatgtttctagagacatcaggaggggatcttttcgggatgtggcttcagaaaggagcctgttggatggtctcttactagtggtcagcaa

SEQ ID NO: 40914 - DNA, 201 bp, Homo sapiens
agttgggggagagattttgaccaggcaggctctcaggtcggtgccatcggtgacgccaacacacctcctggcttggtgtgttttgtggcatttggcaggcmaacgttttgaaaagaaatctcctttcaaaaatcacagcactggttgaagcaggagcatctctccccttaaatgcaaaaggagttaatatgccagtgacta

SEQ ID NO: 40915 - DNA, 201 bp, Homo sapiens
gaggtggaggctgcagtgagctgtgattgtgccactgcactttagcctgggtgacaaagtgagactctgtctcaaaaaaaaaaaaaaaaaaaaaaaaaaaagctagtagcacaccccaaaacttctagacagggcatggtgtgagctggagtagacaactagttcatggtaacaggaccagcagagctccgtcttgatgct

SEQ ID NO: 40916 - DNA, 201 bp, Homo sapiens
aaacccctaaattgtggtgcctcagtgatcttctataacataagttgatagtcaataattgcttaatgggaatcataaatatgagtttatttatatgtgtrtatatatatatatataaaatatatttccatgaatatactgaatgctaagccctccccactttttttttcttttttaaattcagaaatttctagttgtgtt

SEQ ID NO: 40917 - DNA, 201 bp, Homo sapiens
tctgtatttctcagggcagcgtgggacctcagggtttgtcatggaccacacctttctcctttgtccctttttataactcataggctacctccaacttgacrcttatttaagtttttatttattttatttagcattcagaaaactctatagcctcagtctctcgggatgtaaattaaagcaatttcattttcatagtttctc

SEQ ID NO: 40918 - DNA, 201 bp, Homo sapiens
ctcatagttttcaggtggcataagccatggcattttcacctcctttcctggttgtttccagaaagggatgatagccccagtgcagtggctctgtatttctyagggcagcgtgggacctcagggtttgtcatggaccacacctttctcctttgtccctttttataactcataggctacctccaacttgacacttatttaagt

SEQ ID NO: 40919 - DNA, 201 bp, Homo sapiens
tgccttcactgcacattccgggatcgccatgttctagaacattcatgtctgccttttagccagcagaatgctattctcacatccacaatgggacagctaayagcccccatttatcaaatccctgtcatatgctgtgtcaggcactttatatccctcatccaggaggatgcaaaaacctggtgtttttcttttttttttttt

SEQ ID NO: 40920 - DNA, 201 bp, Homo sapiens
gtgtgtgttgggggtggaattagcatgtagaggttggcaaaggggacaggagactgtgggatgattagtatattcttatttggcctgggagggaaaaaaartctttcatttccaacaatattcattctctgtgtcacctcagcatttaatttacttccgtcacaaaactacttgaagttgtcccaggctagttggtcctat

SEQ ID NO: 40921 - DNA, 201 bp, Homo sapiens
gtcaggccattggtataccattgtttttcttaaacatttatttattttcttatatttacagcatatgtggtcatttaaaattattttatagcatataaaastaaaaagaatataaattaattttttagcattaatattagggaagataatctgacatttaaaaatacatgtctatatgtgtatacatacatagaagtatat

SEQ ID NO: 40922 - DNA, 201 bp, Homo sapiens
ctgggcttagtaagttgcctgacttctcatcctggagttcggatccccttgtttctagaagagaaatccctcagatgtgaaggtgtgttccatgattttgycgaacttgccctacatactgttttattatatattctgcccacttctattccctgccaattaattaattgtttcattggtatagttttttttttttttttt

SEQ ID NO: 40923 - DNA, 201 bp, Homo sapiens
taatcagacattatttatatctataatattttacaaattaaaagcagtagaaatagtcactggaaggaagtcagcaagcaggggtgaaaaaaaaaaaaaakaaaagaacctgaagccgccaagagaggctcactgaccatctctgggggaggaagggtgaagagtagcaaatttaccgtcatcagcaggtgtgtaaatgtt

SEQ ID NO: 40924 - DNA, 201 bp, Homo sapiens
aaaaaaaataaaagaacctgaagccgccaagagaggctcactgaccatctctgggggaggaagggtgaagagtagcaaatttaccgtcatcagcaggtgtstaaatgttccatttacattgaatggcacatgtcataaagtacataccgctgcacatcccaccctctgtttctgtttcaactgcagagcctatttttcttt

SEQ ID NO: 40925 - DNA, 201 bp, Homo sapiens
cctgaagccgccaagagaggctcactgaccatctctgggggaggaagggtgaagagtagcaaatttaccgtcatcagcaggtgtgtaaatgttccatttamattgaatggcacatgtcataaagtacataccgctgcacatcccaccctctgtttctgtttcaactgcagagcctatttttctttcccttccagctcagct

SEQ ID NO: 40926 - DNA, 201 bp, Homo sapiens
ataaagtacataccgctgcacatcccaccctctgtttctgtttcaactgcagagcctatttttctttcccttccagctcagctgccttctcctccctgacytcaggtcacccaagactcccactttatgatttccttttacttttagttcattattctctgtgattcagtggaaacataaaaaatggtttttaattttaat

SEQ ID NO: 40927 - DNA, 201 bp, Homo sapiens
cgtctccccgccttgtaagggctgcctgtcattttattagcgctggagcctcccgaccgaagggctgagtaattgacaaaaactgcaggtaaggcaagagrcccgtaattgattcataagatcccttcctccgatcgcattgaagagttaattatttttcctgcagttgggactcagctgttgtttccactgggattaaac

SEQ ID NO: 40928 - DNA, 201 bp, Homo sapiens
agaccctgtctctgaaaaataaaaataaaaaaaaaaattaagttagaagggagggattacgaccctcatgtgtatcaagaaacaagctccatgaagccccrtaggatggctcagcaccagaacgaggtctgactgttaagcaaagtcaagtgcatgatggctgaacattgctgggggaagattttgcaattatgcattgtt

SEQ ID NO: 40929 - DNA, 201 bp, Homo sapiens
ctccccgccttgtaagggctgcctgtcattttattagcgctggagcctcccgaccgaagggctgagtaattgacaaaaactgcaggtaaggcaagagaccygtaattgattcataagatcccttcctccgatcgcattgaagagttaattatttttcctgcagttgggactcagctgttgtttccactgggattaaacagc

SEQ ID NO: 40930 - DNA, 201 bp, Homo sapiens
gcacacacacacttttaagcatttttgatttatatatccctctgcatattttgtgccttgtgatgtgtttaacgaatgacagtgtctttagtgcattgctrcttggggtttctacactggaagtgtaatccgaggccttggaattggtcaaacaaaactcacttggcaacatttacttagagagcactctgcgagcactct

SEQ ID NO: 40931 - DNA, 201 bp, Homo sapiens
ttgtttgctttgctttgccttgtctggtttttcaaagtgctcttttaacaaatgaaagtttaaagcttgagttcaatttgagtaatttgttcccagagaaraagtaaatgaaaagtatttctgggtatttttaatgacacaagtttctgtgctgatatgcgggcaggggttcgggagtgggggcaccagggctcatgagcc

SEQ ID NO: 40932 - DNA, 201 bp, Homo sapiens
cacacataattcaaaggtaatgtaacttgccgtgtcggactttagtccattccgttaaatggagaaaaatgactgacgtgaagaatgacttattgattctyggtgggaaaatgacttctgtaatatgggaagtatggtaaaaggaatagcttaattatttagggagcacttttcaaaatgtgcttttacagcagtacaaat

SEQ ID NO: 40933 - DNA, 201 bp, Homo sapiens
tcaatttgagtaatttgttcccagagaaaaagtaaatgaaaagtatttctgggtatttttaatgacacaagtttctgtgctgatatgcgggcaggggttcrggagtgggggcaccagggctcatgagccgagagcccctgcttcccttggaaaacggaaatttctatctccaactagggaaaaatttgcatgtgtagaatt

SEQ ID NO: 40934 - DNA, 201 bp, Homo sapiens
tttacattatacttaggctggtgttaggatgccgtggctgccaagtttacacaatgcactttctctctctctttcttcttttggtttatgatgtttttcartagtgtcatggaactcacttaatctgatttcatcaagtaaatatatgggaagttgagatgacatatttttatctgacatttgaagaaatattcataaaat

SEQ ID NO: 40935 - DNA, 201 bp, Homo sapiens
aaatcccacatgaaaagtctcaatcacctggctcaaactcatagttttcaggtggcataagccatggcattttcacctcctttcctggttgtttccagaargggatgatagccccagtgcagtggctctgtatttctcagggcagcgtgggacctcagggtttgtcatggaccacacctttctcctttgtccctttttata

SEQ ID NO: 40936 - DNA, 201 bp, Homo sapiens
tctcaccagactgatggtgccatgagggcaggggcaactcctatcctaaggcgtggcccatagtaaggggtattggttagaagaatgaaagattgaatacrtcaaagtgatgagtacagagctgtctgtcattttcttatctttggcctaacaactgaacacattttatgaaatttgcaaatctgtttccaaacatgtttg

SEQ ID NO: 40937 - DNA, 201 bp, Homo sapiens
ttcaggattgatcacaaaatcaaaaccattcctaccagccagaggtgggcacatgacccaggtcagaccagtcacagttcctgattcccggccacagtgcwtgatgggggaatgagcatatatcaaaccaggacagtccaagtccttccggggactttgctgccacagttgacagggggaggtatttgcataacttcacca

SEQ ID NO: 40938 - DNA, 201 bp, Homo sapiens
tgctaaataaggcaggaaattccattaagtttaaatgtgctgcccttaccctaaagtgtttggagggcttcgtagaagagccaaatagattcacacagatyttatttgtagagctgaatgtgcacttcattaaaatactttgtaaggtattcaaggatgggctaggagggtgaggattccaaatcagaatcttcaagccag

SEQ ID NO: 40939 - DNA, 201 bp, Homo sapiens
caaatgaatgaatgtatgagtgggtcaagaacaagattcggccccaaggagatacgcgactttctactttgttttctatttggatttcacacaaaggctckaaggtctcctggtaggccatgctcagaagtctgggttgtcccctgcccaggacaggctcaccctggcctgtgtcctaggtattgtggggccgctgtagga

SEQ ID NO: 40940 - DNA, 201 bp, Homo sapiens
gacctcccaggctcaacctatcctcttacctcagcctcttgagtggctggaaccacaagcagatgccaccatgcctggctaactttttttttttttttttktttttgtagaaacagagtctctctatgttgcccaggcttgtcttgtactgggctcaagcaatcctcccatcttggcctcccacagtattgggattacagg

SEQ ID NO: 40941 - DNA, 201 bp, Homo sapiens
aaaacctgaacctaaaaagaaattctttagccatgtccgtgtgaactaaattcagcgtcagatgtacaaggctgtggttctgaccacccccgggctatttytgaccacaggacagcttaaatggtgtggcccataaaatgtaatctgcaaactcaggctgaatgttgatctatttagggccaagagaagaccaggccttgg

SEQ ID NO: 40942 - DNA, 201 bp, Homo sapiens
tatttgccaaaggtctgagaaaaaaaaaagcctttcaccatggttagttcgagaagcacagcaatacagtacttctgctacgagtgtatacaggctgaggrtgggtgctttgtggcccttttcttttaccggctgactagaatgttgacgttaaagcagttagagtccgagcaggcaactccgaccccaagttggagctgt

SEQ ID NO: 40943 - DNA, 201 bp, Homo sapiens
ttgctgaaggtccccagcctccttgctcccaaacacttcaagaaggaaaatgctgttgcagaaatgttgtctaagctttaccattcagtgtggcccagatmaacctgtcccttctttttgtgatcacagtgtgtaattataaagttatttgtgtgtttggtttatgtcttccacactggactgtaagatccatgagatcta

SEQ ID NO: 40944 - DNA, 201 bp, Homo sapiens
tcctgagtagctgggattataggcacatgccaccatacccagctcatttttttttaatatatatttttagtgaaggcggagtttcaccatgttggccaggmtggtctctaactcctgacctcaagtgatccgcccatctcggcctccccaagtgctgggattacaggcatgagccaccactctaggcctgtatttgtttta

SEQ ID NO: 40945 - DNA, 201 bp, Homo sapiens
aaccttacctactcaagtgtaagatgagatgccactgtggtatcttcaaaggaatttagaatcatgtcttaatggctccattaagaagaattctttttctsttttctctgaaaagcatcccaggtcataaaatgtaatgtgggattgtaggttttgtgggaagatgcacttggcagcaattccttgagaggaggccttgaa

SEQ ID NO: 40946 - DNA, 201 bp, Homo sapiens
aggtcaaagacagctctttagaaagagatgttctttgcttctttgctgactgcccatcccctcctctctctcaaggaaataagatattcatttgcaagtawataatgcagcagtcttggatttgtatcagatcaactttgaatgaaagcctgcctttctgcgtttatttttgcttatctctcctgcttctgcttcctgttt

SEQ ID NO: 40947 - DNA, 201 bp, Homo sapiens
aaaaattcggatgcattttgcacagaattaagacgttatgtgcaatccttgtgtttctaattatatgttgatcaatgacacctttacaaaactgtcatcartctattggtggttgattggtccaaccttagcccgatacctctatctccgcttagtcattcctggtgggtgactgatgacccctgcttaacagtaaacttg

SEQ ID NO: 40948 - DNA, 201 bp, Homo sapiens
gcgatctcggctcactgcaagctccgcctcccgggttcacgccattctcctgcctcagcctcccgagtagctgggactacaggcgcccgctaccacgcccrgctaattttttgtatttttagtagagacggggtttcaccgtgttagccaggatggtctcgatctcctgacctcgtgatctgcccgcctcggcctcccaaa

SEQ ID NO: 40949 - DNA, 201 bp, Homo sapiens
cgcccaccaccatgcctggctaattttatgtatttttaatagagacagggtttcaccatgttatcaggatggtctcaatctcctggcctcgtgattcaccygccttggcctcccaaagtgctgggattacaggcgtgagccaccgcggctggcgaaaattatatattatacacacaaacatacacacacgcacacaccaaa

SEQ ID NO: 40950 - DNA, 201 bp, Homo sapiens
ttcagtgttggatgttcaccgcttctttagggttctaccactcccagtaaatcaagtaataggtttctgttaaaaaccccagtgtgctgatctcagtggcrgccatcttgctttgtaagccttctctagctttatgatgctcccagtatataagacatttccagtgtctagtccaaattagtatttctctaattctcgagt

SEQ ID NO: 40951 - DNA, 201 bp, Homo sapiens
ttatactgccaatctgaggccttttctgacctcatcgctgccactgtaaaatgaattctagccccagaccatgacatgcctactagcttagctctaaccaraaagatttattatcccaagagttgtgaaaatgtggaagaactagaactgtcattcactgctggtgggaatgtaaaatggtacaatgaatttggaaacagt

SEQ ID NO: 40952 - DNA, 201 bp, Homo sapiens
accactggattagtctcttgcctttcaattttatgtttatatacaaatatatgtgcataccaaattttatatatatatatatatatatatatatatatttwtttttttttttttttttttttttggtcggagtctcaccctttcacccaggctggagtgcagtggcgcaatctcggctcactgcaagctccgcctcccggg

SEQ ID NO: 40953 - DNA, 201 bp, Homo sapiens
ctcccagtatataagacatttccagtgtctagtccaaattagtatttctctaattctcgagtgtctgatctgcctggctagaatgattaaaacaaaaaaayagcaaatcagtttgacagtccacttcattaagtggaggacagtgttttgattgctatttaatctgtttttccttctgtctgttcttggctatatggaatt

SEQ ID NO: 40954 - DNA, 201 bp, Homo sapiens
gtgcatatgagctttccctcctcccgtgggttagcatgttccacactcaccttctcaaagcaaagtctcccttaggggacccttggtatcctgttcatctrgcaaatctcagcaccaatagaaacaccaagaacatggattcatcaaaggaaaaatgttgaagtttccatttttatgcttcctggtaatccttcagccctt

SEQ ID NO: 40955 - DNA, 201 bp, Homo sapiens
taagtgatggctgcttatggccatgccctttcttctgcactttgggtgttttgtctggaattttctctcctttccttttgtgaaaaaggatgaattttccragactctgttatgacagaaactcaccagttctctgttgttaatcaacaaatagattgtgaatgcttgactcttctttttttttttttttaaaggagtttc

SEQ ID NO: 40956 - DNA, 201 bp, Homo sapiens
ttttaaatagttaatccatttaagaagtttcatttaaggtactgttaaaaagaaaaaacacagaacaacacagtgagagcagaaaaggtatcatctcctcyccctcttcttctcttttagaaaccttgctgcgtgatccactgatggtaaatatttcatgtactttgcatatcagcctgagttccttttgtgaagtcaggt

SEQ ID NO: 40957 - DNA, 201 bp, Homo sapiens
acctgtaatcccagcactttgggaggctgaggtgggtggatcacttgaggtcaggagttcgagatcagcctggccaacatggtgaaaccctgtctctactrtaaactccgtctctactataaatacaaaaattagccaggcttggcgctgggtttctgtaatcccagctacttaggaggctgagacaggagaatcacttga

SEQ ID NO: 40958 - DNA, 201 bp, Homo sapiens
acactttgaaataatttatgttatgtgaatttcatctcagcaaaaagaggctaacacataaggagacatattttgatacatgtggcatattaagctgctgytgttgttttttaaatattccagctgcgtgcagtggctcacacctgtaatcccagcactttgggaggctgaggtgggtggatcacttgaggtcaggagttc

SEQ ID NO: 40959 - DNA, 201 bp, Homo sapiens
tttatataaaatatgcagagtaggcaaattcataaagacagaatacgcatcggtggtttctggggcggcggggagtatggaaagcctgttaatgagtacawgtttctttagttttttttggttttttgttttttttttgagacggagtcttgctctgttgcccaggctggagtgcagtggcaccatctctgctcactgcaa

SEQ ID NO: 40960 - DNA, 201 bp, Homo sapiens
tcaggaaaattcaatctcgttaatacttttggagggaaaagaaggcaagcgtactcttcagagaacggattcttttggatttgtgttagagaaaaactgtstctaatgaccgcacagcacaaagcaaagcagttaaatgaataaccgccttccagtacagataataaagcaggagaattttgtgtgtcacatcaataaaca

SEQ ID NO: 40961 - DNA, 201 bp, Homo sapiens
tgcagggaattattgcagttttgttttttatttagcacaaacctaaatattacacgtagcaaatgtcacccgatgcaactgtctgtcctgaagaggaggayagattattctgtggctacctaatggtgtttacagagttgccactttgccaaaccccaagacccacacttggtctctggtgttgggtccgccagctctcca

SEQ ID NO: 40962 - DNA, 201 bp, Homo sapiens
aatgtcacccgatgcaactgtctgtcctgaagaggaggacagattattctgtggctacctaatggtgtttacagagttgccactttgccaaaccccaagasccacacttggtctctggtgttgggtccgccagctctccacccttcagaatgggatgtttagggcgtaatcttctgagacccacaacctaagccgggaagc

SEQ ID NO: 40963 - DNA, 201 bp, Homo sapiens
ggatgtttagggcgtaatcttctgagacccacaacctaagccgggaagcagaggcaatttattaccccagcttcctgtccactggaggcccggggagaccktgaaatgctcagctgcaagtcagggtccaccgatgcagcctcggaatttaatgaggcctctccggacccaaagggagatggacatttctaggcttgtgga

SEQ ID NO: 40964 - DNA, 201 bp, Homo sapiens
ccctcttctctcctggtgagaccgttgttggatgtgaaaaggccttcactattgtcaaggctgggcccctgcttttgccttgttactctgcattttaactstggaccagaattgattgccaccaataaaagatactccagtccttaaaaagtcaacattgttatgttttacttagttatgacttagtgaacacctatacga

SEQ ID NO: 40965 - DNA, 201 bp, Homo sapiens
acatggcaaccaaataagagtagctggagcagagactttctcttcttcagattattaagatttgagcaattcattttttttggatggtgtttattaaagtmaagaaatcttttgcttatttgctaatgattctctcccctttctcttcttatatttttgaaggctgaattggtaaaattatctggcccaataaaaatatgt

SEQ ID NO: 40966 - DNA, 201 bp, Homo sapiens
cagacccttgcaacaaaatcttacgtggtcctggatgaaaataacactggaggtaagaaaccttggcctagagggttccccaacctttttttttttttcaktatggccccctcccccaggagccttttgagatacgactttcctaatggtctttgcccatgaaatctgaataccacagatgtgctgaatgcctgttcgtgt

SEQ ID NO: 40967 - DNA, 201 bp, Homo sapiens
atctggcccaataaaaatatgtcctgggttggaaaagagcacaagtttctttttctagccctggagtgaggtggctctctggcctctgggttcgtttggtrtcctggggagtcattgacacccacacactcctagtcacaagacctttccctcccatccagattgtgtttattttacggctctcgcacggagcatgcagct

SEQ ID NO: 40968 - DNA, 201 bp, Homo sapiens
tggatgtattgtcacccctgttgggaatacaccgctcagagaagggttttgtccataggcaacacagagccaattgaggcctttgggcaagcggaggtcawgatggaattcagcctttcagacaattctgccaggcccttggagggtgggaggaaacaggcaagacctctggctcctagaaccgtaaggacccttgccatt

SEQ ID NO: 40969 - DNA, 201 bp, Homo sapiens
ctttcctttataaaccacccagtcttgggtatttcttcttagcagcatgagaagggactaatacaggggtgatcacaaacagcctgcagactgggccatckttcttaggcaggatctcgagctaggagatgagaagagctctataggcaaaaagaatgacttggaaggccacatatggcagagtagctaagactttggggt

SEQ ID NO: 40970 - DNA, 201 bp, Homo sapiens
tgggcaagcggaggtcaagatggaattcagcctttcagacaattctgccaggcccttggagggtgggaggaaacaggcaagacctctggctcctagaaccrtaaggacccttgccattaggaccaaacctcttccagctttctcagcagccacatgtcaccccctcttccaccctttgccctgccaccctccatcccctga

SEQ ID NO: 40971 - DNA, 201 bp, Homo sapiens
gaattcagcctttcagacaattctgccaggcccttggagggtgggaggaaacaggcaagacctctggctcctagaaccgtaaggacccttgccattaggascaaacctcttccagctttctcagcagccacatgtcaccccctcttccaccctttgccctgccaccctccatcccctgataccctcctgccttttagttgc

SEQ ID NO: 40972 - DNA, 201 bp, Homo sapiens
gtcctgacaccatggccaccttccagaaatttccacatgttaagattgcagatgcaggctggacacattagtgatttctaagtgctaagaaaaaaaaagascggctcacacctgtaatctcagcactttgggaggctaaggtgggcgaatcaccccaggtcaggagtttgagaccagcctgagcaacatgacgaaaccctg

SEQ ID NO: 40973 - DNA, 201 bp, Homo sapiens
gccactgtgcccggccttagatgaggtttgtagatgtgtttttcatattcccaaagccatgaaatttgacaggtaaatatatcagttataaaagttttagsattaattatcaactaactcccagaagttgcctcagcctctctttttcagccttgtcttgccccagcccagagacaagccacagctataggttttatttct

SEQ ID NO: 40974 - DNA, 201 bp, Homo sapiens
ccaaagtatgcacgccgcactccacctcccatgcccttttctttttctcagggccatcagaaaggaagtaactggcttagatttgacacctctttttttgktcgttttatgtttttgaatctagcatgtataagctcatcagagagctttcccctggcctgggacaatcaggtttcaactgaggctcacgcacacgtcaac

SEQ ID NO: 40975 - DNA, 201 bp, Homo sapiens
tcttattggaacagctggttttccctttaaaacagggagtccagcagcttctaggatgcttagaatcagaattgttgctcactttttaaggtatagagtakttgtcttattcttaactacattttatatctttgcccttttttcccctactttaaataaaatctatctctaatttatgttacttaagcaatgacaaattct

SEQ ID NO: 40976 - DNA, 201 bp, Homo sapiens
tagatattatctgtaggtttttcaataagaaggaaatttagcttccttctactttggtgccccatgatgatgtgcatcttttttatttctgcatcatatcmatatagtgatatcatgtataatgatgtttaagaagacagttttttttgtttaaattgttataaataagtaagtgtatgcaccactatgccatgtagcata

SEQ ID NO: 40977 - DNA, 201 bp, Homo sapiens
ttctttccttccctttttccttttctttccttctttccttgccatttaaaacatactgataacttggcagcacagggcagtgattaaactcaggcactcaycccaccctacctgggaatctgaattctgtcttttctgctgctgtggattctcagtccccaagttgtgtaaatcaaagcttctcctgccacactagtgtgt

SEQ ID NO: 40978 - DNA, 201 bp, Homo sapiens
aggaagaactcttccaaatgatggcagggatatttggaatctttccccctgagttccctctggaagttaaagcccagatcccgtgaactgattaaaaagcyccagaccattcccgttccagtcatcttgaaactgagcaagaccgtgtcatccatggagcttgaacataggagcactttaaaaaaaaaaagaatgaaaagc

SEQ ID NO: 40979 - DNA, 201 bp, Homo sapiens
ggaagaactcttccaaatgatggcagggatatttggaatctttccccctgagttccctctggaagttaaagcccagatcccgtgaactgattaaaaagccscagaccattcccgttccagtcatcttgaaactgagcaagaccgtgtcatccatggagcttgaacataggagcactttaaaaaaaaaaagaatgaaaagcc

SEQ ID NO: 40980 - DNA, 201 bp, Homo sapiens
caagggtaagatctgctgtcttgtgaatgtcaaagaagtttctcattcgcccctttcttctctctcccagtgtctttaatttgttaatgctttcgacttaytttgctttggataattttcaaagtactgctttctctagagatctctaaaaggcagaagttctggctattaaagatttgccattctcagaacagcccagtt

SEQ ID NO: 40981 - DNA, 201 bp, Homo sapiens
tgagactccgtctcaaaaaaaaaaaaaaaaaaaaaaaagtttgtactcagcctggcgtggtggctcacgcctgtaatcccagcactttgtgaggccgaggkgggcggatcacctgaagtcaggagttcgagaccagcctgggcaacaaggtaaaaccccgtctctactaaaaatgcaaaattaactgggcggggaggcaca

SEQ ID NO: 40982 - DNA, 201 bp, Homo sapiens
gacagattgagactccgtctcaaaaaaaaaaaaaaaaaaaaaaaagtttgtactcagcctggcgtggtggctcacgcctgtaatcccagcactttgtgagsccgaggtgggcggatcacctgaagtcaggagttcgagaccagcctgggcaacaaggtaaaaccccgtctctactaaaaatgcaaaattaactgggcgggg

SEQ ID NO: 40983 - DNA, 201 bp, Homo sapiens
acccattgtacacatttggtattttttctttaaaaaaaaaaagcatttactttttgcctcatgaatctctgagtacattttgtgcattctgtattctactktatttactcaatattaattatatgagaaataaatcctaaatgtaattttgaatggtggcttcacaaaagaacatttcctcttcttttggacatttgctcc

SEQ ID NO: 40984 - DNA, 201 bp, Homo sapiens
ccagcctggcgacagattgagactccgtctcaaaaaaaaaaaaaaaaaaaaaaaagtttgtactcagcctggcgtggtggctcacgcctgtaatcccagcmctttgtgaggccgaggtgggcggatcacctgaagtcaggagttcgagaccagcctgggcaacaaggtaaaaccccgtctctactaaaaatgcaaaattaa

SEQ ID NO: 40985 - DNA, 201 bp, Homo sapiens
gacagctctaggcagaaagcctttctcaggatcccagcttccctgtcttccagaactcaaagacggcttttgtttgttagttttgaggatggagacagctrtcattctaatgaggacttaaatgtgtccctgctgaccgagccagaacttatttttatgttgccactaggagtcttctgagatgctcttgtggctggatgt

SEQ ID NO: 40986 - DNA, 201 bp, Homo sapiens
aacccggagatttgtccttgcagaatgatgccatgaagaacatggccaatggaacaccattgcttcaaatcccgacctctccagttctcctggtttcttgytaggcgggaacttgggcttctttatcagtgactggggtcagttcttgtactcaacttcctatctctgtgatctcttgtaagatgctgcattgtcaaatgg

SEQ ID NO: 40987 - DNA, 201 bp, Homo sapiens
tctagctgtcactgcctgatgtttactgctcaaagcttaggacttggattagagcccaggacttggcagccaagataaaccaggtgcaattacgctgaacrtctcagcccagctcctgtccatccctgaacaggacacttagggtagaggatgttctcagcagtgccatttgcatcccccttcatagccttacaggtatca

SEQ ID NO: 40988 - DNA, 201 bp, Homo sapiens
catcactttctaccacctttccttaaaactaggcttcgtgccaggtgcggtggctcacgcctgtaatcctagcactttcggaggccggggtgggtggatcmcaaggtcaagagattgagaccatcctggccaacatggtgaaaccccgtctgtactgaaaatacaaaaataagctgggtgtgttggcacgcacctgtagtc

SEQ ID NO: 40989 - DNA, 201 bp, Homo sapiens
tccctttgcagtaggaagtgccacctcactccactcttgccagaaagcctggctctgtcataaggaatcttggcccattgtcactctcattgatgacaacscccgcccccaccactaccaccttaactactgaggggatgtcctctggcccagaaggaatgcattggctctagttgaaggggttgctggtttgtaaatagc

SEQ ID NO: 40990 - DNA, 201 bp, Homo sapiens
aatgatgggtagtagagtctgtatacataatttaaaatacattaacatttctgttttgcctgagataagcttgtactggtgtgatcagaaggaagaatgargatttggggaaggaaaattttgagagccattttacagcatttcaagattcagtgatctcagaacctcttttggttaaacaagcatgggaagatggatgat

SEQ ID NO: 40991 - DNA, 201 bp, Homo sapiens
ttctctgtttaaataccacacactccccatatggtttctttggtttcaggcagtatcgcatcagagtcacatatggctaatttatagtcataaaatgataytagagatcactgttgcataacaacaagaaacccctttgattccacacttacagactcttgagtcactaacacaggtttcagtatatataaagaatagatg

SEQ ID NO: 40992 - DNA, 201 bp, Homo sapiens
gctatagggataaataactgctgtggggcaaggactgaaatggttgttgttttgagatggcttttatcattgggccagtgacgacccattcagccctatcrgtgaagagtgaagcactgcactctttaaggatagggctgaatggtttatcacccattcagcggtgaccaccacatcttatgcattgtgatgatcacgatg

SEQ ID NO: 40993 - DNA, 201 bp, Homo sapiens
caacacgtaggttcttagttttttaaatatatatatatatacgtatatatatacgtatatatatgcgtatatatatacgtatatatgcgtatatatatacrtatatatgcgtatatatatacgtatatatacgtatatatgcgtatatatatacgtatatatacgtatatatatatgtgtgtatatatatatataaaaata

SEQ ID NO: 40994 - DNA, 201 bp, Homo sapiens
tgtggtgtgcggtgcaacccgggctgtgttcccgagtgcatcaaacggggattgggacctgttttccttcccactcacatgtaggtcacctacgggagcargggaggaaccatctgaggtgtttttttttttttttttagatttctcattgctgagaacagttccagctctgctgaccaaaggctgagtgtccttttatta

SEQ ID NO: 40995 - DNA, 201 bp, Homo sapiens
tctccgacttatgtatgattcatcaagaggactccaggctgtggtgtgcggtgcaacccgggctgtgttcccgagtgcatcaaacggggattgggacctgktttccttcccactcacatgtaggtcacctacgggagcaggggaggaaccatctgaggtgtttttttttttttttttagatttctcattgctgagaacagt

SEQ ID NO: 40996 - DNA, 201 bp, Homo sapiens
tgacaccacactgctgtctagtgtccaattctccttgcatggctgtgtcacccaggttggaacgtagtgcacaatctcgccttaatgcaacgtcccactgygggcccaagtgattttcctgtcccagcctcctgagtagctgggactacagatgcctgccaccatggcctgctaatttttgtatttttagtagacataggg

SEQ ID NO: 40997 - DNA, 201 bp, Homo sapiens
aggagctcttggattgcaatttttcattcacccctccctctccacccttcctgtcttcaagcctgagcaggtgatactgcattttgtaccgtatgactttwaaacagaaccacgagttcagaactttggttaggtcctgcccgtgttctctagctaacgcatggcaacgctggtttccaacctttcactgtgcgggtttct

SEQ ID NO: 40998 - DNA, 201 bp, Homo sapiens
aagaggtcacataggatattccatttatataaaatatgcagagtaggcaaattcataaagacagaatacgcatcggtggtttctggggcggcggggagtakggaaagcctgttaatgagtacaagtttctttagttttttttggttttttgttttttttttgagacggagtcttgctctgttgcccaggctggagtgcagt

SEQ ID NO: 40999 - DNA, 201 bp, Homo sapiens
ggctgaaacacagcacaacccacccccccgccccaccccccagcctgtaggtttagcagaatcccagcctcacatcctccccgaacttggcagtaaaagcsctgttcttccattcattccgatgatttatattctctctgggcgtcttatattaaacaggggaattccgacatgttccataacacatttactgtaacttga

SEQ ID NO: 41000 - DNA, 201 bp, Homo sapiens
agggagatggagggaggcaaaaagaaaaagggagaaggaaagagaggaaagaggggaagggaggaaggaaagaagagagagaaggaggaagagagggaagkaggcacagaggtagagaggcagggagataatggagatcctggccaaaagttaatgctccgtttctagtagtccacagaaagcaccttgaccaagtgactg

SEQ ID NO: 41001 - DNA, 201 bp, Homo sapiens
ctgcctcctaggctcatgccattctcctccctcagcctcctgagtagctgggactgcaggcgccagccaccacgcccggctaattttttatatttttagtmgagacggggtttcaccatgctaaccaggatggtctcgatctcctgacctcgtgatccaccagccttggcctcccaaagtgctgggattacaggcattagc

SEQ ID NO: 41002 - DNA, 201 bp, Homo sapiens
ctttccattaagtgagtctttctccaagggaacagaagtcttaggttgttgatctggcggtcagaacctaggacaggcaaggcagtgggctgttgtagagkagatgaagctgatcagagcacacccacaccagtgacaaccggtcaggacctgggaagggctctgacccattcatctgagagatgtggcatgaggaacact

SEQ ID NO: 41003 - DNA, 201 bp, Homo sapiens
actctcatgacataattacctcccaaagtccgcacttcctaatgttaccactctggaggttagaatttcaacatataaattttggggggacacattcagaycacaataatgttttataatgttcattttgctttaacaagagacacatgtcagatagtagacatgatctgagaagacacaaaacccagcgtggtgattttg

SEQ ID NO: 41004 - DNA, 201 bp, Homo sapiens
gaggatttgtttttgatctcataggtgtccatcttgctattttctcaactagcagaggcaactctctggggtatcttttaaaagggcactaatggccaggmgtggtggctcacacctgtaatcccagcactttgggaggccgaggcaggtgtctcggtggatcacttgaggtcaggaggtcgagaccagcctggctgacat

SEQ ID NO: 41005 - DNA, 201 bp, Homo sapiens
ctgtttgttttgaaccacttattttggcaagacttcttcagacaggagagccctgagagctcttcaaaggctgggcctgatggtgtttgtcagagaggttygagctcttaaatttaaatggcctcccacagggaagcagaagtccttttggatcctccagaggactgagatcctccagatgctgttcatttgccttattcg

SEQ ID NO: 41006 - DNA, 201 bp, Homo sapiens
aaagtctgtaccaattaagcagctactacccattcctcttccctaccattctaccttctgtctcagtaggtttgcctatttgggatattttatttaagtgsgatcatacaatagcatcatgtgttcaaggttgacccacattgtggcatgtatcagtacttcattcccttttatcactgaatagtattccactgtatattg

SEQ ID NO: 41007 - DNA, 201 bp, Homo sapiens
aagtgctgggattacaggcgtgaactactgtgcctggccaggataatctttaagaagaagataacattagctattcttctcacttcctacgtagaattccmtaccctgtgtctttggcctggaaagggtattggtagcaattgtcttcggctttccctgccatgtgtatgcattcccacggccacacaagcacacacacac

SEQ ID NO: 41008 - DNA, 201 bp, Homo sapiens
tgggtaatggctgaagaaaagaggtttaattggctcatgattctgcaggctgcacaggaagcatagaagcttctgctactgggggcgcctcaggaaacttrtaatcatggcagaaggtaaaggggaagcaggcacatcttacatcgccagagcaggagcaacagagagcgactggggaggcgctacacacttttcaaccac

SEQ ID NO: 41009 - DNA, 201 bp, Homo sapiens
atgaagggttcatcctcatgactcagtcacctcccaccaggccccacctccaacactggggattacaattcaacatgagatttcggcggggacacagatcyaaaccttatcaccagcgcttgttatttcctcaggtacattttgatgtccctccccactttactctcccctacaccttgaagcaggtgcaatcattttagg

SEQ ID NO: 41010 - DNA, 201 bp, Homo sapiens
agttaggcattggtttggctccaagtgaaaactgcttctgttattaacatcagcagcagcaacaagaagagagaagtttatgtctgtctcggaatacgtaygtgacaggctcccccatcgaggtgctcagatatggtggccactgcatgattttgctcaggactgaattagaggcaggtgaaaggccctcactccctggaa

SEQ ID NO: 41011 - DNA, 201 bp, Homo sapiens
cttcccacaattcccagtgagcccaactccttaccacaattcccaccccatgccttccccaaattcctgatgagccctatgccttcccacaattccctgtraattttgctccttcccacaaccccagtgagccccactctgtcccataattccctgtaaatctcactccttcccacaatccccactgagtcccattccttc

SEQ ID NO: 41012 - DNA, 201 bp, Homo sapiens
tcacaattaattgtgccgcagttaattaaattgactgcctggcaatccagtctcaattaaaatactaatagtttatttatttattttgtcttttacgaagygttttcttttaccatctctcaggatcctatgtaggtatcctgatggtaagaatgataataccatgactgattattccatagttgcaggaaccccacatgg

SEQ ID NO: 41013 - DNA, 201 bp, Homo sapiens
ccactccttcccacaattcccagtgaaccccacttgtgtagtgtgtctgtgagtagtctgcccactctccttatgacaggtttccagtattatctgtttcmtaacccatttccaaccttctgggttttttccttcaacgtttcctgtgacagttctccattatatctttgttagataatagttagcaacccattaataact

SEQ ID NO: 41014 - DNA, 201 bp, Homo sapiens
gaataagtattttgcagggcttattttcatcatctggaaaggaggaatagatagggttatcttgaaagtcctctcttggaagggattatggttctgtaatsctgtaggactggactcagtgggtaaatgtagaggtgatggtatctccgtttttattgtcttcagaaatgttgagatcgagtgatataaagtcacagggtt

SEQ ID NO: 41015 - DNA, 201 bp, Homo sapiens
tgttagaaaaggtattttttttatgaagtaagtagggaactaactacctgttcactgctgcccgttcattgctagcacaatgccaagtgtcaaataaatgyttcttgaacaagtgaatagagtacgcttctaggcttctggaaacggtgaatgttgctttatgtggcaaaaagggactttggagatgtgatcaagttcagg

SEQ ID NO: 41016 - DNA, 201 bp, Homo sapiens
ctttgcagacccctgggagcctcattcgagttcttcctgtggagtcccatgccttggtgttgaaccagtgtcctagctgggaggaccgttgtactgcagcrctttcctaaactctgcatgtggtctccatgatgtcctggctgtgttagcatcagaaatggctttgcccacatctcccaactctgccctcttattaggatt

SEQ ID NO: 41017 - DNA, 201 bp, Homo sapiens
taagggtgttttaacaaaatggcaatttccccaggctggcttgtgtattaccttcgcattgcatcccttggctcccatgagtgagcgtggtgacttggtgygtaggtggtacgtgaagacagttgctcactacccaagaactcagggccctaaaccatgctgtaaaatgcaagtgctgatatctaattacctccatcaacc

SEQ ID NO: 41018 - DNA, 201 bp, Homo sapiens
atcacttttaaagaatctgggcttacccagttaacagaaatagaacctgcctgtttatcagtgggtttgcctcacttttctgtgggtttcttttcttttcytaattatgcattaagaaaataacttaagtttctgtgcatacaacatcttcctttctcattcccagtaccctagaaacacagccgttcactgaagaggatt

SEQ ID NO: 41019 - DNA, 201 bp, Homo sapiens
caggggactgttgttattcctcctttacagaggtgggtctgaaggtacagagtggataagtcattttctccgggccagccacacagcgaatgaatggagaytccttgtgtgtagtaaatggctgcagccctataagctataatcatatatcatcaacacctttaccctgttattaacgtgtctgaaattagggaacaccac

SEQ ID NO: 41020 - DNA, 201 bp, Homo sapiens
ccacctttctgaagaaaactgcagagcttttgcagttattaaactagcaacagatgtaaagtccaactgttagagtttttctttaaagcagaagttagcarttacaggtgcttgtgatgtcatcacttagatgatcttataaatgccttttttttttttttttttttttttagtcggagtctcactctgtcgccaggctgg

SEQ ID NO: 41021 - DNA, 201 bp, Homo sapiens
gccaggagggtttctctgaggagatcccatttcaacagatctagaaatgtaatggagccagtcctagggaaacaggactaccaggaatcctcaccagcccsgcaaagacgagggagcagcaagttccaaagcccgtggcatgtcaagggtcgatgaattcaccaactgcaaggggctttggtgaccccagtgaacagatga

SEQ ID NO: 41022 - DNA, 201 bp, Homo sapiens
tataattataatacaatattatatataatatatattttatgtaactataaacaaggggtagattactcatgagttttcacggaaaggggtaggcagttccyggaagtgagggttcttcccctttttagaccatatagggtaacttcttgatgttgccatggcatgtgtacactgtcatggtgctggtgggagtgtctctta

SEQ ID NO: 41023 - DNA, 201 bp, Homo sapiens
ggaaacaacataaaataatattaccggagaaacaatgagtaacatgtataggattttttttttttttttttgacggagtcttgctctgttgcccaggctcsagtgcagtggcgtgatgttggctcactgcaactccgcatcctggtttcaagtggttcttctgcctcagccttccaattagcggggactaccagcgcatgt

SEQ ID NO: 41024 - DNA, 201 bp, Homo sapiens
aaccgtcgtcgtcatttctcaagcgtgacgatactgttacacgtttactgcatattctgcataccaagcacatatccgtcacacgcagtgtggccaacttycgagaggccggcattcagccaaacagcctgaagaaccaggagaaatgcctgagtttccaaatggcttatggtaagttgttgctgccactatgagtagcct

SEQ ID NO: 41025 - DNA, 201 bp, Homo sapiens
cctttttctggggtcttttgcctaatcgtttactggtttggagacactgttttctgtattgtttaggactgaaaatgtagacctaactgaaatcaagcackcgagtatcctaattattttaaattcataatgaatagtcatcatggtttcactttttttatgtactcttttgaaagagtacgatgggggaataaaagccag

SEQ ID NO: 41026 - DNA, 201 bp, Homo sapiens
gagaagtattctgagggacagctagttctatctgcagtgtatcttttttaaacagcatagaactattttttttttttaattctagtcttggtttctgcctytcaatgtgtgaatttaagttcatgtttcttttgatgactgataaatttgaaataatttctgtatttcattgtgttttcttcactaccaagtttttcttat

SEQ ID NO: 41027 - DNA, 201 bp, Homo sapiens
atcattaaaatgagaacactgttattggtctttcgggattgttttgagaaatgagatatcgagacatgcctggcacaaggccttaattcttcttcatggtmaagaaatggcagattttcccccttccattcccacccttgcacatagtaggttctcagcaagtatttgtagatgtaatcgaccagcagagatcatttgtac

SEQ ID NO: 41028 - DNA, 201 bp, Homo sapiens
tcttctgctcagtgaccattagtggaaatgtaaatatctcacctcaatgcagtgtgggttaggaaatgtggctttctgtctagtcaacctctttttcctaygctgtggaaagaggagaagtattctgagggacagctagttctatctgcagtgtatcttttttaaacagcatagaactattttttttttttaattctagtc

SEQ ID NO: 41029 - DNA, 201 bp, Homo sapiens
ttgctcccttattctcacacagagaacatattcacttttcttccaaaggcagagtctcaaaatcccatttaattctttgattctgtgcaaattctagggtstccttcatgcttagatatggttccttatggtcctgtgggtttcagaaaggcagcccattcatgccgtctacccccctgctgctctatataatagaaggtg

SEQ ID NO: 41030 - DNA, 201 bp, Homo sapiens
aaaagaatccatatttttatgtgtagtgttctgtagctcttttagttggtttatactcttttaatggtctgttgaccattttatctaaatattccattttrtcttttacttatttctattataaatggttaatctcttctactaagattgttaaatccatctttttgtttatggctgtgttatttggcacatgcaagttca

SEQ ID NO: 41031 - DNA, 201 bp, Homo sapiens
atataacttttttaagatgaaaaccatttattttcaatttctagtttaactgcctcacagtaaaaaagtgtactttttgtgatggcaggaatttgaagtaygttgaaactgcctttgtgatctggctcatggttaacttcaataacgtatgaaaagaatccatatttttatgtgtagtgttctgtagctcttttagttggt

SEQ ID NO: 41032 - DNA, 201 bp, Homo sapiens
ctgttcttcatcctttaattagcattcaaactaatcgttattagagtgtgtaacatgatctttgacatacctaggtaattttacttaagtatatgagttawgttgatacgcacagttcctcagcatgaatgtcattgttttgcaaattttagctgaaggtgacatcactgtactaaaattttcttgtgcatccacttccta

SEQ ID NO: 41033 - DNA, 201 bp, Homo sapiens
agatgcatacaaaatggaagatggccaacatttctaaaaattttgtttcctgacatagagaacgtttagaggtcaggttgctctgagactgtgttgtgatktcttttttttttttttttttttacttgtttgtcctttcttttattatctcttgctgttatcctcacttttttctttgctgttcttcatcctttaattagc

SEQ ID NO: 41034 - DNA, 201 bp, Homo sapiens
agaagcttagtctcaatttcagagagttattttggcaacatatttgggaaaatgatagttagatgctgcgttagccagcctctgcatgattttttacgcaraacaaacagttccaaatatcagtgctttcagcaactcatatatttctcacttatggtgcatgtcgctgatggttggctgctgctctgatctcactccagt

SEQ ID NO: 41035 - DNA, 201 bp, Homo sapiens
gcttctttttatttcttagagccagagctggaagacaaggcctggcatattttggcaggcctggatcagagcctaggtgtgtaaattaggaattgcatttsgctgctgctaacaaggacccaaacatggtggtaaattcttccacataaaacaacagaaaataagttgttttctggccctgggctggggtggccactccac

SEQ ID NO: 41036 - DNA, 201 bp, Homo sapiens
ggagttttgtttgcaaatgatcacctggtaatttaagagggtgagctaaacttcctccttttctagtatggacctttggggctcaggatgaggatgttcamtttgtactgctggtggagctgcctttccattaagtgagtctttctccaagggaacagaagtcttaggttgttgatctggcggtcagaacctaggacaggc

SEQ ID NO: 41037 - DNA, 201 bp, Homo sapiens
aggacatatgtgtcttctgccaagatgtggaattttggcaaggctagcatgataacaaataaacattcaagcagtcacttaatgatattgaattgaacacmatttctcagaagttcctgtattaaattacaaccataagaacatacacaagcatgcagattgtaagtgtgatgagaatggaaacattccataggacgcaga

SEQ ID NO: 41038 - DNA, 201 bp, Homo sapiens
gggtttatgatcaagtaaagagtttaaagaagtgttttatgagggagttttgtttgcaaatgatcacctggtaatttaagagggtgagctaaacttcctcmttttctagtatggacctttggggctcaggatgaggatgttcaatttgtactgctggtggagctgcctttccattaagtgagtctttctccaagggaacag

SEQ ID NO: 41039 - DNA, 201 bp, Homo sapiens
actcctgtacttcaaggttttggagtgggaaagttgaggaaatgtaagagatcatctctgtctctatcacattaccgacggagaagtgggataagaactaygtgtgttttcacttcttctttctttagagaaaacaaatatcatctgccttgctaggtagttgtgagaaatgaggagataatatctttaaatctcctacgg

SEQ ID NO: 41040 - DNA, 201 bp, Homo sapiens
ttgggtaattctaatgcttacttcatcccagggctgatgtgtgttaggttagggtttatgatcaagtaaagagtttaaagaagtgttttatgagggagttytgtttgcaaatgatcacctggtaatttaagagggtgagctaaacttcctccttttctagtatggacctttggggctcaggatgaggatgttcaatttgta

SEQ ID NO: 41041 - DNA, 201 bp, Homo sapiens
tacagcttttaaggagaactaacttgccactttgatagcagtataggactccaatatttctcatttgtaattttcagaagcacacgggaggtctttgaaayttaatgtctccctgcatcacaaaccaaaagacgagtcagtttataagtaggctgtgcttattaactcagtcctggctttattgattgctttaggttccat

SEQ ID NO: 41042 - DNA, 201 bp, Homo sapiens
tccctcatgtttcaagtggcttttttgcatgatggtgcatatgtctttgtttctgtacagggccctccatgttcagaggcagagtaacgtgaattcatttygcgctaatgagagttgcgatatgtcggcccaaactctctgtgtccttttcttcttgggctgatgaacttgtcaacttttaaaaaatgtgctctccaaaaa

SEQ ID NO: 41043 - DNA, 201 bp, Homo sapiens
aggagtttgagaccagtctggccaacatggtgaaaccccgtctctactaaaaatacaaaaacttagctgggcatggtgacaggcatctgtaatctcagctmctcgggaggctgaggctggagaatcacttgaacccgggaggcagaggttgcagtgagccaagatcacgctattgcactccagcccaggcaacaagagcaa

SEQ ID NO: 41044 - DNA, 201 bp, Homo sapiens
ccccaatcgatcagtggagaaacgagctctggtgggcagtcaggcaaagcagatacacgtgcttcttttcagctttgttggaaggtttcattttgcttcavgaactaggcaggagaattcctgagttcctgtacaacctgagttctctgttaaaacaaggaggaagtaatcatcctgagttcgatgattcagagtaagcca

SEQ ID NO: 41045 - DNA, 201 bp, Homo sapiens
tcagagtaagccatttaacttgtagagctttgggactaacaatgatccctttttggagtccttaattactaaaattatcagcatatttagagttctgaagwtgctgaacccttattgtatctccccagggttagtgagtaattgggaatagtgttccatcttggatgcccccatccactaaccagctttcctcttcgggtg

SEQ ID NO: 41046 - DNA, 201 bp, Homo sapiens
acagatctagaaatgtaatggagccagtcctagggaaacaggactaccaggaatcctcaccagccccgcaaagacgagggagcagcaagttccaaagcccrtggcatgtcaagggtcgatgaattcaccaactgcaaggggctttggtgaccccagtgaacagatgagaaaggggaggaggctgggatcagtgcacagctt

SEQ ID NO: 41047 - DNA, 201 bp, Homo sapiens
agccccagttgttttgaagcatgtcctatcattaacacaggtaatcaggatatattcattgaagtctcactgtgtgccaggcactatgctatgcaccttaygtgtgttattttatttcatccttccagctctgggaggtgatgactgtcatctgcattttgcacatgacaaatctgagggtcagagaacttgcccagggtc

SEQ ID NO: 41048 - DNA, 201 bp, Homo sapiens
agaatttggggagattctgctctaaagggaaaagctttgtaaaggagaattaccagtagagtgaccttataatttaccatccaatggattttgaatacttytgagagagaaatgagatactgataataattataccaagacaacagacataaattgggattggcctagacgagcaaagatgaatggtcattctgtctgtta

SEQ ID NO: 41049 - DNA, 201 bp, Homo sapiens
caatcacttactaactgcattgtgggttaacacagtgtgtgtgtgtgcacttactaactgtgcaactgtgggcaagtgatgtaatctctctggagctcgtytttccttttttcttttcctttttttttttttttttttttttttttttttttgagatggagtctcactctgttgcccaggctggagtgcagtggcgcaatc

SEQ ID NO: 41050 - DNA, 201 bp, Homo sapiens
ggtgcaatcttggctcactgcagcctccacctctgcctcccaggttcaagtgatactcatctcaagtggtttctacctcattaaaacaaacaaacaaacascactcaccatttttgtggtgggcatggtggctcatgcctgtaatcccagctctttgggaggccaacgcaggtagatcccctgaggttgggagtttgagac

SEQ ID NO: 41051 - DNA, 201 bp, Homo sapiens
gcagctgacggccaaaggggaagctgagaacagcaaagattcaactgaaaacattttagggggttcctgacttcaggcctcttttcagaatgagggaattrtctaaaatcccaaatgcattcttagctaaggtcagtgtgtctgggtctgtgtcaggcatgtagcagccacagcaaacttctcttgagatagcatctcctc

SEQ ID NO: 41052 - DNA, 201 bp, Homo sapiens
aaacatctaagtttccattccttataactgattatttttcttgggatcaattctggtcttcaccatctgccaatgtgagttttagtttctctataaacttktaaactttaaactttttttcttttttttttgggggggggggcaatccattcttaacccccttccagtttttctcagcctattcttgtttgtttttgtttt

SEQ ID NO: 41053 - DNA, 201 bp, Homo sapiens
agggatggttctgtggtgtcccacactcaaataaacatcctttaaatacctctagatgcttataattcctgttgcagccttagtcagtgggagccactgasctgcattcgtgtaggaactgagcaaggttcatctagtctcggtagctagctaccccgagagctggctgattttttttttcttaaatttaattcaagactt

SEQ ID NO: 41054 - DNA, 201 bp, Homo sapiens
tcactggctatgaaaatggccccaaataaagtggtatccacacttcttctttctcctacgaatttggaggtctaggaacgggggtaagcctatatggtcakaattagcctgcaaacgtgaattaatatgcagaatctgtccccactgtgatagaatttgccattcgcttcctttgctaaatggcttgcagtggcagctgac

SEQ ID NO: 41055 - DNA, 201 bp, Homo sapiens
catattctgggagaaacatctaagtttccattccttataactgattatttttcttgggatcaattctggtcttcaccatctgccaatgtgagttttagttyctctataaacttttaaactttaaactttttttcttttttttttgggggggggggcaatccattcttaacccccttccagtttttctcagcctattcttgt

SEQ ID NO: 41056 - DNA, 201 bp, Homo sapiens
ctctagatgcttataattcctgttgcagccttagtcagtgggagccactgacctgcattcgtgtaggaactgagcaaggttcatctagtctcggtagctasctaccccgagagctggctgattttttttttcttaaatttaattcaagacttcatgaagtcaacaaaatggtctgttggaaattattcctaacccccaacc

SEQ ID NO: 41057 - DNA, 201 bp, Homo sapiens
aatgtttctattcttctgttctgttcttaaagtatgcctgtaattattaggatataattaaggattctgtcttatttattttttaatcttcttactgtgtytatcttttgtctttctccatattctgggagaaacatctaagtttccattccttataactgattatttttcttgggatcaattctggtcttcaccatctgc

SEQ ID NO: 41058 - DNA, 201 bp, Homo sapiens
ttagtcagtgggagccactgacctgcattcgtgtaggaactgagcaaggttcatctagtctcggtagctagctaccccgagagctggctgatttttttttycttaaatttaattcaagacttcatgaagtcaacaaaatggtctgttggaaattattcctaacccccaaccactgtcactgccacaatcaaacatattttc

SEQ ID NO: 41059 - DNA, 201 bp, Homo sapiens
aagaaagtacacaaatggagagagggggaattggacatgccattgggagaacaaatttatttagatatctttggctgtgttgacagaagctgcccaattawacccaatatacaaattttaaatgcatattagtcaaagttccagttatgtagctttagaaaaatttctatgtgaatgactacttttccctgaaatacgtcc

SEQ ID NO: 41060 - DNA, 201 bp, Homo sapiens
attttaaatgtttctattcttctgttctgttcttaaagtatgcctgtaattattaggatataattaaggattctgtcttatttattttttaatcttcttaytgtgtctatcttttgtctttctccatattctgggagaaacatctaagtttccattccttataactgattatttttcttgggatcaattctggtcttcacc

SEQ ID NO: 41061 - DNA, 201 bp, Homo sapiens
atctacgatgttttctttttgatttttttatgtcattttaaatgtttctattcttctgttctgttcttaaagtatgcctgtaattattaggatataattawggattctgtcttatttattttttaatcttcttactgtgtctatcttttgtctttctccatattctgggagaaacatctaagtttccattccttataactg

SEQ ID NO: 41062 - DNA, 201 bp, Homo sapiens
caaattcaaaataccgtttacattgggaaagggaaaaaggagagaaatatatgagagacgtatgctgggggtatctacgatgttttctttttgattttttwatgtcattttaaatgtttctattcttctgttctgttcttaaagtatgcctgtaattattaggatataattaaggattctgtcttatttattttttaatct

SEQ ID NO: 41063 - DNA, 201 bp, Homo sapiens
cattggataaatatcaaattcaaaataccgtttacattgggaaagggaaaaaggagagaaatatatgagagacgtatgctgggggtatctacgatgttttytttttgatttttttatgtcattttaaatgtttctattcttctgttctgttcttaaagtatgcctgtaattattaggatataattaaggattctgtcttat

SEQ ID NO: 41064 - DNA, 201 bp, Homo sapiens
aggcagcacagtgctgtaatggaaaccataagggcacgcacaatggctcatgcctgtaatcccagcactttgggaggcagaggcgggaggatcacataagrccaggagtttgagaccagcctggccaacatggtgaaaccccatctctactaaaactacaaaaatagccaggtgtcctggtgcatgtctgtaattccagct

SEQ ID NO: 41065 - DNA, 201 bp, Homo sapiens
attaggagcatcatagctaatgtatgctcagggcttactgtgtgctagacattattctgagtttacacagtgatgtcagatttctcctctgtcacagtaarttccaaaagatagtgaagaatattgcagtgaaaacactgaaactcacatatttcatactcaggggtatcttttaagtgtgaagcaagagaaaaaaacgtg

SEQ ID NO: 41066 - DNA, 201 bp, Homo sapiens
tttcccttttttttttaactattcttctttagagtttgttttctcattgaacttgtgatgtacacattaaaggaaaactcattaatgtggaaaattaggarcatcatagctaatgtatgctcagggcttactgtgtgctagacattattctgagtttacacagtgatgtcagatttctcctctgtcacagtaagttccaaa

SEQ ID NO: 41067 - DNA, 201 bp, Homo sapiens
ataagcatatttatatatatatacacataaaacatatatgtacatattatcataatgcctacctgctcttgagaaagtagtgccgtatggctgggggtttytctcactggtttctatggctctcccctcccccactttttctaagaagtggtagtacctatctgactattttcttggctgcctgaagaggcctcaaaatta

SEQ ID NO: 41068 - DNA, 201 bp, Homo sapiens
ttgttgtaaactcgtcctgccgcctggactagttacgcttcccttgattagctctgagaaacgaggcagcgggcactggggcagccacatagacaacatcyaaatttttgttgctttcctgggtcttgccctgtccttactgtttcccttgggcacgctgttcaccccttaggacatactacagtaaccttttcccaccac

SEQ ID NO: 41069 - DNA, 201 bp, Homo sapiens
catttaggcaatatgaccgtgtacaggattctaccaccatcgtcaccatcagtgttactgttccctgccatctgcctatggggtgtctaccatctaaagtycagcactgcactgggcatttttaaattatcattagtatataattatatataataataatttaatttataactatatcatttattaaggtcctactatata

SEQ ID NO: 41070 - DNA, 201 bp, Homo sapiens
tcttaatacaaactggcgtatgttatagttactgtcagttgttgtaaactcgtcctgccgcctggactagttacgcttcccttgattagctctgagaaacraggcagcgggcactggggcagccacatagacaacatctaaatttttgttgctttcctgggtcttgccctgtccttactgtttcccttgggcacgctgttc

SEQ ID NO: 41071 - DNA, 201 bp, Homo sapiens
cccatgtgtgtatgtctaacccagtgacaggtaaggcagccaggagctgctgttatttcagtgcaaagctgttttcacaatcacagacatgcacagctcaraaaccctcacaggtcacgcctgaataccttcaatgtgccccatgtaaaaatacactgcaagtcgattggacatgccctatgaattataccttatttatga

SEQ ID NO: 41072 - DNA, 201 bp, Homo sapiens
ggctaaatcaaatttagctgttcccccaactgcaaagtacataggcatcaagtgaaagggtaaatgcatgaaaacctgaatggctgatcctctaagacagkgagagcagatgttaattgctcactgtccaagtgctgggctctgtgataagagcttcacgcagatgacatcaaagcaccatgtgtgggggaagcacgatga

SEQ ID NO: 41073 - DNA, 201 bp, Homo sapiens
ctggagggtccaggagccccctgaactgagtatccggtgggaggtcagatttccgcattcagaacgagagctcatacggcatccacgcgtgtctttctcaygcatatccccagcccgagtagaagaggacttctgcatctctgttagttctttctcctcctaagaaaaagcagattttaagtaacttatcatttgttcatt

SEQ ID NO: 41074 - DNA, 201 bp, Homo sapiens
catcacgacagtaacaaatatcttagccaacagaacaaaaaatgttcctggtgagaacagccagggattctggaattgactgctgtagttcagaagagatktggcttcccacagggcattgtagagctttatgctgaaaaggtggccccagaggtctgtgtgccattgcccaggtcgagtctgcagtacaaactcctagga

SEQ ID NO: 41075 - DNA, 201 bp, Homo sapiens
ttattcactatcacgaggatagcgcaggaaagaccggcccacatgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcc

SEQ ID NO: 41076 - DNA, 201 bp, Homo sapiens
ggttagctcattgactctacaactctgttttcctcattcattcattcctctaatcaatatgtattgctcacttggtacatgtcagatactttcctaggtgytggggagaaacaagcaaagtacttcagggcctgtattagtttgtttttcacgctgctgataaagacacacccgagactgggaagaaaaagaggtttaatt

SEQ ID NO: 41077 - DNA, 201 bp, Homo sapiens
tcccctttccaatacatctctctctctctttctctctctctctctctctctctcacacacacacacacacacacacacacacagccaaatcagacaccaayataaactgtagagttaacattctttttccaccctcacactttttttagctccgatctgtgttcaatttctgcctgagagagtgatatattcatatattta

SEQ ID NO: 41078 - DNA, 201 bp, Homo sapiens
aggcttcgtgttgtttgtaaatttgtgaataaatctgttaaagaaatattggattcatattcaacttggaaaacagggaaaggccttttattgcatgcttwgaagtttgaatacactttcagtagctcttcgttatctcaaattaaatcttaaattgagcttgtggttctgtgaattaatactccagcctttcagccctgc

SEQ ID NO: 41079 - DNA, 201 bp, Homo sapiens
aacatggtgaaaccctgtctctactaaaaatacaaaattttttttgtattttgggattcggtttaggtgatgtgtgtctgtaatcccagctacttgggagrctgagacaggagaatcacttgaactccagaggcagaggttgtagtgagccaaacttgcacaactgaactccagcctgggcgacagaggaagactctgtct

SEQ ID NO: 41080 - DNA, 201 bp, Homo sapiens
tgcatgccctccaacagtggaagtggtgccctgaatacgccagaaataatcgtggagtcaacgaagatctgggagtattgtttggagacatctcagtattsctaattcattttcccatccttaaataaaaatctttcttactgatgatctgagaacttcttgtaagccccatttccatgagtagagttggccattgcccac

SEQ ID NO: 41081 - DNA, 201 bp, Homo sapiens
tctacaaaaaatacaaaaattagctgggcttggtgacagacgcttgtagtctcagctactcgggaggctgaagtgggaggatctttagagcccaggaagtytaggctgcagtgagccatgaccttgccactgcacaccagcctgggtgacagagggagaccttgtctcaccaaaaaaaaaaaaaaaagagagagaggttga

SEQ ID NO: 41082 - DNA, 201 bp, Homo sapiens
ttatcattcctttgataaccgtgagcacctgtcatgggcctggcactctagtaggctctcaggatgcacaatgaccctgtccctgcttgctggagacatargagaagcccccagccactgacatctgggtgttgtaagaaagcaagaacagtcatggacactgctaagttttgatgccaaagagccaaatttgcagtacca

SEQ ID NO: 41083 - DNA, 201 bp, Homo sapiens
ttctcatgtacttactttaaatcagagagcccacctgtccaattctagcttctcctgggcatcctgtatttgacacagcccctcccagcattctgagtcaycgtctgctgctcttgcactgtccgttttccaaatgaggaactcatcggtaaggccagaaaggaaagggagaaaaaacaaacaaacaaacaaacaaaaaat

SEQ ID NO: 41084 - DNA, 201 bp, Homo sapiens
agcttcccaaagaagagttgtggagaaggaaaagtgaaggaaagtaccttactaagtcattgatggcacattcagcccttgtcaaagtcaaagaagaaatytggagaaattctcaccactgtgcttaggagtcaccctgaactatttcttggatgaaattaccaccctcccacttttggcaatgagacagcaagcttggaa

SEQ ID NO: 41085 - DNA, 201 bp, Homo sapiens
gtgttctgcgaatcccggtctctactaaaaatacgaaaaaaattagccaggtgtggtggtgggtgcctgcaatcccagctactctggaggctgaggcaggrgaattgcttgaacccgggaggcagaggttgcagtgaacccagattgcgcctctgcactccagcctgggcaaaagagtgacactctatctcaaaaaaacaa

SEQ ID NO: 41086 - DNA, 201 bp, Homo sapiens
ggcttttattggccagtatattcaatgattcacttgcacctttaaccttgtgttgttctaatctttttttttttttttttttttttttttttttttttgaracagagtcttgctctgttgtctaggctggagtgcagtggcaccatctcggctcaccacgagctctgcgtcgtgggttcatgccattctcctgcctcagcc

SEQ ID NO: 41087 - DNA, 201 bp, Homo sapiens
agagtgacactctatctcaaaaaaacaaaacaaaacaaaaacaatttggctccagtgagctcattttacgttgtatgtaccagtatgcaagtgttgtatgsatgtgagcgtctgcgtaggtttttatttttctctctcagaatgaaaggtttgattcgtaccagctccccatcccttcccacgatcccatcttaatgtctg

SEQ ID NO: 41088 - DNA, 201 bp, Homo sapiens
tccatatttatttttctccaccttgggtgaaaaaacttcgcttttcgtaatgtggtacagtgtgtgcttctgtaaatggaaatggtttcagcacatcacartcatgcttccctgttgaaagatgctccgttttcccgcatacatgatgtccagcacaacgtctgatttatgagagcatgaccctgggggcctctggaacag

SEQ ID NO: 41089 - DNA, 201 bp, Homo sapiens
ggatgattagtatattcttatttggcctgggagggaaaaaaaatctttcatttccaacaatattcattctctgtgtcacctcagcatttaatttacttccrtcacaaaactacttgaagttgtcccaggctagttggtcctattaattacaacctagagggattctattagtaaactaatggattacagtacctaaatgga

SEQ ID NO: 41090 - DNA, 201 bp, Homo sapiens
atatattttcaattcgatatgatagctttactgtaatgaaagaaaaaataactgaaacaaaatggcgtgtgtttcaacatgtaaatgcttgggccaggctrcaggaaagatggggatgtatgtatccgtggatgaatcaccttgaatggactctcataaaaaagcccaccattaccaggtgtgtggtattgcagactccag

SEQ ID NO: 41091 - DNA, 201 bp, Homo sapiens
ggccatacttagtggctcacgcctgtaatcccagcactttgggaggccgaggtgggcgcattgcctgaggtcgagagttcgagaccaccctggctaacatkgtgaaaccccatctgtaataaaaatgcaaaagatagttgagcgtggtggcgcatgcctgtagtcccagctactttggaggctgaggcaggagaatcactt

SEQ ID NO: 41092 - DNA, 201 bp, Homo sapiens
aaaatcacttttaaaaaatgtatggtgtccatctgggttagcaaacacatgctcacacgtctgtgcttgctggatttttaagaacttaccagcatttaagrttttcttatgaaactgattttactcaccagggatagagtctcaaagttggaggtattttatgttgttttaaataatatcgtcatcacatgtcattttaga

SEQ ID NO: 41093 - DNA, 201 bp, Homo sapiens
gtttccaatgataacagccatctgacttgatcggagttctatggattttcactaaaatagaatcatcgccttggtgatggatagaaaaagtaaagcaatayatcctgataaatgctgtgccttcctccttcgtctctctggcggtgaccttgtgcaatccataagagggcaaggctgagagccccggccaccgccgccgtg

SEQ ID NO: 41094 - DNA, 201 bp, Homo sapiens
taaaactctgcctttctaaagaaacagggacacggtgcagaaaagttcatctggagttaggcttgtgtcttgctgtctctttaacggagagttcatgggcwgggtacagtctgtgagaaggaatgaaaaccccagggtagatgctaacaaaaatcacttttaaaaaatgtatggtgtccatctgggttagcaaacacatgc

SEQ ID NO: 41095 - DNA, 201 bp, Homo sapiens
ggagggaccgggtgggagaatattgaatcatgggggtggttcccccatactgttcttggggtagtgaatgaatctcatgagatctgatggttttataaggsggaaacacctttcacttggctctcattttctcttgcctactgccatgtatgatgtgcctttcgctttgcactatgattgtgaggtctccccagccacgtg

SEQ ID NO: 41096 - DNA, 201 bp, Homo sapiens
aattatagctcaaatttaattaaaatagcttttattgcttctattcatgtgtccctggattttaagtgatgcatcagaatttcatgatgagcaaatgcctrtggatgccctcatttctcatccttcttgactgtctgctaagattcactcttggtcttgtctttgagcttttctgttcagtgatgtaatgggacaggctct

SEQ ID NO: 41097 - DNA, 201 bp, Homo sapiens
aagtaccaaaacaaaacaagaaacccagaattatagctcaaatttaattaaaatagcttttattgcttctattcatgtgtccctggattttaagtgatgcrtcagaatttcatgatgagcaaatgcctatggatgccctcatttctcatccttcttgactgtctgctaagattcactcttggtcttgtctttgagcttttc

SEQ ID NO: 41098 - DNA, 201 bp, Homo sapiens
taataaatatctgctagtttttaaagtttgagaaaaacccgtattgtggaatgaaaatgatactgacaaggaatacatctagatcagaaatactgatatcstaagtgagatcttgttttttaaaacaaaaaaaagtttaagaaattgtcatataggctgggcgtggtggctcacacacataatcttagcactttgggaagt

SEQ ID NO: 41099 - DNA, 201 bp, Homo sapiens
gcactgttccaactccagtctggctgctttttcaacctggggctttagtcatgtcaatattcctgagcttccatgtgcttatttgaaaaataggaagattygtccagtctcaaggaactatgataagtagcaaacaatatcccagaaaaatctccagtcaaaaatccactggaggccaggtgcgttagctcatgcctgtaa

SEQ ID NO: 41100 - DNA, 201 bp, Homo sapiens
gcatcattgcaaagtattagaaagggccctgcctgggctaggagccagaagcattcttcagttcccaacggccatccagccactcattgctgtgtgagctstggctggtcagtaagaacctttgatcccatgtttctttatcttcttctttttttttttttttttagccatagtctcactctgtcacctaggctggagtgc

SEQ ID NO: 41101 - DNA, 201 bp, Homo sapiens
gatcaagcagagggcaagtggtagattctagaatttgcatccaggcagttgagtctagaattgtctttgtgtattttgctccatggtctagcacaggatcmccattggtagatcatcacttagaatgccatcactaccttctaacagcaatcagtccccttaagtggctttcttctcttttttttcttttatctttttgtt

SEQ ID NO: 41102 - DNA, 201 bp, Homo sapiens
cacctgcttcccattggccagaattcagtcacatgatcacaaccaactgcaagggattctgggaaatgtagtctggtgatgcctcgaggaggcaagagaartgttttcagtgaacacattgccttctcaggcttgctttctattgtagattgcttacaatattgcttttaaattgcatggtcttgtacaaatgatacgagt

SEQ ID NO: 41103 - DNA, 201 bp, Homo sapiens
tatatctgtatctatatctaatctattttttgagaaaggctctcactctgttgctcaggctggagtgaagtgatgcaatctcaggtcactgcaactgctgyctcatgggatcaagtgatcttcacacctcagcctcccaagtaactgggaccacaatgcccagctaatttttatatttttttgtagagacggtgttttgcc

SEQ ID NO: 41104 - DNA, 201 bp, Homo sapiens
cgtatgcactgacagaatggtacatcccaccactgctctgtgtctgtgtgcgactgtcagctgctctctactgctcctcatagacttcctgtctgcctttytctgcatttctcagtctccccatctccccttcttatctaatccccttccttcctctctcaactcttccttcctctatcctttttctttcccttttttttt

SEQ ID NO: 41105 - DNA, 201 bp, Homo sapiens
catcgcgattcatttgtcccattgggccatgggataggtgactacagagccagattcgaatgtggccctgtgccggtgcccaaaccagcaggctgcacgtrtgcactgacagaatggtacatcccaccactgctctgtgtctgtgtgcgactgtcagctgctctctactgctcctcatagacttcctgtctgcctttttct

SEQ ID NO: 41106 - DNA, 201 bp, Homo sapiens
gattgtccacagctctgctctctgctcaccccggggatttagcagtaacagaatccacactagaaggacagagtgctgtacagacagaaggaaagacgcasacccaaaccttgataaccatggcaatgcaataggaaatctctttatttcgttggtgctcaagtgataccattaagtcccttaagatgcggaatttccttg

SEQ ID NO: 41107 - DNA, 201 bp, Homo sapiens
cctcagcctcccaaagtgctgggattacaggtgtgagcctctgtgcccggcttctgccagcttctcattatgatttttgagcagatttcgctgctttttckgcctttgttgtgtttataaactagaagtaattatgtcaactttgtaagggctcagtagcgtagaataaggccatgtctgtaatctccccttctgtgaaca

SEQ ID NO: 41108 - DNA, 201 bp, Homo sapiens
agtcacgtagaaagcagttattgtttccaagttccctgcccttgttaaatgtcagctttgagtgaaaatgttcctaattttactcagagtgcaaagaacayccaggtcaggtacctgacctgcttgattcatgtcttggaaacactcctttgtctttcagagaaagtaaagagtgatggagacagagagagaaagtgtgac

SEQ ID NO: 41109 - DNA, 201 bp, Homo sapiens
taatctttcccacctttttgattgtgagtcttcagaccctccccagagagtcagtcctgccttatgccctggggaaaggaatgctgacctcatgaagctcycataaaaacccaagagggctgggtttgggagcttccagatagctgaagacaaggaggttcctggagcgtggctgcctaggaagggctggaaagctccatg

SEQ ID NO: 41110 - DNA, 201 bp, Homo sapiens
actaccatcccatttgggccaacctcttttttttttttctttttgtttcgagatggagtctcgctctgtcaccaggctggagtgcagtggtgcaatctcarctcactgcaacctctgcctcccgagttcaagctattcttctgtctcagcctcctgagtagctgtgattacaggtgcgtgacaccacaccccgctaatttt

SEQ ID NO: 41111 - DNA, 201 bp, Homo sapiens
gacgtagtcttgctctgttgcccaggctggagtgcagtggtgtgatttcggctcacagcaagctctgcctcccaggtttacgccattctcctgcctcagcytcctaagtagctggtactacaggtgcctgccaccacgcccggctaattttttatatttttagtagagacagggtttcaccatgttagccactttggtctc

SEQ ID NO: 41112 - DNA, 201 bp, Homo sapiens
ttttttttgtatcacaaaagttacattttttttttttttttttttttttaagacgtagtcttgctctgttgcccaggctggagtgcagtggtgtgatttcrgctcacagcaagctctgcctcccaggtttacgccattctcctgcctcagcctcctaagtagctggtactacaggtgcctgccaccacgcccggctaattt

SEQ ID NO: 41113 - DNA, 201 bp, Homo sapiens
ggggggtggatgtaggagagaagttgaaattagctggggttttttttttgtatcacaaaagttacattttttttttttttttttttttttaagacgtagtsttgctctgttgcccaggctggagtgcagtggtgtgatttcggctcacagcaagctctgcctcccaggtttacgccattctcctgcctcagcctcctaagt

SEQ ID NO: 41114 - DNA, 201 bp, Homo sapiens
attcgtggtcatttggaaagaaaagtatgttaagacaaaatgagcaggtggttggattagtattttctttctacacatatagaaactgttcctatcatacstgactcagttttcaaactggcttaatccaaagcctggggggtggatgtaggagagaagttgaaattagctggggttttttttttgtatcacaaaagttac

SEQ ID NO: 41115 - DNA, 201 bp, Homo sapiens
aaatttctgtgtcttcatttgcaactctcttttctccagtaaagaggaaagtgtatagttctcctttccttacagaaacattattttgttattgttgtttkggtttgggtttctgaagtataaatgcatatgaactggacagaaggattatgcccatgtgccaggtggccaagatggggcttgtgatttgaagcttctttt

SEQ ID NO: 41116 - DNA, 201 bp, Homo sapiens
gaagaaatagcctcattagtaacttttctgtaagcaatctccttatttcttgttttttgttcttttgttttttgtgtgtgcttctgcgtgcacctcctctrtggctccccccaccaaatttctgtgtcttcatttgcaactctcttttctccagtaaagaggaaagtgtatagttctcctttccttacagaaacattattt

SEQ ID NO: 41117 - DNA, 201 bp, Homo sapiens
aaagtattgcttcttaagcctgggccaagtgtgtagacttgatagaattctgattaatgcatcttattacattaattttagaagaaaccagaaggcatttytcctattcctagtgcaggccagcctgccagaagcatttgcctccttaaagagctaatatcttcagctaccaacaatcataaaactgaaagatctatcgga

SEQ ID NO: 41118 - DNA, 201 bp, Homo sapiens
gagtaaaagtcctttatgattagcaaattgcaggtcctcccctttctgatatttacagcccttgcaaccgcctgtacaaaaatcgggaaaaggcagaagasggctgtcattaatgtaaaagcagctggttacctccccctccccagcgcacacatcacctcctagtacaattagtcaccatgtcttttcccttccgtcaag

SEQ ID NO: 41119 - DNA, 201 bp, Homo sapiens
gatacagatttcactatccatgaattgtggccttaactttctcatgtacttactttaaatcagagagcccacctgtccaattctagcttctcctgggcatyctgtatttgacacagcccctcccagcattctgagtcatcgtctgctgctcttgcactgtccgttttccaaatgaggaactcatcggtaaggccagaaagg

SEQ ID NO: 41120 - DNA, 201 bp, Homo sapiens
cttcaaccctgactctgattcacaaagaatagggaagcttagccaactgcagtttcaaagtattgcttcttaagcctgggccaagtgtgtagacttgataraattctgattaatgcatcttattacattaattttagaagaaaccagaaggcatttctcctattcctagtgcaggccagcctgccagaagcatttgcctcc

SEQ ID NO: 41121 - DNA, 201 bp, Homo sapiens
agagtaaaagtcctttatgattagcaaattgcaggtcctcccctttctgatatttacagcccttgcaaccgcctgtacaaaaatcgggaaaaggcagaagmcggctgtcattaatgtaaaagcagctggttacctccccctccccagcgcacacatcacctcctagtacaattagtcaccatgtcttttcccttccgtcaa

SEQ ID NO: 41122 - DNA, 201 bp, Homo sapiens
tcactgtccaatatggtagccacgtgtgactattaaaatgtaaattaattaaaattaaaagttcaattgctctgaaatagcagccacatttcaaatcttcwgtagccagatgtggttattggctaccatattgggtagcaccgatatagaacatttctaccatagtagaatgctcttttggatacatctgctttaaagcat

SEQ ID NO: 41123 - DNA, 201 bp, Homo sapiens
ttcccctaaccctctgtaatccctggtggagctaaggaatgaaaagttgcttaaacattttcctgttgccagtttttcttaaacattagtgctattctttyttttttttttttttttttttttttttccttcttcaaccctgactctgattcacaaagaatagggaagcttagccaactgcagtttcaaagtattgcttct

SEQ ID NO: 41124 - DNA, 201 bp, Homo sapiens
atgcatgacctgtgcaatgcacctgcttcggtgcctggcacagagtcgcaaagccacaaagatggtgcttgttggttgtatgtgttgtttccatctgataycaccattgaggggagcaagatgacatgtgcctaccccacgtgtccagcagcaaagccacctggcatagtgggctgctcagcgtgcctggttcatactgcg

SEQ ID NO: 41125 - DNA, 201 bp, Homo sapiens
tcacattaaaagcacaaccaaattgtagtacaatgttcaggacacttttatgtcactttaaaatgtagagtatcatctaaaaatgagcaattgctgtgaaraaactggggttggctctgattttgtggctcagttttttttggtttcttgagaagatcatctttaagtcaaaagttatgcaatgccaagtactcatctgtg

SEQ ID NO: 41126 - DNA, 201 bp, Homo sapiens
ataaaaataaaaagtcaaaaggaaacaaacaatgttgctgagaagtgatagaatattctagtttatatctcagtcattttacagctctggcatttctgggkaacactttagaatacttccactccggttggtccataaaaagctgcctgtgtttttatgttttgaaaatacacgcagagagacccactgcatgtcctatta

SEQ ID NO: 41127 - DNA, 201 bp, Homo sapiens
gctgttcctgctgttactaactggagtacattgcatgaaaccttgctgtttccttaaaccctgcaccgacctttacaaacagtgcctttactaaacacttyttacgttacccgttttgagtgtaccatctgcctcttgccaggaccctgaccaagaatttgaaatctcagaccatgatgacctccttgcccaatgcgtaag

SEQ ID NO: 41128 - DNA, 201 bp, Homo sapiens
attttaagcaactgacccttgggataaaaataaaaagtcaaaaggaaacaaacaatgttgctgagaagtgatagaatattctagtttatatctcagtcatwttacagctctggcatttctgggtaacactttagaatacttccactccggttggtccataaaaagctgcctgtgtttttatgttttgaaaatacacgcaga

SEQ ID NO: 41129 - DNA, 201 bp, Homo sapiens
cccccaattctataggttctattatatctccgctggtttaaggcaactgctgtttcttttaggagttttcttttctttccttgctgaatatctgcacttascaatactgcccaggcacatgggctgtggctcaagttttcagtgcaggacagtgtgtcattgcaggagaagacagaacccggccagatcctcccgctgccg

SEQ ID NO: 41130 - DNA, 201 bp, Homo sapiens
ttcaccatgttggccatattggtcttgaactcctgacctcaagtgatcctcccgcctcagctgcccagggtgctgggatcacaggcgtgagccaccgtgcrcgacctcagggtcccttctaacctgtgctgttgtcataaaccctggaggagaagcaagatctttctagcaggagcaacatcatcccaaataaagtgatag

SEQ ID NO: 41131 - DNA, 201 bp, Homo sapiens
aggatgggtgctttgtggcccttttcttttaccggctgactagaatgttgacgttaaagcagttagagtccgagcaggcaactccgaccccaagttggagmtgtgtgttgaagatagaagagcaaatatgtagaaggaacctggatttctatttttttaaaaaatataataaatcatccagccccaaatgtcaggaacctg

SEQ ID NO: 41132 - DNA, 201 bp, Homo sapiens
gagcactggatacctagactctgctgggctctagagaagtgctgggctacagcgcccagtgccctacctcttggggccagccagcctcaccaaaaaatcasgcttctggcttgctccaaactcaggaagttgctgggaagtctggctagcaacaccctcattcccagtcctggccatgcctctctgctctccctagcacag

SEQ ID NO: 41133 - DNA, 201 bp, Homo sapiens
acgaaactcacatcttctttaaataaaatctccatttagaaatttttgaagacttgtggatagaagaagtaaccttgaaaagggcagagctgagccagacmccttttcagctgggtgctccctggaagatggatcttgccttgtggatgtttttctaccgtgacagaagatagaaaggatgaaatagaaagagtgtgagtg

SEQ ID NO: 41134 - DNA, 201 bp, Homo sapiens
ttttttttttgtattgtttgtatttttcatgtttttcgtagagtcagggtttcacagtgttatgcaggatggtctcgatctcctgacatcgtgatccgccygcctcagcctcccaaagtgctgggattacaggcgtgagctgacgctcccggcctacagcatagatttgaggcatcttgaaggtagatgcagaagagtggg

SEQ ID NO: 41135 - DNA, 201 bp, Homo sapiens
cgaaactcacatcttctttaaataaaatctccatttagaaatttttgaagacttgtggatagaagaagtaaccttgaaaagggcagagctgagccagaccmcttttcagctgggtgctccctggaagatggatcttgccttgtggatgtttttctaccgtgacagaagatagaaaggatgaaatagaaagagtgtgagtga

SEQ ID NO: 41136 - DNA, 201 bp, Homo sapiens
ccgccacctcgcctggctaatttttttttttgtattgtttgtatttttcatgtttttcgtagagtcagggtttcacagtgttatgcaggatggtctcgatytcctgacatcgtgatccgcccgcctcagcctcccaaagtgctgggattacaggcgtgagctgacgctcccggcctacagcatagatttgaggcatcttga

SEQ ID NO: 41137 - DNA, 201 bp, Homo sapiens
tagtcattttcagagacaaaaatttgggaaaaggattgtagaatgactggcttcccaaaaccacttggtgtttacaaagttatcaaaaacgggctgggacyactgatggtaataacaaaacctggggccctgaatcgtgtattctacatccgttagcacactgaagccacaccgcaaacttgtgaggccagcgttgcttcc

SEQ ID NO: 41138 - DNA, 201 bp, Homo sapiens
agagaataaggtgttggtttgttataaggtggtcctttataaagtttagacctattttaataaggctgacttgggttgaagataactagagccatgacttycatcttgatggacaatgagtactcactctacttttttagtttatatttttattttagttcatttcatttaagacagcgtctgttacccaggctggagtgc

SEQ ID NO: 41139 - DNA, 201 bp, Homo sapiens
gcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgaacgtgagaacccc

SEQ ID NO: 41140 - DNA, 201 bp, Homo sapiens
tgcctcagcctcccgagtagctgggattacaggcatgcgccaccatacctagctaattttgtgtttttagtaaagacagggtttctccctgttgttcaggstggtcttgaactcctgacctcaggtgatcccgcccgcctcggcctcccaaagtgctgggattacaggcatgagccatcgcgcccggcctagcctccaaca

SEQ ID NO: 41141 - DNA, 201 bp, Homo sapiens
gtggctgaaatgagactctttcacactgtttaaagatgcatgtgcatatgttggtgtccacacatcaacttaattttttcatgttccttgaaggaagcccktctaggtccttctgaaagaagggctggagatttttattaaacattacttctaggctgggtgcagtgactcatccctgcaatcccagtactttgggaggcc

SEQ ID NO: 41142 - DNA, 201 bp, Homo sapiens
cagagccagctcaagaacccagcgccagtggctgatgcttcttctttttttttttttttaatggattcttctaaggatggctgcatcagccaggggcagcrggtcatacctgtaatcccagcactttgggaggccaatgcaggcggatcatctgaggtcgggagttcgagaccagcctgaccaacatggagaaaccccgtc

SEQ ID NO: 41143 - DNA, 201 bp, Homo sapiens
gcaccattgcactccagcctgggcagcaggagcgaaactccttctcaagaaagaaggaatagctgcatcacttatgctcttgatggtacagaaaatgatcygcatggaggaaatctagacatcagcgattcagagtcaaaatgttattcaggggagagagacccttcatgtgaagaaattttaggaatactttaattattt

SEQ ID NO: 41144 - DNA, 201 bp, Homo sapiens
ggccaggagtttgagaccagcctggccaacatggtaaaaccctgtctccactaaaaatacaaaagaaattagctgggcatggtggcaggtgcctgtaatcycacctacttgggaggctgaggcaggagaatcacttgaacctgggaggtggaggttgcagtgagccgagattgcaccactgcactccagcctgggtgacaa

SEQ ID NO: 41145 - DNA, 201 bp, Homo sapiens
gtcttcgtaatatagctagtttttgtccattcattttgctttgacttccttgtataggtacaaaggtgtaagtaggagagtctaccaggcagcacacagaygtggccctgtaaccacccttgtgtaaaatcagagtaatcctccctatccttgcttatttcactgggttcatgggtgatgactgtaaatgacacaggagac

SEQ ID NO: 41146 - DNA, 201 bp, Homo sapiens
gcgatttaatttgctgctgaatgcacttttgaataaagggcctagaagatgcagtctcgaggaaccgaggccggttagagacaggctggcagctttgcctyctctcccaagacaaaggcctccccgcccccctaaatccagcacacaatcagctgctctccctccccctattctcagcaggagagtcaggatgcatatttc

SEQ ID NO: 41147 - DNA, 201 bp, Homo sapiens
gacagatgaatactcagggttttttttttttttttcttctaacttgtcctccttgatcaggatttctcaaatgcacatttgtctaatatactgttgaaccrtgcaagtaccaaaacaaaacaagaaacccagaattatagctcaaatttaattaaaatagcttttattgcttctattcatgtgtccctggattttaagtga

SEQ ID NO: 41148 - DNA, 201 bp, Homo sapiens
tcgctgcaggctacttggttgtacttgagtaatttactcaagattctcttcagcccagtttccttatctgtaaaatccttccactgttgttaggaggatargaaagccagtattggtaaaaacatatatcagagtccttttgactgtttagaaagtgttaatttactccacgattatccattcaacatttattagttggct

SEQ ID NO: 41149 - DNA, 201 bp, Homo sapiens
tacagtgccagtgggcagaaggttttgcaagaatagcttcaggaagactttgtgggaagacagatgaatactcagggttttttttttttttttcttctaayttgtcctccttgatcaggatttctcaaatgcacatttgtctaatatactgttgaaccatgcaagtaccaaaacaaaacaagaaacccagaattatagctc

SEQ ID NO: 41150 - DNA, 201 bp, Homo sapiens
tgcagcctctacttcctgggctcaagtgatcctcccacctcagcttcctaagtagctgggagcacaggcaccagcaatgacacctgcctaattttgtattktctgtagagatggggttttggcatgtttcccaggctggttttaaactcttgagctcaagccatccacccgccttggcctcccaaattgctggaattatag

SEQ ID NO: 41151 - DNA, 201 bp, Homo sapiens
tgatcctattcgcatgataaaaatcataatgtctcaaattacttactcaataaaatgtgggtttgtctattattagtgattattagggttataatgcagcrtggaaatttggagcaaattaactatacatgcaagctgttgggctcaagtgcagttaatcatacgcatacagtgccagtgggcagaaggttttgcaagaat

SEQ ID NO: 41152 - DNA, 201 bp, Homo sapiens
ctgcagaactgaggtgggccccaaaacttgcgtttctaaaaggtactagctgagcatgatgactcacatttgtaatcccaccactttgtgaggccgaggcsggtggatcgcttgaggccaggagtttgagaccagccttgccaacatggtgaaactccatctctactaaaaatataaaaatttgccgggtgtagtggtgca

SEQ ID NO: 41153 - DNA, 201 bp, Homo sapiens
ctgcatgctgcagccagctcaggaaagatttcaggaagagcgtttaggaaggcagctttgaaaagaaaatggaaagatgaggttgcagagggtcagtccawggtgaccagaatctgacctggggcaatgccataaatccaagaaagactgggtttcaggtgcaggaaatgcgattgtgcacggacccttgcctttttaccc

SEQ ID NO: 41154 - DNA, 201 bp, Homo sapiens
ccagatgtggaagaaatagcctcattagtaacttttctgtaagcaatctccttatttcttgttttttgttcttttgttttttgtgtgtgcttctgcgtgcmcctcctctatggctccccccaccaaatttctgtgtcttcatttgcaactctcttttctccagtaaagaggaaagtgtatagttctcctttccttacagaa

SEQ ID NO: 41155 - DNA, 201 bp, Homo sapiens
aggtgaccagaatctgacctggggcaatgccataaatccaagaaagactgggtttcaggtgcaggaaatgcgattgtgcacggacccttgcctttttaccvagtatctagcccatccttctttcttagaagcagaattttctaagaggtacacggtagttcaggataaaaattccctgtgctaactgcccttgcagctagc

SEQ ID NO: 41156 - DNA, 201 bp, Homo sapiens
cagtttagtgcctgccaagagtaactggtgggtctgtgtcaccttctgacatgatcagtgtgattgtctccaacgcatccatggaagtgaaaccgttggargaagctaatgccgtgagccagctgttggttatgtttttgttttgtttttcttttttacttgctggatagtgggttctgtttattgagaaatatttacatc

SEQ ID NO: 41157 - DNA, 201 bp, Homo sapiens
tggtctttgctttcataggttatttctcctcttccatagcaacacatgtcaaggcaaggaccatatcttattcagttcctagtcatcttttctttcttttsctttttcttttttaaattgttaagatctgccataaaaatgtctgtcagagtaggcatgattgcatattctttagatggatgggtggatggatggatggat

SEQ ID NO: 41158 - DNA, 201 bp, Homo sapiens
gtgcccagtttagtgcctgccaagagtaactggtgggtctgtgtcaccttctgacatgatcagtgtgattgtctccaacgcatccatggaagtgaaaccgytggaggaagctaatgccgtgagccagctgttggttatgtttttgttttgtttttcttttttacttgctggatagtgggttctgtttattgagaaatattt

SEQ ID NO: 41159 - DNA, 201 bp, Homo sapiens
gaaagaaaaaaaaaatttgtggttacagtataataaaaataaactgtttgtcgtgactgcagctgacatttatcagcctgtttgtgggtgatctttctctytctctataatacagaacataatttgtcactttgtaaatacattccagtctaaatccctgccagcatctgttagtgtttgaaggattaatgtgctaccctg

SEQ ID NO: 41160 - DNA, 201 bp, Homo sapiens
aaaaaaatgggaaagaaaaaaaaaatttgtggttacagtataataaaaataaactgtttgtcgtgactgcagctgacatttatcagcctgtttgtgggtgmtctttctctctctctataatacagaacataatttgtcactttgtaaatacattccagtctaaatccctgccagcatctgttagtgtttgaaggattaatg

SEQ ID NO: 41161 - DNA, 201 bp, Homo sapiens
ccccaaagtagctgggaccacaggtgcacaccaccacttccagctgattatttaaaaaaaattttgtagtgacagtgtcttgctgtgtttcccaggctgtycttgtactcctgggctcaactgatcttcccagcttggcctcccaaagtgctgggaatacaggtgtgagccactgtcccaggccagttttaactcacaatg

SEQ ID NO: 41162 - DNA, 201 bp, Homo sapiens
tttttttgacggggtcttaatatgtcacccaggctgtagtgcagtggcgcgatgacagcccactccagccccaaactcccaagctccagtgattttccttyctcagaccccaaagtagctgggaccacaggtgcacaccaccacttccagctgattatttaaaaaaaattttgtagtgacagtgtcttgctgtgtttccca

SEQ ID NO: 41163 - DNA, 201 bp, Homo sapiens
tccatatatttttaaaatgttgcttttagagtatgtgcaagtttggggcatttttgagggcttttttttttgacggggtcttaatatgtcacccaggctgyagtgcagtggcgcgatgacagcccactccagccccaaactcccaagctccagtgattttccttcctcagaccccaaagtagctgggaccacaggtgcaca

SEQ ID NO: 41164 - DNA, 201 bp, Homo sapiens
ccatttattctgttgctgaaaccattccagctttttctggttggcttctatgaaggacgctattttaatggggtgatttttttcttctcactacattcttsctcactccccactttttatgtccggtggccataggctggtgagaacttgattttgaacagttgaaggtctgctgttagggacgtgctaatctagggaatt

SEQ ID NO: 41165 - DNA, 201 bp, Homo sapiens
ttctttcttttcttttctttttgttgagacaaagtttcactcttgtcgcccaggctggagtgtaatggtgcgatatcggctccctgcaacctctgcctccygtgttcaggcgattctcccgtctcagcctcccaaggagctgggattacaggtccatgccaccatgcccagctaatttttatatttttagtagagatgggg

SEQ ID NO: 41166 - DNA, 201 bp, Homo sapiens
catgccattctcctgtctcagcctccggagtagctgggactacaggcacccgccacctcgcctggctaatttttttttttgtattgtttgtatttttcatrtttttcgtagagtcagggtttcacagtgttatgcaggatggtctcgatctcctgacatcgtgatccgcccgcctcagcctcccaaagtgctgggattaca

SEQ ID NO: 41167 - DNA, 201 bp, Homo sapiens
aagagactggagaaagccaatctgtttctccctgaaaatcatcttacttttttaacgcttcgtacctagatttggcctgggcagcccagggagactgttcragcactggatacctagactctgctgggctctagagaagtgctgggctacagcgcccagtgccctacctcttggggccagccagcctcaccaaaaaatcag

SEQ ID NO: 41168 - DNA, 201 bp, Homo sapiens
agtatagacacgtggcaccacgcctgggtaatttttgtagttttagtggagacaggatttcaccatgttggccaggctagtcttgaactcctgacctcaastgatagacccacctcagcctcccaaagtgctaggattacagacatgagccgacctttttatgtattgttgatacagtatgacaagggaagagttaactga

SEQ ID NO: 41169 - DNA, 201 bp, Homo sapiens
gcccatcccaaatgaattctaatcctcagcctctagaatgcctggagtgagaaaacagaatattgttcttttctgtttatattatttcatactgagttaayacacttgccaagactccgaggcagcttctggcttgacaatgccttctttaactagcctagtttctagaataaagttcgggtccaccaggccctctgagtg

SEQ ID NO: 41170 - DNA, 201 bp, Homo sapiens
tgggtttcaaaggtactcttttttcttttttgagacagggtctcgctgtgttgcccatgctggagtgcagtggtgcgatcacagctttctgcagcattgascttgtgggctcaagcaatcctcctgcctcagcctcccaagtagcttagaaccacaggcatataccaccatacctggacatgtttttaactttaattttta

SEQ ID NO: 41171 - DNA, 201 bp, Homo sapiens
tcgagttcttaatctgagcagtttcgaaaccaagcccacattaattaatataaataatgactgggaaacgttgcaggactccccggaaaagaatgtataarttgatgtgtttttgtatatgcttatgtatatgcctttgtgcacgaaaggagataaatggtgtatttcacacagttccttctcctcctctaagggatatta

SEQ ID NO: 41172 - DNA, 201 bp, Homo sapiens
tccttaaataaaaagctgtggctatgaagaagtgagagtttttttttttttcctctccaaaccaccacgtgctcttgtgtgttattgtagtggcttcgcaragtatttatttggccagaaagtctatagtcaaattgctcttcattctcaagtgtagtatttatttctccagctcatgcagaattctgttttatatggagg

SEQ ID NO: 41173 - DNA, 201 bp, Homo sapiens
cttaggcatccatgctcagggctctctgtggtaggcaacagctggattatttactttctagaatatctcgagttcttaatctgagcagtttcgaaaccaarcccacattaattaatataaataatgactgggaaacgttgcaggactccccggaaaagaatgtataagttgatgtgtttttgtatatgcttatgtatatgc

SEQ ID NO: 41174 - DNA, 201 bp, Homo sapiens
ctactaaaaatagagaagttagccaggtgtggtggtgggcgcctgtaatcccagctacatgggaggccgaagcaggagaattgcttgaacccaggagggasaggttgcagtgagacaagatgatgccattgcactccagcctgggtcacagagcaagacttcatctgaaaaaaaaaaaaaaaaaaaaaaaaaaagaaaaat

SEQ ID NO: 41175 - DNA, 201 bp, Homo sapiens
gatcagcctgggcaatatggtgaagccccgtctctactaaaaatagagaagttagccaggtgtggtggtgggcgcctgtaatcccagctacatgggaggcygaagcaggagaattgcttgaacccaggagggagaggttgcagtgagacaagatgatgccattgcactccagcctgggtcacagagcaagacttcatctga

SEQ ID NO: 41176 - DNA, 201 bp, Homo sapiens
tgtaactcgagtgttctgtgaagccagatattggtgccaagctaaatttgtgcgtgcagcttctgtttaaggcaattatatagtgtgtaatacccagtagmgaaattaagtcgaagtacattttgcccatagagattatcctctcagttggatttattttaaacaagttttgccccttatacattaaggtgcatgcaataa

SEQ ID NO: 41177 - DNA, 201 bp, Homo sapiens
cagctactcaggaggctgaggcaggaaggtcacttgaacccaggaggtagaggttgcagtaagctgatatcatgtcaccgcactccaacctgggtgacaargctagaccctatctcaaaaataaacaaacccttgctattttagcttccgatgaggatatttatccttctagcatttgaatgcagccaaagtccttactgg

SEQ ID NO: 41178 - DNA, 201 bp, Homo sapiens
ttttttttttttttttttgagatggagtttcactcttcttgcccaggctggagtgcaatggcgtgatctcagctcactgcagcctccaccttccaagttcragtgattctcctgcctcagcctcctgagtagctgggataacaggtgcacaccaccatgcccggctagtttttgtatttttagtagagacagggttttgac

SEQ ID NO: 41179 - DNA, 201 bp, Homo sapiens
tataagcaatagtccctgaacatcatttggcctgaactaggctagagtttctcttaatcaaaataataacgatgatttttccatgccaaggagtggtgtcrtatcatgaagtagatttatgtacacattaaataaacttttacattttaatgtaccaatttgcaatttttttttctattcaccaaaatattccagataacg

SEQ ID NO: 41180 - DNA, 201 bp, Homo sapiens
gaagtgggcgtcgtgatgccagtgtcttcgtaatactatctttctttcccctttagcacccagaacttatgaaatatgactcggtttatcctgaacacatstctgtgcatcagggaggatgggagaattaattccagtttctcaattgcaaaagtgaggctggtcatggggcttggaaccacgccacggacgcatgaagcc

SEQ ID NO: 41181 - DNA, 201 bp, Homo sapiens
caggtgcacaccaccatgcccggctagtttttgtatttttagtagagacagggttttgacatgttgccaggctgctctcgaactcctgacctcaggtgatycacctgccttggcctcccaaagtgctgggattacaggtgtgagccaccgcacccggcccctgcctttttattttgctaaacctgatgacccttgccatag

SEQ ID NO: 41182 - DNA, 201 bp, Homo sapiens
caaatggggaacagtcctgtgcagtgtttctaggaagttaccagcttcatcataggaagacgttctccatcgtttggatctttttcaccagcaccttttgrttgtggtggtttgggatgtgatgatctcagaactttacatcctccatgaaatctctgcagcgatagttgaatgtcttgccttttctattattgccctttt

SEQ ID NO: 41183 - DNA, 201 bp, Homo sapiens
tgctctcatttcattttcactgaactgaaaataaggtaacagaccctcaggtctacctataagtaccttccaactgttccacttttgtaaatttagttcarataatacatatgctgaaattcctatatcccccccatactccagatcttcagtgtggaatttaaatataattccttattgtaaaaaaaaaaaatttttttt

SEQ ID NO: 41184 - DNA, 201 bp, Homo sapiens
tttgacatgttgccaggctgctctcgaactcctgacctcaggtgattcacctgccttggcctcccaaagtgctgggattacaggtgtgagccaccgcaccyggcccctgcctttttattttgctaaacctgatgacccttgccatagcagaactaaagtgatgatgatgattacagcagatcagttattttgagctctgac

SEQ ID NO: 41185 - DNA, 201 bp, Homo sapiens
tgaataccttttgctttctataaaatggtgtggcattgctggtattttcactcttccttcctaccctggatgctgatttgatgcttccagccttagcggtyttcttgcttctaggactgaacagggaagagggaaaagtcaaaagaatgacagaaggtcctcacgttgcagaacactgaccaatgttggcaactacaagac

SEQ ID NO: 41186 - DNA, 201 bp, Homo sapiens
agcctgtacttgagtccttagacagaaagcatcttatcattcacaagcttagctatgcaatatattcctccctccccccaaggtagttgttgttgggtttktttttttttttttaagagatttacagtgatctttccatataggtttttctcgaaacatatatatttttaatttctcaccatctcaggggtaaataaatat

SEQ ID NO: 41187 - DNA, 201 bp, Homo sapiens
gtgtgagccaccgcacccggcccctgcctttttattttgctaaacctgatgacccttgccatagcagaactaaagtgatgatgatgattacagcagatcarttattttgagctctgactttgcatgaggccctttattaagtgcttcacttgtgtgatctgatttaatcttcacaagcaaactgggacagagggactgtgc

SEQ ID NO: 41188 - DNA, 201 bp, Homo sapiens
cggcccctgcctttttattttgctaaacctgatgacccttgccatagcagaactaaagtgatgatgatgattacagcagatcagttattttgagctctgastttgcatgaggccctttattaagtgcttcacttgtgtgatctgatttaatcttcacaagcaaactgggacagagggactgtgcctattcccatttcacag

SEQ ID NO: 41189 - DNA, 201 bp, Homo sapiens
agtgcacctgaccctaggataatcttaattttaagtaactggtaactcataaatttttaaacactctgcagttcaaagaaaacatgtttgtggtaggtagycagtttataacctgtgtaagactgtgttattagcaaatccctcaatgtgttgaccaagagtgggtaggaatcctgcagacagaatcttttgaaggtggtt

SEQ ID NO: 41190 - DNA, 201 bp, Homo sapiens
ttttcacccgggttctccctgtctataaggggaaaagacagggttcacaccaaggcctgtctggatccaaaacccatgctcataatcactaagttatactmcctcttcgagatgctgatttggaaaataactccatgatgaaacatgtcaagggagactgcctgtactccgtaatgcagaaatgcattagagctcaaaaat

SEQ ID NO: 41191 - DNA, 201 bp, Homo sapiens
gttccctgtactctgcaatgctgagtacttctcatccttcaggtctactgcaagtgtcacctggccaacacaccatgccttcccagtctctggtgttactstctgcatactgtagaccatcatcttgtttgcatacttgtctgttatctctttatcatccttctacccacatcaggcaattccaagagagaagaccactgg

SEQ ID NO: 41192 - DNA, 201 bp, Homo sapiens
agtccctgtgcaccttcagaaccacatctagcaatagaaggcgctgcacggggaattctggaatgaataaaaacgcttggcagtaccgcatggcgagccaktacccgtgaatgctacttcctccaaagagaattcctgggataacagagaatccattcatggctgccaggaggacttggatatttctcattttccattggc

SEQ ID NO: 41193 - DNA, 201 bp, Homo sapiens
caaggggaccaggaaatgctgaaagttcaggcctcggaaaggacaggatgtggaaggatgttctggactcaaggaggcctagggacccttggcaggaggcrttcatgggtctgtagtccaaggctccactaccatctccttggcttctctcttccattctagcttcttctgcttattcatcacttttgcttcctatgaaat

SEQ ID NO: 41194 - DNA, 201 bp, Homo sapiens
gttattagcaaatccctcaatgtgttgaccaagagtgggtaggaatcctgcagacagaatcttttgaaggtggtttgtttttttattcctttataagtacwgttgtagatttacaaagtaattgagtatatagtacataaggtcttgtgtacccaccgatcgcaattgagcatatagtacatgctgtcctgtgtacccact

SEQ ID NO: 41195 - DNA, 201 bp, Homo sapiens
tttccattggccctggagtggaggaacagagccgaaaagtacgtggggggcaggcaaagctgcggtcagaggcagaccctgttggtgttggccgtgtcaascagctttgctggtttctattatagccctggtgtggcaaaggacactgtgtgactgtgagctcaggtcagcattgcgatcccttcaggcctctggcttgca

SEQ ID NO: 41196 - DNA, 201 bp, Homo sapiens
gaaatctctagcttctcaaactgtttcgtggtggagtgccttttgggcacaggagaaggaaataagagcctcgcgaggtttgggaatgctgcctctagctytcacactgcatgcagaattcctactctgagagctcactttatctcaaaaacccatgcatattctgcatctactctgaattccgcagtgttgtgtgttact

SEQ ID NO: 41197 - DNA, 201 bp, Homo sapiens
gtgtcatacagcagagggctgtgatgctctactgaggagtggaagtgtttttctgagggcatcaaacacgccgtcaagcagggaggcaacaaatctgagtygttccacagatactttgagtgcagtacaagttggtaatgggtaacaggctaaaccatgtggcaccccttccctcttatcagcttcttgctaccatgcaga

SEQ ID NO: 41198 - DNA, 201 bp, Homo sapiens
ttttttttttttttttttgagactcactctgtcacccaggctggagtgcagtggcatgatcatggctcactgcagcctcccgggctcaagctttccacccmcctcagcctcctgagttgctgggaccacaagtatgcaccaacatgcctggttaatttttgtggttttttttttttttttttttttcctgctgagatgggg

SEQ ID NO: 41199 - DNA, 201 bp, Homo sapiens
ctttttatagtcagtaattggaattcttctgaagaaagagctatcccttctcccccatttctttcttttcttttctttttgttgagacaaagtttcactcytgtcgcccaggctggagtgtaatggtgcgatatcggctccctgcaacctctgcctcccgtgttcaggcgattctcccgtctcagcctcccaaggagctgg

SEQ ID NO: 41200 - DNA, 201 bp, Homo sapiens
attcaatcattagaaaataattttaaatgagcttagcagttctcagaattttggatttcaggaaacaaactttttaaaaacaaaacaaaaaggaggatacsaatttaagcttgtcaaaaagattttcccccaaaagaaaaacacattaaaaacaacgacaaaaatcaacaaaaactaacactgttcccccatcaacaatca

SEQ ID NO: 41201 - DNA, 201 bp, Homo sapiens
ctcataattcggtgtgagaaacacacaaggcatgatgccattcccatctgggatgaacagggaagacttcctgggagaggtgactatggacttaattttgytttgacacagcaaaaacatgaggaatgaattttgtgacttggaagattgttagttttctgtggagggaacaacactcatcttgcaaatttgccttcacta

SEQ ID NO: 41202 - DNA, 201 bp, Homo sapiens
taaaaccaggggagactcgacccaaggcattgtgtttgagctaggctttgaacaatgtatagaccctcaccaagtatggaagtggaagagtaagacattcmaggtagaaggaacagtatgaggaaagtcagagagctaacaaagattatagtgtaatgccagaatcatgagaaatttgctgagaattcatttgaggccata

SEQ ID NO: 41203 - DNA, 201 bp, Homo sapiens
gcattttacataaaaacctctaaagctctcaggctaattagtaatgtagcatatacaaattaagtttttttctgctgtgcttaattcttattaacacactmatcatgagagcccccaaattgctgtaaggagcacatttagaaaacatataaaggatcgatagttggtacttaagaaatcgttgaaacaccttttcttttt

SEQ ID NO: 41204 - DNA, 201 bp, Homo sapiens
gcagtgtctgagtgtctgtaccttcctataccttcaccatatcatgtatttgtcattttatagtgagttgtattacttgctaggtgagctggtatctcctytgataacacaaagaaggcctgggtttgcttggcaatttgttccaatattcttttcagttttaaataagttttgaacaaaaagttttagcattttacataa

SEQ ID NO: 41205 - DNA, 201 bp, Homo sapiens
gtcatgagcaacgttgctggtttacctggggctaaataagaagtttaaatgcaaatagataattcttgagaaagcttcttccctgtatatactctttctgyagcagtgtctgagtgtctgtaccttcctataccttcaccatatcatgtatttgtcattttatagtgagttgtattacttgctaggtgagctggtatctcc

SEQ ID NO: 41206 - DNA, 201 bp, Homo sapiens
gttttccattttttcagtcatgagcaacgttgctggtttacctggggctaaataagaagtttaaatgcaaatagataattcttgagaaagcttcttccctrtatatactctttctgcagcagtgtctgagtgtctgtaccttcctataccttcaccatatcatgtatttgtcattttatagtgagttgtattacttgctag

SEQ ID NO: 41207 - DNA, 201 bp, Homo sapiens
ctgttttccattttttcagtcatgagcaacgttgctggtttacctggggctaaataagaagtttaaatgcaaatagataattcttgagaaagcttcttccytgtatatactctttctgcagcagtgtctgagtgtctgtaccttcctataccttcaccatatcatgtatttgtcattttatagtgagttgtattacttgct

SEQ ID NO: 41208 - DNA, 201 bp, Homo sapiens
ttattgctgggcacagattctgttttccattttttcagtcatgagcaacgttgctggtttacctggggctaaataagaagtttaaatgcaaatagataatkcttgagaaagcttcttccctgtatatactctttctgcagcagtgtctgagtgtctgtaccttcctataccttcaccatatcatgtatttgtcattttata

SEQ ID NO: 41209 - DNA, 201 bp, Homo sapiens
taaattaatcccttattgctgggcacagattctgttttccattttttcagtcatgagcaacgttgctggtttacctggggctaaataagaagtttaaatgyaaatagataattcttgagaaagcttcttccctgtatatactctttctgcagcagtgtctgagtgtctgtaccttcctataccttcaccatatcatgtatt

SEQ ID NO: 41210 - DNA, 201 bp, Homo sapiens
tggaacacagccaggtgcatttgtttacctattgtctatggctgcttttgcactacagtagcaaagttgagtacttataaatgtagagcctgcaaagtctraaatatttactatctgcccttttgcaggtaaatttgaggactcttgagttagacagctaattagttggtgttacctaaattttgtgaattgtggctaaat

SEQ ID NO: 41211 - DNA, 201 bp, Homo sapiens
ctttatcaatagaagtggggaaatcgtacctgccctgtctgcctcattggatgtggaagaaatgacataatccatgagagtggcttctgaatgaagagaasctgctaaagggaagacatgatctcaagtcagccacctctgacccaaataagaacacataattacaagactgtattgtataatcatgcaggacacaaggta

SEQ ID NO: 41212 - DNA, 201 bp, Homo sapiens
ttcaccatgttggccaggctggtcttgaactcctgacctcaagtgatcggcctgcctcagcctcccacagtgatgggattacaggcatgcgccaccatgcstggctaatttttgtatttttagtagagatggggtttcactatgttggccaggctggtctcgaactcctgggctcaagcaatgcactggccttggcctccc

SEQ ID NO: 41213 - DNA, 201 bp, Homo sapiens
gcacctgcatgttgtaaaaacacaaaataaaaaaaaaataaataaaagcagaccccttggttcagatatctttgtttgtgtaaatgttttggcattctttrtgaaaatcttcagattttcaagagcttaagatgacctcctctagccggctgcagcagtgtctaggtatctgtgaatgtgtaagaaattgagacagcctgc

SEQ ID NO: 41214 - DNA, 201 bp, Homo sapiens
gttttttgtttttttaagggaggaaatttctttcagaagtcagtactggacattcccttatttcaccttgagctacacatcccatagtcagcttagccctstccctggtgcgggggagcaggactgttgcctgtatcccttagtcattgccgcaggcttgctgcatcacaaaccaccattagacctcagtggcccgcagca

SEQ ID NO: 41215 - DNA, 201 bp, Homo sapiens
cgctgccattcagttttactctgcacaaaatacagccaacatttttgcatttctttcttccttcctccttttcttctttctttccttccttccttcctttytcccttcatctatctttgttccgcttttgtttgtttttttttagatcgctgcatgctgccgcgttgggttaaccatggtagcattttaccatgagaagcc

SEQ ID NO: 41216 - DNA, 201 bp, Homo sapiens
tattgttttttgtttttttaagggaggaaatttctttcagaagtcagtactggacattcccttatttcaccttgagctacacatcccatagtcagcttagmcctgtccctggtgcgggggagcaggactgttgcctgtatcccttagtcattgccgcaggcttgctgcatcacaaaccaccattagacctcagtggcccgc

SEQ ID NO: 41217 - DNA, 201 bp, Homo sapiens
gcacaggaattatttcccttttaaacgttagttttcattttaccagtgcaactctgctattggcacatctatgaaatacgtaaagctatcattttaatacyaaagaggaaacacaaatttgactcatttccccagaaaattcccctcctgctttccatatgttatatagttaactgtaaaagtggcaccacctcttaaaca

SEQ ID NO: 41218 - DNA, 201 bp, Homo sapiens
ataaggctgcagtaattctcttcccaccttcgatgggcaggtgcaacctttggctgcagaaattctcacttcccagcagcagctttgagcaccctgctctkaatgtttcttgggcagcagcagctagggaagaaactcagttaaggctgtttgaggacccaaggtggtctcactctgcaacacacatcggcagccagtggt

SEQ ID NO: 41219 - DNA, 201 bp, Homo sapiens
aaatggtggcaatgaaatcattgcgtaggccagttggagtgagccaaataaaatacatctgcagtccagattcaacctgcaggccatcattctgctgtcaytggtgtagaagactttttcagcctagtttattctaggctcttttcatttctccctgatttgaggctttgtaggacgttgcacaggaattatttccctttt

SEQ ID NO: 41220 - DNA, 201 bp, Homo sapiens
gaggtgtcccttttgcagttgttcagaaggtcccgtgggcaggagcagccagaggaacatgaaaccagctcgtaggtggtacttgtggcaacagcagttayagccaaggagaagttaaattctaaagacttgggcagtctccagggaatatactaactgagaaataacatccataaaaataattcaatactagtatgtaaa

SEQ ID NO: 41221 - DNA, 201 bp, Homo sapiens
aggcgtgtgtcactgcatccagcttaagttatccgatttgtaaatggtggcaatgaaatcattgcgtaggccagttggagtgagccaaataaaatacatcygcagtccagattcaacctgcaggccatcattctgctgtcattggtgtagaagactttttcagcctagtttattctaggctcttttcatttctccctgatt

SEQ ID NO: 41222 - DNA, 201 bp, Homo sapiens
ccttccaacatctagcattattgtgtgttgaataaatacttgttcgattaggtctaatcactcttcatgattggatttccaaaatgtggactctcagcagkacattacagggacagtggttgggtctggagatgtcacccttagctgtttttcacaatgagaggttgttttatcataaataaatcaataaatggcagatta

SEQ ID NO: 41223 - DNA, 201 bp, Homo sapiens
aaggtcagctcctgaccttcataataaggactcacatgtgtcggtcccaaggatccccaagggatactcatggttgaaggtgtctatgtgttctccttggwgtccagcgaatgcctcttgacaatctgtggtcatactcacaacctatgaccacatacgaggaagcgaggtgtcccttttgcagttgttcagaaggtcccg

SEQ ID NO: 41224 - DNA, 201 bp, Homo sapiens
ctgactcttttaacttgtcaacatttcctacattcaacattgtactctaatatccagtaaagtgaaacaaacaaacaaataaatacacttttttcaagaamaaataaatatctgtgatctcatcatttgaccgtcagtattttcatttttgcatgtgccactttaatttccctaggcaacactagctagtggcccacaata

SEQ ID NO: 41225 - DNA, 201 bp, Homo sapiens
tttggcctcctgggtagccgggactacaggcgtgtgtcactgcatccagcttaagttatccgatttgtaaatggtggcaatgaaatcattgcgtaggccasttggagtgagccaaataaaatacatctgcagtccagattcaacctgcaggccatcattctgctgtcattggtgtagaagactttttcagcctagtttatt

SEQ ID NO: 41226 - DNA, 201 bp, Homo sapiens
caggcacgccaccacacctggctaatttttgtatttttagtagagatgggggtttcaccatgtgggccaggctggtcttgaactcctgacctcaggtgatygacctacctcggcctcccaaagtgctgggattacagtcatgagtcaccatgcccgaccagcaagaccccactgctattgtccagtgtggtaggtaccttt

SEQ ID NO: 41227 - DNA, 201 bp, Homo sapiens
ccctgatgagattacaggtcctcagtctcctcattgtatctgaagactaaagaatcagaaatttgtgactccacttagtttttctccacccaggagccctyaggccgctggtgagtgaagttcttacccattagggattattaatatactagataagagtacagtctctggagctaggcttgtgactttgaacaaattatt

SEQ ID NO: 41228 - DNA, 201 bp, Homo sapiens
tgctttgaatgcaggcctgctgtttgcctgtggacctcaggatttgtaaggccatctccacccacctacagctaagtttcccaagagccgatctccagccraagtccaaggttccttgatgacccctgggaggagatgcaacacacagtttcctagaatcatttactccccaggctaagcacagtcacagaaatgaggtag

SEQ ID NO: 41229 - DNA, 201 bp, Homo sapiens
tctgatggccagtgatgatgagcattgtttcatgtgtctgttggctgcataaatgtcttcttttgagaagtgtctgatcatatccttcgcccacttgggtsgatgaagctggaaaccatcattctcagcaaactgttgcaaggacaaaaaaccaaacaccgcatgttctcactcataggtgggaattgaacaatgagaaca

SEQ ID NO: 41230 - DNA, 201 bp, Homo sapiens
gccatctctgcctctgtcttctcaccaccatcttccttgtccatgtctctctatgtcttcaatgttcttcttataaggacaccagtccttggatttagagyccaccctaattcactgtaatcacatcttacctaagtccatctgcaaagaccctatttccaaataaggtcacattctgaggccctgggtggacatgcattt

SEQ ID NO: 41231 - DNA, 201 bp, Homo sapiens
attgtttgtttaaaatcactttggattctcatttaccttttccccctcaagatctttgtttttgactttggagataaccagaaataactaagcatgcttcsttccctctacgatttcatcctcatggggaagcaagaccccactcttttattttcatgtatgtatatatgtatgtatgcatgtatgtatgtatgtttgaga

SEQ ID NO: 41232 - DNA, 201 bp, Homo sapiens
aaaagagacagccagtcaagccctgactccttttgtgaccctgatgagattacaggtcctcagtctcctcattgtatctgaagactaaagaatcagaaatytgtgactccacttagtttttctccacccaggagccctcaggccgctggtgagtgaagttcttacccattagggattattaatatactagataagagtaca

SEQ ID NO: 41233 - DNA, 201 bp, Homo sapiens
cccacgatcccatcttaatgtctgttgtggaagttggcccacagaagcctcaaggctaaccaacaagaaagatcacttcatatgcattagctggaaggtarcaagaggaaatcgcctgccagggtccctgactcccggaggaaagtgtcctctgagccctccttgagggacataaatagccccaaaagtcactgaatgcta

SEQ ID NO: 41234 - DNA, 201 bp, Homo sapiens
cactttaaacattgcatccttgagttgcatatgatgggatctcttgaatcatttacattttgaaaaaagaaagtgaaatattctttaagaagccaaagtamtccacgagaatgtatggtgtttgttcagctggatatcttatttatttgaagtactgagagagaaatcttttctgactgctcaaaacagggaataataaac

SEQ ID NO: 41235 - DNA, 201 bp, Homo sapiens
tttaaggacctttgtgatagttttgcacccactggatgacccagaatcatcttcctcttttaagatcagctgattagcaacgtcagttccacccacaatcytcatttccctttgttgcgtaacctaacatattcacaggttctggtgagtgggatgggggtatctctaggggaccattatccagccttccacaggcacttt

SEQ ID NO: 41236 - DNA, 201 bp, Homo sapiens
caaagaattgtagttggatcaaatgagttggagtgggatacagcaacaatctatattctgatttcagcaacactgtgcagtgtaattccatattatattayaccacatcttctgtgggtctttctttgggggaagctaacattttaaaaggtttccctttgtaacctgtaaccccctctaccccaaaagtatattcaagag

SEQ ID NO: 41237 - DNA, 201 bp, Homo sapiens
aggctagccaatcatttcaaagcctgtgtagaatatctagactatatgtaatcctaggatttgttgttgttttgttatgattttttttaagcaggaagctwaaaaaaataaccacccgttactttgctgcttttagaaaataggtttgagattgattttgaatactaaagtatagttttcatgttataaagccaaccatgt

SEQ ID NO: 41238 - DNA, 201 bp, Homo sapiens
gatagttttgcacccactggatgacccagaatcatcttcctcttttaagatcagctgattagcaacgtcagttccacccacaatcttcatttccctttgtygcgtaacctaacatattcacaggttctggtgagtgggatgggggtatctctaggggaccattatccagccttccacaggcactttgtcacaggccaggcg

SEQ ID NO: 41239 - DNA, 201 bp, Homo sapiens
agggcctctgaatgagagctgggagaggccagaatgggcctgtaagaggttgatgtgtatgagacctgaagccctatgcctttgggaaggagaggaaggastaatatttgtgtggtacaaaggatgtgcctggcataccccatatcttttacaaagacataaatgtcttctgaataaaagtatgatgatgatgatcatggt

SEQ ID NO: 41240 - DNA, 201 bp, Homo sapiens
ctctctcagaatgaaaggtttgattcgtaccagctccccatcccttcccacgatcccatcttaatgtctgttgtggaagttggcccacagaagcctcaagsctaaccaacaagaaagatcacttcatatgcattagctggaaggtaacaagaggaaatcgcctgccagggtccctgactcccggaggaaagtgtcctctga

SEQ ID NO: 41241 - DNA, 201 bp, Homo sapiens
aaaaactagccagaaagcgtgaactttttttttttttaagccataaagcttggtaaggctagccaatcatttcaaagcctgtgtagaatatctagactatwtgtaatcctaggatttgttgttgttttgttatgattttttttaagcaggaagctaaaaaaaataaccacccgttactttgctgcttttagaaaataggtt

SEQ ID NO: 41242 - DNA, 201 bp, Homo sapiens
ttgctgtgtaagaaattaccacaaatttagtatatttgttatctcatagctccataggttaaaagtcctggttcaggctgggacttctgctcagggtctcwtgaggctgaaatcaaagcgtcagccagggatggggtcttatcagaggcccttggttactaacagaattcattttcttgtaactgtaggactgaggtgctt

SEQ ID NO: 41243 - DNA, 201 bp, Homo sapiens
ctgttattttatgtttcactaagagtgcgaagaacattgttaattatacaatgatccaaaaatgtcttctctctcagaatgtattgttttatatctattasaaaggctcttttgacttaggcatagatttctcatacatcaggccatttctatgcctgcctgtgaacacagggattttgaattacaatactgaatcctagt

SEQ ID NO: 41244 - DNA, 201 bp, Homo sapiens
ctataaagttttagctagacagcgaatcaaggtggcaacacatggtgggttcttaaataatagttgtcatttgagtgctttctatatgatgtacatttcawtttgcactttacaaataacctcttcctttttctgtttaatcttaaaaaagatcccgggaggcaggcgttattgtgcccatttcctggataaggagaatga

SEQ ID NO: 41245 - DNA, 201 bp, Homo sapiens
tggccatggaattgagaagcaggagcatggctcacaaattcacaaatcagcttctccactaatgaggggtgaggaagttaaaatatagactttgttgttgktgctgttttaatgaagaggctggacattaaaatcaaggggaggaataatcatgtcttctcttgaaatgggcagtgaacttcccggaaccagagtgttgcc

SEQ ID NO: 41246 - DNA, 201 bp, Homo sapiens
ataggagactctttgaacacttttttaaaaggcaagatgttggcctggcgtggtggctcacgcctgtaatcccagcactttggcaggccaaggcgggtggwtcacctaaggtcaggagttcgagaccagcctgaccaacttggcaaaacccagtgtctactaaaaatacaaaaattagctgggcatggtgtcacatgcatg

SEQ ID NO: 41247 - DNA, 201 bp, Homo sapiens
ggagcttgcagtgaaccgtgatcgcttcactgcactccagcctgggcaacagagcgagaatccatctcaaaaaaaaaaaaaaaaaaaaaaaaaaaaaaaargaaagaaagaaattacaggtaggctagagcacggatgagcaaactgtttttataaaggaccagagagtatatatttcaggctttgcaggccctatgacgt

SEQ ID NO: 41248 - DNA, 201 bp, Homo sapiens
gctgttcttaactctgaaagcagagtgggccatttgaatgctcactttgatattttttaaaggaaaaatttgaggcattgacacatgccttttgcttactygcttggattggtttgatcaactttgttgcggtctaatttatgtaaaataaattgcatccatttaaatatacaattcaatgagttttgacagatgcacatg

SEQ ID NO: 41249 - DNA, 201 bp, Homo sapiens
ttttttgcccttttgggggacaaaatgtctttatgttaaattgttttattattgttatctttatggagttaagggcacataaaatattcttacagagagarattctgtagtttccacaagtaaccagagaattgttcatggcagagaattattttttcaatgcctattttctcctgaattttctgacggagttagagatag

SEQ ID NO: 41250 - DNA, 201 bp, Homo sapiens
tttagaaatatttctaacctctggccttttttcttatctctacttaaagcttttctggaaggaattcattttccactttccttaatgttccttaaatgttstacatatcttaaaagtggattcctcataaaacaatatggactatggtcttattctgtttaacggtatgaaagctcgcctgaaaggccaagagtaagattc

SEQ ID NO: 41251 - DNA, 201 bp, Homo sapiens
ggaaggaattcattttccactttccttaatgttccttaaatgttgtacatatcttaaaagtggattcctcataaaacaatatggactatggtcttattctstttaacggtatgaaagctcgcctgaaaggccaagagtaagattcttttaaaatcatgcccaagttttaaaggaatataaaactttctctttaaaaatata

SEQ ID NO: 41252 - DNA, 201 bp, Homo sapiens
tttctgttttcttcttccatttttatgttttgctatgccattcattcattctattcttttcatttctttttctttttgtaaaaattgtacagagtttaaarttagtcaggtatgtctattaaatttttacgtaaaaagttaaagcagccctcagcatcaacttcttcttcatttctaactcatttagtgaattcagttggt

SEQ ID NO: 41253 - DNA, 201 bp, Homo sapiens
cgcctgaaaggccaagagtaagattcttttaaaatcatgcccaagttttaaaggaatataaaactttctctttaaaaatatacctttctgctttcatcccytaacccacaaagctcaagtctagtttaattcaaacttggaaatagttcttttattattgctccctgcaatgggaacagagctgaggctcctaaggtctag

SEQ ID NO: 41254 - DNA, 201 bp, Homo sapiens
tctacctggtgggagaaacagctgccagaaaatccagattcccattctcatgctagcttcataacagcaggagagctcctcactctgtttcccagggtgtrtatatatatgtatacatatgtatatgtatatcaatatatatatcaggtaagattctagtccagtgtgagccatatgctttattcctgagcaatcgctgtg

SEQ ID NO: 41255 - DNA, 201 bp, Homo sapiens
ccaaagtgctaggattacaggtgtcagccacagtgccatgccctgatgtgatgcttaaattcagaaattgggaaggagggtcaggtagctataagcaaaayacaagagaaatataagagaaagaaagacttgtatctgttgttagtgagtttttgtggtggtgatacattaatggaggcaacagagggtcagaaatcaggg

SEQ ID NO: 41256 - DNA, 201 bp, Homo sapiens
atatactgaatgctaagccctccccactttttttttcttttttaaattcagaaatttctagttgtgtttattcccctcgtcagcatactttatcatatcaragccttttcagacactgtaaaactactgagttatgtttgggtcatgttttgcggtatgccctttaatagtgtagctttagaaatgcaattttcagcctct

SEQ ID NO: 41257 - DNA, 201 bp, Homo sapiens
gggcacggtggcctacacctgtaatcccagcactttgagaggctgaggcgggaagatcacttgttgaggtcaggagttcgagaccagcctggccaacatgstgaaatcccatctctactaaaaatacaaaaattaggtggcaggcacttgtaatcccagctactcagaaggctgaggcgggagaatctgttgagtccggga

SEQ ID NO: 41258 - DNA, 201 bp, Homo sapiens
gaagagcataagaaaaaggaagggtactgggtggaccaaatctattgttacaatatcccttatattccttagggttcctttttttcaagttaaagcattgrgtcatgtctctgataaatcgcccccccaccccgatccccaccctctgccgccccggccttctttttgtgctgttgggttccaaactttacctgaggattt

SEQ ID NO: 41259 - DNA, 201 bp, Homo sapiens
ggctgatgccttctttcactagctttatgtggctggcagttctgtcctgccactcttttcctcatcatctcagcctccctgcccatggcactcaagagtcsaccttggcagaacctgcaactcttcagcgcctccctaatgaactccttgcaagggcccttggttaagttacagtagagaagtggttgcttaagcaagtag

SEQ ID NO: 41260 - DNA, 201 bp, Homo sapiens
gaattttgtgtagcttttcctgactttttaaaattcaaatatatttcataaagttgaaatcacactgtggtctttttttttttttttttttttttaaccaracatatagtggccatgtttctatgtcaatacatactgtttggcagtacagttgtactgacttgacattatagcttcataacttagtaaattaatccctta

SEQ ID NO: 41261 - DNA, 201 bp, Homo sapiens
ggcaccacacacgatgagattggaggcacctgggtgtcagcctcttgggctggctcattacaggccactctgtctgaggaacactcaggtttgcaaaccgkttcttaaaattacaggatacctagggacctgttggggtgggagggaagaaccctatgggcagaaatgtgactttctgtagcaaagatgtactgtttccca

SEQ ID NO: 41262 - DNA, 201 bp, Homo sapiens
acaaatgagggaaaatatacaaatgagttgaatatatacaaatgagggaaaaattgttccttgtgtcaggaacaattactgtgaattttgtgtagcttttyctgactttttaaaattcaaatatatttcataaagttgaaatcacactgtggtctttttttttttttttttttttttaaccaaacatatagtggccatgtt

SEQ ID NO: 41263 - DNA, 201 bp, Homo sapiens
ccctggacctcgctctgctccgtagcgtgcagcattttgctgaagcattcaaggccaagaatgtgtgagtgttccagtggagggttatagatcataatttyttgctattgtaatatctttatcagatgaacacaattgggagaatgcaaggctgttgtgttgtcttggcgtccaaacaggaggctcatttatattggccct

SEQ ID NO: 41264 - DNA, 201 bp, Homo sapiens
attgtgagccacacatgcaagggatctaggctgcatgctccttacgaaaatctaatgcctgatgatctgtcactgcctcccatcaccttcaagatgggatygtctagttctaggaaaacaagctcagggctcccaccgattgtacattatggtgagttggataactatttcattatatattacaacgtaataataatagaa

SEQ ID NO: 41265 - DNA, 201 bp, Homo sapiens
cacacatgcaagggatctaggctgcatgctccttacgaaaatctaatgcctgatgatctgtcactgcctcccatcaccttcaagatgggattgtctagttstaggaaaacaagctcagggctcccaccgattgtacattatggtgagttggataactatttcattatatattacaacgtaataataatagaaataaagtgc

SEQ ID NO: 41266 - DNA, 201 bp, Homo sapiens
atcccttatattccttagggttcctttttttcaagttaaagcattgagtcatgtctctgataaatcgcccccccaccccgatccccaccctctgccgcccyggccttctttttgtgctgttgggttccaaactttacctgaggattttcacatgcacatctgttaaatgccatttaaagagaacactaacaagagaaagct

SEQ ID NO: 41267 - DNA, 201 bp, Homo sapiens
ccataacacatttactgtaacttgataccatgaactacacttgctgttatttatcatttctttttattttctctcattgcagcataaagccaaggtagaarcaatgaccctggacctcgctctgctccgtagcgtgcagcattttgctgaagcattcaaggccaagaatgtgtgagtgttccagtggagggttatagatca

SEQ ID NO: 41268 - DNA, 201 bp, Homo sapiens
tatacaaatgagggaaaatatacaaatgagttgaatatatacaaatgagggaaaaattgttccttgtgtcaggaacaattactgtgaattttgtgtagctyttcctgactttttaaaattcaaatatatttcataaagttgaaatcacactgtggtctttttttttttttttttttttttaaccaaacatatagtggccat

SEQ ID NO: 41269 - DNA, 201 bp, Homo sapiens
cctacttttaaaaaattgaggtgaaattcacataatataagattaaccatttcaaagtagacagttcaatagcagtacattcacaatggtgtgtaaatacygcatctatctatttccaaaatatttgtatctccccacaataaaagtctgtaccaattaagcagctactacccattcctcttccctaccattctaccttct

SEQ ID NO: 41270 - DNA, 201 bp, Homo sapiens
cctgtaggtttagcagaatcccagcctcacatcctccccgaacttggcagtaaaagccctgttcttccattcattccgatgatttatattctctctgggcrtcttatattaaacaggggaattccgacatgttccataacacatttactgtaacttgataccatgaactacacttgctgttatttatcatttctttttatt

SEQ ID NO: 41271 - DNA, 201 bp, Homo sapiens
cttgaacctgggaagtggagtatgcagtgagccgagatagttctactgcactccagcctgagcaacagagcaagactccgtgtcaaaaaataaataatatrtgtgtgtgtgtgtgtatgtacatgaattatatacaaatgagggaaaatatacaaatgagttgaatatatacaaatgagggaaaaattgttccttgtgtca

SEQ ID NO: 41272 - DNA, 201 bp, Homo sapiens
ctgggtagaacacacataatgaaccatatgcacgagaactttttcatctttctgcatacacttggaactagttctttgttattgtaaaagcatcatgcacyaggtaaaatgtttaataacacagagaaatctaattgtcaagtatcttctcaacacacattaatcaacaattctcatatcgaaggataacctcttgtattt

SEQ ID NO: 41273 - DNA, 201 bp, Homo sapiens
cagttgctcacactcggtcaatacttgccttcctttgaggccatctgcactcactgacaatctgatcgctcccctgaatggaggtgaaagcatgcaagctmggagttaagatctttaactcagggaagaccctgtctatggaagtgctgagctcttcagtgtcatcacagaaaagcatgagcccctccctggtacggagtc

SEQ ID NO: 41274 - DNA, 201 bp, Homo sapiens
tgtggagctgtgcattagggctgggtagaacacacataatgaaccatatgcacgagaactttttcatctttctgcatacacttggaactagttctttgttwttgtaaaagcatcatgcaccaggtaaaatgtttaataacacagagaaatctaattgtcaagtatcttctcaacacacattaatcaacaattctcatatcg

SEQ ID NO: 41275 - DNA, 201 bp, Homo sapiens
gcttctccctgcatagccacttctctttccagtggtgtttgtattttggttcattcaatcaatgaatgattgattgaatcaaccacttggtcccttcaatytgtaaccttcctgcaacactgtctttgtgatgttatcataaccttgatttttgagggatagaattgggcataatcagagaaaacgtggtctgggacacat

SEQ ID NO: 41276 - DNA, 201 bp, Homo sapiens
ggaaggagatatgacacatctctagtttgttgtaagtcgcctaccctagacctcatctccagtgctctgaatgtggagaggtaggtgcagggcagtgggayagagaggtgcactttgaaagactatcacatggaaacaaaagttccggctgggcacggtggctcacgcctgtaatccaagcactttgggaggccaaggcga

SEQ ID NO: 41277 - DNA, 201 bp, Homo sapiens
catggcaaagacccatcattgatgagtgactggatgtgaggaatggagcaggggagatgctgatgatttggttacccccttctccatcccccaccacccaytgatgttattatccagtaaggaccaggagagaagaagagatttaagaagaagacaatggctgtggtttgatgaagataaaacgccctgccagaatcattt

SEQ ID NO: 41278 - DNA, 201 bp, Homo sapiens
aagtacaaaaaattagcctggcgtggtggcgggcacctgtagtcccagctactcgggaggctgagaccgaagaattacttgatgaaacatggcagacgacrtagaccagcagcaaactaccaacactgtggaggaccccctggatcttaggctcagcccagaggagcgaatttgtgtgaaaatgagaaacgaccgagagct

SEQ ID NO: 41279 - DNA, 201 bp, Homo sapiens
attcaaggatttatgttgttaatcctccgggctaattataatttatgggatcttggcaaattaatatgcagttgctattcaaaagtggagagcaatgtaargcaggcataaacaagccttgttcatttttaatttatttccaccaatggagaatattaaataaaatgaacactggggtatttcgctccaagtttggtgttc

SEQ ID NO: 41280 - DNA, 201 bp, Homo sapiens
taaaagtacaaaaaattagcctggcgtggtggcgggcacctgtagtcccagctactcgggaggctgagaccgaagaattacttgatgaaacatggcagacracatagaccagcagcaaactaccaacactgtggaggaccccctggatcttaggctcagcccagaggagcgaatttgtgtgaaaatgagaaacgaccgaga

SEQ ID NO: 41281 - DNA, 201 bp, Homo sapiens
cttatttgctccatgcaatgttcacaggtctttacatgtaaaaacaaccctgtaaaataaataacattattctcttcattctccaagtaagctgaggcagmggattccagcacaagcaatttggttccaaaacctgcccttttaacctctaccagattttggtgaactctctgtctttggaagggtaggtggcggctgcgg

SEQ ID NO: 41282 - DNA, 201 bp, Homo sapiens
tagtgtcaagcagtacaggctttattcaatggccatggaattgagaagcaggagcatggctcacaaattcacaaatcagcttctccactaatgaggggtgrggaagttaaaatatagactttgttgttgttgctgttttaatgaagaggctggacattaaaatcaaggggaggaataatcatgtcttctcttgaaatgggc

SEQ ID NO: 41283 - DNA, 201 bp, Homo sapiens
tgtaagtgaggccatgcagtatttgattttctcttcctgcattagtttgctgaggataatggcttctagccccgtccgtgttctcgcagaagacatgatcrcattcttttatatggctgcatagtattccatggtgtatattcactactttttttttaatccaatctgtcatttgtggacatttaggttgattccagtaga

SEQ ID NO: 41284 - DNA, 201 bp, Homo sapiens
tcatttagcttccacttgtaagtgaggccatgcagtatttgattttctcttcctgcattagtttgctgaggataatggcttctagccccgtccgtgttctygcagaagacatgatcgcattcttttatatggctgcatagtattccatggtgtatattcactactttttttttaatccaatctgtcatttgtggacattta

SEQ ID NO: 41285 - DNA, 201 bp, Homo sapiens
gggtcaacttcttaccgacaaagctggtgccccaaaagaatggggtcttatcctgttgggtgtcatgaagccaacacacaaaaccgaaagtagtgtcaagyagtacaggctttattcaatggccatggaattgagaagcaggagcatggctcacaaattcacaaatcagcttctccactaatgaggggtgaggaagttaaa

SEQ ID NO: 41286 - DNA, 201 bp, Homo sapiens
tgtgcaggtttgttatataggtaacttcatgtcacaaaggtttgttgaacagattatttcatcacgcaggtaataagccttgtatccaatagttatttttmtgatcctctccttcctctctccctctaccctcaggcaggccccagtgtctgttgttctttctttgtgtccttgagttttcatcatttagcttccacttgt

SEQ ID NO: 41287 - DNA, 201 bp, Homo sapiens
ggccacaaaaatcatgtcacaagatcttgttgatgtgcatgcattcattcattcaacaaatattattgagcatctaacataagccgggtgctttgctaggkacagaatgctgtacaaggtccctgtcctcatggggaccgtatgttgggaagacagatgataggcatggaaatgaagagacaaaccactccgacttcagcc

SEQ ID NO: 41288 - DNA, 201 bp, Homo sapiens
gacggttggcaccgatgctaatcagtgctatgggaaaataggcagagcgaggagcgtaagaattattatgtgtgctgtttgatagagactgtacaaggaaracctctctaaaaaggtgacatttggagcagagacatgaaggaagggattgctggaggcagaacattctaggcagaaggaaccgcacgtgcaaaggccctc

SEQ ID NO: 41289 - DNA, 201 bp, Homo sapiens
tagagtctggattctttttatccagaagccattctttcagcctgtgcctttttgtaaataccataccccatctatttccacaaaggatttggggcattagsgagtaaagggggaatatgttctagaagaagggcgctcacctcagtaaattgatgggtgggccacaaaaatcatgtcacaagatcttgttgatgtgcatgc

SEQ ID NO: 41290 - DNA, 201 bp, Homo sapiens
catgttaattagatatgcatgtatgtgtatgtatgatgtatatacccatatacacacagtctatatatacatgtatgcgcacatacacatattttaaggaragaattataaaatgatcaattcaagcttactatatgctagaggtgaggaatatttgaatacaagtcttatctagtagattaaaacagaaattaaagactg

SEQ ID NO: 41291 - DNA, 201 bp, Homo sapiens
cccacgggccaggactgggatctggactgggccatggcccattggatggcagaaaggttctcactgaagcccccataaaggtgggactcactgggaaaccsctctctgtggtgccagggaaggacgtctgtgggaggtgcctaccaaggaagtctctggaaatcagcctgcaggggtggagtgccgggaaactcccgcccc

SEQ ID NO: 41292 - DNA, 201 bp, Homo sapiens
ttaggagaggaatcactgtgaatgtagacctcgggttggtcattttcctagtaagatagaccagactgactggaaaagtcaccctcttgggctatcctgcrtatgtggctcggcattgcttccgtcaggataatgcatcagtttcttggacaaagggtgcatttctgctatttgaatgcagacatatttttggatataagc

SEQ ID NO: 41293 - DNA, 201 bp, Homo sapiens
ctggcagagggcttttttctgatcaccacccatgttaattagatatgcatgtatgtgtatgtatgatgtatatacccatatacacacagtctatatatacwtgtatgcgcacatacacatattttaaggaaagaattataaaatgatcaattcaagcttactatatgctagaggtgaggaatatttgaatacaagtcttat

SEQ ID NO: 41294 - DNA, 201 bp, Homo sapiens
gagttcgagatcagtgtggacaacatagggaggtcctgtctctacaaaaaataaaaaataaaataaaaaaataaaaataaaaataaataaaaagtagttgsgcgtgtgttgtggagcatgtgggggtcccagctacttggcaggctgaagcaggaggatcgcttgagctcaagaggttgaggctgctgtgagctatgatct

SEQ ID NO: 41295 - DNA, 201 bp, Homo sapiens
tcccctttctggcagagggcttttttctgatcaccacccatgttaattagatatgcatgtatgtgtatgtatgatgtatatacccatatacacacagtctrtatatacatgtatgcgcacatacacatattttaaggaaagaattataaaatgatcaattcaagcttactatatgctagaggtgaggaatatttgaataca

SEQ ID NO: 41296 - DNA, 201 bp, Homo sapiens
tactggccaggtagaaagggcgtccaggtgaagggaccctggttcagtgatctccaacctgcacgtctcatttgtgaggaagccgtagggtgtggactttycttgtttctgaccttgagtgattagaaaatagcagcttttatatgtcacaaatggactttagataagcatgaagatgacgaagactgtggaatatgtagc

SEQ ID NO: 41297 - DNA, 201 bp, Homo sapiens
ttctttttctttttgtaaaaattgtacagagtttaaagttagtcaggtatgtctattaaatttttacgtaaaaagttaaagcagccctcagcatcaacttyttcttcatttctaactcatttagtgaattcagttggtctttatatatgtagctttaagtaattgcatgtaaactgttacttcttcattttctagtcttag

SEQ ID NO: 41298 - DNA, 201 bp, Homo sapiens
tttggctactaaagggtaaagagaatcaggccgagcacagtgactcatgcctgtctgtaatcccagcactttggaaggccaaggtggaaggatcgcctgastccaggagttcgagatcagtgtggacaacatagggaggtcctgtctctacaaaaaataaaaaataaaataaaaaaataaaaataaaaataaataaaaagt

SEQ ID NO: 41299 - DNA, 201 bp, Homo sapiens
gtcgttgtgagcagtgccttggtcccgatgatgattctccaaaatgtaatctctgctgacagaacaagagtctgcaaattgggagtctggaaagggaagakaagggctttgtccctggccccaaagactcagggagaggtttactggccaggtagaaagggcgtccaggtgaagggaccctggttcagtgatctccaacct

SEQ ID NO: 41300 - DNA, 201 bp, Homo sapiens
tggccccccagaaattatctccagcagcagcaacagagaggactggaatgccattgacaggtcccacaagtcagcaatcagcacgccattttttaaaattwatgttgctattgtatcgtaaggttcttctgaagcgaccacttcataacactgtgtagtccaatccctaagctgggcaatttttttttcccctttcaatac

SEQ ID NO: 41301 - DNA, 201 bp, Homo sapiens
agaagacagttttttttgtttaaattgttataaataagtaagtgtatgcaccactatgccatgtagcatatcaagattatttttctttcctgcaccttatwttttccctggagttaatactcatctttttttagaaatttgctgagtttgtgatgtacctatcattcaacctcaaactttcatgtgattgtctaaatctca

SEQ ID NO: 41302 - DNA, 201 bp, Homo sapiens
gatgagttaaaaaaaaaaaaaaaaaaaaagttgcctggcttggtgcagtggctcatgcctgtactcccagcactttgggaggctgaggtgggcggatcatytgaggtgaggagtttgagaccacactggccaacatgttgaaacccgctctctactaaaaatacaacaattagccaggtgtggtggcgcacgcctgtaatc

SEQ ID NO: 41303 - DNA, 201 bp, Homo sapiens
ttaacatgctgttagtgcatgcaaaaaaaagcccagtaattgtagggctcatcagtacattgttaattgatcctcatttcctattattttacctcaaagcmaacacatcattcaccatagtgacaccagagttgtttatcttctctgtgcaagtgtgtgctctttttagcaagctttttggatcctctgtttcagagggcc

SEQ ID NO: 41304 - DNA, 201 bp, Homo sapiens
tatcattcaacctcaaactttcatgtgattgtctaaatctcagttccttttattagaaaaaaaaaaaaaaacaactcccctggagcctttgtaccttctgyagtttggggttgttgtcctttttgcttggtgcacaggaatacttggtgatgttctttttaaaactgccctcacattgtatcctggaaagttcatttacct

SEQ ID NO: 41305 - DNA, 201 bp, Homo sapiens
gaaagtgtcatgtcaaagataaagggagaacagcattttctttttttacaagtcactcttacttaaacacacagcatgactctccttacacatttatttcrgaagagcaaagtccgggtccccaggctcaactatcagccgccttctcatcccaagggctgtcaccaccagaaatttaacatgctgttagtgcatgcaaaa

SEQ ID NO: 41306 - DNA, 201 bp, Homo sapiens
tcagaaattgggaaggagggtcaggtagctataagcaaaatacaagagaaatataagagaaagaaagacttgtatctgttgttagtgagtttttgtggtgrtgatacattaatggaggcaacagagggtcagaaatcagggaaatcagggtggaaaatagcccagcagaggggaaaagaggaagtctgaacgagggccaca

SEQ ID NO: 41307 - DNA, 201 bp, Homo sapiens
gtgagccgagatcatgcctgggggacagtgagactctgtctcaaacaaattactccaaaatttagtggctaaaaaacaacataaaacaagaaacatttctkttgtgcctcctcttttcctccctccctctttctcatagttaatttgtttgaatcaggattcaaataaggtcgatgcatttttaatctataggttttgtct

SEQ ID NO: 41308 - DNA, 201 bp, Homo sapiens
aggcaacagagggtcagaaatcagggaaatcagggtggaaaatagcccagcagaggggaaaagaggaagtctgaacgagggccacattgcagatagaggcyggtgtactggtctgctcaggctgccataacaaaataccacaggctggatgacttgaacaacaaaaatacattttctcatagttgtggagcctagaattcc

SEQ ID NO: 41309 - DNA, 201 bp, Homo sapiens
tccccgattacaatatagagaggctaaattatagtccatatcacttttcctttaaatccctttacttttttgtgctacaagagtttcagaataataattcygcagaaaaaagtactgattgtccagcagttgtgtcaggtagaaaactgggatgcccgactgcattggtttagccagaactgtggccatgaaaccttgcct

SEQ ID NO: 41310 - DNA, 201 bp, Homo sapiens
aatctctagcttctcaaactgtttcgtggtggagtgccttttgggcacaggagaaggaaataagagcctcgcgaggtttgggaatgctgcctctagctctyacactgcatgcagaattcctactctgagagctcactttatctcaaaaacccatgcatattctgcatctactctgaattccgcagtgttgtgtgttactat

SEQ ID NO: 41311 - DNA, 201 bp, Homo sapiens
tttgaaaacttaccttgtttatatgtttcttctgttgcaatttcttccattacctggaatagctgctttggacggcaaaccaagcaatgccctttcacagstgtgggatgaatggggaaagaagtcttggtaaggaagcaattcagagaacatggaagcatctcatggcagcagtcacaattttgtgttgcgtaatatttc

SEQ ID NO: 41312 - DNA, 201 bp, Homo sapiens
atttggtagcttgactggggaagaattggcttcccaaatcacccagattactagcagactttatttccttgtagctttttgactcggcctggcttcttgcygactgttggctgttggctggaggtacccctcagctcctagaggcatcaacagttcctgaatatctgggcttttcccacaaagcagcttccttcatcaagc

SEQ ID NO: 41313 - DNA, 201 bp, Homo sapiens
cctttttttctctgaagtcattgctcctgtgtgtgtgtgtctgtatataaaaaaaagtatgtatacatatacgtatatgtatgtgtatagataaaaatgcrtgtatggtgctgggcgcagtggctcacgcctgtaatcccagcactttgggaggctgaggcgggcgaatcacgaggtcaggagatcgagaccatcctggct

SEQ ID NO: 41314 - DNA, 201 bp, Homo sapiens
ttatcccttctgttgatgcaattaaagctaatggatctcatatatatatatatatatatatatatatatatatatatatatatatatatatatttatatawatatattttatatttaaaaatatttatattttatatatttttatatatttatgcaagtatatatctaaatatataaaatatatataaatatatacatata

SEQ ID NO: 41315 - DNA, 201 bp, Homo sapiens
acgaaggaggaggaggaggaaaaggtgacttgcctctagctgatgtggattatttctcttttttaatttccatgtctgcgtagcttcatcatagatctcarcttaaggacaatgaaagtcgtttattgagtacttagtatgtgctggttgcagagccaagtcttttttttttttttttttttcctccttttttgagagaga

SEQ ID NO: 41316 - DNA, 201 bp, Homo sapiens
atcatcaaaaatagagatgacagccaggggtggtggtgcatgcctataatcccaacacttttggaggccaaggtgaggagaccacctgaggtcaggaattyaagactactgggcaacatggtgaagctctgtctatcctaaaaatgcaaaaattagccgggagtggtggtgcatgtctgtagtcacagctacttgggaggc

SEQ ID NO: 41317 - DNA, 201 bp, Homo sapiens
ttgattgcttctcttcccattgtttatagatacccattctcgtaatgatggcactgtgtctgtcatagaaggcctaattctccctgttaacattgaacatraaaacctcatatgggccaggcacagtggctcatacctgaaatcccagcactttgggaggctgaggcggatgaatcacctgaggttgggagttcgagacca

SEQ ID NO: 41318 - DNA, 201 bp, Homo sapiens
tgccatccacggacggcttaagtgttaacagttcagtggagggtcagcgtgacagccttttgcacccacatctgggttcttgtccagtgtccaggaggaaygaggtctcatgagcaaattttaaggatggcaaatgtgggggattttattgctgatgaaagtggctttcactgggaagataagctaaaaagaagacaaagc

SEQ ID NO: 41319 - DNA, 201 bp, Homo sapiens
aaattttgttttctatttttcatgtttttgggtttttctagatggcctgtctttaacacttcttgatatttttgattaaattttcatatatcatcaaaaayagagatgacagccaggggtggtggtgcatgcctataatcccaacacttttggaggccaaggtgaggagaccacctgaggtcaggaattcaagactactgg

SEQ ID NO: 41320 - DNA, 201 bp, Homo sapiens
gcccaggcgaggatgaggagtaactgagctgcagaccattgtttagccctccttccacctgggagactggctgctggttctcattgcttctgtgggtctcyaggtttctatcattacacagattagcacacggttccatgatcatggacccgttcagtacacaatgaaatcatttgcaaagcaccttggggtctgttagag

SEQ ID NO: 41321 - DNA, 201 bp, Homo sapiens
atggttgtcttcttttttattccatgaaacaaattgattaatgtgtcgagggagcaaggtggtacttatacctacccagcctgcttgtgtgtgtctcaagktggagagaggctgtggaaacaatagagagaatagcatggaaggccacgttgcaattaaacaagattgggaaagaagacgggactaaaatcatgccttgaa

SEQ ID NO: 41322 - DNA, 201 bp, Homo sapiens
tttctttcttttttttttttagggagggtctggctgtattgcccaggccggagtacagtggcacgatcttggcttactatagccttgacctctctggctcmagtgatcctcccacctcagcctcctgagtcactgggactacaggtgcacactaccatgcccagctaagtttgttcattttttgtagatacagggtctgac

SEQ ID NO: 41323 - DNA, 201 bp, Homo sapiens
ttaattttgatgctggtttttgatgatgtattgaaaacttgtataaactggcaattacaactggaaaacatttctagtttagaagagacccttatttttcrtatgcttaggaatatccagcaagccacttttaaaggctttttatcacattttattcttaagctttctgaattccttattatattttgcctgataaatagt

SEQ ID NO: 41324 - DNA, 201 bp, Homo sapiens
aacaactaattaataaatatttgtgaatatagtgagtgactaaagtaatgcattaatggttgaatggctggccaccgtgcctcatgcctgtaatcccagcmctttgagaggccaaggcaggcagattacttgaggtcaggagttcaagatcagcctgggcaatatggtgaagccccgtctctactaaaaatagagaagtta

SEQ ID NO: 41325 - DNA, 201 bp, Homo sapiens
tcagccttttctctcgatctttttttttttttttttcctttcttaagaaagggtcttgctcttttgcccaggctgcagtgcagtggtacaatcagagatcmctgcagcctccaactcctaggctcaagcgatcctccagcctctgcctgccaagtatctgggactacaagcatgcactcctgtgcttggttaattttgact

SEQ ID NO: 41326 - DNA, 201 bp, Homo sapiens
acccctgccagaaataaagggattaatctctttttgcttggcatagggagaagacagtgtctgctgatgtgcttaacttttttttttttttggtcaggtgygtaggtatgtgactgaaacccatagactttgcacatattgtcaaatgactttccagagggactcaggcactttatttaattaatgccaatgaagcccgtt

SEQ ID NO: 41327 - DNA, 201 bp, Homo sapiens
aaaaagttcccaacacttgcatgtcttacttctttaacctcatagaacccaacaaataagttataagaaagggagaagaggccgggagtggtggctcatgyttgtaattccagcactttgggaggccagggcgggtggatcacaaggtcaggagttcaagaccagcctggccaagatgatggggaaaccccgtctctacta

SEQ ID NO: 41328 - DNA, 201 bp, Homo sapiens
agttaccttctgtttgtaaacatctgtttggaaacgtttgctggtgcccaccccagcacccccccacccctgccagaaataaagggattaatctctttttscttggcatagggagaagacagtgtctgctgatgtgcttaacttttttttttttttggtcaggtgtgtaggtatgtgactgaaacccatagactttgcaca

SEQ ID NO: 41329 - DNA, 201 bp, Homo sapiens
caggaaagacaatgcagctttgtgttttggtttttatcagttaccttctgtttgtaaacatctgtttggaaacgtttgctggtgcccaccccagcaccccyccacccctgccagaaataaagggattaatctctttttgcttggcatagggagaagacagtgtctgctgatgtgcttaacttttttttttttttggtcagg

SEQ ID NO: 41330 - DNA, 201 bp, Homo sapiens
ttgcaccttttaattgctggatgttttccagaaaggctgtttgcagtagttccagtgggttcatctgtgaatcaggaaagacaatgcagctttgtgttttkgtttttatcagttaccttctgtttgtaaacatctgtttggaaacgtttgctggtgcccaccccagcacccccccacccctgccagaaataaagggattaa

SEQ ID NO: 41331 - DNA, 201 bp, Homo sapiens
ttcctcatgctttctctctttccagacaataaactttattttcttcataagaattcagtctacgcaagggtattaggcagcttgtttgcaccttttaattsctggatgttttccagaaaggctgtttgcagtagttccagtgggttcatctgtgaatcaggaaagacaatgcagctttgtgttttggtttttatcagttac

SEQ ID NO: 41332 - DNA, 201 bp, Homo sapiens
tggcgttcgctttacccttgcccttgatgtggtgccgagttgtcaggattctcgtaaaattcctgggtgatggcttcttctgttctctttatttccttaastgaacatctgtctaattgttcacctccatcgctttagtgctttcctcatgctttctctctttccagacaataaactttattttcttcataagaattcagt

SEQ ID NO: 41333 - DNA, 201 bp, Homo sapiens
tcttggctttggattttgtcccttttttaggctgcggggcggggggtcggttattttataagcaaagaagtacagccagtatgattctgaagcaactaggycacagtagaaaaaagttggagagtgaaatctcaagcaagccaaaaagtgatagatgagttaaaaaaaaaaaaaaaaaaaaagttgcctggcttggtgcag

SEQ ID NO: 41334 - DNA, 201 bp, Homo sapiens
gcctgggcttcccaaagcgctgagatgactgcgccaccacacctgccacaaaatttctttgttatggctgaataatgtttctgtgtgagtgtgtgtgtgtstgtgtgtgtgtgtgtgtgtgtgtgtgtgtttgaataatactcctatgaacattgtaccaatatctattcagatctctgctttcgattcttctgcatatat

SEQ ID NO: 41335 - DNA, 201 bp, Homo sapiens
attcaggcagctgaggcaggagggctgcttgagctcaggaggtggaggctgaagtgagctgtgattgtgctgttgcactccagcctgggcgacagagggasagcttgtctccttgtctctaaaaaagaaaaacatgctcagaggccttgtgagttagctctctccaaagtttttaagacaaggaattcagttaatcaagtt

SEQ ID NO: 41336 - DNA, 201 bp, Homo sapiens
cctgaggtcaggagttcgagaccagcctggccaacatggtgaaaccccatctctactaaaagtacaaaaattagccaggtgtgatagcgggcgcctgtaaycctggctactcgggaggctgaggtgggagaattgcttgaacccgggaggcagacgttgcagtgagccgagattgtgccactgcactgcagcttgggaaac

SEQ ID NO: 41337 - DNA, 201 bp, Homo sapiens
aaaattttcccctttctggcagagggcttttttctgatcaccacccatgttaattagatatgcatgtatgtgtatgtatgatgtatatacccatatacacwcagtctatatatacatgtatgcgcacatacacatattttaaggaaagaattataaaatgatcaattcaagcttactatatgctagaggtgaggaatattt

SEQ ID NO: 41338 - DNA, 201 bp, Homo sapiens
agtgagtatggccttttggtcagcattgcagaacctggcaagtcctaattccctgtgagcttgacacaggaggccgcctcctcctccaggcttacttggargcattctgtcctcttgttggaagggaaattggtatggtagggaggtgcttcttctgggagtgggtttgtaaaatcaagactgttttcatccaaaccagtt

SEQ ID NO: 41339 - DNA, 201 bp, Homo sapiens
aaagtaaacagatcttagagagggacaccgatccctaccctgcatggggttattcacagagccatggggacactaaacgtaccttatctcttgaccatgcyattgattagttatgtgtttgcctgtgttattaataatgtatacattgaaaaatctatgtgcattatagtctttgatcttgtcatgaatttcaaagccaaa

SEQ ID NO: 41340 - DNA, 201 bp, Homo sapiens
cccagtccagtgagtatggccttttggtcagcattgcagaacctggcaagtcctaattccctgtgagcttgacacaggaggccgcctcctcctccaggctyacttggaagcattctgtcctcttgttggaagggaaattggtatggtagggaggtgcttcttctgggagtgggtttgtaaaatcaagactgttttcatcca

SEQ ID NO: 41341 - DNA, 201 bp, Homo sapiens
agattttggaggacttgaaaggttcctgctacctttggctggggatggagggaacatggaagatgggtctttgtttagaggaagctctttatcctggtacsctggaagttggcatagtcttagcagttagtccagatgtgaatttcaggattattctgtgagtcttccaagtcctgtctcagcagtgaaataggctcagtg

SEQ ID NO: 41342 - DNA, 201 bp, Homo sapiens
acccagtccagtgagtatggccttttggtcagcattgcagaacctggcaagtcctaattccctgtgagcttgacacaggaggccgcctcctcctccaggcytacttggaagcattctgtcctcttgttggaagggaaattggtatggtagggaggtgcttcttctgggagtgggtttgtaaaatcaagactgttttcatcc

SEQ ID NO: 41343 - DNA, 201 bp, Homo sapiens
cttgggaagtggactcagaggccaagtgactttgatttttcactttatcctggagtttctcaaccttggcactattgacattttaggccaggagattcttkgttgggggggatttcctgtgagttacaagacattaagcaacatcactggcctctacccactagatgccagtagcatcttctatttcctcaagtctcaaaa

SEQ ID NO: 41344 - DNA, 201 bp, Homo sapiens
aacggctccgccttcctgccagaatttctccgtggggaggagctgccacccagtccagtgagtatggccttttggtcagcattgcagaacctggcaagtcstaattccctgtgagcttgacacaggaggccgcctcctcctccaggcttacttggaagcattctgtcctcttgttggaagggaaattggtatggtagggag

SEQ ID NO: 41345 - DNA, 201 bp, Homo sapiens
ggatcagctggtgctccaggataaaaatcgtgtcaccacttttgccgaaaagtcactgtgtttctcctgtactcagcaggttacagggtgccatattgttytcagtcttccggctctaccctgttttgaagtgcggccgggtgttgttaaacggctccgccttcctgccagaatttctccgtggggaggagctgccaccca

SEQ ID NO: 41346 - DNA, 201 bp, Homo sapiens
tacttttgttctcaccttgggaagtggactcagaggccaagtgactttgatttttcactttatcctggagtttctcaaccttggcactattgacattttargccaggagattctttgttgggggggatttcctgtgagttacaagacattaagcaacatcactggcctctacccactagatgccagtagcatcttctattt

SEQ ID NO: 41347 - DNA, 201 bp, Homo sapiens
tcctggtggggggaccagatgagcaatagatctccatatgcagaggggtaactgagtacgactctgggacttacactagaacattcatattgcaataaagsagatttttcctgagcacctactctgtgccaaagcactattgtaggctgtggagatagggagctgaagtactgaaagcgttacagtcaagggccagaaaac

SEQ ID NO: 41348 - DNA, 201 bp, Homo sapiens
ggctggagtagtgtgcagagcctggcggtgattgttctcattagaaagtatagtgtaatactcaataaattacttttgttctcaccttgggaagtggactmagaggccaagtgactttgatttttcactttatcctggagtttctcaaccttggcactattgacattttaggccaggagattctttgttgggggggatttc

SEQ ID NO: 41349 - DNA, 201 bp, Homo sapiens
caggttttgtttttttgtgtgtgtgttattttgttttttgtttttttgtttttcgggggctggagtagtgtgcagagcctggcggtgattgttctcattaraaagtatagtgtaatactcaataaattacttttgttctcaccttgggaagtggactcagaggccaagtgactttgatttttcactttatcctggagtttc

SEQ ID NO: 41350 - DNA, 201 bp, Homo sapiens
agaaacttggacagaggaaaatgaaaatgttctattaattccactagcatgagataatcactcttaatattttgttgcatgttcttttctttcttctgagkgatagcatttttttcaacaaattgggctcgtaatatataggcacatagatatataattaaaaaaacaagaatttctcatgtcattaaacattgcttgaaa

SEQ ID NO: 41351 - DNA, 201 bp, Homo sapiens
tctatgtaacctcagccatcttggattcccagcttactcacatcatagatggagagtcagttgtttagaaaaaaactttcttttttttttctttccttttkcttttcttttctttctttctttcttttttttttttagggagggtctggctgtattgcccaggccggagtacagtggcacgatcttggcttactatagcct

SEQ ID NO: 41352 - DNA, 201 bp, Homo sapiens
cattcttcacgtctcagatatataaagcttatttcaaaataaattctggggagcgttcaacctgattgaatctgctgtaagctctgttaatatatttgttygagtcacttgcactcaaaaggtttttagacagaatatcacttttttatattattcatggtaatgtaattcccccctttaatctcttcagggtttcccatt

SEQ ID NO: 41353 - DNA, 201 bp, Homo sapiens
agcaacacacaaggattgggagatgttcatggcaagaaaaattcagaagggacattgttgtttcactaattctgtaaaggagagcagcggcatttacttakgccgattccccattctctctttctgtttttaaacagagacagatcttgctctgttgcccaggctggagtgcagtggcatgatggcatgatcatagttcac

SEQ ID NO: 41354 - DNA, 201 bp, Homo sapiens
ctccctctccgttaaaatgcaacttaattggtaaagtttagttgactagagatttcatttatttatttatttatttatttatttatttatttgtttgtttrtttgtttgagatgagtcttgctcttttgcccaagctggagtgcagtggcatgatctcggctcactgcagcctctgcctcccgtgtccaagtgattcttct

SEQ ID NO: 41355 - DNA, 201 bp, Homo sapiens
caaggcgagtggatcacgaggtcagcagttgaagaccagcctggccagcatggtgaaaccccgtctctactaaaaatagaaaaaattagccgggcatagtrgcatgagcctgtaatcccagcgactcgggaggctgaagcaggagaatttctggaacctgggaggtggaggttgaagtgagctgagatggcaccattgcac

SEQ ID NO: 41356 - DNA, 201 bp, Homo sapiens
gaggtggtagatgcttttaaacaaacagatctcaggagaactctttcacaagacagcactagggggatggtgattagaaagcacctcatgatcccgtctasttcctgcagagaacagactagccccctatgcagcacacacctttgtgaggtccctcctccaacacagggattacaattcaacctgagacgtgggtgggga

SEQ ID NO: 41357 - DNA, 201 bp, Homo sapiens
ctgagaaatataaaaaaaaaaaaagcccacattttaaagggaatttggtatttttaacaaagcatcagggggccgggagcagtagctcacgcctgtaatgmcagcactttgggaggccgaggcgggcggatcacaagatcgggagatcgagaccattctggctaacatggtgaaatgctgtctctactaaaaatacaaaaa

SEQ ID NO: 41358 - DNA, 201 bp, Homo sapiens
tgcatgagtctttattttatgtccttggagtgtatagcagagttagatagatctttctggattggcggttgattgaatattggctgtacaaagaaactggwtaggagtatagagaaaagatcaatcatagcactagcttatagtttattttattctttaatgattttttaaaaatatttctctcacttacttgaaaagcag

SEQ ID NO: 41359 - DNA, 201 bp, Homo sapiens
gctgcatcttctaagataatggtttttcatggagactggcattgtcccgtccctatgagggggacatttgggaatggcatttttagtactcacaaggtaastggggcactcttggtcttggggaggggaggtggctggggacgcagagggtcctgcggtgggtggatacttacaacatagaaatgtcctggctcttgatgc

SEQ ID NO: 41360 - DNA, 201 bp, Homo sapiens
gcattccacatacagcagtacctataatgtatatgcttcttaaagaatgcatgagtctttattttatgtccttggagtgtatagcagagttagatagatcyttctggattggcggttgattgaatattggctgtacaaagaaactggttaggagtatagagaaaagatcaatcatagcactagcttatagtttattttatt

SEQ ID NO: 41361 - DNA, 201 bp, Homo sapiens
gccaccaccgccaaccccaccttttttttttccacataagctttcatttctggtaaatacatccttgccagagttcccaggtccaagccggtcctttgtgraccagtatgcagatttgaagttgagcactgtcacttgcctcttaggagtgttttgtgcaaccacatatttgtgttggcagataacagtagaaagaatatc

SEQ ID NO: 41362 - DNA, 201 bp, Homo sapiens
gtcagcgagacagtagagagtggtggagatggtggcgcacaagagggtcagtgccccatctcaaggaacagctgcacctcggcctacgcgattgtgaaaaygtgagcatatgcaggccagaccttggcttctctgtcttcatttttcacaggagccagaagtttggatgtgcaatgtgaaatctcacaaattaaacatgtt

SEQ ID NO: 41363 - DNA, 201 bp, Homo sapiens
tataatttttttcttcttttctatctgctagcaaagtgggtaagttgacccatgacatggtccactggagggaccacatttgtgactctagcaattaagcytcccttctcatctgtggataaaactgacctcccagtgtgctggagtcaaacatattcagcatccaatccacattggactgtttgcatgtaacgtacagaa

SEQ ID NO: 41364 - DNA, 201 bp, Homo sapiens
tttgtttttcttcaaacctagatcaagagtcaaacactcaaatgtttggtgggagcagttgatgatccagagctttggagtcagcgagacagtagagagtsgtggagatggtggcgcacaagagggtcagtgccccatctcaaggaacagctgcacctcggcctacgcgattgtgaaaatgtgagcatatgcaggccagac

SEQ ID NO: 41365 - DNA, 201 bp, Homo sapiens
agttccattaggtgacagtgtgtgcacagtttatggaggatgaagcggaaaacctgagccacaaggcagtagaggttggacgagacactcattccgaaggsgggtgtgtatgtgcaaactgtataatttttttcttcttttctatctgctagcaaagtgggtaagttgacccatgacatggtccactggagggaccacatt

SEQ ID NO: 41366 - DNA, 201 bp, Homo sapiens
aaagaggaagggttggaggagacaaaaaatggagtggtagtggcattgggaggtccaagagtggatggtatcacagaagccaagacaggaaagtgagccasaagtgagggaggagcaggatcctctgcaacagggcagtctagtcttagcagagaggaggttgctgaatttattgattgagaagccactcctcgccaggca

SEQ ID NO: 41367 - DNA, 201 bp, Homo sapiens
tgcaggtgtcatggatgaaacagcaatgccttgcggtgacaaattcagtgtagaaataattttagcaagcccagtgattggaaaacaatgactcaactttragctatattgattttgtatttctgggctcagcttttgactcagtctcattccccagaaataatccctgttaacatttcggtttgtgttatggaagtgttt

SEQ ID NO: 41368 - DNA, 201 bp, Homo sapiens
gccttgccataccttttcccatttatccatggattggtatgagccctaatggtgcacccttccgacaatccttcatccttcccagacgtttcatcagccargtgaaatttgcaattgtttcagtgattgaaattatgcttggagtgcaggtgtcatggatgaaacagcaatgccttgcggtgacaaattcagtgtagaaat

SEQ ID NO: 41369 - DNA, 201 bp, Homo sapiens
gggaggccaaggtgggtgggtcacctgaggtcaggacttcgagaccagcctggccaacatggtgaaaccgcatctctactaaaaataaaaaaaaaaaaaaattagccaggcatggtggtgcatgtctgttatcccagctacttgggaggctaaggcaggagaatcacttgaacctgggaggcagcggttgcagtgagccga

SEQ ID NO: 41370 - DNA, 201 bp, Homo sapiens
gccaggaggaggtcctagtcagctgatgtgagattacatggccctgactgtcttgcctggtgctgcaggccaccttcacagccttgccataccttttcccrtttatccatggattggtatgagccctaatggtgcacccttccgacaatccttcatccttcccagacgtttcatcagccaagtgaaatttgcaattgtttc

SEQ ID NO: 41371 - DNA, 201 bp, Homo sapiens
caaggtgccggcacagttgatgtcttctgaggtctccctcgtctgcttgcagacagccgccttcccaccgtgttctcacgtgacctagccgctgtgtgcaygcatccctggtttcttttcctgtgttcagatgtcctcttctttgaaggacaccactcagattgcaataggacctgccctgatagcctcattttttacata

SEQ ID NO: 41372 - DNA, 201 bp, Homo sapiens
gaaagctcgcctgaaaggccaagagtaagattcttttaaaatcatgcccaagttttaaaggaatataaaactttctctttaaaaatatacctttctgcttycatcccctaacccacaaagctcaagtctagtttaattcaaacttggaaatagttcttttattattgctccctgcaatgggaacagagctgaggctcctaa

SEQ ID NO: 41373 - DNA, 201 bp, Homo sapiens
tattgaaggctgagaacagaacgacaaacaacaatcacaacaaaaggctggggaagattttcctggtggggggaccagatgagcaatagatctccatatgyagaggggtaactgagtacgactctgggacttacactagaacattcatattgcaataaagcagatttttcctgagcacctactctgtgccaaagcactatt

SEQ ID NO: 41374 - DNA, 201 bp, Homo sapiens
ttggtaagtgttattattgaaggctgagaacagaacgacaaacaacaatcacaacaaaaggctggggaagattttcctggtggggggaccagatgagcaayagatctccatatgcagaggggtaactgagtacgactctgggacttacactagaacattcatattgcaataaagcagatttttcctgagcacctactctgt

SEQ ID NO: 41375 - DNA, 201 bp, Homo sapiens
gtatctgtaatatggggaatcataaaagcacctacttgttaaggcatattaaatgcaacgctactttgaaggactcatagtagttaacacccagtttggtragtgttattattgaaggctgagaacagaacgacaaacaacaatcacaacaaaaggctggggaagattttcctggtggggggaccagatgagcaatagatc

SEQ ID NO: 41376 - DNA, 201 bp, Homo sapiens
acacttaatacctccttggctttgaagctctcctttgtggcactacaaggtcctctttgaaatcccacattcttttttggatttaggtattaaccccttgstgtgaggagaaagataattgtcaacacacttaggagagaaatcatgcagtaaagctgacccgacatagactaacttaaaactaactagttcattagtgct

SEQ ID NO: 41377 - DNA, 201 bp, Homo sapiens
ccttaacttaatcacacttgcatttgattttatcatgcaaggtagcatactcacaggtgggattaggacttagacaccttcagcaagaaacattactcagsccaacacactcctcaaacctaagcttattcccaatcacacagtcaggagaggatgcccacaatgcacttggggttttgtgtctgtgtctcccctccaaga

SEQ ID NO: 41378 - DNA, 201 bp, Homo sapiens
ctgggaagtcaaggctgcagtgagcaaagatcacaccactgcagtcaagcctgggtgacagggcaagaccctatatcaaaaaaaaaaaaaaaaaaaaaaawatatatatatatatatatatatatatatatatatatgtatatgtatatataaatttaaggaagcatagaattgaagaggctattccaaggtcacatgact

SEQ ID NO: 41379 - DNA, 201 bp, Homo sapiens
acattggtaaaactttgtctttgttttaaataatcagtcagttgtctcaatccataaaagagtatctcttgtacaatgtctgcttttgagtgattcacttsgatgcgtactgaaaatatacctttaagtagttgagtgacttgaaatattggtaaatgttctttaatattttgtctgtcagtgttagagactatcaggtta

SEQ ID NO: 41380 - DNA, 201 bp, Homo sapiens
aatgttaaggctagagtagaatgacatcatgggaaggcttattgaaacttggagtggattcgtagtctgccacgagaatccttgtctgatgtttgtgggtstgtaggactgaatttgaagtccttaaatggatgtcctaacagtgaataaagacgtggggcttgaatttatgtattatcttattactctgtcattttcttg

SEQ ID NO: 41381 - DNA, 201 bp, Homo sapiens
ttctggtgcctccacgtggaagtgggctgccacaatacttctaaagagaattggcatttttctttaaataagaaggaggaggatgaggagagagacgacasaaaattcactcacagaagtgaacataaattctaacattggtaaaactttgtctttgttttaaataatcagtcagttgtctcaatccataaaagagtatct

SEQ ID NO: 41382 - DNA, 201 bp, Homo sapiens
tatacgtatatatgcgtatatatatacgtatatatacgtatatatgcgtatatatatacgtatatatacgtatatatatatgtgtgtatatatatatatawaaatatatttaaataatgttaaggctagagtagaatgacatcatgggaaggcttattgaaacttggagtggattcgtagtctgccacgagaatccttgtc

SEQ ID NO: 41383 - DNA, 201 bp, Homo sapiens
tcctattcagaggctcagtttctctgcaggacagaaatgagaggcacaaaatttcatagctgtcttgcccctcctgtggtctgtaagaatgggaccaggaytcctagttgtgaacccgaaaggatttccattaggatcaggaagtgtgagttggcttagaaaaagtaaagaaagaacagtgctgtttcatttatttatcat

SEQ ID NO: 41384 - DNA, 201 bp, Homo sapiens
taatataattaatgtaaaaacacatacttcttttcaacaaaaactggctctctttgtagtctcttttttaatttggtgcaatcacttaaaaagtttagcasatttaaaattttacatcattttaaaattgtttctcttttataagaaggatgctatttactattaatgtagaagtacaaaggaaacggttactttggattt

SEQ ID NO: 41385 - DNA, 201 bp, Homo sapiens
gggtgatctccactgaactcctattcagaggctcagtttctctgcaggacagaaatgagaggcacaaaatttcatagctgtcttgcccctcctgtggtctrtaagaatgggaccaggactcctagttgtgaacccgaaaggatttccattaggatcaggaagtgtgagttggcttagaaaaagtaaagaaagaacagtgct

SEQ ID NO: 41386 - DNA, 201 bp, Homo sapiens
aaggccaatgcgggtggatcacctgatgataggagttcaagaccagcctcaccaacatggtgaaaccctatccctattaaaaatacaaaaattaacaggcrtggtggcgggcatctgttgttccaggtactcgggaggctgaggcagcagaattgcctgaactcgggaggtggaggtagcagtgagctgagatggcaccac

SEQ ID NO: 41387 - DNA, 201 bp, Homo sapiens
aacattctaaaattagatgagggtgttttttttttttttctttttgagacagggtctcactctgttgcccaggctggagtgcgatggcacaatctcagctsattgtaacctccacctcccgggttcaagcgattctcctgcctcagcctctctagcagctgggactacaggcgcctgccaccatgcccggctaacttttgt

SEQ ID NO: 41388 - DNA, 201 bp, Homo sapiens
agcctggccagcatggtgaaaccccgtctctactaaaaatagaaaaaattagccgggcatagtggcatgagcctgtaatcccagcgactcgggaggctgargcaggagaatttctggaacctgggaggtggaggttgaagtgagctgagatggcaccattgcactccagcctggcagacagagtgagactccatctcaaaa

SEQ ID NO: 41389 - DNA, 201 bp, Homo sapiens
tgggattacaggcgtgagccactgtgcccagccaaacctcggcacttttatccaacaaatatttatttcgtgactattatgagtcaggcttaagaatacaytagtaggtacagcaggagagcatgtagaagaggatagatgtagaaaatcgggacggcatgttaggaatatagataggaattactaaggaaaattgtattt

SEQ ID NO: 41390 - DNA, 201 bp, Homo sapiens
gtgaaaccccgtctctactaaaaatagaaaaaattagccgggcatagtggcatgagcctgtaatcccagcgactcgggaggctgaagcaggagaatttctkgaacctgggaggtggaggttgaagtgagctgagatggcaccattgcactccagcctggcagacagagtgagactccatctcaaaaaacaaacaaaaaaaa

SEQ ID NO: 41391 - DNA, 201 bp, Homo sapiens
ttcctccccttttatcaagagccgtaagtccttggaaaatgcaaagagggggaaaaagaagaaaaacagcaacgagtttattggagagttaacacttaaakactccagtacattgagtgtgacatgcctgtgtaggagactgtctgtcccccaaataattgacaatttctctccatctaacaagaaaatatatggcacttt

SEQ ID NO: 41392 - DNA, 201 bp, Homo sapiens
atacacaatatgttatatgagatcttcacccaatcaaggattaaatggccaattcctaaatgatgcctacctttttatggccatgtatacctttgcctcartactactggcatttgctgacatccatttatcaagatacagggatggatttctagaaggcccaggcaggggtgctggccaggagacaccaggcatagacct

SEQ ID NO: 41393 - DNA, 201 bp, Homo sapiens
tcgcagacacggaaaaaaggattattcctccccttttatcaagagccgtaagtccttggaaaatgcaaagagggggaaaaagaagaaaaacagcaacgagkttattggagagttaacacttaaatactccagtacattgagtgtgacatgcctgtgtaggagactgtctgtcccccaaataattgacaatttctctccatc

SEQ ID NO: 41394 - DNA, 201 bp, Homo sapiens
gtggcgtttccacacacagggaagcagatagttccattaggtgacagtgtgtgcacagtttatggaggatgaagcggaaaacctgagccacaaggcagtakaggttggacgagacactcattccgaaggcgggtgtgtatgtgcaaactgtataatttttttcttcttttctatctgctagcaaagtgggtaagttgaccc

SEQ ID NO: 41395 - DNA, 201 bp, Homo sapiens
aagatgagtggcgtttccacacacagggaagcagatagttccattaggtgacagtgtgtgcacagtttatggaggatgaagcggaaaacctgagccacaakgcagtagaggttggacgagacactcattccgaaggcgggtgtgtatgtgcaaactgtataatttttttcttcttttctatctgctagcaaagtgggtaag

SEQ ID NO: 41396 - DNA, 201 bp, Homo sapiens
tccactttccttaatgttccttaaatgttgtacatatcttaaaagtggattcctcataaaacaatatggactatggtcttattctgtttaacggtatgaargctcgcctgaaaggccaagagtaagattcttttaaaatcatgcccaagttttaaaggaatataaaactttctctttaaaaatatacctttctgctttcat

SEQ ID NO: 41397 - DNA, 201 bp, Homo sapiens
cctactgggttcaagcgattttcctgcctcagtctcttgagtagctggtgttacagaagcctgctaccatgcctggctaatttttgtgttgttttattttwattttatttttttagcagagacagggtttcaccatgttgaccaggctggtttcaactcctgacctcaggtgatctgcctgcctcggcctcccaaagtgct

SEQ ID NO: 41398 - DNA, 201 bp, Homo sapiens
atatgtgactatgatgagtaatgattttgaacatgaaaactatgcttattgctcatatctatgttattttattatttactttttttgagatggagtctcgytctgttgcccagtctggagagcagtggtgtgatcttggtttactgcaacctctgcctactgggttcaagcgattttcctgcctcagtctcttgagtagct

SEQ ID NO: 41399 - DNA, 201 bp, Homo sapiens
agtgtttaaggatccacttcctctacatccttaataatacttgatattatcggtcttctaaattttctgtttgggtacatagtggtattttgttgtatatwtttttttaattgtgaaatatgtgactatgatgagtaatgattttgaacatgaaaactatgcttattgctcatatctatgttattttattatttacttttt

SEQ ID NO: 41400 - DNA, 201 bp, Homo sapiens
gtggcttactcattgtcattggtgagtagtactccattgtgtggagaaatcacattgttttaaaaatacctaattacctgctgatagacatttgggttctkcccagtttttagctgttgtaaatggatactaatgtgaacgaagccaccgtgaatattgatgcactagtctttgtgtggacatatatctgttttatcttgg

SEQ ID NO: 41401 - DNA, 201 bp, Homo sapiens
cagtggcttactcattgtcattggtgagtagtactccattgtgtggagaaatcacattgttttaaaaatacctaattacctgctgatagacatttgggttsttcccagtttttagctgttgtaaatggatactaatgtgaacgaagccaccgtgaatattgatgcactagtctttgtgtggacatatatctgttttatctt

SEQ ID NO: 41402 - DNA, 201 bp, Homo sapiens
agcacatgcttcttgtagagtctgcagaatcggagccaattaaatctcttttcattataaattatccagcctcagttacttctttattgcagtgcaagaayagcttaacacacaaggtcttacccttgatcacggtctgcagcatgtcttttaccatgtaaggtaatatgttcagtggctgtgggggttaggatgtggact

SEQ ID NO: 41403 - DNA, 201 bp, Homo sapiens
tacctagattatctagcatgagctccctgtctcaaggtgatagagtttgcatgtttttctcctgcacatgccatgttgaaacataatccctagtgttggcrgtgggtgtgctgggaggtatttggatcatgggggtggaaccctcatgcatgacttacggccatccctttggtgataagtgagttcacatgatatctggca

SEQ ID NO: 41404 - DNA, 201 bp, Homo sapiens
gagtaagactccatctcagaaaaaaaaaaaaagaattaatatcaattttccacaaactcttttaaaaaaacagaagaggaggaaacactttccatctgacwctgtgaagccactattactctgacaacagaggcagacaaagatatcacaagaaaaggaaactttaggtcactttcacttataaatagagatgcaacaatt

SEQ ID NO: 41405 - DNA, 201 bp, Homo sapiens
ccggctccttcctcccacatcaccccacatttttttttctttctcctcaccatcaagaaatgttccagaatgccattattcttcgtcaccacggtcaggtrtatcatcctaagggcagagggtgaaggtgcgtaattagtgtttcaccagactgagcatcatcctcggtgcaggggagaatggctggtatttatgagtgaa

SEQ ID NO: 41406 - DNA, 201 bp, Homo sapiens
aaagagagaaagagagagacccaaaatagtcaaactgaggttttgggttctggtgatagaatattaaatcataatgaagcatttaatgttttgttgttgtkacaattgttgttttaccctagggctatgcaaagtagtttaaggatgtatttatttcagtggggaaaaaaagtggaggatatacatttggaggataaggaa

SEQ ID NO: 41407 - DNA, 201 bp, Homo sapiens
tctgccttcaaaagcctgaatttccaaggctttctgccatgagtacttagctttgaaaaacatgagcatatttttcattcttcttgccggcctctccctgygtcatgcctgttattcttttctccctcaacattgacctaggtcagaaggaccctattttaatgtttagcgtttgggggtcactccatagagaggggtttg

SEQ ID NO: 41408 - DNA, 201 bp, Homo sapiens
acatcgcataaagatgcagatttgattccccctttactcacactataaaaacaaagtttttaaagtggttagccatacctggaaatgtaaatgcattcgcstaatgtaatgccaaagaaaaattaagacaaatgataccacatcgctgccacaaactgcggctcgtacaaaattcactttagttattatgctgtgaatacg

SEQ ID NO: 41409 - DNA, 201 bp, Homo sapiens
ggcatcttccccgccttcctccacctctgccttcaaaagcctgaatttccaaggctttctgccatgagtacttagctttgaaaaacatgagcatatttttsattcttcttgccggcctctccctgtgtcatgcctgttattcttttctccctcaacattgacctaggtcagaaggaccctattttaatgtttagcgtttgg

SEQ ID NO: 41410 - DNA, 201 bp, Homo sapiens
attacatttgaatctttcagcaagcttttggctgagctgggcatcttccccgccttcctccacctctgccttcaaaagcctgaatttccaaggctttctgmcatgagtacttagctttgaaaaacatgagcatatttttcattcttcttgccggcctctccctgtgtcatgcctgttattcttttctccctcaacattgac

SEQ ID NO: 41411 - DNA, 201 bp, Homo sapiens
tggagatttcaaggatcatcagggaagctagtgtggctggagatgaatggagtgggtaggagaggtgctgttgggggatgggtatctggtagactctgagrtagcggtgaggaagacattagagggtttgagctagagagtgatgcgagctgtttgatttttgaaacatcgctggatttcagaatgaagtccagactgcat

SEQ ID NO: 41412 - DNA, 201 bp, Homo sapiens
agaatacatacttcataagcaggaggcatatatgtttgtatatatgtatgtacatagacttcatacacatgaaataaaatttcaaatggttcctctgttcmgcaaacgtgacccaaagttttggcttatttggcgttttgttttcttgaagacatacttgaattttaaatagttaatccatttaagaagtttcatttaagg

SEQ ID NO: 41413 - DNA, 201 bp, Homo sapiens
gatgttaattgagatataggagtacttcattaagtctccagaatacatacttcataagcaggaggcatatatgtttgtatatatgtatgtacatagacttsatacacatgaaataaaatttcaaatggttcctctgttcagcaaacgtgacccaaagttttggcttatttggcgttttgttttcttgaagacatacttgaa

SEQ ID NO: 41414 - DNA, 201 bp, Homo sapiens
gattacatttgaatctttcagcaagcttttggctgagctgggcatcttccccgccttcctccacctctgccttcaaaagcctgaatttccaaggctttctsccatgagtacttagctttgaaaaacatgagcatatttttcattcttcttgccggcctctccctgtgtcatgcctgttattcttttctccctcaacattga

SEQ ID NO: 41415 - DNA, 201 bp, Homo sapiens
tattgtgaaataccatttgacccagcaatcccattactgggtatgtaaccaaaggaatagaaatgattgtattataaaggtacatgcacatgtatgttgaytgcagcagttttcacagtagaaaagacatggaattcacccaatccgaattttaacaagtcttccatgtgattctgagacagactcatgttcgtgtggttc

SEQ ID NO: 41416 - DNA, 201 bp, Homo sapiens
tggactgattgattacatttgaatctttcagcaagcttttggctgagctgggcatcttccccgccttcctccacctctgccttcaaaagcctgaatttccmaggctttctgccatgagtacttagctttgaaaaacatgagcatatttttcattcttcttgccggcctctccctgtgtcatgcctgttattcttttctccc

SEQ ID NO: 41417 - DNA, 201 bp, Homo sapiens
cacccaatccgaattttaacaagtcttccatgtgattctgagacagactcatgttcgtgtggttctggctctgcagaactgaggtgggccccaaaacttgmgtttctaaaaggtactagctgagcatgatgactcacatttgtaatcccaccactttgtgaggccgaggcgggtggatcgcttgaggccaggagtttgaga

SEQ ID NO: 41418 - DNA, 201 bp, Homo sapiens
gttggtggactgattgattacatttgaatctttcagcaagcttttggctgagctgggcatcttccccgccttcctccacctctgccttcaaaagcctgaayttccaaggctttctgccatgagtacttagctttgaaaaacatgagcatatttttcattcttcttgccggcctctccctgtgtcatgcctgttattctttt

SEQ ID NO: 41419 - DNA, 201 bp, Homo sapiens
acgcagactcatgtgacccatcagggcttcagggtgtcctctggtgaagggcagcagcaggacagagccccacttctagctctggctcaggttaagtgttkcagcgccctggcttctgtgtcttcatgtgcaaatggagataatagtcagcacctatgcaggttactgtgaaaacaggttggaagtatttatctacagcgt

SEQ ID NO: 41420 - DNA, 201 bp, Homo sapiens
acaatggataattttttagcaaaaggatgttccacatttaactggacattatctctgtctctctccctccttacctgcctcctatcctctcttcccacccsctacgatgtctatgtatagtttcaacctggcaaccctgtgacctcagcactaggatatggatagaaaacatagtagcccctatttacctttatcttttat

SEQ ID NO: 41421 - DNA, 201 bp, Homo sapiens
aggagacgggtcggggagactgtgcccatttgacaggtgtgaatgcgaacagaggctgcagctggttagaccagggctgtgcaaccctagagccattgccytgaccacaaagccacagtctcctagtcctaatattaagaggtaggaggtagatagagattgtcccttaagccacattccattcttcatatttttgtaccc

SEQ ID NO: 41422 - DNA, 201 bp, Homo sapiens
gctggccaggagacaccaggcatagaccttcctttctcagagccttcgtggcccctagtttgaatctttgagtcactgcagtaaagttcctgatgtttgasagtactccttatgaagggagtcatatgagttgctagctgggttctctggatggtggtgtcatgccaacatgggagccactagcacaaagaacatgctagg

SEQ ID NO: 41423 - DNA, 201 bp, Homo sapiens
cgcagattgccagtgactccgggaatgcctaggtttatgtatggattaacacagtgatagaccctgagtagcaaaagacgaagactaattacctgacagarctcccctccactcgcctgggtcattgaaattaatttctgctttcaagcttggcagaaagcagctgcagaatttcagttcaatacttaaattaacggggag

SEQ ID NO: 41424 - DNA, 201 bp, Homo sapiens
ggattaagttagggagacagtaatggtattgttagcaggctatttcaatgattttctctgcggaagagtagggaaaggtgacattccaactgggaatattmgactctgcagatccctactcggagtttttcagccctgttttaagtgccgagctgggttttgcctcatgatccaattgttttattagcgaaatcatcatct

SEQ ID NO: 41425 - DNA, 201 bp, Homo sapiens
tccttctttctgatcttgagaccttgatttgtccagtattttctcatcattagctgagtgtaagcattttttggcaagaacattataaaaatgatgtggtrtctttcttagtatattatctcaggtagaacataatgttgatctgtctcatccctggtaatgttaaccttgatcacttggttaaggtgatgtctgctgagt

SEQ ID NO: 41426 - DNA, 201 bp, Homo sapiens
tacagaccccaaagcttgctgtcccctgggcaggtgcatgagggggtcccaggcaatcaggctcttctcaaacctgaattatacccggcctcagggtatargggtcaggcagctgtttgacaggattcttgcaaatgtttttggtttctctgtctactcattacgtacactctgccagaggttgaaaactcaatgttgaga

SEQ ID NO: 41427 - DNA, 201 bp, Homo sapiens
ggtgatgtctgctgagtttttccaatgtaatgttattaatttttcctttgaaattcataattatttgaagggagatgttttgagatgatgctggcagcccygttttccttaaactttcacatgctgactttctattgttggatcttgcctgcagcagtgtttaccatgatgcttggctagtggtgactatgtatttccctt

SEQ ID NO: 41428 - DNA, 201 bp, Homo sapiens
tcttgcttgtaggaagaacaagagacgagacacagcaaggtgatgatgggtatgtgaagcaggataaagaaaaaaacaggacaggcattacaggcttaagyctgtaatcccagcactttggaaggccaatgcgggtggatcacctgatgataggagttcaagaccagcctcaccaacatggtgaaaccctatccctattaa

SEQ ID NO: 41429 - DNA, 201 bp, Homo sapiens
tcacagtgtttctagctcccctttccaatacatctctctctctctttctctctctctctctctctctctcacacacacacacacacacacacacacacagscaaatcagacaccaacataaactgtagagttaacattctttttccaccctcacactttttttagctccgatctgtgttcaatttctgcctgagagagtga

SEQ ID NO: 41430 - DNA, 201 bp, Homo sapiens
tctttaaggaaaaaggttggatggatgatgtcaaagacccactgttcagtctttctttcttatattttgagccttaattgggtccctgtgagtcaatttcmgatgatagaatttgctgttttatagttttactctaacatgtagtaccttgagatagaccagtgatcccagactaagaattattcagaatcattcaccgtc

SEQ ID NO: 41431 - DNA, 201 bp, Homo sapiens
tttatttattcatttatttgagatggagtctcactctgtcacccaggctggagtgcagtggtatgatctcggctcactacagcttccacctcccatgttcmagctattttcctgcctcagccttctgagtagctggaattacaagcgcccgccaccatacttcgctaatttttgtatgtatatgtgtatatatatgtatat

SEQ ID NO: 41432 - DNA, 201 bp, Homo sapiens
atgcctggctcaagtactagttctatgtcaatgatggtaccaatggactctaactttagaatgttgttgactgaaggcccctgccccctgccttgctttargtggaggatctggtcaaggctttgtgaatcaggggatgctccacacctttctgctctctgcaacagggccagggatctgagtcccttcttgtctatccag

SEQ ID NO: 41433 - DNA, 201 bp, Homo sapiens
agctgacttccctctccttcattcccaaccaagtttgaccccgccgcagtggagattgtggcagatgggtcagatagcatgtgtcctgtcgctgtcacaastttttaataagggctgggggtcctcttgaagagcccaggaactgcagtccctcctctatgccttcccctgaacacagtgcgccctcactaataaattctg

SEQ ID NO: 41434 - DNA, 201 bp, Homo sapiens
taaattctagttagagacttaggatttccagtgactgaaattggaatgttaggtgttaaagacacacatcaaaatgagactcttggttttttttataagtrcaaggattgcaagatacctgaaaagggagtatttttcccccacatgcatctcaggagggtagcctcagatataagcttaggagtcctgaatttatcatca

SEQ ID NO: 41435 - DNA, 201 bp, Homo sapiens
ctagtgtgggtctatacgtgacactaggtgtagtgtaggtgacaaacaaaaagcagctttcgtttgcttaaaatttttgttctctgcctttatttttcaaraatattttcactaggtatagaattctaagatgaaagttttattttttttcagctgtggcttccatcattttcctgagaggtataactatcagtcttgtag

SEQ ID NO: 41436 - DNA, 201 bp, Homo sapiens
ttccattactcacctcctaggttaagcattgttattattattgatatagtaatttttgctatatattttaaaactcacagatttcactcttaccatttggrtcttaacatgtcgttaccctttatgttgctctttgttactttctgcatctctgggtttatagctaaggtcattttcctcctgcctgaagagcatccttta

SEQ ID NO: 41437 - DNA, 201 bp, Homo sapiens
aatagatggcatgaagcacttcagctttgcattcaagtactcatgtgtatgatcaagcatcgtcatgatcattattgactggaaagcctgtaagaagaagsggataaggccagggtgcagactgggcagtagttccctgtcatgaatccactctgcagttgttttataacatgcaacaaaaactaaagtctaatagcactc

SEQ ID NO: 41438 - DNA, 201 bp, Homo sapiens
gccaccatgcccggcaatttttttttttttttttttttaagtagagacagggtcttgctgtgttgcccgggatggtcttgaactcctgggctcaagcgatmctccctccttatcctcccaaagtgctgggattacaggtataaaccaccaacccagcctcaggagaaataaatcttttaggaaaaaaaagtgacacagttt

SEQ ID NO: 41439 - DNA, 201 bp, Homo sapiens
atggcaccatctgagctcactgcagcctcaaccgcctggtctcaaatgatccacccaccctagcctcctaagtagctgggaccacaggtgcatgccaccaygcccggcaatttttttttttttttttttttaagtagagacagggtcttgctgtgttgcccgggatggtcttgaactcctgggctcaagcgatcctccctc

SEQ ID NO: 41440 - DNA, 201 bp, Homo sapiens
ttgtttgttttttgagacagagtcttgctcaggctggagtgcgatggcaccatctgagctcactgcagcctcaaccgcctggtctcaaatgatccacccamcctagcctcctaagtagctgggaccacaggtgcatgccaccatgcccggcaatttttttttttttttttttttaagtagagacagggtcttgctgtgttg

SEQ ID NO: 41441 - DNA, 201 bp, Homo sapiens
tgctataaacgcttaaggattccttagctttagggaatgaaactacttgggcaagaatataaaattttgttctattttattttaaagctctggttacatayggtcaagttgcttcccaaaaagcgtctctgtcaggatgatcttatgaacgacgttagtacctcaattttactgtcccatccttttttcctccttccttgc

SEQ ID NO: 41442 - DNA, 201 bp, Homo sapiens
gttacagcagacatagcaaactaatgcaaatgggctttgcttgaagtccctcagctgctaagggtcagaaacaggatttgaacctacagttttgaggcctsaacctgctatgcagtgctttcttcctgatagtgaaaccactgtggtcccaaacccacagggctctatttagatttaaacaagactatgaatgtaaacaga

SEQ ID NO: 41443 - DNA, 201 bp, Homo sapiens
aggcagcagaattgcctgaactcgggaggtggaggtagcagtgagctgagatggcaccactgcactccagcctgggcaatggagcaagactctatctaccmcccaccctgcaaaaaaagaaaagaaaggaaaaaaaatcttggtgcttgtaggagaggcatttatttcttttaggactggacggggcttggagggtttcca

SEQ ID NO: 41444 - DNA, 201 bp, Homo sapiens
taaacaagaacaaatggagaatctttcactatgactgcaactgaaaagaggagtaatggaaggacatgtactcttcccatatatttttaaacaattactgkatctgatttttcatttttcattttttttttttctggaagaaagagcagatctggataaagtcagtatacaatgtggtctttggtgacagacccaagttca

SEQ ID NO: 41445 - DNA, 201 bp, Homo sapiens
ttgataactccctggcaggttctcttcatcgggcctccacatagggtatgcgaacctcttcatgtttttaaaagggagagatttaataaaggcaatttggkacttaaaaattgttagaagagctaaaagagtagttttgaggttgaccttcagaacggcttcctgaataatacagaagtgaccctccaggaaggcccttcc

SEQ ID NO: 41446 - DNA, 201 bp, Homo sapiens
gtgacaataatggagatagagaaaacaggatggattcaggaaacatgaccacactgagcatattcaaatgtaattgtcagttttcgtgtctccctcccackggaccacaagcccctaactcttcatgtacacaccctgactcccagtgtgggctggccacccaggaggcacccagtttatgtgtgctgcgtgagtgatgtg

SEQ ID NO: 41447 - DNA, 201 bp, Homo sapiens
ctctctctctttctttctctttcctttctttcttccatttaaattgagacagggccttgctctgtcactctggctggagtgcagtggcataatcatagctsactgtgcccttgaactcttggactcaggcaatccctcgacatcagccttctgagtagctgggactaccggtacctgccaccacacctggctatttctttt

SEQ ID NO: 41448 - DNA, 201 bp, Homo sapiens
cttagatcagacgtgcttttgaaatatccagatatatacaacacaaagagcgaagtttgttttatattttgtttgtttaggttttttttttttttttttttggctggtgtttactgaatgcgtgcaaggctttctgtcacaggctctgtgttaagatatttaacgggtgtttcattttcccagcaatgctataggacacag

SEQ ID NO: 41449 - DNA, 201 bp, Homo sapiens
ttattttcagtttatcaattaagttgttcaagtcttctatatactttgtgtttgtctgcttattttatctgttactaagagggatatgttaaaatcttccrttataattgtgaatttgtctatttattgtcctaattctgtcaatttttgacatatatgagaggctctattattaagtacatataaatttagaattgtcat

SEQ ID NO: 41450 - DNA, 201 bp, Homo sapiens
caacactcagtctgatagtttagaaagcttttgcaaggcattccccaatataaccattaagcatcaaactctcaaatggaagtttcgaaaaacagaaaaaagtgagcataaatgcaaactatcaccccatgtaatagtttatttatttcatgctccacttttctgggcagttttgttgtcattctctctctacctcttttt

SEQ ID NO: 41451 - DNA, 201 bp, Homo sapiens
tgatcatcctcctgagtagctgggaccacaggtgtgcaccaccacgcccaactaattttttgtagagatggaattttgccatgttgcccaggctggtctcraactcttgggctcaagcgatccacccgcctcggccaccccgattcctgggattacagccatgagccactgtgcctggtcttctttttaatatatgtagtt

SEQ ID NO: 41452 - DNA, 201 bp, Homo sapiens
attataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgcttt

SEQ ID NO: 41453 - DNA, 201 bp, Homo sapiens
cttagggttcataggatctgtagtccttttctttatttttcatttttaaaaacaactttattgaggtatgattgacgtacaaaaagcctcacgtatttgaygtatagaacttgataagtttggagataagtatatacctgtgaaaccattatattttataagtacatgatacaatatgagcacagtactatatggtagatc

SEQ ID NO: 41454 - DNA, 201 bp, Homo sapiens
caagcacctatcgttttcctgtgtattccaagaggccagtgtggctggtggaataagatgttttcctgttttcaagatgcagtggactctcttttatttarcagcagtgtctatgtgttaggaatccatgtgagttctctaagtctgggacaacgataggtgtgtctgagtcctgcattaccatggtttattctttccttt

SEQ ID NO: 41455 - DNA, 201 bp, Homo sapiens
cttaagatcttcttagggttcataggatctgtagtccttttctttatttttcatttttaaaaacaactttattgaggtatgattgacgtacaaaaagcctyacgtatttgatgtatagaacttgataagtttggagataagtatatacctgtgaaaccattatattttataagtacatgatacaatatgagcacagtacta

SEQ ID NO: 41456 - DNA, 201 bp, Homo sapiens
gttgttcaccatatcttaagatcttcttagggttcataggatctgtagtccttttctttatttttcatttttaaaaacaactttattgaggtatgattgaygtacaaaaagcctcacgtatttgatgtatagaacttgataagtttggagataagtatatacctgtgaaaccattatattttataagtacatgatacaata

SEQ ID NO: 41457 - DNA, 201 bp, Homo sapiens
aagaggaggagtccatgcaaagataaaggcagagggtgaagttgtgcatccacaagctcagatatgcctggagccatcaggtgctggaagagatactggargatctcttccagggcctctggaggaagcacagtcctgctaactcttaatttgggacttctggcttccggaactgcaaaagaacaagtttctgttgtgtgt

SEQ ID NO: 41458 - DNA, 201 bp, Homo sapiens
aacctgcctggccttgtgttatatcgatgctttctcaatctgttaaaaacgtagctgctattgaatgactaagaattgtttactctcatttccactctctkacatcttttttttttcttttaataccctgtgatgaaactgtgaagaaagatattcctgatcattgctttgacctggaaatttcaaagggacccacagtcc

SEQ ID NO: 41459 - DNA, 201 bp, Homo sapiens
tatttgtaacaaacaaataaacaaaaaacaaaataaataaaagctacccagcttagattattttgtcataaaagccccaaaagactatgacaaatccttcyatctatgtgtccttaggcaaaatacccaaactctctgaataccaattttctcatccaaaaaaatgggtgaataatatctaagaggtaataaccctaatac

SEQ ID NO: 41460 - DNA, 201 bp, Homo sapiens
aagatatccctaaagacatcctgctggtttcagtggctcatgcctgcaatcccagcactttgggaggctgaggcaggcggatcacttgagctcaggaattsgagaccagcctggccaacatggtgaaaccttatccgtaaaaaaaataaaaaattagccagacatcgtggtgcatgcctgttgtcccagctatttgggagg

SEQ ID NO: 41461 - DNA, 201 bp, Homo sapiens
tgtcagatgtgccctttctggtaataaaaagtcctttgccgtgggttattttgtcaagtgagatagcaggacttaacaggtttgtttgggaaaataaaatytgatagaaaaacggcatgcttttcccccacagatttcttggtagcatcattcaaaactacagtgagcagtatctttgcaggattttaatatttattcatt

SEQ ID NO: 41462 - DNA, 201 bp, Homo sapiens
aagtatgggccacacaaaacaggtctgtgggcttgacttgtcctctgatcatcagtttgtgacctctgttctaaagagtgaaaactatgtaagatagtatmagataagtaggtatttaaattactttgcaccttttccatttcatagaacttgaatgtttgtgttcaaagcttaaaacccaagacagtgagctattaagcc

SEQ ID NO: 41463 - DNA, 201 bp, Homo sapiens
ttaaaggtagaaacagaaaaaaacaggcagaaacataaaaagctcggagatggcttcctattgcttcttcattctgggccagagcaaatcatatggtcgtrctccagggtgaggaagtatgtcccacttacagactgaaaaggtgctgcaagtctgcacggcagagggcatggataaggggttcgtaaaaacttagggcca

SEQ ID NO: 41464 - DNA, 201 bp, Homo sapiens
gataacatttctataaaatataaccatattttcaaacaaagagaaaagtggcgttgtgctacatttcttctccagtgcttggttccctagaagacagccarattctcacttcttttcctgcattcagtctcttgtgatatcacatggcatgtggcctctgaaaaactccgctgtctagttgtaaaagaatacaagtaagta

SEQ ID NO: 41465 - DNA, 201 bp, Homo sapiens
gtaatgccagcagcacgggtgatgatcatggtcaacatgaccaactagaaagcccaaaccccacctctagctgacagtggcttctcagctaacctgtcacyacgtgggattgggcccccagtggtgtaagctttttcagagaagctacacatctagcttttggacctgtgatctccccaatgttttaatgctggcaactaa

SEQ ID NO: 41466 - DNA, 201 bp, Homo sapiens
ttaacttctttaaacctcagtttcttcatctgtaaaatgcacatcataatatctctattcagagatacaggtggttctattaaacacatcaactctgtgtwtataaagtcttaacccattgtggaataaattaagtgctcaattaaatgttagctgctgctattaataacaacaataataatattttcttcacgcatgaaa

SEQ ID NO: 41467 - DNA, 201 bp, Homo sapiens
ttgtagagatggggtcccactgtgttgcccaagctggtctcaaactgaactcctgagctcaagcgattctcccgccttggcctcccaaagtgctaggatgrtgataggcaggagccaccacacctggccatggataacatttctataaaatataaccatattttcaaacaaagagaaaagtggcgttgtgctacatttctt

SEQ ID NO: 41468 - DNA, 201 bp, Homo sapiens
gacacatgccactacacctagttgatttttgtattttttgtagagatggggtcccactgtgttgcccaagctggtctcaaactgaactcctgagctcaagygattctcccgccttggcctcccaaagtgctaggatgatgataggcaggagccaccacacctggccatggataacatttctataaaatataaccatatttt

SEQ ID NO: 41469 - DNA, 201 bp, Homo sapiens
aagtgattctcctgcctcagcctcctgagtagctgtgactacggacacatgccactacacctagttgatttttgtattttttgtagagatggggtcccackgtgttgcccaagctggtctcaaactgaactcctgagctcaagcgattctcccgccttggcctcccaaagtgctaggatgatgataggcaggagccaccac

SEQ ID NO: 41470 - DNA, 201 bp, Homo sapiens
acacatgtgcagccactgtatgacgtctggattttccttgacttatggtgatcactattgggaggtggtaagcaaacaggtgacataatttgaatcatggktttaaaagacgccatggttgccatgaggaggacaatgcgtaggaggcaggagtgaaagctaaaggatatgctgggaggtgaccctggagttaaagagagc

SEQ ID NO: 41471 - DNA, 201 bp, Homo sapiens
tgcaaaggccctggggtggaaacacactcgatgtgttcaagggagagtaagtggtgaatgggtttggagccaacagggataatagacaacgctatcaagargggggccaaccacacatgtgcagccactgtatgacgtctggattttccttgacttatggtgatcactattgggaggtggtaagcaaacaggtgacataat

SEQ ID NO: 41472 - DNA, 201 bp, Homo sapiens
aaatctcaagcacaggtgcagcaagtgcaaaggccctggggtggaaacacactcgatgtgttcaagggagagtaagtggtgaatgggtttggagccaacarggataatagacaacgctatcaagaggggggccaaccacacatgtgcagccactgtatgacgtctggattttccttgacttatggtgatcactattgggag

SEQ ID NO: 41473 - DNA, 201 bp, Homo sapiens
tccctaactcatgatggtttgacttatgatttttgaactttacgatgatgtaaaagtgatattcagtagaaactgtgcttagagtacccatatgactattstttcttcctttcagtatagcattcaataaattacatgagacattcaaccctctaataaatcaggctaagtgttaaatggttgtgttaaatgcctttgtcc

SEQ ID NO: 41474 - DNA, 201 bp, Homo sapiens
ttggaaccctgcaacttccatcatagggaacggctcctgggctagcctgctggatgatgagagacacgtagtcactcccagaaccggcatccagcagttasttagttagacatgtaagtgaggccatcccagactatccagccccagctgtgccaattcagaggagaagaaactgcacatttcactcacagcactgcaaaa

SEQ ID NO: 41475 - DNA, 201 bp, Homo sapiens
ggagatgttctttgagattcggtgattgagttgtgaacatatggactgagggtgttttgtggtaaggcttgagtcatgtctgtagcaaggatgtttcctgrataatgtgcactgagcatcaagtgcctgcagtggcctggcgggtaatgccagcagcacgggtgatgatcatggtcaacatgaccaactagaaagcccaaa

SEQ ID NO: 41476 - DNA, 201 bp, Homo sapiens
agtctcacacttgacatagtagggtttgacatggtttaaataaaatctcaaccagatcagtgggagatgttctttgagattcggtgattgagttgtgaacrtatggactgagggtgttttgtggtaaggcttgagtcatgtctgtagcaaggatgtttcctgaataatgtgcactgagcatcaagtgcctgcagtggcctg

SEQ ID NO: 41477 - DNA, 201 bp, Homo sapiens
cttacgaagtcaaactctcagttaaatgtttatctagcaattcatttcttctgagccatctgttgctaggcaggatctgcagacctcttggttgcatgtgstgggttgggtcctccaagtctcttagcacaaagtcctgatgtttaaatcctgcaagcgaattgccacctttatttccaagttctcctcgaaatccacatt

SEQ ID NO: 41478 - DNA, 201 bp, Homo sapiens
tgagcctgctacccttgtgcttctctgtccacgcaaagccaagtgctactgcggggttttccaaggcatagctagcatcctaatagtctcacacttgacakagtagggtttgacatggtttaaataaaatctcaaccagatcagtgggagatgttctttgagattcggtgattgagttgtgaacatatggactgagggtgt

SEQ ID NO: 41479 - DNA, 201 bp, Homo sapiens
cctgcctcagcctcccacagtgatgggattacaggcatgcgccaccatgcctggctaatttttgtatttttagtagagatggggtttcactatgttggccrggctggtctcgaactcctgggctcaagcaatgcactggccttggcctcccacattgctgggattacaggcgtgagccaccatgcctggccccctttcact

SEQ ID NO: 41480 - DNA, 201 bp, Homo sapiens
ttgacactaaaagcttaagtcccatgatttgcctttgtggatggaaggccttggccttcttttatgatatatgtgttggggggaggcatgtggtatgtggrgcgggtaaaatacgagcctcatgcctgtctaagctggtgacttggcttggaaaagatgatcattcgtcaacgcatcacaagtcacagggcttatctccat

SEQ ID NO: 41481 - DNA, 201 bp, Homo sapiens
aaacttaaaccagaaggaaccttcctggcatcggggaaagaagctgcctttttcttagctcctacctctgtgggagctttgtcagtatttgaggggacagrgttcccaccttcatgttttttgtgcctgaggattctgtgggcgactgtccccacctgtccagcctaccagtgagtctcatggtgtgcggctgcctgctcc

SEQ ID NO: 41482 - DNA, 201 bp, Homo sapiens
ttaggcctatcttcttgctttatgcataatggcagatctccagggagggagaggatgtgtgctggaagattctacaacttgttgattggttcctaaagatsgttttagtgctatgtttgtggggcggggctggagggggctggaaatcaccatctctgtggccttttaattgtgcccagttacaagtaacatttgtcccca

SEQ ID NO: 41483 - DNA, 201 bp, Homo sapiens
tttaggagctctgtgccaggaacctggatgaagacccagtatgtatttcttattatatcacaatatcacaaatccacagtcacatggtgattgtggtagtktggggggcctgatggtggggtacacctgcttgaagtcaggctaccatgcccattggggtcctcccccttttttgccctctgatcttgtgagttccttaac

SEQ ID NO: 41484 - DNA, 201 bp, Homo sapiens
ttctaaatactctcccagagtagggaggaaaaatcatccaaactacttggtaattgaattcaagagtgatggaccaaaaattattaatgcattcccttccstccaccagccaaagaggattccatctttattctcctcccaaatgcaggctccattaaccttttacctttctttctttccggtctttcttttctatatctt

SEQ ID NO: 41485 - DNA, 201 bp, Homo sapiens
accccatgcctggccaatttcaaggattttaggagctctgtgccaggaacctggatgaagacccagtatgtatttcttattatatcacaatatcacaaatscacagtcacatggtgattgtggtagtgtggggggcctgatggtggggtacacctgcttgaagtcaggctaccatgcccattggggtcctccccctttttt

SEQ ID NO: 41486 - DNA, 201 bp, Homo sapiens
tcagcttcccaatgtgctaggattacaggcatgagaccccatgcctggccaatttcaaggattttaggagctctgtgccaggaacctggatgaagacccartatgtatttcttattatatcacaatatcacaaatccacagtcacatggtgattgtggtagtgtggggggcctgatggtggggtacacctgcttgaagtca

SEQ ID NO: 41487 - DNA, 201 bp, Homo sapiens
agtagtagtgaatgccctgactttggggtttgcagtaagctaggattaagtgcttcacagtgaggcacagtggggagctactctgaggatgaattgcctartaaataagtgaggtttgtataaccgaggccagatcttagaacctcctgctatctgtacatagaagaatgttttagtcagaggcaaggcaaggtcaccagg

SEQ ID NO: 41488 - DNA, 201 bp, Homo sapiens
gtacaatggctgacgcccgtaatcccagcgctttgagaggccgaggccggtgtatcgcctgagtccaggagttagagaccagcctgggcaaacagcctgargcaaaacctcatctctacaaaaaatacaaaaaatcagctgggcgtggtgatatgcatctgtggtctgagctactcaggaggataaggtgggaggatcatt

SEQ ID NO: 41489 - DNA, 201 bp, Homo sapiens
acactctaaggaatggcatgacattctcctttcttctcctgcattcattggaacctgaatgtagtattaattataagactgttagacttcaggggactacmctcttattctaaaatagtggtcaactaactgtgcccttcagacagaattcctgcccagcacctggctttgtaattaaagttttactggaacagaggaata

SEQ ID NO: 41490 - DNA, 201 bp, Homo sapiens
ttgctgagaggtggggagggggtgggggctctgtgcatggaatggggggaaaagcttcagggaagggcagtgcaaattgtttctggactgatgccatcttytaataatagtagttaatagactgggtacaatggctgacgcccgtaatcccagcgctttgagaggccgaggccggtgtatcgcctgagtccaggagttaga

SEQ ID NO: 41491 - DNA, 201 bp, Homo sapiens
agaggaataccagttaatttatatctcgtctgttgccacttttgctttcatgctattaaagctgagtatttgggagatacttgaaaaatctaaaatgcttmctatctggccctttagagaaaaggttttccaatctctgttctagaggattcgtggtcatttggaaagaaaagtatgttaagacaaaatgagcaggtggtt

SEQ ID NO: 41492 - DNA, 201 bp, Homo sapiens
gaaaagtatgttaagacaaaatgagcaggtggttggattagtattttctttctacacatatagaaactgttcctatcatacctgactcagttttcaaactkgcttaatccaaagcctggggggtggatgtaggagagaagttgaaattagctggggttttttttttgtatcacaaaagttacatttttttttttttttttt

SEQ ID NO: 41493 - DNA, 201 bp, Homo sapiens
ggggatcacccctcccatatgacctctgactttggccatgtgactggccttggccaatttggaaagtgctttgcactggggcttgcctttccttgttgatmtttggaaccctgcaacttccatcatagggaacggctcctgggctagcctgctggatgatgagagacacgtagtcactcccagaaccggcatccagcagtt

SEQ ID NO: 41494 - DNA, 201 bp, Homo sapiens
agaactccactctcagaatctacacctggaggggatcacccctcccatatgacctctgactttggccatgtgactggccttggccaatttggaaagtgctktgcactggggcttgcctttccttgttgatctttggaaccctgcaacttccatcatagggaacggctcctgggctagcctgctggatgatgagagacacgt

SEQ ID NO: 41495 - DNA, 201 bp, Homo sapiens
gctgtgcagaagctcttatctgcgcatcccatctcatggacaccatgctttccagcccgttccagcaagcacatgagaaagtccactctggcaagacggaraaaatgcttctgctgaaataccaggaaggtgtggaggctgggtgtcattgttccccctcctgatcatggcagcttcaggccagacaatgtcttgaacttc

SEQ ID NO: 41496 - DNA, 201 bp, Homo sapiens
tggaactacaggtgcccgccaccaggcctggctaattttttttgtattattagtagagatggggtttcaccgtgttagccaggatggtcttgatctcctgwccttgtggtccgtctgcctcggcctcccaaagtgctaagattacaggcacgagtctccgcacccggccctgtttttgcatttttagtagagacgggtttt

SEQ ID NO: 41497 - DNA, 201 bp, Homo sapiens; identical to SEQ ID NO: 8532

SEQ ID NO: 41498 - DNA, 201 bp, Homo sapiens
gacgggttttcaccaggttggccagcctggtctcaaactgttgaccttaggtgatctgcctacctcggcctcccaaagtgctgggataacaggcgtgagcmactgcgcctgtctacattttctgtctttactggtattatggtgggaacccataaaccactgcgaggcagataccattttaagcaggaaaccttatttttt

SEQ ID NO: 41499 - DNA, 201 bp, Homo sapiens
gatcatttgaaatctggaacattctttcctacggtggttgacttttcactgcctttgaggttctttccaagtaaaggcgttattctttgtggtgtgctccyggaggtcactaacaaaacgtctccagcaggtgttgtgtggattcccccaaatccgtaggctcttatttcctagacatgaagagtatgtgcgccttctttt

SEQ ID NO: 41500 - DNA, 201 bp, Homo sapiens
accaactccattgttactagatatcctgacactgaagaagctaaaaccaaacaacaatgacaacaacaaacccaagtctgccttatggcacattcttcacrtcgtaacaccttccttgggaccctatttctcagtatggacctgactctcccagggatcctagaatgcaagcatagtgattgcaaaccagaccatttgagg

SEQ ID NO: 41501 - DNA, 201 bp, Homo sapiens
cgcccagagtcgtatcacttgactgcatttgaccattcagttttcagaccaactccattgttactagatatcctgacactgaagaagctaaaaccaaacarcaatgacaacaacaaacccaagtctgccttatggcacattcttcacgtcgtaacaccttccttgggaccctatttctcagtatggacctgactctcccag

SEQ ID NO: 41502 - DNA, 201 bp, Homo sapiens
acatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgca

SEQ ID NO: 41503 - DNA, 201 bp, Homo sapiens
aggaataataattcagtgaaaggaaatttggatgacatgaactcatttccattagacttgagccacacaaatcaatgggaaaagaaacagctgaatccagsataatatctggctatttggagtgggcatgataatggagggagattggggaggtaacaaaccagctactattaagttcaagtcatgtcagttattcaaatt

SEQ ID NO: 41504 - DNA, 201 bp, Homo sapiens
aaaacagcaggaaaaactacatggttggctggatttggccaagttgacatagagagccaatccctcatctccagcagggcttttactcaatgatacagtgygcatgaattgcttgggggattgtgtacaaagtgcagatttggttataggaggtcagggaggggcctcaattctacattcctaagaagctcctaacaggct

SEQ ID NO: 41505 - DNA, 201 bp, Homo sapiens
cagggttattaggaataataattcagtgaaaggaaatttggatgacatgaactcatttccattagacttgagccacacaaatcaatgggaaaagaaacagytgaatccaggataatatctggctatttggagtgggcatgataatggagggagattggggaggtaacaaaccagctactattaagttcaagtcatgtcagt

SEQ ID NO: 41506 - DNA, 201 bp, Homo sapiens
ctcagcctcttgagtaactgggactgcaggtgcatggcactgtgctccacaattttttttttttttttagagatgggatctcactgtgttgtccaggctgrtctcaaacccttgggtttaagtgatcctcttgcctcagcttcccaatgtgctaggattacaggcatgagaccccatgcctggccaatttcaaggatttta

SEQ ID NO: 41507 - DNA, 201 bp, Homo sapiens
ttctcctgcctcaaggagctgcttctagtgtgtgctcttaaccctaaaggaaggaaacactgtgtcttcctcttctctcatacagagcccttcccatgacmaatgtgtggagtgttccctccttttacgtaattctccaattttctggaccccagcttggtgtcctacaattcagttttgacactaacgacccagagtcag

SEQ ID NO: 41508 - DNA, 201 bp, Homo sapiens
ctgagtagctgggactacaggtgcatgccaccacacctggctaacttttatttatttttagtagagaggcagttttgctgtgttgcccagactggtcttgractcttgagctcaagaaatccttccacctcagcttgacattacaggtaagagccaccgtgtccggcccccctttcttcttttttaaagtggggtattaag

SEQ ID NO: 41509 - DNA, 201 bp, Homo sapiens
agaatagatggcaaatcccatgatttgtatttgactgacagtcaagaccctgtggggtgtgagcctggtgggggcattccaggctggtttctcctgcctcmaggagctgcttctagtgtgtgctcttaaccctaaaggaaggaaacactgtgtcttcctcttctctcatacagagcccttcccatgacaaatgtgtggagt

SEQ ID NO: 41510 - DNA, 201 bp, Homo sapiens
tatttggaccacttctccctctttccggacagctgcttagtaggtttagcttaaattatacacatgccaagcatgtacacatatgagaagcctatatctcrtaatatccacagagaatagatggcaaatcccatgatttgtatttgactgacagtcaagaccctgtggggtgtgagcctggtgggggcattccaggctggt

SEQ ID NO: 41511 - DNA, 201 bp, Homo sapiens
gaagagacctcaattctgtgccttgatgggattacaccgaagggagcactggtaggctgttgatgaaacaggtggtatttggaccacttctccctctttcmggacagctgcttagtaggtttagcttaaattatacacatgccaagcatgtacacatatgagaagcctatatctcgtaatatccacagagaatagatggca

SEQ ID NO: 41512 - DNA, 201 bp, Homo sapiens
ttggttgtcttagtagataggagtgtgagtacagaattatacgaagtgagaccatgggtgtgtgtgtgcacgtgtgtgcgcatgcctgtgtgtgtcattgsttagttaacaaaaggattgccctctgaagaacatgaacttgggccagacagcacgtgtagggggtggaattatggagcaattgttactttcttgtattaa

SEQ ID NO: 41513 - DNA, 201 bp, Homo sapiens
tcctgcctcagcctcccaagtagctgggagtaaaggcacatgccaccatgcccagctaatttttgtatttttgttagagatggggtggccaggctggtctwgaactgctgacttcgagtgatccaccggccttggcctcacaaagtgctgggattacaggtgtgagacattgtgcccagcttggagcatcttaatttaagc

SEQ ID NO: 41514 - DNA, 201 bp, Homo sapiens
ctaaatcataaagaaccctgtctcgagcagacgagaaagagtaacggaggcctcaatggtgaaaggaaatcctgtaccagctgtgaaaacaatgagacacrttcagtaatagaatatagtgtgcttacaaattcagagttgggttcccttcttctcttgaagtggctataaattaattcatcaaaataaaaaaggccaaac

SEQ ID NO: 41515 - DNA, 201 bp, Homo sapiens
agagccaaggtcaatctgaatttttctttttctttcttcctttttttttttttttttttttttaaaaaaaaaaaggtgcttgaattagaaaggtagcacaytgtccacatggacagtgcaggatggggctggctttttcatttctgagagctggcaatggaatgaaggtctttttttttttcttaatttttcttttttaaa

SEQ ID NO: 41516 - DNA, 201 bp, Homo sapiens
agtaagcacagtggctgggataggaccttggcatctcgtgcgaagcccctctgcctggagtcctgcctctgtgacacttgcttactgtgtgacctgggtcractcatacctactgttcgtcagttttctcatctgtaaaatggggattccagtggttattatgagaattaaatatgacgatacataaatagcacctggaaa

SEQ ID NO: 41517 - DNA, 201 bp, Homo sapiens
aaagtaatataccacttttcgcttttttaatggtgagagccaaggtcaatctgaatttttctttttctttcttcctttttttttttttttttttttttaawaaaaaaaaggtgcttgaattagaaaggtagcacattgtccacatggacagtgcaggatggggctggctttttcatttctgagagctggcaatggaatgaa

SEQ ID NO: 41518 - DNA, 201 bp, Homo sapiens
gttgctgagaggtggggagggggtgggggctctgtgcatggaatggggggaaaagcttcagggaagggcagtgcaaattgtttctggactgatgccatctyttaataatagtagttaatagactgggtacaatggctgacgcccgtaatcccagcgctttgagaggccgaggccggtgtatcgcctgagtccaggagttag

SEQ ID NO: 41519 - DNA, 201 bp, Homo sapiens
aggtgtttcttatttttatcattttccgtaaaggtaggattgtgttgacagccctgtaataaatgtctcttggaagagatgtgttgctgagaggtggggarggggtgggggctctgtgcatggaatggggggaaaagcttcagggaagggcagtgcaaattgtttctggactgatgccatcttttaataatagtagttaat

SEQ ID NO: 41520 - DNA, 201 bp, Homo sapiens
tcttcttgtaaggtgtttcttatttttatcattttccgtaaaggtaggattgtgttgacagccctgtaataaatgtctcttggaagagatgtgttgctgaraggtggggagggggtgggggctctgtgcatggaatggggggaaaagcttcagggaagggcagtgcaaattgtttctggactgatgccatcttttaataat

SEQ ID NO: 41521 - DNA, 201 bp, Homo sapiens
cctccccagattttttttagaactggaagtttccatttcctggcactggtgaaagctctaggacataaaacttgggagccgatggccttcaggctgcccayaatgtgaagagaggtcatttcagacattcagataaagtctgtggctccagtatttttctaggtcttgctccctccctgaccttttcacagtttggtgaca

SEQ ID NO: 41522 - DNA, 201 bp, Homo sapiens
cacgacagtaacaaatatcttagccaacagaacaaaaaatgttcctggtgagaacagccagggattctggaattgactgctgtagttcagaagagatttgscttcccacagggcattgtagagctttatgctgaaaaggtggccccagaggtctgtgtgccattgcccaggtcgagtctgcagtacaaactcctaggaggg

SEQ ID NO: 41523 - DNA, 201 bp, Homo sapiens
cttttttcttttttgagacagggtctcgctgtgttgcccatgctggagtgcagtggtgcgatcacagctttctgcagcattgaccttgtgggctcaagcartcctcctgcctcagcctcccaagtagcttagaaccacaggcatataccaccatacctggacatgtttttaactttaatttttatttttgtagagatgagg

SEQ ID NO: 41524 - DNA, 201 bp, Homo sapiens
actaggaattgaaatggcctgaagctgagtttccactcttgtgaaggctggactgtctcttgttattacagcgagggtataactctttaggatcccgaccmaaggtttggtgtgtttaccgtggccctttcctggtgggtcctgagctcaaatttatgtctttttccttgttataaaattgccaaaagctcagcccatctt

SEQ ID NO: 41525 - DNA, 201 bp, Homo sapiens
atcatacaatgagtggcttaaatatttattcttacagttctagaggctggaagtccgagacgagggtgccaaccttgttgagttcttagtgaggtccctcyttctggtttttaagtagcctgtttcttgctgtgtcctcatatggtggagagctgagaggaattgagagagagagagagagaggtcgcactgtctcatgtg

SEQ ID NO: 41526 - DNA, 201 bp, Homo sapiens
gcgtccaggactaaagtcatgtgcaatttaacaagatcttggtgagataaaggaagttgcgcttgaggaaacattgaaacacaccagatggaattttccarttccctcctacatgatagagactaggtgaagggagatagaccacaaattgattttgtgtaactcttaaattaagtggagcagagttaaaaaaaaaaaatc

SEQ ID NO: 41527 - DNA, 201 bp, Homo sapiens
caaagtaatataccacttttcgcttttttaatggtgagagccaaggtcaatctgaatttttctttttctttcttcctttttttttttttttttttttttawaaaaaaaaaggtgcttgaattagaaaggtagcacattgtccacatggacagtgcaggatggggctggctttttcatttctgagagctggcaatggaatga

SEQ ID NO: 41528 - DNA, 201 bp, Homo sapiens
gcaaagtaatataccacttttcgcttttttaatggtgagagccaaggtcaatctgaatttttctttttctttcttcctttttttttttttttttttttttwaaaaaaaaaaggtgcttgaattagaaaggtagcacattgtccacatggacagtgcaggatggggctggctttttcatttctgagagctggcaatggaatg

SEQ ID NO: 41529 - DNA, 201 bp, Homo sapiens
acatttgggaaatttgtaaagccttactttgaatgtctttttcttcactctatctgtattgtttggtgctttctatataaatttataaattggatgtaccbccacagatgtcggttttctggtaataatacttttttacattaaaaaaaactcctgaaatgaaaatgtaacttagtcttattattgtaatctccccttgcc

SEQ ID NO: 41530 - DNA, 201 bp, Homo sapiens
aatgtccggtttggagttggaggagtcattgattttaggcaaggtgatggtgagcccacagagcacagagttaatggaactctggccgttgatgtagcttygaagcctgaatttaagtcatatttttgaaaagttgcgtcttaaaaagttactagcgatggagaatgaaaagtcaatttggacactttaaaagtgagcctc

SEQ ID NO: 41531 - DNA, 201 bp, Homo sapiens
gaaggcctaggaggtgcagggatgtttatatgggctgctagcgcttagtttcctgccacagggagacagtaagaaaggtgacgtcaatctgagatgagagrgagagcaaaacagttcttttgaccaccttgaccccgaccttgaaataaggtggaactaataaatcccgctttgtgctggagcaagttttggctgagtttc

SEQ ID NO: 41532 - DNA, 201 bp, Homo sapiens
atctaagatagtgatctggttacatagattatcagagatacttttttttttgattatcagagatacttttaaaaaagcaactacaaggtaaggattatcckttaatttagtgtttttctattaaactcaatttgctttaaagttttttacattttgcctcttttttgtatgtttgagtaccacttcctaaccaatcacaat

SEQ ID NO: 41533 - DNA, 201 bp, Homo sapiens
aagaaaactcacagaagcagaaacttagggcttgctttaaatgttatcagtgtgaattgagatggtgtcagcattatttttttaaagaccaaaacaacaakagtaacaaacacacacaagccactgttagattttacaaaactttaaaaagtaattatcttaaagatatctaagatagtgatctggttacatagattatca

SEQ ID NO: 41534 - DNA, 201 bp, Homo sapiens
gccaccttttgccgcagtaacaaacaatcccagactctcaaggcttgcaaaaataaatgtgtgtttgtttgctcataacacatgtggctgagggttggccrtggctccacagtcacaggtgggctttcctgggctcagcttctcacagcgtctccttgcagggcccaggctgtaggagatgtcatcagggcctgcagaggg

SEQ ID NO: 41535 - DNA, 201 bp, Homo sapiens
tcgcaatgattcggtgtgttttgttccgtgcatcctggcatgtgaaagaagtgaggtaaagagtataatttacttccttgttttaaagctagcattgcccrtgccttccacgcgggactgttgtggatatttgaccactgcaagaaaactcacagaagcagaaacttagggcttgctttaaatgttatcagtgtgaattga

SEQ ID NO: 41536 - DNA, 201 bp, Homo sapiens
aatcactgaatatgttataaccaaaaaggtcaaactcgcaatgattcggtgtgttttgttccgtgcatcctggcatgtgaaagaagtgaggtaaagagtayaatttacttccttgttttaaagctagcattgcccgtgccttccacgcgggactgttgtggatatttgaccactgcaagaaaactcacagaagcagaaact

SEQ ID NO: 41537 - DNA, 201 bp, Homo sapiens
caggagtttgcgaccagcctggctaacatcatgaaatcccatctctacaaaacataaacagaaattagctgggcattgtggtatgtacctgtagtcccagstactcaggaggctgaggtgggaggattgcttgagcctgggaagtcaaggctgcagtgagcaaagatcacaccactgcagtcaagcctgggtgacagggca

SEQ ID NO: 41538 - DNA, 201 bp, Homo sapiens
tttatgttgctattgtatcgtaaggttcttctgaagcgaccacttcataacactgtgtagtccaatccctaagctgggcaatttttttttcccctttcaawacatcacattgattttctgtatgactttatctgcttaatacaaagtgggattgaacagttatttgtctggatttgatcattccttattaaacatttatga

SEQ ID NO: 41539 - DNA, 201 bp, Homo sapiens
gctctctgagccaataaaagaagctatattcagcactggctgtataagatctttaatgttttaggctgtcaatgttggctgtggttaggctgacataattrtgagctgcatgtaccaatatatagctctttacccacaaaagcatgctgcaacggggaatctttcagagataataaaaggattcatcaagtgtctatacga

SEQ ID NO: 41540 - DNA, 201 bp, Homo sapiens
agcctctgacttgcaaggtgtgcttcagaaatttgcagcttctatttaggtaggaagagtttgccagcccgaaaactccagtaagcaaacagctttatagyaccccagccatagaaagtgagagctttcgaagaatctgtggttagaactaagaggatttttctttctcctttttctgctgttattatctcaaggagagag

SEQ ID NO: 41541 - DNA, 201 bp, Homo sapiens
aaagatagtgtgcatgcctcatctctaaggggcagccattattgacgtccagctgaatgttgccacgtggaaattagctataaacttgccagaacctccartttttctggagagattagattagaaattcatatatttttaaatattaaatcatccctttttcttgagatggtgtcacgtcgttgcccaggccaccgttta

SEQ ID NO: 41542 - DNA, 201 bp, Homo sapiens
ccaagttgtgtaaatcaaagcttctcctgccacactagtgtgtattaggccaggacttcatagtgtgattcaaatcaccaactgaatttttttttcctttycttcccctttctgggggactacgtttttcatggagaccggggccctccagctgctgtgatgatcctcccttgccagggaggtgctgttaatagcaaatgc

SEQ ID NO: 41543 - DNA, 201 bp, Homo sapiens
catgttgtagcatgtatcagtacttctttttttagggctgagtaatattccatttacggatatgccacatttcatctatgcattcagttcacggacatgtrggttgtttccacattttggctattgtgcataatgcttccaggtacacttgtctacacatttttgtgtggatataggttttccttttttggggtatgctcc

SEQ ID NO: 41544 - DNA, 201 bp, Homo sapiens
atatgtcatcgaggtcccctctttatttattcccttagttttgatgatcttttatgggttatattcttcaaagggaaaattctctccgaatggggctgccrctggcagacgagcactgtcccatcttggcttgttcccccagtgacaagaagctgttttccccactacccttggcccaaaagccacagggagaaccaggat

SEQ ID NO: 41545 - DNA, 201 bp, Homo sapiens
gctaaatctatgtccccaatatagggaagacaggagaaagtgccaaagatagtgtgcatgcctcatctctaaggggcagccattattgacgtccagctgartgttgccacgtggaaattagctataaacttgccagaacctccagtttttctggagagattagattagaaattcatatatttttaaatattaaatcatccc

SEQ ID NO: 41546 - DNA, 201 bp, Homo sapiens
gccctgttaataattcataattatatagcatagcatagggcagtttcagatgcttcaactaccaggtaggtagaataaaggaatgaagttgctgtgtatasgatgataaatggtgctaaatctatgtccccaatatagggaagacaggagaaagtgccaaagatagtgtgcatgcctcatctctaaggggcagccattatt

SEQ ID NO: 41547 - DNA, 201 bp, Homo sapiens
tggtatccccaaacaaaatgttatcaaatgaagaactccttcccagctctcccttctgagtgtctgattttattcaagctcagatggcttctcagatagcktaaaaagtgatggagaatttcttttaccaattgtatgccctgtgggaacctgggtgctgtaatcactgaatatgttataaccaaaaaggtcaaactcgca

SEQ ID NO: 41548 - DNA, 201 bp, Homo sapiens
cctttcccaaaccatagattcatggaactgtcaaagagcagcactgaactttgtactcaatgccttaatttttccagttgaggataattcacactaaacawgggatttcacctctctgactcatgcatcaggaacttggagataaagccctgttaataattcataattatatagcatagcatagggcagtttcagatgctt

SEQ ID NO: 41549 - DNA, 201 bp, Homo sapiens
tggttagattacacgtttcctgagaggtatagatttcaaaattggtgtatttcacccgtccctcatcatggtatccccaaacaaaatgttatcaaatgaaraactccttcccagctctcccttctgagtgtctgattttattcaagctcagatggcttctcagatagcgtaaaaagtgatggagaatttcttttaccaatt

SEQ ID NO: 41550 - DNA, 201 bp, Homo sapiens
tactctaggaaggagaatctctgttgggatcttttggggagtacttgcctcccaagtgcttaggctcccgctgctgacaagaccctctgcctggcaagccstgcaggttggaatcctctgttagggttccaaagccttcaccaactcagagctctttctctctctgtttctcttttttgaatttaaattgatcctagtcac

SEQ ID NO: 41551 - DNA, 201 bp, Homo sapiens
gctgtttactctaggaaggagaatctctgttgggatcttttggggagtacttgcctcccaagtgcttaggctcccgctgctgacaagaccctctgcctggsaagccgtgcaggttggaatcctctgttagggttccaaagccttcaccaactcagagctctttctctctctgtttctcttttttgaatttaaattgatcct

SEQ ID NO: 41552 - DNA, 201 bp, Homo sapiens
ttaattatgaccataaaggccccatctccaaatgcagtcatgttgggggttagggcttcagtgtatgagtttgggatggcaggggagcagttcagctcgtragaatcgtaagattcctgatctgtttctcttccaagaaattgtttggtttcatgttgattttatctccttttccctatctgtctcaaagcactgaagaaa

SEQ ID NO: 41553 - DNA, 201 bp, Homo sapiens
tgtaaattgtctaaaattaaattttctgtggttgtcatccacatgggttctgaacttgctgttataattattcacattttcttgcagtgaaaatctacagrtcaaggtcatcttcacgtctttagttcttgttttgcttcaggtcagtttagaaccgaatgttaaaaggatattgtctattcgaagggtcagattgtggca

SEQ ID NO: 41554 - DNA, 201 bp, Homo sapiens
ttcttcctaccttccatatgagagaatagggaaaattaaagaataaatgtctctgggtttaatgcaactttactaaggaatgaaagtccgataagaatccrtatcttttgaaagaagattttttaaattccttatttttccttcctgcatggtcataaaacacactggggacagcccaccctgagaagtcaccaggcatct

SEQ ID NO: 41555 - DNA, 201 bp, Homo sapiens
tgaggctaaaataagctgcttttagtatcacatttggcaagtagtaaactctggataaatatacttttgaattgtgtgattattgttgttaccatttattraaagggaatgatgaatgtagtgagagaaggaaggaagagagagagggaagaaggggaaaaagagggatggaaaggaggaaggaaggaaaggagggaggag

SEQ ID NO: 41556 - DNA, 201 bp, Homo sapiens
acagttgatctcactgattcatggggaccctgggagtatgtttgtgtatttgggggttgggatgggggggtgggtggagggtcagagaggtggcaaaagcrggtgggaacagggttacagagcaaagtaattagatgccctttagatgctcttagttaaagaccatgcaaaaaggatgaaatcttttgatcatgttcttca

SEQ ID NO: 41557 - DNA, 201 bp, Homo sapiens
gtcagtagcaggccaccaagagccatcccacctcagaaagacagaagccatcactgcaaatggcaagggcatgaggcagtttgaaactggcaaaactggasctttcatggaatccagggcttgagctttaatgctttacacttttgttttttcattccatacgcttttgctttagcttcctggcaaaattcagacaaacct

SEQ ID NO: 41558 - DNA, 201 bp, Homo sapiens
gccttgctgaggaaattaaattcctgttcgagtgctatttctttatggcactgaggagcaagcatttctaacaatcatattgcttaagaagtggatggcargaagataattactaatatgtctgcaattgatctgaaattgacacagttgatctcactgattcatggggaccctgggagtatgtttgtgtatttgggggtt

SEQ ID NO: 41559 - DNA, 201 bp, Homo sapiens
gcataatgcaattaaggcccattggattagaatttgcaggatgccattagcaataagctctgagtgtagattattgccgtgcttaaattttctccttcagyggtaacacttctcttgtaaattctaactgggtaaaataaatatgatataaaacagacacaaataagaatatatagatgatgttaatttcttcagagcttc

SEQ ID NO: 41560 - DNA, 201 bp, Homo sapiens
gtgccaggtggccaagatggggcttgtgatttgaagcttcttttcctagattcaggaaagtatcactggttaatcagggaatacatctttcggcccattgkaaaatgtctgttcttagcaccctaaatgcccaggtattagcatacttgggaaatgtctagaaacccctatttcaatttactgaccatttttggtaaattc

SEQ ID NO: 41561 - DNA, 201 bp, Homo sapiens
gagtagatgttagcaacatcatgagctcaaacccctccagcttacagcggagacagtgaggtcctgtaggatgaggttggagagcaggaacttgcccgagrtcatgtgcagagttcgaggcagggcctggatgggaagcccagcatggagaccccaggccgtctctccgccatcttgttgtgatgcttccggaagaatgcc

SEQ ID NO: 41562 - DNA, 201 bp, Homo sapiens
accaccaccattcaggttcttctattaaccctcctatatttgccaaccctcaacctgttagaaacaagaaatgggactctggagtagatgttagcaacatmatgagctcaaacccctccagcttacagcggagacagtgaggtcctgtaggatgaggttggagagcaggaacttgcccgaggtcatgtgcagagttcgagg

SEQ ID NO: 41563 - DNA, 201 bp, Homo sapiens
atagcttgctgcactcttgctgggtatgtgtaattattcccatttcacccgatccctgggagtttggtgaattaatcacccagcatccaaatagctaaccrgtagcagagctgggattcaaactcagttaggctgacttctgtgcctgttttcttgcctaagcggtggacgcattgagtaggagaaggccagttattcctc

SEQ ID NO: 41564 - DNA, 201 bp, Homo sapiens
tttaggcagcagaatgagactatgtctcaagaaaatgttcaagaagaaatacaaactattgaaaaaggaaggctgaatgctttatcagaaaactgtatttrgaggggacctttctggggtcttttagtcagggtacataagtgtcagctgctacgacaaacaacttgcaacgtctcattatcttcatacaacaaacgctga

SEQ ID NO: 41565 - DNA, 201 bp, Homo sapiens
aagggaggctgggaaatatagtttgctgtgtgctgggtgggtgggagggagcgtccacattagtgaacagccaggcagtcgctgcctcaaatttctttagkgttatcctttcattccagcaattgaatttgatttgcactgtttcacttctctacaagggtgtaaaaagtagaggttcctcttgaaagaatttcctcccca

SEQ ID NO: 41566 - DNA, 201 bp, Homo sapiens
ttaaatttttatattgaataatctttgatttgtattgtcatgttgttttatagcagttactgctgttttagtgtgatttgggatgaaaattttaaaaaatmaatatgtataatccaccatctttgttccttttatttttatgttactcattcttttaagcttgtcttagacgtgagtattatgttttattttgctgggaga

SEQ ID NO: 41567 - DNA, 201 bp, Homo sapiens
gggacagcgtgtagggtttgcatgatttgtggggccgtttcatgtttgcacggtttggcttggcttgggactctgccagtggtcactgcagtttaacaaaytccccccgggtgtgaaggaaagcgagataaatgcaggaaaaaggatacattttgaaatctggaaattttacataacaggcatcagatttgaagaatgtcc

SEQ ID NO: 41568 - DNA, 201 bp, Homo sapiens
tctccgaactctcattaatttttcacaggcttgtgatggatagtttttatttattcacgtctgagattccgttgtgtgaaaaggactcattttataacatwacatattcatggcttgggatggatgggataaggaacttattattaatgtgtcactgtgggaaacttactctagttcatttgcgaaccttgttaaattcgg

SEQ ID NO: 41569 - DNA, 201 bp, Homo sapiens
tgtgctttaagactgtaaaattttagcccattaaaaataaaatctgttgctttccacccacacctggcaatttggtgagggacgggggctaggatatttamtgtctgaaagttttagggaggcttttatgaactgggccatctctccttgtccccatttttctttgcatctccgaactctcattaatttttcacaggcttg

SEQ ID NO: 41570 - DNA, 201 bp, Homo sapiens
ccctctgataatcctgcaagagccagcccagttttgctgacagcacagtctgctgtttaattattgtgtgttcaatgacttacctctttttagtttaattraaattatttctcagattaagagccatgctatgatgcttgccaacggatatttaaaacatgtaactgatttgttttttataatgcttcaggagaactcagt

SEQ ID NO: 41571 - DNA, 201 bp, Homo sapiens
gacgtctatgctttccagcttgccaattctggggcctggcacagtatctttcaccccggagtctcagtttcctcatctgtaaaatgggaaccatgacgtcrgcatcacagagttgtgagaattcgacaaggtggaatgaaagcaactagtgtggtgtctgaccgcttgtgttagtccatgaggaatttccttacgtattgt

SEQ ID NO: 41572 - DNA, 201 bp, Homo sapiens
atgcctatgcttttaaaaaattattgtgatacagtgaaacaaggaagaacgtgtagctggaaaaatagtatttgcttgtaatatacattcagattcataayaggcttatttgattcccaggacagggtgagcaaaggatgctgtttcctgggtgtctgctttggtgttcattgagtcatgtctctctctttagaccttact

SEQ ID NO: 41573 - DNA, 201 bp, Homo sapiens
attactgaaaaaaaaacaaaacaacaacaacaaacaacaaaaaaaacaccttccactaaaactgactcaaaaagataatagcagggaaaatgacatgtcgrtctgtgattccttttttacttgtcagtccttttgggagttgaacatataagcacatgtacctctatgtgacttttgagacgtctagaatagagaattcac

SEQ ID NO: 41574 - DNA, 201 bp, Homo sapiens
gcctgaaataatttcaaattaacccctgaggaacaaatgctcatgactttcaatgaatagaaaaatcagactgctagaacctccagactgcatgtcatgcrtagaagtagaatcctggggaagctagctcacaaaagcaagggagatacctgcaaggctgagctgagcttgcaagggaagaaaaatattagagagttgtca

SEQ ID NO: 41575 - DNA, 201 bp, Homo sapiens
agtggaatcacagacatgagccaccatgcctggcctgaaataatttcaaattaacccctgaggaacaaatgctcatgactttcaatgaatagaaaaatcaractgctagaacctccagactgcatgtcatgcgtagaagtagaatcctggggaagctagctcacaaaagcaagggagatacctgcaaggctgagctgagct

SEQ ID NO: 41576 - DNA, 201 bp, Homo sapiens
ggtccacctcctgggtaaaggagattctcctgcttcagcttcccaactagctgggacaacaggtgtgtgccaccacgtccagctaatttttgtatttttawtagagacggggtttcaccatgttggccaggctggtcttgaactcctaacctcaagtgatctgcccgccttggcctcccaaagtgctgggattacaggctc

SEQ ID NO: 41577 - DNA, 201 bp, Homo sapiens
caaattccaagcaaactttttacttcttattatgtaaaatggaagggttagccaaattaagatctcaccatcaaccttgagggagtgacttctacatgccrtgtattactggttataaagctagtcttgtttggattgaagaatttaatcatatttaacttttcaaaggatgctttttaaaaaaccttatccgcgtgttat

SEQ ID NO: 41578 - DNA, 201 bp, Homo sapiens
cattttattttgtgggcagatttcttttacagttctggctgggtttcttttagttggcttctttgctttgctcctgttacgacttagccctgtagctctgrgctcttcgattctcacgtgctgatggtgtagctgagctctgctaatgctggttattaatctgacaatctataccagggaggttttataattgccataatt

SEQ ID NO: 41579 - DNA, 201 bp, Homo sapiens
agctagtctgagtggcagccttacccattttattttgtgggcagatttcttttacagttctggctgggtttcttttagttggcttctttgctttgctcctrttacgacttagccctgtagctctgggctcttcgattctcacgtgctgatggtgtagctgagctctgctaatgctggttattaatctgacaatctatacca

SEQ ID NO: 41580 - DNA, 201 bp, Homo sapiens
ggtatttcctggcaacctttggtgtttggggcatgttgtcacctcattgccatctctgcctctgtcttctcaccaccatcttccttgtccatgtctctctrtgtcttcaatgttcttcttataaggacaccagtccttggatttagagcccaccctaattcactgtaatcacatcttacctaagtccatctgcaaagaccc

SEQ ID NO: 41581 - DNA, 201 bp, Homo sapiens
tggatttcaactagataaggcccattttcatggatggacatgtgagttttcatctataatatagaatgctattttctagttaggttggagcaaaagtaatygcggttttcaccattatattcaatagcaaaaaccgcaattacttttgcaccactactttttacctagcagttcaacagctgtaaagaaagatgctgagct

SEQ ID NO: 41582 - DNA, 201 bp, Homo sapiens
tctgggcactgaattcagtcacaaaccctagcatgctcctttgctacctcaggggacaaagtcaagaaaataacactaggattgccaccctgctctctctstctctctctttttttttttttctttttgaggaagggtctctctctgtcacctggctggaatacaatggtgctatcttggcccactgcaccctccatctcc

SEQ ID NO: 41583 - DNA, 201 bp, Homo sapiens
agttttgaggacacactgtaaaaatgtatgacagcagtttgaagataagtctgttgccccaaataatcataagaagaagacagaagaaaaattgattcccrtagctctctgggcagtgggatgggggtaaagcaaggaattaataaaaacccaccagaatacattatttcagacaatcaaggagagcgttacattttaaag

SEQ ID NO: 41584 - DNA, 201 bp, Homo sapiens
aactcccaatctgaacggtagtcaaagaaggtcttcttctctttggagactgaaaggctgagagggtacctgccctgctaaggaaatgaacaggacggaakaatgatggagggagaatgggaagtcctcagcacataaaagtttgagctggaaatgaaatatacaactctgcatagtcagcagattttgctgggctgggcc

SEQ ID NO: 41585 - DNA, 201 bp, Homo sapiens
cttgggaggtggaggttgcagtgagccgagatcatgccactgcactccagcctgggcgacagagtgagaatccgtctcaaaaaataagtaaataaaataaytaactaggctaggcacagtgggtcatgcctgccatcccagcactttgggagtccaaggcaagaggatcacttgagcccaggatttcgagaccaacctgga

SEQ ID NO: 41586 - DNA, 201 bp, Homo sapiens
actgggaagataagctaaaaagaagacaaagcaggaaggtaattttcccctggagctatgccatcaagctgttcttctgaagtccagccgcttctctccarctgtggtctctaatttccagctgcttctcctcttttcttcaatgtgccagcggagcctggggtttttatgggtacaggattgggggcaggccgggccatg

SEQ ID NO: 41587 - DNA, 201 bp, Homo sapiens
tcttttttttgagactggagtcttgctctgttgcccaggcaggaatgcagtggggtgatctcagctcattgcaagctccgtctcctgggttcacaccattytcctgcctcagcctcccaagtagctgggactacaggcacccgccaccaagcccagctaattttttgtaattttagtagagatggggtttcaccatgttag

SEQ ID NO: 41588 - DNA, 201 bp, Homo sapiens
ttgagacggagtcttgctctgtcgcccaggctggagtgcagtggcgtaatctcggctcactgcaagttctgcctcctgggttcgtgccattctcctgcctyagcctcccgagtagctgggactacaggtgcctgccaccacacctggctaattttttttttttttttttttttgcatttttagtcgagacagggtttcacc

SEQ ID NO: 41589 - DNA, 201 bp, Homo sapiens
gctgatgaggatagcagtttcttttgttcttttaaaacatatataaaattatttttatcaaacatgacagatcaaaagccttctggaaaggagagatggtractaatttaggcagtgtcttttgctttcacatggtgtacccagtactattaatatgaatttatcacatggaaacaaacttttaaaaaaattaattttgtg

SEQ ID NO: 41590 - DNA, 201 bp, Homo sapiens
atatagatggactgtgaagatgaagaaaggttctggttatgaactcacagaggaagtgacggctgaactttgtaaggacacaagtggtttaacaagtttcytggcccatatgagatctcggctccgacgttacaggcagcagtgtggggcctcaccttaccttttcccacttccatccttctccacccccgttcagttccc

SEQ ID NO: 41591 - DNA, 201 bp, Homo sapiens
cactcccaactcagcaacctgggtgtttcagccagggcttttccaggccttaatttctctgacacaggaggatggaattacattatttccaccacaaagaytgtgttttaaatccttcttagtttgcagcttttcttcccttttgcctcctctttagttcattccaatgataaatcctccctcctttgtcacagagccact

SEQ ID NO: 41592 - DNA, 201 bp, Homo sapiens
tagatgccttaaagatatgctatccacaggagcagagagcacagcaggctggatgccaaggagaattcgaccagggtaaggcttacaggcaatccattcastgcagagtcttcccccatccacacatataactccctttagtattgatgacctttctctcctgaaatattacagaaactgccctgaacgaagatagatggt

SEQ ID NO: 41593 - DNA, 201 bp, Homo sapiens
ggattacaggcgtgagccaccacgcccggccttgatttttcttaacctttatttccaattatgcatcttctgagtaactataaagaaaagcaaaatctacrgtaggtatggagtgagtgcagagtcaccatcagcttgaacaaatgtgtgtatctgtggtcaagtttaattgcttcttctgtaatttatattaatcacgct

SEQ ID NO: 41594 - DNA, 201 bp, Homo sapiens
tctcccaggtactccagagctcttgacaataaatgagaacaatatagaggcagggggcacttttcatctcaggccagttccaggactctgtgtaaactgtwctaagccgaaacgtattcctttgtcccttttgccgctgtcctcctaatccacatctgggcagtgtgcactgtggctgggagttgacacagatccttgtct

SEQ ID NO: 41595 - DNA, 201 bp, Homo sapiens
tggctaatttcttttgtatttttaatagagatgaggtcttgctatgttgcccatgctggtcttgaactcgtgggctcaagcagtccacttgcctcagcctmccaaagtactgggattacaggtgtgagccaccacatctggcgaaactctgggtagtttctaattatttctgtatttctatttgtatttaaaagtacagga

SEQ ID NO: 41596 - DNA, 201 bp, Homo sapiens
gtgttgttatgcagtgtgtgactgtaccagcagcttgatctttgtgcttctagagaacatttaaattgattcgcttttgtgagacagggtcttgctctgtyacccaggcttcagtgcatcagcgtgatcatagctcactgtagcctctccctcctgggccaagtgatcctctcacctcagcctcctgagtagcttggacta

SEQ ID NO: 41597 - DNA, 201 bp, Homo sapiens
aggatgtacttacaaatcctacgtggtataacccattatacacagaggctgtatgggatagcctgttgcttccaggctgcaaacttgtatagcatggtacygaactgaatactataggcagtcataacacaatggtaagtatttgtgtatctaaacacagaagtggtacagtaaaaatacagtgttgtaatcttatgggac

SEQ ID NO: 41598 - DNA, 201 bp, Homo sapiens
ggaggtgattagatcatgagggtggagccctcataagtaagatttgtgccctgatgagaagaggatagaaaggtagctaactttccttaagctatgtgaakgtgagaacacagtgggaaggcagccatctgtaactagtaggagggccctccccaagaacgtgaccatgctgccaccttgaccttggactttaagcctcca

SEQ ID NO: 41599 - DNA, 201 bp, Homo sapiens
agaaggacgtgtttgcttcctctcctgccatgattgtaagtttcctgaggtctccccagccacgtggaactgtgagtcaattaaacctctttcctttatamatttcccagtcttcgatatgtccttatagcagcatgaaaacagactaatacaggggcctctgggaggtgattagatcatgagggtggagccctcataagt

SEQ ID NO: 41600 - DNA, 201 bp, Homo sapiens
ggacatggttgtgtccccactgaaatctcatcttgaactatagttcccatgatccccatgtcttgtgggagggacccggtgggagataattgaatcatgcygttctcacgataatgagtgagttctcatgagatctgatggttttataaggggctttcttcccttttgcttggcacttctcttactgctgtcatgtgaaga

SEQ ID NO: 41601 - DNA, 201 bp, Homo sapiens
tctttttttttttgtcagactacttgccagcatactaaaatcaggatattttacttaaatgtagatttatgacagttttgaaaaatcagaatgagtattgkagactaaatgtttatgtcttccccaaaaattcctatgttgaaaccctaatcttaaggtcatggtatttggacatggttgtgtccccactgaaatctcatc

SEQ ID NO: 41602 - DNA, 201 bp, Homo sapiens
agtgattgacttacccgagtgtacacatgtttgcatctcacttgtatgttccttacatgtttacttaattattgggaaggtgtattaatgtcctgttgctrctataatggaccaccacaaactcggtgcttctatgctgcaaacctaagattataggcagtcataacacagtgttaagtatttgtgtatctaaacatagaa

SEQ ID NO: 41603 - DNA, 201 bp, Homo sapiens
tcagttttcgtgtctccctcccactggaccacaagcccctaactcttcatgtacacaccctgactcccagtgtgggctggccacccaggaggcacccagtytatgtgtgctgcgtgagtgatgtggaatgactgcccacgtaggaagtggcaggttggagaaaaagcagtcacagctcctggctgctgtggctgctttgag

SEQ ID NO: 41604 - DNA, 201 bp, Homo sapiens
tatgactttacctatttcgggtaattgatataaatggaatcatacaatacgtggccaactgacttctttcatttaatgttttcaaggtttgtgttatttcrtgtattaatattatgttggtgcaatcacttttgaaccaatctaactaatacttcatccccttgtatggccaaataatattctattctatcaatatattat

SEQ ID NO: 41605 - DNA, 201 bp, Homo sapiens
gctttatgtggagaaaacagtattggaaattattactcagttcaagaaaacctcactgagcacctaccatgtaggtgctcatcccgataccactatcaggmcctttggaccagttgcaaggatgcaggatgaggaaggcaatgtgagaaaacagaaggagcaccaggcagtcgtgggcttgatttttattttactattttt

SEQ ID NO: 41606 - DNA, 201 bp, Homo sapiens
gcttcagggaagggcagtgcaaattgtttctggactgatgccatcttttaataatagtagttaatagactgggtacaatggctgacgcccgtaatcccagygctttgagaggccgaggccggtgtatcgcctgagtccaggagttagagaccagcctgggcaaacagcctgaggcaaaacctcatctctacaaaaaataca

SEQ ID NO: 41607 - DNA, 201 bp, Homo sapiens
cccaggctcaactatcagccgccttctcatcccaagggctgtcaccaccagaaatttaacatgctgttagtgcatgcaaaaaaaagcccagtaattgtagsgctcatcagtacattgttaattgatcctcatttcctattattttacctcaaagcaaacacatcattcaccatagtgacaccagagttgtttatcttctct

SEQ ID NO: 41608 - DNA, 201 bp, Homo sapiens
ctcttacttaaacacacagcatgactctccttacacatttatttcagaagagcaaagtccgggtccccaggctcaactatcagccgccttctcatcccaasggctgtcaccaccagaaatttaacatgctgttagtgcatgcaaaaaaaagcccagtaattgtagggctcatcagtacattgttaattgatcctcatttcc

SEQ ID NO: 41609 - DNA, 201 bp, Homo sapiens
cttccaaatgcccttaacccacagatgggaagaaaatgaggtggggggaaggggactttcttgcttcctcatagttctcccccatcctgtaaaggagcctrtgcttcccgactcccagggccctgcagcatgtcaagaacaatattggacaagcttgtcagtgagggtccaggtggttccctgccactacgatgcatgctg

SEQ ID NO: 41610 - DNA, 201 bp, Homo sapiens
tgcatagacatttgcaccccagggatagcaccattactcccaaaaattgcaggtttgaaagggtacctaaaaacaagccaccagattgtcccattccactrtcattctgccatcaacaccgaggtgtcggagtagcaggagagccacatatttcttagtgaggggacccagaatgatcccttttgtgctagaggatctgag

SEQ ID NO: 41611 - DNA, 201 bp, Homo sapiens
accttcaccaccacccaatgtgtcctgctcatcactgaggtttgtcatttttactctgagtctgtccattgtcatcatctccaccatcaccccttttgttytcattgccacccttgcctggggtgagtgaagacgctcttctctggcttccacccttccaaatgcccttaacccacagatgggaagaaaatgaggtggggg

SEQ ID NO: 41612 - DNA, 201 bp, Homo sapiens
acactgtcatggtgctggtgggagtgtctcttagcgtgctaatggattcatattagggtataatgagtagtaaggatgaccaaatgtcgttgccatctttsttttggtgggttttggccggcttctttactgcaacctattttatcagcaaggtctttatgacctgtatcttgtgctgacctcctatgttatcctgtaact

SEQ ID NO: 41613 - DNA, 201 bp, Homo sapiens
accctgcatctactaaaaatacaaaaattagctgggcatggtgctgtgcacctgtaatcccagctactcaggaggttgaggcacgaggatcacttaaaccsaggaggaggagattgcagtgagccaattgcgccactgcactccagcctgcaatgcagagtgaaactgtcttaaaacaaacaaacaaacaaaaagcaaaaa

SEQ ID NO: 41614 - DNA, 201 bp, Homo sapiens
tcttgaagtcctgaccttaagtgatccaccctcctcggcctcccaaagtgctcggattacaggcatgaaccactgcgcctgactgtacttttttttttttwaagtatacccatacccattgtacacatttggtattttttctttaaaaaaaaaaagcatttactttttgcctcatgaatctctgagtacattttgtgcatt

SEQ ID NO: 41615 - DNA, 201 bp, Homo sapiens
gacaatggcctttatttttccttctacttaagggctctcacgttctagaatacatcttaccagcgattaattatgccttgagattgccaggagacgtagaygagcttttattgttttagccactgaatatacctctagataacacaatacatatttacagtgacaagctttgtattatttataggattatagcaaatcatc

SEQ ID NO: 41616 - DNA, 201 bp, Homo sapiens
tcatttcaagtcttcctacctttgctctgagttgtcccacctttccagaccgaacgagtgttcatcttgcatatgttgattgatgtctcatgtctccctagaatgtgtacaaccaaactgtgctctgaccactttgggcatgtgtcatcaggccctcctgaggctgtgtcacaggtgcacatcctcaaccttggcaaaata

SEQ ID NO: 41617 - DNA, 201 bp, Homo sapiens
ctggaagccccctcctcatttcaagtcttcctacctttgctctgagttgtcccacctttccagaccgaacgagtgttcatcttgcatatgttgattgatgkctcatgtctccctagaatgtgtacaaccaaactgtgctctgaccactttgggcatgtgtcatcaggccctcctgaggctgtgtcacaggtgcacatcctc

SEQ ID NO: 41618 - DNA, 201 bp, Homo sapiens
tgctttcaggtggagaaattgtaccattgctgaaaatagcttcgctgacagttagggcaagcttcattggtagcaagtttctatctggaaagatgtaggasaggaacactgactctggaagcagacgtgacctagttttgaaacctgggataaccacttcctatctgtatgacccgagcaagttactttccttctcagaac

SEQ ID NO: 41619 - DNA, 201 bp, Homo sapiens
aaatttgcctatctctgatgattagcaagattgataggcttttcttatgtcgggccatttgttttttaacgaattgccctttcatcttatatgcatgactrttggatatgtatcgattactaattgattgcttgcctcatgtgctataatttaattttcaaaatgtcccttagaagttaatttataaagtgtctattactt

SEQ ID NO: 41620 - DNA, 201 bp, Homo sapiens
agctcattcattttgttaatcctgagtttggaatcaaccaatttatttaaacccgtgaagcctcgctctgtgcccggtcaagtgctgggagtggcatctgyggggagggccaaggcagatgtcatttccagactgcattggatcctggattcagaagctgaagcttaggagtgggcatggtggttcacgcctgtaaaccca

SEQ ID NO: 41621 - DNA, 201 bp, Homo sapiens
gcacagaaactgaagttaaagctaatacaatgtttttcatttttacccttacctctacaatgtacttaattgttacagattcgtatttattgattatcatrttgtattacattgatagccgtttaaaatttatgaagattccgtacttgtcatatttaattctcagcaccgtgcttacagctgtcttgtgataatgtcgaa

SEQ ID NO: 41622 - DNA, 201 bp, Homo sapiens
gcggggaggaaacctatttcagtgtctctactatttctacctaggtggaggataactagccagatgaacggagctaagccttttgtatgaagtttatttcwtataaagaggaacaaaatcagaatcaaatttcttctgtagttgcacagaaactgaagttaaagctaatacaatgtttttcatttttacccttacctctac

SEQ ID NO: 41623 - DNA, 201 bp, Homo sapiens
ctgtgcttgatggttttactttttgtgatttttggagccttcatgttagaagccatagtcatatggtgctctctgaaagcaagacaaggtttcttcactasactctaagaggagatctgagacagagagatgggggcggggaggaaacctatttcagtgtctctactatttctacctaggtggaggataactagccagatg

SEQ ID NO: 41624 - DNA, 201 bp, Homo sapiens
ttattattattgttgatctcttactgtgcctaatttataaattaaaatttatcctaggtatgtatgtataggtgaaagcatagaatacatagggtttggtmctatccagttttcaggcatcactgtgggtcttggaacgcatctcccgaggataagggggggctactgtcagtgtgaacctgattagatctcaactgaaac

SEQ ID NO: 41625 - DNA, 201 bp, Homo sapiens
atgagcgttttgcttcgtgtactcatttatttctgaaaataatgcagccccttgtagggctttctggctaattgagtggtgccatcattcatgcagttgcrcaattcacacaccaggctgccactttggcccctgcgtcaccttcaccaccacccaatgtgtcctgctcatcactgaggtttgtcatttttactctgagtc

SEQ ID NO: 41626 - DNA, 201 bp, Homo sapiens
ggtggatgagcgttttgcttcgtgtactcatttatttctgaaaataatgcagccccttgtagggctttctggctaattgagtggtgccatcattcatgcarttgcacaattcacacaccaggctgccactttggcccctgcgtcaccttcaccaccacccaatgtgtcctgctcatcactgaggtttgtcatttttactct

SEQ ID NO: 41627 - DNA, 201 bp, Homo sapiens
cccaaaaattgcaggtttgaaagggtacctaaaaacaagccaccagattgtcccattccactatcattctgccatcaacaccgaggtgtcggagtagcagkagagccacatatttcttagtgaggggacccagaatgatcccttttgtgctagaggatctgagttcatttcatgaaactgaagcatcttcttggagatata

SEQ ID NO: 41628 - DNA, 201 bp, Homo sapiens
agggtgcttatgaggaaggtttcctactcctaaaagagatacacaggaagagagaccttctgcttcctctggacactggcgcagcctggactagcagttgscagcttgggtttggacaacctccgaccttagttgaaaatgaccctgtgtaggacagaggagcaagtggaaagaacctgggtgcattgtggcattttagag

SEQ ID NO: 41629 - DNA, 201 bp, Homo sapiens
gcaggagagccacatatttcttagtgaggggacccagaatgatcccttttgtgctagaggatctgagttcatttcatgaaactgaagcatcttcttggagmtataagctcaccttgggataggcccttgcagatgacaataaaggtattttggcacataaaaaaactgctcagcacaccttgtatttgtatttcctttgac

SEQ ID NO: 41630 - DNA, 201 bp, Homo sapiens
tccctagtgttggatagctaggccatttataatttggacactattttaaaaaataactcaggcttattttactatttatttttgccttacactttttgtamaagtaatcagagcagtaataatagatgactccccaaaatccttttgcctctaatgattagtctaagcccataatgctgtgttccttgccagtgattggtt

SEQ ID NO: 41631 - DNA, 201 bp, Homo sapiens
ttagtgaggggacccagaatgatcccttttgtgctagaggatctgagttcatttcatgaaactgaagcatcttcttggagatataagctcaccttgggatrggcccttgcagatgacaataaaggtattttggcacataaaaaaactgctcagcacaccttgtatttgtatttcctttgacgtgaaccatggccatccagt

SEQ ID NO: 41632 - DNA, 201 bp, Homo sapiens
aagattacaccatgtaaatgaattgtattttatgtaaccattccctagtgttggatagctaggccatttataatttggacactattttaaaaaataactcrggcttattttactatttatttttgccttacactttttgtaaaagtaatcagagcagtaataatagatgactccccaaaatccttttgcctctaatgatta

SEQ ID NO: 41633 - DNA, 201 bp, Homo sapiens
tcgtaatatataggcacatagatatataattaaaaaaacaagaatttctcatgtcattaaacattgcttgaaaaaacatactagtaatttcctaagattayaccatgtaaatgaattgtattttatgtaaccattccctagtgttggatagctaggccatttataatttggacactattttaaaaaataactcaggcttat

SEQ ID NO: 41634 - DNA, 201 bp, Homo sapiens
acttggtaaagaagcagatatttctttaatacgtgtatatattagactgtgaatttattcatcttccttattcatcatataagtaaattatatgattggayccaggcataaaacgtgatttgactcccccttgcccatcacagttctggagttcacatatcatttgttactttgaaaaatgaacttttgttatttgattat

SEQ ID NO: 41635 - DNA, 201 bp, Homo sapiens
aggttcttctgtgataaaaatagacttggtaaagaagcagatatttctttaatacgtgtatatattagactgtgaatttattcatcttccttattcatcayataagtaaattatatgattggacccaggcataaaacgtgatttgactcccccttgcccatcacagttctggagttcacatatcatttgttactttgaaaa

SEQ ID NO: 41636 - DNA, 201 bp, Homo sapiens
gccacgcaacattcccactgccatgttggcttgtttttcttttgttttcttgtcaacataagcctcatgagacaacagcaggatgcaagattgtacaatgrcaccatgactctgctttctgggtgtcctctgtgggctctcagcagtgtccccgatgtggagggtcttcttattctgtgtgtgtgccctctgctgttgaaa

SEQ ID NO: 41637 - DNA, 201 bp, Homo sapiens
aagagaccaatttaaaacattctaatgagcatcatctcataatttggtaatctcatgtaaaatgcttataataggggtgtgtgtatgttatatatattttwaaaataaatttgtaatcatgtatacagtagtccccccttatccgtggtgtttcagtttttttttttttgagtcagagtattactctgttgcccaggctgg

SEQ ID NO: 41638 - DNA, 201 bp, Homo sapiens
gagaccatcctggctaacaaggtgaaaccccgtctctactaaaaatacaaaaaattagccaggcgcagtggcgggcgcctgtagtcccagctactcgggargctgaggcaggagaatggcgtgaacccgggaagtggagcttgcagtgagctgagattgcgccactgcagtccgcagtccggcctgggcgacagagcgaga

SEQ ID NO: 41639 - DNA, 201 bp, Homo sapiens
actgagcaggaagggccaggtgttttacgactctttggagttagcagcttgttggctctgatttggtaaaagcaacggaaatgccttcagcacggtgaacrttacatgcaaatgttgggaagtgttaggaaagggaatttttttaggcgagggaatttcgcattgaggaaggtccctgcttcgtttttagacacagcctat

SEQ ID NO: 41640 - DNA, 201 bp, Homo sapiens
agatcaagaggcccggaaccccgcagtcctgaatgctaaccagtagagacaagggaggaattcatttctgtttgtgttcaacatagactgagcaggaaggrccaggtgttttacgactctttggagttagcagcttgttggctctgatttggtaaaagcaacggaaatgccttcagcacggtgaacgttacatgcaaatgt

SEQ ID NO: 41641 - DNA, 201 bp, Homo sapiens
ttaatatcctcaaattaaaacatacgtttttaaagaaagattttgcagacttttaagctgggcaactgtctgccttacaagatgcgtctggaaaccccagygccatcctccttttttagtcttgtatatttatgtatccccggccagagttggctggggcacagtctaacagtgtcaccgtgtaagctgacccagtgacct

SEQ ID NO: 41642 - DNA, 201 bp, Homo sapiens
ctttattattttaatggagtgcaaggtgcagtctttttgaagatgtagaatgtggccttataaaagctaagtgctactttatatttctgctgtccttgccsgtggcctgcactggggagttgtatattgtatcagtaattttaaaagccagcaagtgttctaccagctgaagaagttttcctaatggtggctggtcaaacg

SEQ ID NO: 41643 - DNA, 201 bp, Homo sapiens
ggctgggcacggtggctcactcctgtaatcccagcactttgggaggccaaggcagatgggtcacctgaggtctggagttccagaccagcctgaccaatatwgtgaaaccccatctctactaaaaatacaaaaagttagccgggcgtggtagcacacacctgtaatcccagcaactcgggaggctgagacaggagaattgct

SEQ ID NO: 41644 - DNA, 201 bp, Homo sapiens
caccttccgcaggaatggcctttaacactgtcacctcaccccattcccctccactcttgggaagcatacgtctaggtgagtggtgaagatttttattctgmatttttgaaataatatcgtactgcaagttccaggcaatcaaaaactcacaaatcacttgcactctgcagcagtggtatcaggtctgaagaaaggaagagg

SEQ ID NO: 41645 - DNA, 201 bp, Homo sapiens
ggaggcacaggaggtaaaaatacattgttcaagggtcaattattgtgttgtacaaggtgtgaaatctaccaggttgccatccgagtggagaatttttttastgtacttgcctatgaaggtaaagaagcaaatggaaatttttttttaagaattgaaaggattttatttcaaatcaactctcatacctcatcctgggctcca

SEQ ID NO: 41646 - DNA, 201 bp, Homo sapiens
aaatagtcacatcatggagaatggggtatccatcccctcaagaatttatcctttgagtgataaacaattcagttatacccttttagatattttacaatgtrcaattaagttattattaactataatcaacttgttgtgctatcaaatagtaggtcttattctttctttctatcttttttgtacccattaaccatctgcact

SEQ ID NO: 41647 - DNA, 201 bp, Homo sapiens
ccactgccatgttggcttgtttttcttttgttttcttgtcaacataagcctcatgagacaacagcaggatgcaagattgtacaatgacaccatgactctgytttctgggtgtcctctgtgggctctcagcagtgtccccgatgtggagggtcttcttattctgtgtgtgtgccctctgctgttgaaagttgcctgtcaccc

SEQ ID NO: 41648 - DNA, 201 bp, Homo sapiens
caacagcaggatgcaagattgtacaatgacaccatgactctgctttctgggtgtcctctgtgggctctcagcagtgtccccgatgtggagggtcttcttaytctgtgtgtgtgccctctgctgttgaaagttgcctgtcacccatgatgctgtgctgattgagcaaactaatccataacccaccgccacgttcctcgccta

SEQ ID NO: 41649 - DNA, 201 bp, Homo sapiens
cccctgtttcaaatgaatacagattcattttgtcacctgtgtgaaattggtgtccgtgtgccttgcttcctaggctgtccaccatgacatcagcctgcccrtgcaatgcttgagatttgccctgtgactcaacccaaatctaaagcccgagtcgtatgaatccaggacacctgcctgcaaatgcatttttcatgtataggt

SEQ ID NO: 41650 - DNA, 201 bp, Homo sapiens
aatacagataatttctctcttaaattccataagctggagacactgcccctgtttcaaatgaatacagattcattttgtcacctgtgtgaaattggtgtccrtgtgccttgcttcctaggctgtccaccatgacatcagcctgcccatgcaatgcttgagatttgccctgtgactcaacccaaatctaaagcccgagtcgta

SEQ ID NO: 41651 - DNA, 201 bp, Homo sapiens
gggtattactctgttgcccaggctggtgttgaactcctggcctcaagcgatcctcctgcctcggcctcccaaagtgctgggattacaggcttgagctactkccccaggctcttcccccgtttgttaatacataccatgaccttggcctttcccacctcttaggttttgcttactttcccttctgtcctttacttatgactc

SEQ ID NO: 41652 - DNA, 201 bp, Homo sapiens
acactgtttaccagattggagtgcagtggtgcaatcctagcttactgcagcctgtaggtcccgggctcaagcgatcttcccacctctgccacttgaatagstgggactacaggtgggtaccaccatacccagctgttgaaaaaaaaatggtggggtattactctgttgcccaggctggtgttgaactcctggcctcaagcg

SEQ ID NO: 41653 - DNA, 201 bp, Homo sapiens
atgccgacccacaagctctggagcagtcaactcagaatggtcaggacttggtcagtaatgcccatttttgctaaattttgtccccacttccaacgcaggaycaaccagagaaagccacatatgctccccaaaccaatcatacaggatgtcctggtctagggagcccacctccggcttccccatgtccacagcctccaatcg

SEQ ID NO: 41654 - DNA, 201 bp, Homo sapiens
cccacacttactcttattcacccagaacaggtgtgtgccaccttggagaagatgaagccagagagaaaatcagtcagacaggaattatgttgaaaggtgamtgaatacattaccacctcccaggagttgaatgaaaaacggctatttctttaggacgtcaaaccacctttttcctctctaattcatgcatatccctataca

SEQ ID NO: 41655 - DNA, 201 bp, Homo sapiens
tggatgtctgaggtatgctaagcctaatctccatcttctcaaagctccactgccactgtcccgtaagggtgggcagattcctccccattctataaaataayagctaccatttcctgagggcatactgagtgctgacaggcacatcaacatcagaccatcaccttcttatacctcaaaatagtctgcagggtgactcagaag

SEQ ID NO: 41656 - DNA, 201 bp, Homo sapiens
gcagaccattgtttagccctccttccacctgggagactggctgctggttctcattgcttctgtgggtctccaggtttctatcattacacagattagcacayggttccatgatcatggacccgttcagtacacaatgaaatcatttgcaaagcaccttggggtctgttagagaagggaatggatgtctgaggtatgctaagc

SEQ ID NO: 41657 - DNA, 201 bp, Homo sapiens
ttcattctgtttctttattattttaatggagtgcaaggtgcagtctttttgaagatgtagaatgtggccttataaaagctaagtgctactttatatttctrctgtccttgccggtggcctgcactggggagttgtatattgtatcagtaattttaaaagccagcaagtgttctaccagctgaagaagttttcctaatggtg

SEQ ID NO: 41658 - DNA, 201 bp, Homo sapiens
ttataagttacattttacataaaaaggcagcagtggtgaagctggaagagggcacctaggctttgatttcaggcaagattttgttaggtcccagtattggracttccggttggtggattttgctcaagaatagttttctctttgtctaacgcttcatgagagacaacctaaataaagccacagccagtgttacagaaatag

SEQ ID NO: 41659 - DNA, 201 bp, Homo sapiens
caatcatatttaaatcattgctgctggaactttagttgactttataagttacattttacataaaaaggcagcagtggtgaagctggaagagggcacctagrctttgatttcaggcaagattttgttaggtcccagtattgggacttccggttggtggattttgctcaagaatagttttctctttgtctaacgcttcatgag

SEQ ID NO: 41660 - DNA, 201 bp, Homo sapiens
aaaacctcatttctgctaaaaatacaaaaatcagctggttgtggtggtacacccctgtaatagcagctactcaggagtctgaggcaggagaatcccttgarcccaggaggcagagattgcagtgagcccagatcatgccactgcactccagcgtgggtgacagagcaagactctgtctcagaaagaggaaagaaatggaat

SEQ ID NO: 41661 - DNA, 201 bp, Homo sapiens
aaacagggttagtaaaggcctcagagagaagatgtcctttgagctgagtcttgagactccagagatcaggactcaaggactgtggaacctgtacattcacrtcctggtaatcttacattgctcagaagactccagggacattgaggttgcccccatggagttgaaactcctatgctgatcacttaggaagccaagaacaaa

SEQ ID NO: 41662 - DNA, 201 bp, Homo sapiens
catcacaaaacctcatttctgctaaaaatacaaaaatcagctggttgtggtggtacacccctgtaatagcagctactcaggagtctgaggcaggagaatcycttgaacccaggaggcagagattgcagtgagcccagatcatgccactgcactccagcgtgggtgacagagcaagactctgtctcagaaagaggaaagaaa

SEQ ID NO: 41663 - DNA, 201 bp, Homo sapiens
tgatgattaatacaactaataaatagtgcattagtattataggcacaaaagacagtatgaagtacagcacagatcatgaggagggtagggtcagttctacrtaaaaacagggttagtaaaggcctcagagagaagatgtcctttgagctgagtcttgagactccagagatcaggactcaaggactgtggaacctgtacatt

SEQ ID NO: 41664 - DNA, 201 bp, Homo sapiens
gtggatagcttgaggtcaagagttcgagaccagcctggccaacatcacaaaacctcatttctgctaaaaatacaaaaatcagctggttgtggtggtacacycctgtaatagcagctactcaggagtctgaggcaggagaatcccttgaacccaggaggcagagattgcagtgagcccagatcatgccactgcactccagcg

SEQ ID NO: 41665 - DNA, 201 bp, Homo sapiens
atggactgcattccatgcctggcactgtgcctatgatttattaaaatctaaagccattaataaataaattattcaatccatgcattgaattatctagctcwttcaaagacagtcacagtccatccctcaaagagctcatggaccagtcgaaggagggtgacagcctgggtcaaattggtgctgagcacacaggcaggggtc

SEQ ID NO: 41666 - DNA, 201 bp, Homo sapiens
aggcaagtaggggcaccgaaagctttaaagcagggagtaacaggcttgtagtgacttttatcgaagtagaagttgaatagatctagcctggcacagtggcycacgcctgtaatcgcagcactttggttggctgaggcgggtggatagcttgaggtcaagagttcgagaccagcctggccaacatcacaaaacctcatttct

SEQ ID NO: 41667 - DNA, 201 bp, Homo sapiens
aaatcagtatgattcatcataaataagtcaggactatgattgacagtctacctagaaagattaggaaagtggggaccaccccccaattattacctttgttyttacaagtgtgtttaaatctctttctgttaatttacaatttgaaaggtgggtgaggagaagagtttgaaaaatagattactgtcttcattaatacaggtt

SEQ ID NO: 41668 - DNA, 201 bp, Homo sapiens
ttatttaaaaaaatcagtatgattcatcataaataagtcaggactatgattgacagtctacctagaaagattaggaaagtggggaccaccccccaattatwacctttgttcttacaagtgtgtttaaatctctttctgttaatttacaatttgaaaggtgggtgaggagaagagtttgaaaaatagattactgtcttcatt

SEQ ID NO: 41669 - DNA, 201 bp, Homo sapiens
tctttgaaagttgtccttctgcacccattttccccagacctaacctcgatttgtgctccaggtctgagcagaaatgttattccctccagaaagccttcccyggatgttgagggatgaagttgtagccccctcccgaatgcgtcctcagaactcgctggttctcgtcctcgccctcagcatacttgctcattgtttgtttcc

SEQ ID NO: 41670 - DNA, 201 bp, Homo sapiens
tgattattttgctctttgaaagttgtccttctgcacccattttccccagacctaacctcgatttgtgctccaggtctgagcagaaatgttattccctccaraaagccttccctggatgttgagggatgaagttgtagccccctcccgaatgcgtcctcagaactcgctggttctcgtcctcgccctcagcatacttgctca

SEQ ID NO: 41671 - DNA, 201 bp, Homo sapiens
ttcactgaaccaagagatgccataagcagtccttgttgtaataatttaatagcgaagccctcagcaatagatcttcaggtaaaatggatgctgactgtctrtctgtcatatgaagattcagacattgatgtaatttaaaatacttgtagtatcatggatacaaacatatgcctttttatttctgaaggaatttccagaatg

SEQ ID NO: 41672 - DNA, 201 bp, Homo sapiens
tggcccaccagccatggtttggacaagcttagtctacaggttcttcaagaggggcttgagcatttgaaagacttctagtgggagagatcacaaggtacaastagaaaatcctgggctggcctgagaggcagacctgtgattattttgctctttgaaagttgtccttctgcacccattttccccagacctaacctcgatttg

SEQ ID NO: 41673 - DNA, 201 bp, Homo sapiens
ggtgacaggcttctttcttctcatcattaaatgacatactggagatcagtcagatgaactgcaatttatatcttgcccccacccagtgttgatttgcccgrggtcatacagataattagtaatgtcttatctcagttttcttatctgcaaaatgagaatacctgatggggttagtgtgggagtttaatgtctgtaaggtgt

SEQ ID NO: 41674 - DNA, 201 bp, Homo sapiens
aatctggagtccaccatcctgggtctagctggggacatccttgaatcagcctctgggaatcactgaaccaacatgagtcacttgctactgtgagatctcaraacacatggatcaggacagagggcagggctgtttccccaaggaaatccaaatgctttacaggaaggggagtggatgctggcccggcccaggcgaggatga

SEQ ID NO: 41675 - DNA, 201 bp, Homo sapiens
taaattttatttttcagtttacttggttttgcctccttctagaactagaacataagctctctgaagtcagggaccatgcctagaatcgccttccttttatytcccatcagccgaaactaactctgctgtgtcacgctgtgttaggctgtgttggctgtgagtaagagaagtctcacccaactagctgaagcgaggtgggtt

SEQ ID NO: 41676 - DNA, 201 bp, Homo sapiens
tgattttgatttggttgtttttggtagagatgatatcttgctctattgccaggctgatctcggactcctgggctccatcaatcctcttgcttcccaaagtrctgggattataggtgtgagccagtacacttggccttttggcaccattattctgcctgccatcctgtcctaactaaagaaagtaaggtccctccatcctcc

SEQ ID NO: 41677 - DNA, 201 bp, Homo sapiens
atctgccatgccaaataacacctttgcaggtttcagggtagagcatggatgccttttgattttgatttggttgtttttggtagagatgatatcttgctctrttgccaggctgatctcggactcctgggctccatcaatcctcttgcttcccaaagtgctgggattataggtgtgagccagtacacttggccttttggcacc

SEQ ID NO: 41678 - DNA, 201 bp, Homo sapiens
ccaggttcaaatgattttcctgcctcagcctcccaagtacctgggattacaggagcctgccaccacgcctggctaattttttgtacttttagtagagatgrggttgcaccatgtttaccaggctggtctggaactcctgaactcaagtgatctgcccgcctttgcctcccaaagtgctgggattacaggcgtgagccactg

SEQ ID NO: 41679 - DNA, 201 bp, Homo sapiens
cccaagaggatccgacagctctggaacttgtaatatttgcagcatgtcttgccctcttaatgtctaagaagtcaaaaaaggacacgtatgcctagaaaacrtgaataattatcatctatcaaatttttaccatgtgccaagcatagtcatatttggctaacgaaaacaacaaaatcaaccgtgacaaggttttattagtaa

SEQ ID NO: 41680 - DNA, 201 bp, Homo sapiens
ctggaatcctactgccaaattatggcactcatcctacttggtgtaaaatcctgggatgatagcttataatagtaataataagacctgcttcccggtgattmtctaaggattaaatcagttcatggagatgaaatacttaaactgtgcctggcacaaagtaaatgttagtgctactattatccctgctgctgttaaccccaa

SEQ ID NO: 41681 - DNA, 201 bp, Homo sapiens
aacatgtaaatcagctcattcattctgctggccctaaataggtagaaggaagggaaacatgaaagggagccttcatctgttttcctgcagatgcccggctygtggttaacccaagcaagaggtagttaaacggccccgcagattgccagtgactccgggaatgcctaggtttatgtatggattaacacagtgatagaccct

SEQ ID NO: 41682 - DNA, 201 bp, Homo sapiens
cttgctatgctgcccaggctggtctggagctcctggcctcaagcagtcctcctgctttggcctcctgaagtactgagattacgggtgtaagtcaccacacscagcccagaggccttctttaaatgctagtcctttttctcttcctccatctgggtcttggttccatgcgtattcagtttgtgaaaaatttgagtcgtgcac

SEQ ID NO: 41683 - DNA, 201 bp, Homo sapiens
tgtagtggtgtgatctcagctcagtgcaggcttggcctccagggctcaagcagtcctcccatgttgacctcctttgtatctgggaccacaggtatatttcmccatgcctggctaatctttgtgtttctgtaaagatgaggtcttgctatgctgcccaggctggtctggagctcctggcctcaagcagtcctcctgctttgg

SEQ ID NO: 41684 - DNA, 201 bp, Homo sapiens
cctcacatttgcttgcagccagtgctcaaaaccatagacaggcagtgtccccaaccactccctgcgtttctctttctttgccttccgaagctgccatcttrgtggtttttgaagcatcaacacttacttcacatgcagaggccccttttatttatttatttttaatttttttgagacagggtctcgctctcttgctcaggc

SEQ ID NO: 41685 - DNA, 201 bp, Homo sapiens
atgaaggttgtgattcagttgcccaagcagtaaggcctgactggtgtcacgatcccacaacccgcacaaaggcgccattgttgcccagtgtgaagggagctgaggcatcaccaaagggggccaagcgtcccttctctgggttagaaatgttgttttccatttgctggtaaacaacagtccaagttcattgtcctgacacag

SEQ ID NO: 41686 - DNA, 201 bp, Homo sapiens
agccccagtaaccctaagattgaacaaaaccctacttacgtgctacggatttaatatagcgtcaggctcctctaggtacaataaaataccaagttaagagyattaattccttacaaccctgatgggtcccagctgtgcacacgcatgtagggtgtgagggtgtgtgctcagcgggcacaggtgctgacggggctgttccac

SEQ ID NO: 41687 - DNA, 201 bp, Homo sapiens
atcagaaaagaggtcgtgtgtgtgtttgtgtttttttaatatcccatccagcccccagccccagtaaccctaagattgaacaaaaccctacttacgtgctwcggatttaatatagcgtcaggctcctctaggtacaataaaataccaagttaagagcattaattccttacaaccctgatgggtcccagctgtgcacacgca

SEQ ID NO: 41688 - DNA, 201 bp, Homo sapiens
tttgttccctctgcatatagcactttctcaaaaagtagtttggtgacaggcttctttcttctcatcattaaatgacatactggagatcagtcagatgaacwgcaatttatatcttgcccccacccagtgttgatttgcccggggtcatacagataattagtaatgtcttatctcagttttcttatctgcaaaatgagaata

SEQ ID NO: 41689 - DNA, 201 bp, Homo sapiens
agatggcctctagtgaccctcacttcctgggttttacattgcagtatatttctcttctactctgaacaggattgtcctgtgtaacctacagggggaagtgrtagcgcatgacctctgaagctaggtgacaaaatacatttggacttctgctttgcttctcttggatcactccttgtggcagaagctagacaccatgttgcg

SEQ ID NO: 41690 - DNA, 201 bp, Homo sapiens
atttatttatttatttatttatttatttgtttgtttgtttgtttgagatgagtcttgctcttttgcccaagctggagtgcagtggcatgatctcggctcaytgcagcctctgcctcccgtgtccaagtgattcttctacctcagcctcccgagtagctgggattacagttgtgcaccaccaggctctgctaatttttatat

SEQ ID NO: 41691 - DNA, 201 bp, Homo sapiens
cccactaagagtaggtctttctgttaggtacagactctacaataaccaaattcacagaaactgatgtgtaaacccagggtcataaacaataattttcaacmggagctataattatcacatagtttgaaatgctcttgttaatctgagtaggaagagaggatgagaattttcttataggtggaactacagaaaaagagttta

SEQ ID NO: 41692 - DNA, 201 bp, Homo sapiens
tgtgtgagtgtgtgtgtgtaaaataccaaagagaaaacaataaaaaaatagagaaaataataataactagccaatgtgtcatcactccagacaacagccayggtcagtatttggttaacccattcagattttcccctatgaatgagttttttcgcctccataatattagttataatacattgatactacatcccgagtgtt

SEQ ID NO: 41693 - DNA, 201 bp, Homo sapiens
aacttgtgtagggaaactctcccttatgataccgtcagattccttgagacttatttgctattgtgagaacaccttgggaaagacctgcctccatgattcarttacctcccacctggtccctcctgcaacatgtgggaattcaagaagagatttgggtgggtacacagccaaaccatatcaaaaaccatttacaaaactcta

SEQ ID NO: 41694 - DNA, 201 bp, Homo sapiens
ttcagcagtctgcctttccctttctgttataaaatcatgtttttattgaattacattttaatattggtatcactttaaaatgaaaatgagtacttgcaaamtgtatttttgaaggagttgggtggtggtggggggatgccattttggcaacagatgacttcggttcaagtcctctctctgtctcttacttgctttgtggct

SEQ ID NO: 41695 - DNA, 201 bp, Homo sapiens
agtaactcaacattaactgtgtacccctcctagtttggccactgttctgcccaaacatacaagagtcaatgtaagtctctgggagcactcacctttgggcrtgttgctacagagtcactcattcctagaaattgcgaagtcacgaagttgtcaaaaaacacaacgacaggccgggcgcggtggctcatgcctgtaatccca

SEQ ID NO: 41696 - DNA, 201 bp, Homo sapiens
cttctaagcacttcttaggtgcctctgggctttttaacattctttggcagttgtaatttattaattgatttttaaatttggccggtgaaaatgaactttargtaggggtttgaggaaaatgaaaaggcctatttgtttttcagtggctggttcttcgtgttcagcattaaggattggtagaaatcaggcaacctctatgta

SEQ ID NO: 41697 - DNA, 201 bp, Homo sapiens
gattcccaaaatagacgggagttacacagagacctttttttttttaacctcctctgagattttttttaacctcctctgagattctgtatttccttaatgasccgaaaaatctatttagcccagtttttatccttgcagataagttagtacgcttctttttctgctggttgtgatcatatttctatttaggggtaaaggtgc

SEQ ID NO: 41698 - DNA, 201 bp, Homo sapiens
gtgttgggaggaaacagggtgcagagtgggaagggcaggagtatctaagtggccaaatttagcctaattaacagatttgcctagggctgaccctgaagcaraaagcaaagcctagatcagtctgctctcctcctaccaacagggtaatgatgaggttgaaccaccagttctcaatgccatacatgagattcccaaaataga

SEQ ID NO: 41699 - DNA, 201 bp, Homo sapiens
aaaaaacaaacaaacaaacaaacaaaaaataggaaaaaaagaaagagcgtatttatagatggtagagaattctgggcatgagaaacccagccaaacaagtrgaatgtgtgcataggtgggactgctgatcttgttttatgaaagaaataaaggcaagtcaaacagatcctttcgcaaggatccccatgtgtgtatgtctaa

SEQ ID NO: 41700 - DNA, 201 bp, Homo sapiens
ggaatgccatagtggtgagctaagagcaggcagttagttaagtgtatgacaagtatctcattataaatggatgctgaaatgtccaagtgtggaaatgataygcttcagctcttatttttaagtcatccttatctctttcacttattccctcattcaggcaccaaaaatgctgtttgactgggagagcaagtggagctgttc

SEQ ID NO: 41701 - DNA, 201 bp, Homo sapiens
gtgtttttttttttttttttagatttctcattgctgagaacagttccagctctgctgaccaaaggctgagtgtccttttattagtctgagcccctagagaraccaaagaggcaaccctcgagccaactgacagccagctgtggggttggaccctgtttttcatacagtgagcactcttgaacccagagaaggtgcaggttg

SEQ ID NO: 41702 - DNA, 201 bp, Homo sapiens
tattcctttccaacttccacttgccccaaataggtagaagttagcctttatttttggtgtcatgtcttctttccctcctcctatcagtttttcagaaactscagaaatttaacctagtacacaggggccccccacccctgtttccagatgccttctagaaagaggactgggagtgtgaatgaggccatgtgggctttgttt

SEQ ID NO: 41703 - DNA, 201 bp, Homo sapiens
aaagcaaagccaatagagatcttgaaaaaaaaaaaaaaaagaaaaaaccaccgtggtattctaggaagaaaaaagcatttttcgaatgaaaactttttatkatatttgatatattctgcttcccttccctagtatgtattaatgagatgaaatcacttcttaattttcaggttaatattaaagttgaagcccatccctcta

SEQ ID NO: 41704 - DNA, 201 bp, Homo sapiens
tttcctgcatcagctaagcatttatttcatgtagtcctcacactagattgagtggttccatattaatatcctacgtcaaagatgagtaaattgagatgcgkaggttctaatttgcccagtgtcgtggtgtgtgatcttgaccactagcctaaactgctattttatgtccacccatcaacctctacggctgcccctcatttg

SEQ ID NO: 41705 - DNA, 201 bp, Homo sapiens
ccagcccgttatgtcgcaagggctttgggaaatctcaatttattgctagcctggtagatattgagcagggtgtgatcctgttattgggctttcagactttmgcttagcaacctcattgcacccaggacccccatttaatcagcgactcctatggctgtttgggggctctctttcaaataattcttctcacccatgaacatc

SEQ ID NO: 41706 - DNA, 201 bp, Homo sapiens
cagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatga

SEQ ID NO: 41707 - DNA, 201 bp, Homo sapiens
tgacctcaggcagtctgcccacctcggcctcccaaagtgctgggatgacgggtgtgagccaccgcaccaggccatttcctcagttttaaaaagcaaataasaaacaacaacaaactgcatcagagtaaccgtttcaaaaacccatctcaggtctgttttttcttttttttttaagttagcattttctagaagttttggtat

SEQ ID NO: 41708 - DNA, 201 bp, Homo sapiens
tggcataatttagccagataaagtgcccacctagcactcatcccacctcctcactcctctatcctgtgaatgcagaaatacaattcctcatttacaaacarctgtgcatgtagggttgcttgcaaaagttcgtcgtgtgccgatatttcattaccacttttgccagcgctctcgtctgcatttcctgaggtttttcttttt

SEQ ID NO: 41709 - DNA, 201 bp, Homo sapiens
gagtgtttatcagctcacaccaaggaagagagagctcaggagcgactgggcatgaggtggagtgagcactgtgaatgctggggaatggaaagtcctttatstggtgttgcctaagggtacggggaacctggcctggtgttgggaggaaacagggtgcagagtgggaagggcaggagtatctaagtggccaaatttagccta

SEQ ID NO: 41710 - DNA, 201 bp, Homo sapiens
gaaaacaagtaagagtaactttgtacaccgtgggctcccaatcagtgctgcttttcgttgttgatgttgttgttaatgttgaaaaaaatcttcaagtcatrtttgcccccacagaccttcccagacagtctaactaaatgcactgtatttgctaactgttggaacttggcttttggactagaccagcacctcgagaaagaa

SEQ ID NO: 41711 - DNA, 201 bp, Homo sapiens
ggatcgcttgcatccaggaggttgaggctgcagtgagccatgactgtggcactgcacttcaacgtgggcaacagtgtgagaccccatctccaaaaaaaaaagcagtatagtcagtaagaaagaaaacaaactaacagtcaatattgtggctgctctcaatgttctttaaacggatcacattgccacttttttctctttgta

SEQ ID NO: 41712 - DNA, 201 bp, Homo sapiens
ttctccatttatattggtatggatacgtgaatatttagtttattctgtaggtcataatacgacagtattgtgatatattttggtgctcaaattgttccggstttggcccataggaggtctttcgggcaggttcctgcacccttttgacatgccccgttcttttttgagcactttcttattttttggcactgtaagaggctt

SEQ ID NO: 41713 - DNA, 201 bp, Homo sapiens
tttggttctttaacattctcttcttcactaaacccaaattaataattccttactattgtcattaaaagttctcactggatcattccatttatactcagagkaacaaagcaaacccaattatttgagagacactgaaatgaattttgagtctagaacagcatctgcaaactttgcaaaggttcacatgataaatattttctg

SEQ ID NO: 41714 - DNA, 201 bp, Homo sapiens
ggttaacgtggtatctgccagatttctccactgtaaaggatcatttttttcctttgtaattaataaatatattgggggaggtactttgggactacttctcwaattttcatccattaattttagcatccctctggggatcttgcctgcaatgattaatactgtggtattctcatgactgatattgtctttctgtcatgcctt

SEQ ID NO: 41715 - DNA, 201 bp, Homo sapiens
agatgggtttatgcctaattgtgccaccagtttttcccataaaataattcatttggaaggggtggcctaatccagtctgaaccaattctaagatggtagcrtggatgcgggaggcactgcacaggatggaaagcatggagtttggaatctggcacaagtggatttgaattcagacttagtcatcaggagctgtgggacctt

SEQ ID NO: 41716 - DNA, 201 bp, Homo sapiens
aagacatggagctgagagtgaatatgagagtgaatattctgcacgtccattttaatgaccttgtgcctcattttccccatttaaggtagatgggtttatgyctaattgtgccaccagtttttcccataaaataattcatttggaaggggtggcctaatccagtctgaaccaattctaagatggtagcgtggatgcgggagg

SEQ ID NO: 41717 - DNA, 201 bp, Homo sapiens
tgaaaggctgtctccaaccatgcggacacagcgcagtgaagcggttggaaaagctacagacaaatggaaaaccttcattccaaagggtcgttgtctcctcytatttaatagccctgcattcatgcacttttttttatcttgctgtctttttttttttttttaatcaaataccaaagtacttctatggactggtcttaaaaa

SEQ ID NO: 41718 - DNA, 201 bp, Homo sapiens
ttactttttgggctggtaaagccacctaggtcagtgccatgtccaacccaatctggaaaacgattattgtggtgcctgttttgttgacttaacaaagccartcgcccattcctatgctgctaagatgcgaatgcccagctcaggggatgagattactgtcagctttgcctaagctttgggcattagcaccctccatatgca

SEQ ID NO: 41719 - DNA, 201 bp, Homo sapiens
ctttggttctttaacattctcttcttcactaaacccaaattaataattccttactattgtcattaaaagttctcactggatcattccatttatactcagartaacaaagcaaacccaattatttgagagacactgaaatgaattttgagtctagaacagcatctgcaaactttgcaaaggttcacatgataaatattttct

SEQ ID NO: 41720 - DNA, 201 bp, Homo sapiens
aattccagttctctcatattaagtgacaagttgcagaatgcccctgtctttctgagctgtttttatatctgtacaatggggttaatactactagtatttgmttccagggattgttttggaggggagtgaggaataaatgatataattcactaaaacacgtagaatagtatttgacacagagtaggtcagcatgcccaaagt

SEQ ID NO: 41721 - DNA, 201 bp, Homo sapiens
tctttatttcaaaaagagtggctgtgaatctttaaaaatttctttggttctttaacattctcttcttcactaaacccaaattaataattccttactattgkcattaaaagttctcactggatcattccatttatactcagagtaacaaagcaaacccaattatttgagagacactgaaatgaattttgagtctagaacagc

SEQ ID NO: 41722 - DNA, 201 bp, Homo sapiens
cgtagtactgatgtggatatgatttgagctaagactctgctgttgattctcttcaaaaacttggcagtagcccttggatcccattaattgcattcaacagkcatgtattttattaatttttgttcctaaagaaaaaaaaaaatccagattgcttagaaaataaatgtgactcacgcagagcagaatccgaattttctaagt

SEQ ID NO: 41723 - DNA, 201 bp, Homo sapiens
caaaccaccaaacctgggttggcgtttcagtgcctgacacagttgtattcctaagacatagttgggaccagacctcaagaaaatagccaacaaatactggstgaatgaacgaaagaggccatatgcagtcagcccccctctctctgggttctacatatgtagatttaactaatgacagattaaaagcattcgaacaaacgg

SEQ ID NO: 41724 - DNA, 201 bp, Homo sapiens
ctcatttctgggggactaattaaatgcatcctgtgtgaccccactggaagaggacatttggaatcttgtacctggttttctccagacttcgcctcattcascatttccctgtgctcattttgccttgcatccttttgctgtgataaatctcagccatgagtgtgaccgtatgctgagtcttatgagtcttccttgcaaacc

SEQ ID NO: 41725 - DNA, 201 bp, Homo sapiens
agaaatagaaaattaattgagttttagtttttagaaaattatctaagaagtagatttttagaaatagaaaattaacgtagatcacagaaaattatccaaastcagttaattttcccttttccagcaactgtatttgtcctccccacttctcttccctgccttctttttttctccttagcacttacaatgtctcactcatgt

SEQ ID NO: 41726 - DNA, 201 bp, Homo sapiens
agacagtgttagtcaacatcaaatgtctggatcaagagaggcaagaatcccgtggatttggcgttggccagaacttgtctggaatcttgttttctgccttsagtgtcacctgttgagagctctgttgacaaactggcatttgtccttgggagagtagcctcaggaccaggggtgaagagttcagtaaactgtgtttaaccc

SEQ ID NO: 41727 - DNA, 201 bp, Homo sapiens
tttgttttaaataaaaatcatactagagcagtaggcagtgtgggtgagttctcccactttacattttactttgcataatttaggcccctttcaggccactyttccccctgtgccccaggtgtgtttgctaccatacctccccaggggatagccctccaaacctgattggccacctagtctggtcttaaagtcccaaaggga

SEQ ID NO: 41728 - DNA, 201 bp, Homo sapiens
tcataccactggattagtctcttgcctttcaattttatgtttatatacaaatatatgtgcataccaaattttatatatatatatatatatatatatatatwtttttttttttttttttttttttttttggtcggagtctcaccctttcacccaggctggagtgcagtggcgcaatctcggctcactgcaagctccgcctcc

SEQ ID NO: 41729 - DNA, 201 bp, Homo sapiens
tgttgatgcttttttgcctttttgacaattaaaaataatctcataccactggattagtctcttgcctttcaattttatgtttatatacaaatatatgtgcmtaccaaattttatatatatatatatatatatatatatatatttttttttttttttttttttttttttggtcggagtctcaccctttcacccaggctggag

SEQ ID NO: 41730 - DNA, 201 bp, Homo sapiens
ggtgtaaattagtcaccagtgtctcatagggttgggctgaaacttaacacatcccatcactttgattggctaaagtcagttacataaccaagcccagcttyagaagggaaattgtatgccttacaaggaggtgagaggatggaaaatgaatatttgctgaacagactttctgtccagtttgttgtatttggtggtggtgca

SEQ ID NO: 41731 - DNA, 201 bp, Homo sapiens
cagaactcacaaaatgtccagctttctttcttttattcaaaatttatacttcataattgaagttcacctcccaaaagacatagcttggtttagcatagagytatgatgtgttttctctttgttccttttgcacactttccttgtctggaggcgttgggcttggatccttcattcttcatgaggctgatgtttttccatttc

SEQ ID NO: 41732 - DNA, 201 bp, Homo sapiens
ttacaccctgtgatttgaattttccatactccattccattctatatgtcagatgcatcttcctaaaacacacctttgtcacatcactcctctgctcaaaarcattcagtggctccctgggccctctgggactaagtttataatgctcagcttgtcattcctttgcccagtgtactctctgtctcactaatttgttcattat

SEQ ID NO: 41733 - DNA, 201 bp, Homo sapiens
ataaatatatacatatatgtgtatatatagattttgttttttgagacagggtcttgctctgtcactcaggctggagtgcagtggcgtgatcatggctcacygtagcctcaacctcctgggctcaactgattctctcatcttagcctcctgagtggctgggaccgcaggttcatgctaccgtgcccagctaattgtttaatt

SEQ ID NO: 41734 - DNA, 201 bp, Homo sapiens
aaagttaccttgatagttcaggtgtgcagagaaaattcacagccatcaatagaaaagaaaaaaaaatcctgtttataccttaggcattctgtgatccttasgatgtagccatgacagtattacgggttttaaaagccacccaagtaatctaaatttcctccaaactaacaattcctgaaagattgaaatattgctaccaat

SEQ ID NO: 41735 - DNA, 201 bp, Homo sapiens
gcaagaatttatcccttctgttgatgcaattaaagctaatggatctcatatatatatatatatatatatatatatatatatatatatatatatatatatatttatataaatatattttatatttaaaaatatttatattttatatatttttatatatttatgcaagtatatatctaaatatataaaatatatataaatata

SEQ ID NO: 41736 - DNA, 201 bp, Homo sapiens
tgtcctgtcgctgtcacaagtttttaataagggctgggggtcctcttgaagagcccaggaactgcagtccctcctctatgccttcccctgaacacagtgcrccctcactaataaattctgagggctgacactgcctgagccggctggtctttgccctcaatttcattgagatgggccattgaaaactcattacaagctgtt

SEQ ID NO: 41737 - DNA, 201 bp, Homo sapiens
tgcaagaatttatcccttctgttgatgcaattaaagctaatggatctcatatatatatatatatatatatatatatatatatatatatatatatatatatatttatataaatatattttatatttaaaaatatttatattttatatatttttatatatttatgcaagtatatatctaaatatataaaatatatataaatat

SEQ ID NO: 41738 - DNA, 201 bp, Homo sapiens
tggaagaaggaaggcgcccctccttcttagctgattgatgatgagatagaaagatagaaacagccccatcactatgagatggaaacccttctttccttcakctgacttccctctccttcattcccaaccaagtttgaccccgccgcagtggagattgtggcagatgggtcagatagcatgtgtcctgtcgctgtcacaagt

SEQ ID NO: 41739 - DNA, 201 bp, Homo sapiens
aaaaagcttccaactttttttttttttttttttgagttggagtcgcactctttcacccaggctggagtgcagtggcccgatcctgggtcactgcaacctcygcctcctggattcaagcgagtttcctgccttagcctcccgagtagctgggattacaggcacccgccgccacacccagctgatttttgtattttagtagag

SEQ ID NO: 41740 - DNA, 201 bp, Homo sapiens
tcatcctctgaaaaactcttctgaacaacatcggctgtgcatagtaactgccttgagtggggccattttagaaaatatatgaggtacgggatgaagatgasggaggaaaatggttcctacttatcattactttgtccctccaaaagcctgcatgcgggaagaaaaatccacccagtgcaagaaccgtggcagtactcagac

SEQ ID NO: 41741 - DNA, 201 bp, Homo sapiens
gaatacaaggggggataaagatagacttaaaatacgctctctagaaaaaagtaagaaatatggaaagaaatctaatttagaaaaatgcacgcacccacagrcacgcttcacaggactggcaggtggagaggatgtttgttaacagggctggctattttactttaagtgctgcaaacattgcactaatgtttgggtctttgc

SEQ ID NO: 41742 - DNA, 201 bp, Homo sapiens
gagtgagaccctatctcaaataaaaataaaaatagaatacaaggggggataaagatagacttaaaatacgctctctagaaaaaagtaagaaatatggaaakaaatctaatttagaaaaatgcacgcacccacaggcacgcttcacaggactggcaggtggagaggatgtttgttaacagggctggctattttactttaagt

SEQ ID NO: 41743 - DNA, 201 bp, Homo sapiens
gtaaaaaaaatcatctcacacctgtagccgcagctactcaggaggctgaggcagtagattcatttgagcccaggaggcggaggttgcagtcaaccaagatyacgccactgcacaccagccgggggtgacagagtgagaccctatctcaaataaaaataaaaatagaatacaaggggggataaagatagacttaaaatacgc

SEQ ID NO: 41744 - DNA, 201 bp, Homo sapiens
aaacaaacagcttgtttgtggttcgtcctgaaatcctccctgctcacaaaacagccagctacttggttttctaaaagacgtaattttgcaggcagacttcrtagagccattctgtgcagaagaagggaagggagaagctgtttgttttacctgtagtatgaagatattctttgcgctgttagaactgagctcattaattct

SEQ ID NO: 41745 - DNA, 201 bp, Homo sapiens
tttgggaggtcaaggcggatggattgctggagctcaggagtttgagaacatccagggaaacatagtgtgaccccatttctacaagaagtaaaaaaaatcawctcacacctgtagccgcagctactcaggaggctgaggcagtagattcatttgagcccaggaggcggaggttgcagtcaaccaagatcacgccactgcaca

SEQ ID NO: 41746 - DNA, 201 bp, Homo sapiens
ggaaaggatctaagatgattggaaacagtgtacatagaatacaagaggagttgggcatgctggctcatgcctgtaatcccagcactttgggaggtcaaggyggatggattgctggagctcaggagtttgagaacatccagggaaacatagtgtgaccccatttctacaagaagtaaaaaaaatcatctcacacctgtagcc

SEQ ID NO: 41747 - DNA, 201 bp, Homo sapiens
gcttgaggccaagaatttgagaccagtctgggcaacataggcagaccccatctctaaaaaaaaaaaaaaaaaaattaaattagctgggcttggtggtgcayacctgtaggctgagctgctcgggaggccaagatgggagaattgcttgaggctggatgtgtgtggctatggtgagctaggatcacgctactttacttcaac

SEQ ID NO: 41748 - DNA, 201 bp, Homo sapiens
gctgggaagtccaagatcaagctgctggcagattgagtgtttggcaacggcccactttctggttcctagatgttcacctccttgctatgtcctcatatcgkgggaggggcaaagggtctctctatctggcctcttttaagcccttaacccattcatgaaggctttgcctcaatgacctaatcacctcccaaaggccctacc

SEQ ID NO: 41749 - DNA, 201 bp, Homo sapiens
attttatttcaggaccttggtaaggggttatacaatatttcttttgaaacgagggtctcgattattgggcttgagtatcctgatctaattaatgcactggrcagagctggcagacgtgtgggacacccagctattctctggaagggaagggggatataagagacacactataaaggtgaatggtaatcggcatctcccctt

SEQ ID NO: 41750 - DNA, 201 bp, Homo sapiens
gggtgagatgaacattgattgagcctttacatcggagacactataacaaatgctttgtgtacatcagctctttcaaattaatacaattctactagaggggrcactattagtatccccaatttacagatgaaaaaaatgagggacagagaggttagatgtgtatctaaggtcacatagctcacaaacgacacagcatgcacc

SEQ ID NO: 41751 - DNA, 201 bp, Homo sapiens
aagaacatcatggcccccttcatatcctggttaatgtccccgctgaccctgagttctgcctccatcactggaacaagagcctgtctttgggaagaggtgtsttccctggcactcgtttgatttgtagccgccacacatggcaggtcccaagctgtctgaagtcttggctgccattcctaagctactaaaactttgctggag

SEQ ID NO: 41752 - DNA, 201 bp, Homo sapiens
gatttggacggtttgctttagagtgcattaacttctttatcacattaatactgactcatatcttatttcccacttgcaataagaaaaccattcaaatcttkccctcacaggacaatatctttaatagcttctgtgtgtttcctatttttggctgtttctgtataaacagactaatctaatagcatactgaacccatctaac

SEQ ID NO: 41753 - DNA, 201 bp, Homo sapiens
tttagtgagctctgctggcaagtgtgtcaaatttataaatatcactactataaagacatacttttggatatggatttcttcctcagtttatttcttctttsattttttcatgtccaggtcactacgtattgcgtatatttggttggaattttatttttgagcaattcatttacccagattgtgtttctggagattaaagca

SEQ ID NO: 41754 - DNA, 201 bp, Homo sapiens
tacctgaactgtctcttaaaaggctctgtctccaaacacagtcacattgtgaggtactgggggtttgggcttccacatacaaagtctgggacacagtacgytctcataagagacctcttctcaacaggatccatgtttgatccgggggaataaagctagagttgctttcttccttgtaatatgtataatgactcatgagag

SEQ ID NO: 41755 - DNA, 201 bp, Homo sapiens
aggaatgtagttcctcacagttctggaggttgggagtcctagatcaaggtgtcagcagggttggtttctctctgtaccattgtccctggcttggagatgaycatcttctctgtcttcacatggtcttccctctgtgtgcgtttgcatccttatggcctcttcttgtgagggcactggtcatattggattagggtccaccat

SEQ ID NO: 41756 - DNA, 201 bp, Homo sapiens
atgttgcctccagcatcccaggaactccgttaatgtttatttgaatgatggaatgaaggtgtcttgctatattttgacatttctgtcaaaatatgaatctrtctttgcctagcatcttttcatgtgcacattgcccatctttataacaaagtgtgagtgggaaaggacttttaatcttcattatattatcattcatatgaa

SEQ ID NO: 41757 - DNA, 201 bp, Homo sapiens
tattccagtgggccccgctgcattcttcccagtcccaggaaatctttgtgcatggctgtcttttctgtgccatcttgggcatctcacgcattggccctatmcacatgttgcctccagcatcccaggaactccgttaatgtttatttgaatgatggaatgaaggtgtcttgctatattttgacatttctgtcaaaatatgaa

SEQ ID NO: 41758 - DNA, 201 bp, Homo sapiens
tttaacaagagacacatgtcagatagtagacatgatctgagaagacacaaaacccagcgtggtgattttggcagccttgccatgcatctctaacatgcacrtggccagaaaaatagcttggacattctgttcaaccctccacatcaactggtcagtttagtctttaaaaggtgataggcctgttgtggtggctcacgcctg

SEQ ID NO: 41759 - DNA, 201 bp, Homo sapiens
aaagtccgcacttcctaatgttaccactctggaggttagaatttcaacatataaattttggggggacacattcagaccacaataatgttttataatgttcmttttgctttaacaagagacacatgtcagatagtagacatgatctgagaagacacaaaacccagcgtggtgattttggcagccttgccatgcatctctaac

SEQ ID NO: 41760 - DNA, 201 bp, Homo sapiens
gataccaataattaatatctatggttgattgtaaaaatggccaccaattcttccctgtcccctgcatatgtacatccttgcactgtgaaattgtagatctygccctccaaaggtgaagttcgtttgtccactccttgaaccaggatggcatgaaacttgatttgaccaatgaggcatttggaaacacggcacaagcaaagg

SEQ ID NO: 41761 - DNA, 201 bp, Homo sapiens
aggtagatttttagaaccaaatgccttttaggaagctacctctcttccaccctgctgcctttgtgttgaataaactatattaaattatccaggaggaatgrttagtgatctgattcattaatatcccttgttattaagaactgtctgtatttgtgtcctggttggcagatattaagtccacagataccaataattaatatc

SEQ ID NO: 41762 - DNA, 201 bp, Homo sapiens
catttgcaaaacactttgacaatactttcctttcagtctattttcctgtgtatggggtaagtgttgcccttctgcaactttccttttattttatttatttmtttcttttcaatactctgaatatcactggagcagctgcagattcagggcagtatggggtggttcaggaacagaactgacaggtattgaagccaaaaattg

SEQ ID NO: 41763 - DNA, 201 bp, Homo sapiens
tttatattgctgaaaatgtcatttgcaaaacactttgacaatactttcctttcagtctattttcctgtgtatggggtaagtgttgcccttctgcaactttmcttttattttatttatttatttcttttcaatactctgaatatcactggagcagctgcagattcagggcagtatggggtggttcaggaacagaactgacag

SEQ ID NO: 41764 - DNA, 201 bp, Homo sapiens
ggcggtgcatgcctgtaatcccagctacttgggaggctgaggcaggagaatcccttgaacctgggaggtggaggttgcagtgagctgagatcacgccattrtactccagtctaggcaacaagagtgaaactctgtctcaaaaaaattaataataataatgttacaataataataatgttagtgatacatatcattttgaaa

SEQ ID NO: 41765 - DNA, 201 bp, Homo sapiens
agagaaaaacaattacactagctgctggtctgtatttactggttagaatagaatattattaccatcaagaataacattagtggccaggtgcggtggctcaygcctgtaatcccagcactttgggaggccgaggtgggtggatcacctgaggtcaggagttcaaaaccagcctggccaacatggtgaaacccccgtctctac

SEQ ID NO: 41766 - DNA, 201 bp, Homo sapiens
ctgcaaactacccccgcccccgggttcaagcaattgtcgcacctcagcctcccaagtaactgggattacaggtgcccaccaccaagcccggctaatttttstattttcaatagagatgaggttttgccatattggtcaggctggtcttgaactcttgacctcaggtgattcacccacctcagcctcccaaagtgcagggat

SEQ ID NO: 41767 - DNA, 201 bp, Homo sapiens
ggggttgggggagggagagcatcaggaagaatagctaatggatgttgggcttaatacctaggcgatgggttgataggtgcagcaaaccaccatggcacagrtttacctatgtaacaaacctgcacatcctgcacatgtaccctggaacttaaatttttttaaaaaatgtttttattgtgattttcacaggaaagaaggggc

SEQ ID NO: 41768 - DNA, 201 bp, Homo sapiens
aggcggagcttgcagtgagccgagagcccgccactgtactccagcctgggcgacagagcgagactccgtctcaaaaaaaaaaaaaaaaaaaaaaaaaaaaagacacgtacacagacaaatgttctgacagaaatacactgagatatctacagtgcttgtctctggataggatagggtataatttaattgtttatagttaag

SEQ ID NO: 41769 - DNA, 201 bp, Homo sapiens
gcaacacgtaggttcttagttttttaaatatatatatatatacgtatatatatacgtatatatatgcgtatatatatacgtatatatgcgtatatatataygtatatatgcgtatatatatacgtatatatacgtatatatgcgtatatatatacgtatatatacgtatatatatatgtgtgtatatatatatataaaaat

SEQ ID NO: 41770 - DNA, 201 bp, Homo sapiens
gtggcgggcacctgtagtcccagctacttgggaggctgaggcaggagaatggcgtgaacccgggaggcggagcttgcagtgagccgagagcccgccactgyactccagcctgggcgacagagcgagactccgtctcaaaaaaaaaaaaaaaaaaaaaaaaaaaaagacacgtacacagacaaatgttctgacagaaataca

SEQ ID NO: 41771 - DNA, 201 bp, Homo sapiens
tttgtagcttgattctatttataatgtactcacaccttaaccaatagcctcacagatggcatatgagaatactcatactcagtgctgctaaaaacagcctrctgcctgaacaccagagtgtcttttaaagcgtagaaaagttgggtacataaaatttctgttgcaaaaaggaatgtataggccttaattgaaaatgtatct

SEQ ID NO: 41772 - DNA, 201 bp, Homo sapiens
ttctttaaaaaaaatttatgacatattacttttgctaattatgtgtgtgggtagattatgttattcatgaattttatttcaggaccttggtaaggggttayacaatatttcttttgaaacgagggtctcgattattgggcttgagtatcctgatctaattaatgcactggacagagctggcagacgtgtgggacacccagc

SEQ ID NO: 41773 - DNA, 201 bp, Homo sapiens
ttttcagagttggtttaccaatatgatgtctgtattaaaatatatgtaatgctgctttcaaaatgttaagtattatgagaatacattaacaaaactctggygaattttttgtcttatgtttcttgaatccaaacctataagtaggtgcaaacattagacgatttcattttgggcttctgatacactcctgtccgagaagtt

SEQ ID NO: 41774 - DNA, 201 bp, Homo sapiens
atgagagcagattttgcctgtttcttccaaaatctggattcagtgacatcgtgttggtagcttgaaactgaccgtggtgagaatatttacaccatggaaaktggcaaatgctactaataaggatgattgttttagttttcattttgtaattttcagagttggtttaccaatatgatgtctgtattaaaatatatgtaatgc

SEQ ID NO: 41775 - DNA, 201 bp, Homo sapiens
cggtaaaaaacttgtttccattgatctgaccccagaattccctgtgcttatacagatacacaacgtgcactgggtcttccagaaatgcaggggccttctamatcaagggaagattgtgtggtgttttgttccagtcttttaccaaggtctcaataccatcttgaaacatcatgcagcactgctcataatatttgagtcacc

SEQ ID NO: 41776 - DNA, 201 bp, Homo sapiens
gggcattttggaaatttggaaaggcattttggtggcctttggcacttagcaggtggggtccacgggtccatcctgtgatgccataggcagtccaatataasaaagaactgccctcgtcccggtaacatacacctgtgcccccagacattcatttcggtaaaaaacttgtttccattgatctgaccccagaattccctgtgc

SEQ ID NO: 41777 - DNA, 201 bp, Homo sapiens
tattttgcattgtttatgtcagcattaagcagtattcttacacagtttgtaagtcttaaaactcagtatctactctagtagttgctccaaatgtgatgtcstcataaatcaccgagggatcttgttaaatttggattctgattcagtaggtctaggtggggcccgagcttctttgtttccttttcttatttaatttttgtg

SEQ ID NO: 41778 - DNA, 201 bp, Homo sapiens
cataccatatgctgaaagacttggaatgcaaaaacctaaggccaagggcacttctcaatattaaaccctcagttgtaatggaggcatcaagactataagayccaagaccttaacttttgtgctccttgtcttgtggagggaacatccatcctcaaaacagaaacctgtgagatcccttgaatatactgacaatacactgat

SEQ ID NO: 41779 - DNA, 201 bp, Homo sapiens
acttgtggaataattttttaatataaaataattaccatcactaatcctaactgtgcacattcttgactctgtgacactgagcaaaatcctgaacctctctrtgccttgatttctttcacgtcttgttctagttttgaagagcgattcttgtgtgaattcagggagaggaggcatgaggcatggtaaggccaccgtacgtct

SEQ ID NO: 41780 - DNA, 201 bp, Homo sapiens
ttagaagaaaaccagaggtctgtgcacactatggatttttactacaatgatgccctttcacatacagcgagaaggattaagaggtactgtattgttggttrataaagtcaaacttgtgaacagagcaaaagggcattgcttggtcattgcagcttccacccatgcaccttacacagaagtttgggccctaacatggaaact

SEQ ID NO: 41781 - DNA, 201 bp, Homo sapiens
ggaagccttcactctcatgacataattacctcccaaagtccgcacttcctaatgttaccactctggaggttagaatttcaacatataaattttggggggasacattcagaccacaataatgttttataatgttcattttgctttaacaagagacacatgtcagatagtagacatgatctgagaagacacaaaacccagcgt

SEQ ID NO: 41782 - DNA, 201 bp, Homo sapiens
tggtgcccatcaccccgatcacatgaacgtctatgcccaggtcccatttcctgacattcccaacatctctaccttctccgggcctagggcagggatcactstttcagaaacatgagcgtatggaagccccagtgtgttccttgaagtcccgatgcgtgatttgtccccatgctgtgtcgcacttggtcatctggaccctgg

SEQ ID NO: 41783 - DNA, 201 bp, Homo sapiens
aaagaggtgtaaatggacaagaatgaaaagcaattgcaagggcccttgaaggtttgtgaaggatggcaaagtgacttggatgttgatttctaaaggaggtraaacttgaaggtagacaagctctttgtgtccatacatttgatgggtcatcctatgaaggagggcccatctcttacggcaggcagcgtggcgtaggcctca

SEQ ID NO: 41784 - DNA, 201 bp, Homo sapiens
cagcacagtgaggaggtattctttggagagcactgtttcccaagagtgattctaacaaagaggtgtaaatggacaagaatgaaaagcaattgcaagggccyttgaaggtttgtgaaggatggcaaagtgacttggatgttgatttctaaaggaggtaaaacttgaaggtagacaagctctttgtgtccatacatttgatgg

SEQ ID NO: 41785 - DNA, 201 bp, Homo sapiens
gtcaggagatcgagaccatcccggctaaaacggtgaaaccccgtctctactaaaaatacaaaaaattagccgggcgtagtggcgggcacctgtagtcccarctacttgggaggctgaggcaggagaatggcgtgaacccgggaggcggagcttgcagtgagccgagagcccgccactgtactccagcctgggcgacagagc

SEQ ID NO: 41786 - DNA, 201 bp, Homo sapiens
acgaggtcaggagatcgagaccatcccggctaaaacggtgaaaccccgtctctactaaaaatacaaaaaattagccgggcgtagtggcgggcacctgtagkcccagctacttgggaggctgaggcaggagaatggcgtgaacccgggaggcggagcttgcagtgagccgagagcccgccactgtactccagcctgggcgac

SEQ ID NO: 41787 - DNA, 201 bp, Homo sapiens
agcaatttacaaaattgcacatactctataaatacacttctgttataaaaatagacacgtacggccgggcgcggtggctcacgcctgtaatcccagcactytgggaggccgaggcgggcggatcacgaggtcaggagatcgagaccatcccggctaaaacggtgaaaccccgtctctactaaaaatacaaaaaattagccg

SEQ ID NO: 41788 - DNA, 201 bp, Homo sapiens
aatacaggcctttcccatttcacagtgtttctagctcccctttccaatacatctctctctctctttctctctctctctctctctctctcacacacacacacacacacacacacacacagccaaatcagacaccaacataaactgtagagttaacattctttttccaccctcacactttttttagctccgatctgtgttcaa

SEQ ID NO: 41789 - DNA, 201 bp, Homo sapiens
taaatacaggcctttcccatttcacagtgtttctagctcccctttccaatacatctctctctctctttctctctctctctctctctctctcacacacacacacacacacacacacacacagccaaatcagacaccaacataaactgtagagttaacattctttttccaccctcacactttttttagctccgatctgtgttc

SEQ ID NO: 41790 - DNA, 201 bp, Homo sapiens
aaaaccacacttacatttaaatacaggcctttcccatttcacagtgtttctagctcccctttccaatacatctctctctctctttctctctctctctctcwctctctcacacacacacacacacacacacacacacagccaaatcagacaccaacataaactgtagagttaacattctttttccaccctcacacttttttt

SEQ ID NO: 41791 - DNA, 201 bp, Homo sapiens
tttggcagttacctgaaagaaaatttagtgattgccagtccattctctagccttctgaagaagatagattgtaatctttaattaagctatcactcacaccmaaaaaaaaaaaaaaaaaaaaaaaaaagcggggcaaggggttggagaatgttcatatcacattattttggatgtctggggttgcacctggaagctcagata

SEQ ID NO: 41792 - DNA, 201 bp, Homo sapiens
gtacttcatgatcttggaagaaggaaggcgcccctccttcttagctgattgatgatgagatagaaagatagaaacagccccatcactatgagatggaaacmcttctttccttcagctgacttccctctccttcattcccaaccaagtttgaccccgccgcagtggagattgtggcagatgggtcagatagcatgtgtcctg

SEQ ID NO: 41793 - DNA, 201 bp, Homo sapiens
cattgtcccccaccttattctaaataatgactttcttaaaactacatgttttgggggaatgtcctgcaatattgctttacatctttttatttttttatttyattttattttttttgagacagagtctctgtctccaggctggagtgcagtggcacaatctcagctcactgcaacctccacctcccgggttcaagcgattcc

SEQ ID NO: 41794 - DNA, 201 bp, Homo sapiens
aagtaaaaccacaggggatctgttggaagtggcatgatggaggaattttaaaagaattgaacaaataaaatagtcagagctcaaaaattgagtactgcttygtttctcccaaataaccatcaccagacaaacaggtgtgtgtgtgggtgggggaggtggcctggtggtacttcatgatcttggaagaaggaaggcgcccct

SEQ ID NO: 41795 - DNA, 201 bp, Homo sapiens
gaattgtctttggctgcacataatatacaattgttgatgagctaaaaaaaaaaaaatccccaaaaaatctcataatgttttaagaaagtttatgaatttgkgttgggccagattcaaagttgtcctgggccgcatgtggcccaccagccatggtttggacaagcttagtctacaggttcttcaagaggggcttgagcattt

SEQ ID NO: 41796 - DNA, 201 bp, Homo sapiens
agcaaaatggggtaagaacagaatctgccttgcagagaattaaccgagatgatgtgtggaaagggcctatcccagaggctggtgtaccatggtggcttctyctggctctgctggttattattattagcattattgtcattgtgaaagtgacaaggaatgtgcctgtgcgtgaatctcactcttagatcagacgtgcttttg

SEQ ID NO: 41797 - DNA, 201 bp, Homo sapiens
aagaattgtctttggctgcacataatatacaattgttgatgagctaaaaaaaaaaaaatccccaaaaaatctcataatgttttaagaaagtttatgaattkgtgttgggccagattcaaagttgtcctgggccgcatgtggcccaccagccatggtttggacaagcttagtctacaggttcttcaagaggggcttgagcat

SEQ ID NO: 41798 - DNA, 201 bp, Homo sapiens
gaaaaggaaagacaacagataagtgattgccagggactggagaggagtggggggtgagtgggaaccagagtggatataaaacagcaactggaggatcctgrtatagatggaaatgttctgcatcttgactgtctcaatgtcaatttcctggttgtgaaatcgtactagagttttgtgagatatcacctatgggggaaactg

SEQ ID NO: 41799 - DNA, 201 bp, Homo sapiens
catctcaaaagagaagaaaagagaagaaaaggaaagacaacagataagtgattgccagggactggagaggagtggggggtgagtgggaaccagagtggatwtaaaacagcaactggaggatcctggtatagatggaaatgttctgcatcttgactgtctcaatgtcaatttcctggttgtgaaatcgtactagagttttgt

SEQ ID NO: 41800 - DNA, 201 bp, Homo sapiens
catcctgtgtagaaatatcaataaatataaaggtaagtattattgtccccattttacagatgagaaaatggagtcccagggacctacctgctcaagggcasagaaagcttgaatgagtaaatttactttgtgttgttccaaaggtttctccaaaggtctttgcacctcccaaggctattctcattttgagaaagactggca

SEQ ID NO: 41801 - DNA, 201 bp, Homo sapiens
tgtttagtaagtcatctatgttgtttgggaggaaagagaatgagcattcctcagttcctgcactgcaccaggccttgccaatacagtacctcatttaattmttgctaccatccttgaggtggctggcattaggccatttgcggggtgtagaaaatgacatgcagaaatactgtagcagctcacttaatatcaggcagatgg

SEQ ID NO: 41802 - DNA, 201 bp, Homo sapiens
tgaggtctcctgaaacttattcccgcaaggacatactactgtggacccacctgaagggtggcatccactcttctagtaggatctcacattggtattttcasacacttctgccccttgccatgtttagtaagtcatctatgttgtttgggaggaaagagaatgagcattcctcagttcctgcactgcaccaggccttgccaa

SEQ ID NO: 41803 - DNA, 201 bp, Homo sapiens
ttgaaggaatgtttcacttccaaatccagatctctgacttcccttgaaaatttggagtgccactcaagtcggccgctctgagctagaatcctggtgttcaraattggcaggaagggcacaggggcaaggtataggctcacgtctccacattctgcacctcccaggctcctgccattgatgtgagcgggttcctgtactgca

SEQ ID NO: 41804 - DNA, 201 bp, Homo sapiens
ccagggacggctccttggcaagttgtactgctgtggcctagggagggacaactggcagggccacacaaggaggtaaaaccttatgctccatttgcaaagcyagtggccccagcagagataggaggccctctctgtgatttcggcagtggtttccctgggattgaggtctcctgaaacttattcccgcaaggacatactact

SEQ ID NO: 41805 - DNA, 201 bp, Homo sapiens
ggatcttcaggtttggagggaggccgatagagagtgtctggagttgccaacgtcctctccttgggtcatgggtgtgtgtgtgtgtgttttcttcttgttgktgggtttttttttttttttttttttttttttggcttttgcgcctatggtgacttttagcgaatggatactattgaaggaatgtttcacttccaaatccag

SEQ ID NO: 41806 - DNA, 201 bp, Homo sapiens
tttttttaacagttagatttactcttcctttgcacagactaatagcacactgaggtaggatccagggacggctccttggcaagttgtactgctgtggcctrgggagggacaactggcagggccacacaaggaggtaaaaccttatgctccatttgcaaagccagtggccccagcagagataggaggccctctctgtgattt

SEQ ID NO: 41807 - DNA, 201 bp, Homo sapiens
cccctgtgggcttagaagaaaaccagaggtctgtgcacactatggatttttactacaatgatgccctttcacatacagcgagaaggattaagaggtactgwattgttggttgataaagtcaaacttgtgaacagagcaaaagggcattgcttggtcattgcagcttccacccatgcaccttacacagaagtttgggcccta

SEQ ID NO: 41808 - DNA, 201 bp, Homo sapiens
aatggatcttcaggtttggagggaggccgatagagagtgtctggagttgccaacgtcctctccttgggtcatgggtgtgtgtgtgtgtgttttcttcttgktgttgggtttttttttttttttttttttttttttggcttttgcgcctatggtgacttttagcgaatggatactattgaaggaatgtttcacttccaaatc

SEQ ID NO: 41809 - DNA, 201 bp, Homo sapiens
gtgggaatgtctcatccccctgtgggcttagaagaaaaccagaggtctgtgcacactatggatttttactacaatgatgccctttcacatacagcgagaargattaagaggtactgtattgttggttgataaagtcaaacttgtgaacagagcaaaagggcattgcttggtcattgcagcttccacccatgcaccttacac

SEQ ID NO: 41810 - DNA, 201 bp, Homo sapiens
agtgtgcccattttacagaggtggaggaggaagctccaaaaatgaagcccaaggatcttaaggtaatatatgggcttgaatccagtgtatcttgctccgamagccttgcttttgtcattatccaacattagctgtctttattatagtggccttcttaccacctacaaaacaagtgccagcattctagtaaaatttattcac

SEQ ID NO: 41811 - DNA, 201 bp, Homo sapiens
taataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttct

SEQ ID NO: 41812 - DNA, 201 bp, Homo sapiens
aaagtaaagtaataaacaaataagttttgggttgggcgggagattagttagagacaggatctgtaggtcagaagtggtatttgggggagtagggagttttktttttttttctttttcccttatgcatttgggagtggaagagctgtcagattctgaatttagttagatttataatgctagagacattcagcagtctgcctt

SEQ ID NO: 41813 - DNA, 201 bp, Homo sapiens
agcactttgggaggctgaggcaggtgaatcacttgaggtcaggagttcgagactagcctggccaacatggtgaaaccctgtctctactaaaaatacaaaawtttttttgtattttgggattcggtttaggtgatgtgtgtctgtaatcccagctacttgggaggctgagacaggagaatcacttgaactccagaggcagag

SEQ ID NO: 41814 - DNA, 201 bp, Homo sapiens
ttagtttctcttacatgtatgaagttggatagttagaatgagatgaaaataaatgggctgggcgtggtggctcatgactgtaatcccagcactttgggagkctgaggcaggtgaatcacttgaggtcaggagttcgagactagcctggccaacatggtgaaaccctgtctctactaaaaatacaaaattttttttgtattt

SEQ ID NO: 41815 - DNA, 201 bp, Homo sapiens
tggagctcagaaaggaggagaaaggtccctgctggtctgtggagagggccttggccaccagagggatcaaatggcccaggcaggaaataagtatcccgctytcagatctgaggccagattttcaagtgtatgcatgattctggggtgctacaaagggtatagagtatggagttagaacattacacgtcaacaagaatatgg

SEQ ID NO: 41816 - DNA, 201 bp, Homo sapiens
acctcatagaagtgagccctcttactgaattatgtggctggggttcttgggtatgttttgttctattttctggttggtggttttctttctgtcgggtcccrtgggctctttttggacctcttctcagaatgtttttcgttttttttattttttgagatggagtcttgcactgtgtcctgggctggaatgcaatggcaagat

SEQ ID NO: 41817 - DNA, 201 bp, Homo sapiens
ctatgtctaccagaagccttgctgcagttttaatggggtttaaatctataggtctaacattaaacctatagatcaattcgggagaattgacatctttactrtgttgagtcttccagtttgtggacatggtatgtaattctatttatttagtataaacccactggagtgtgtacctaagcatttcattttctttggagcgat

SEQ ID NO: 41818 - DNA, 201 bp, Homo sapiens
cacacctgtaatccctgctacacaggaagctgaggcaggagaatcgcttgaacccaggaggtgaggttgtggtgagccgagatcatgccattgcactccarcctgggcaaaaagagcggggtaaaaaaacaacaaaaaaatgatgtaggaatgaacagatgaacaaccccacacaacctaaggacaactttgaatcaattc

SEQ ID NO: 41819 - DNA, 201 bp, Homo sapiens
aggacattgttttaagtgggaaacgtcagctctctcaacttctacacattcgactattccctactcctcagtgaccccaaagaccccagagaaactcagtrtgaaaaatcactatggaagtgcaatagttattactttgtttggaattcactacaacactgtttctcaaaatataattcctgagtcacttggaagattaca

SEQ ID NO: 41820 - DNA, 201 bp, Homo sapiens
atgctaaccaggatggtctcgatctcctgacctcgtgatccaccagccttggcctcccaaagtgctgggattacaggcattagccaccacacccggcccarattttcttataaagtcaaatgggagatacttgtttgcaagaaatagttcttttggttcttacttttccataaggattgagtctcaaaatgtctggtagca

SEQ ID NO: 41821 - DNA, 201 bp, Homo sapiens
ttactttaattccccctacaagaatgccgagacacctctgcctattttctctttctgtgtttgttgtttcttttgtttttgttttcgagactgagtcttgstctgtcgcccaggatggagtacagcagtgcaatctcggctcactgcagcctccaactcccggctccagtgattctcctgcctcagtctcccaagtagctg

SEQ ID NO: 41822 - DNA, 201 bp, Homo sapiens
actcagataggtgtgtattctcaagaagctttcattctaatgacacatactttgtctccagtcagagttatggcaggttttttttttttttttttttttttgactaaattcacccatatttgatggcaagtgtgatcacagcatgtttataaaaatcattcttaattaaggcatttccatcttatcaagccccctatttaa

SEQ ID NO: 41823 - DNA, 201 bp, Homo sapiens
tggccaatttcaaggattttaggagctctgtgccaggaacctggatgaagacccagtatgtatttcttattatatcacaatatcacaaatccacagtcacrtggtgattgtggtagtgtggggggcctgatggtggggtacacctgcttgaagtcaggctaccatgcccattggggtcctcccccttttttgccctctgat

SEQ ID NO: 41824 - DNA, 201 bp, Homo sapiens
gactcagataggtgtgtattctcaagaagctttcattctaatgacacatactttgtctccagtcagagttatggcaggttttttttttttttttttttttttgactaaattcacccatatttgatggcaagtgtgatcacagcatgtttataaaaatcattcttaattaaggcatttccatcttatcaagccccctattta

SEQ ID NO: 41825 - DNA, 201 bp, Homo sapiens
tttttttttttgaaatggagtcttgccctgtcccccaggctggtgtgcagtggcatgatctcggctcactgcaagctctgcctcctaggctcatgccattstcctccctcagcctcctgagtagctgggactgcaggcgccagccaccacgcccggctaattttttatatttttagtagagacggggtttcaccatgctaa

SEQ ID NO: 41826 - DNA, 201 bp, Homo sapiens
tatggagcctgttaagaccagtgatgctgtggcctgaataacaacaggataggaacattcccttcttctcataaatcttgtaaatttgcattgtttgtgcygaacagggcccgtgtgttctgatagcaaacatggagaggcccaaaaggctgatctgggaccatgtccccattgaacactgctctgtgctgagtctgcaga

SEQ ID NO: 41827 - DNA, 201 bp, Homo sapiens
tcatgcactgtcaagcaccgtaactttagctacattctattgattagaagaatactagtaaagaccatagttaggagaggggaacctggctccaccattgsaagggaggtctatcaaagaacttgtgggcatattctaagaccaccacactctgccactccacacaccctgactctcctaacacctgctcgcttcactggt

SEQ ID NO: 41828 - DNA, 201 bp, Homo sapiens
aaaataatgattataactatgacctccagaagcttttgctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctg

SEQ ID NO: 41829 - DNA, 201 bp, Homo sapiens
taatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacacaggggaggaaaacatccttggcaggttcgcatattgg

SEQ ID NO: 41830 - DNA, 201 bp, Homo sapiens
gttctgtgccaaggattttagaaagtcatgtctcattcagttcccctaacaggtctaggagtcattatcctccccaacctaaggaaactgagacccagagrttcagagtatcccaagatcctacaggaattgcagattgtagccaaaattggaactcctaattccagagctcctccctcctgctagcatttttctttgagt

SEQ ID NO: 41831 - DNA, 201 bp, Homo sapiens
  misc_feature (1)...(201): n = A,T,C or G, or insertion/deletion polymorphism (see Tables 1-2)
atcatcacacctttcccttagcctgtactaggttctgtgccaaggattttagaaagtcatgtctcattcagttcccctaacaggtctaggagtcattatcntccccaacctaaggaaactgagacccagaggttcagagtatcccaagatcctacaggaattgcagattgtagccaaaattggaactcctaattccagagc

SEQ ID NO: 41832 - DNA, 201 bp, Homo sapiens
ttatatataataataatttaatttataactatatcatttattaaggtcctactatataccaaattctattggacacatgtcctaataataaacgtgatatmatctatcattatttacaaaacttcacactctgacctttattaattatgtgtgtgccaattatgtgcagggaactgtattaatcgtagttagcaatatcgt

SEQ ID NO: 41833 - DNA, 201 bp, Homo sapiens
tgggcatttttaaattatcattagtatataattatatataataataatttaatttataactatatcatttattaaggtcctactatataccaaattctatyggacacatgtcctaataataaacgtgatataatctatcattatttacaaaacttcacactctgacctttattaattatgtgtgtgccaattatgtgcagg

SEQ ID NO: 41834 - DNA, 201 bp, Homo sapiens
ggaggagactttgactctagatgacatgatgtaccctgtgttctgcaagctggagaacatcatgtagaatctgaaaattaggagagagaggcaatcagaaraagacagagtggtgttgcagggacctgcagtcagcctagtcccccagtttgcgtttgaatttggtcccagattttttttgtttttgttttttagtagtta

SEQ ID NO: 41835 - DNA, 201 bp, Homo sapiens
gagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtc

SEQ ID NO: 41836 - DNA, 201 bp, Homo sapiens
ggtgccattttcctgactgtagatacttgggtaaggaggagactttgactctagatgacatgatgtaccctgtgttctgcaagctggagaacatcatgtaraatctgaaaattaggagagagaggcaatcagaagaagacagagtggtgttgcagggacctgcagtcagcctagtcccccagtttgcgtttgaatttggtc

SEQ ID NO: 41837 - DNA, 201 bp, Homo sapiens
tctctactaaaaataaaaaaaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaac

SEQ ID NO: 41838 - DNA, 201 bp, Homo sapiens
aaaaaaaatgttttctggtcaagtcacatgcctctgaggtttttttttttctttctttcttttctttttttttctttttcccagactcctcatacccctcytaggagacagtgattccctggcttcaccaggcaggctcttgggggcttcctggtccctgtcactcttaaaatgcagcctgtctttggacatctactccaa

SEQ ID NO: 41839 - DNA, 201 bp, Homo sapiens
tttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggac

SEQ ID NO: 41840 - DNA, 201 bp, Homo sapiens
atttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatgga

SEQ ID NO: 41841 - DNA, 201 bp, Homo sapiens
gcaaggtagaaagacacctgaaggtgaacatctttggcccatgtgaaattttgttacgtgttgttaggtttcatttgtctctcagtcaatcagtcaatcartcagtctctctccttccatccccccttgtcccccttttctcttctctccccttccctgctccctctctttaaggttttctcacagattaagagagtagca

SEQ ID NO: 41842 - DNA, 201 bp, Homo sapiens
atacttttaaaagtatatttatttccagaattcaatttgtaagaggtttgagggaaaaataatactgagttttgagtgtttctgattttaaaaatgtgttsagtagaattaaacgtgttcaccaaaacccattttatccctttaaattattgggcaattaattgtatttacttagcattgaatgcatgattagaaatggaa

SEQ ID NO: 41843 - DNA, 201 bp, Homo sapiens
ctaccccacgtgtccagcagcaaagccacctggcatagtgggctgctcagcgtgcctggttcatactgcgtgtttatagtcccagggtgttttcagagagyaaaagtcctttatgattagcaaattgcaggtcctcccctttctgatatttacagcccttgcaaccgcctgtacaaaaatcgggaaaaggcagaagacggc

SEQ ID NO: 41844 - DNA, 201 bp, Homo sapiens
accattgaggggagcaagatgacatgtgcctaccccacgtgtccagcagcaaagccacctggcatagtgggctgctcagcgtgcctggttcatactgcgtrtttatagtcccagggtgttttcagagagtaaaagtcctttatgattagcaaattgcaggtcctcccctttctgatatttacagcccttgcaaccgcctgt

SEQ ID NO: 41845 - DNA, 201 bp, Homo sapiens
gttcaaaagtatcctctctaggcaaataacgagatttcgccagcaggatctcccgttaaaggcgtgcatgtgtggctttgtagacacgtatgtgtgtgtgmgtgcacacctgcctgcccttgcacagtgggcactgtttccagtgtgcagtgaggccctcccttcgtgtagaacaggacaggacaatgacaaagttattca

SEQ ID NO: 41846 - DNA, 201 bp, Homo sapiens
tcaggctggagtgtagtggcatgatcttagctcactgcatcctctgcctcccaggttcaagcaattctccgtgtctcaatctccctagtagttgagattasaggtgcccaccaccaagctttgctaatttttgtatttttttagtagagacagggtttcgccatgttggccgggctggtcttgaactcctgatctcaggtg

SEQ ID NO: 41847 - DNA, 201 bp, Homo sapiens
catggaacctcagactgggatccttgacttccttatctataaaatatggcttataactcaccctgtattatagatctgctgggaacatgatagaacgtctraacagtgctggcttatagcaagtgttcagagatgtgtttcgttgtttttcttttttctttttttgagatggagtttcactcttgttgcccaggctggagt

SEQ ID NO: 41848 - DNA, 201 bp, Homo sapiens
tggccccatacgtatttgtaaactttcttagaacatcaggatttttatgcacggaccttttatgcatggactgtggtgttttttgatttttggttgcgtgygtgtgtgtgtgtgtgtgtgtgtgacggagtcttgctctgtcactcaggctggagtgtagtggcatgatcttagctcactgcatcctctgcctcccaggtt

SEQ ID NO: 41849 - DNA, 201 bp, Homo sapiens
cgtgatgccagtgtcttcgtaatactatctttctttcccctttagcacccagaacttatgaaatatgactcggtttatcctgaacacatgtctgtgcatcrgggaggatgggagaattaattccagtttctcaattgcaaaagtgaggctggtcatggggcttggaaccacgccacggacgcatgaagcctccccgtttac

SEQ ID NO: 41850 - DNA, 201 bp, Homo sapiens
gcctggccaacatggtaaaaccccacctctactaaaaatacaaaattagtcaggcgtggtagtgtacacccataatcccaggtacacaggaggctgagacwtaagaatcgcttgaacccaggagacgggggttgcagggagctgagatcgtgccactgtactccagcctgggtgacaagagtgaaactccatcttaaaaaa

SEQ ID NO: 41851 - DNA, 201 bp, Homo sapiens
tcatcctgggcaacagagtgagatgctgttttgtttttgtttttttttgtttgtttgtttggttttttttggaaaaagaaagaatcaccataaaaaagatkggtaactcggaaatttcaaatgcttgaatttcttgggttgggaagaatatcccaaaatgtgtttccaactacctcactgattttgacttcacagggagaa

SEQ ID NO: 41852 - DNA, 201 bp, Homo sapiens
ctttcccacctctgccaaggtcaaaaatggaacttgcttcttgttctcgtatcactcagactaagcagttgatgtaacagataacccccaaatttcagtgrtttcacatttaatctgtaaaaaatgaggatttgtttatagccccaaagacagtctagtttggattatttgaggacctagacttcacctgcacagtggttt

SEQ ID NO: 41853 - DNA, 201 bp, Homo sapiens
ttttttttttttgagatagactcttgcctgtcgcccaggctgcagtgcggtggcatgatctcggctcactgcaacttttgcctcctagattcaagcgattstcctgcctcagccttctgagtagctgggattacaggcgcccgccaccacacccagctaatttttgtatttttagtatatacggggtttcaccatgttggc

SEQ ID NO: 41854 - DNA, 201 bp, Homo sapiens
cacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatccc

SEQ ID NO: 41855 - DNA, 201 bp, Homo sapiens
attacattttttgaatatgtttcttctttgcctcttgaggactaaccagccgggtttagattatttcctccccgtgtcgctttcctgcccccacatgttawagatggtgcaagggaaccagagagctttgatccctggtttctctggtcacaaacctgctctcctctccagaactccaggctgcctttctgtgggggctaa

SEQ ID NO: 41856 - DNA, 201 bp, Homo sapiens
ctgcctccatctccctttctctgtaagtggaagtggtattcattgatcacacactacatgccggacaccaagctattacattttttgaatatgtttcttcyttgcctcttgaggactaaccagccgggtttagattatttcctccccgtgtcgctttcctgcccccacatgttaaagatggtgcaagggaaccagagagct

SEQ ID NO: 41857 - DNA, 201 bp, Homo sapiens
tttgaggggtggtatgaggtcacagtcacagccacccctctcaccagctgtgtgacaattctggatttccttagctgtcctctgcctccatctccctttcyctgtaagtggaagtggtattcattgatcacacactacatgccggacaccaagctattacattttttgaatatgtttcttctttgcctcttgaggactaac

SEQ ID NO: 41858 - DNA, 201 bp, Homo sapiens
aactctctcattgccttcagagagttggtgattttggggggggcaccagtgtgagtcctttgatccttgaatgacaatttggatttgtctcaaggtcctgmtaaatgggaactggaggaactggcctactatggtattacaggctagcacatggtttgcattctgagggagctcagaataggcaaggtagaagacataggt

SEQ ID NO: 41859 - DNA, 201 bp, Homo sapiens
ggggccataggctgccaagctgtggtttctaggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggta

SEQ ID NO: 41860 - DNA, 201 bp, Homo sapiens
tatatttcctgtggctgagctgagccgcacttggagatttgatccattttaactctctcattgccttcagagagttggtgattttggggggggcaccagtktgagtcctttgatccttgaatgacaatttggatttgtctcaaggtcctgataaatgggaactggaggaactggcctactatggtattacaggctagcaca

SEQ ID NO: 41861 - DNA, 201 bp, Homo sapiens
gtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccacgttaactagtacattgatgctgttgtgtgc

SEQ ID NO: 41862 - DNA, 201 bp, Homo sapiens
gattttttttttcataaaaccagtctaaaaaagccatgggttattttgtcatggcacgttttgatatgaatatttccacccccattatttgcataacaaaktacagattatccagaacaggtgggctgtacataaacaggctggtgggctggatttgtcctgtggactgtagtttgctgacatccaggctagatccttaat

SEQ ID NO: 41863 - DNA, 201 bp, Homo sapiens
gtgctgggattacaggtgctagccaccacacccggcctcttctcgatagatcttatttggctgacaacgaaagctgttgtgctggtagcatcatccctttscatgcaaaagataaactgaaatctgaagtagccatatccttccggccaggtttttcaagtggttactctgttctgatcattgtcatgacaggaatagtga

SEQ ID NO: 41864 - DNA, 201 bp, Homo sapiens
attcatatatttaggtatagttagaaaaagcaaaatggtaacaatagaatcttgatgggattgatctcctgcagcaaggagcaacagaaaaaaaaaaaaakggaatcaagaacccaggtgctttttataggttaattgtgcagggttatcatgtatctctttaaaatcaccatcttgattctgagctttggttctacacat

SEQ ID NO: 41865 - DNA, 201 bp, Homo sapiens
caaatcagacaccaacataaactgtagagttaacattctttttccaccctcacactttttttagctccgatctgtgttcaatttctgcctgagagagtgawatattcatatatttaggtatagttagaaaaagcaaaatggtaacaatagaatcttgatgggattgatctcctgcagcaaggagcaacagaaaaaaaaaaa

SEQ ID NO: 41866 - DNA, 201 bp, Homo sapiens
tctacctataagtaccttccaactgttccacttttgtaaatttagttcaaataatacatatgctgaaattcctatatcccccccatactccagatcttcaktgtggaatttaaatataattccttattgtaaaaaaaaaaaatttttttttgatcaaggtgattttgataaactaaatgcatctttaattttactcacagc

SEQ ID NO: 41867 - DNA, 201 bp, Homo sapiens
ctgtgtgtcaccttctctctgagctcaccctctctaggaagccttccttgctggaatgcccattccctgatataaggattccacccaccacgccccttgcrgttccttgccggtgtcctgtcctgggcagacataagccctgtgggttccagtttctcattaggaacctggatgatggagcagggatcatgctcattaagt

SEQ ID NO: 41868 - DNA, 201 bp, Homo sapiens
attagcatcaccctgctgtgcctcagtgtttccatctataaactgggtataataatcattcctaccccataggttgctgtgaagattggctcacatcagtmatgtacttggaatggatcctggcataaaaagagcccttggaaaatgatagcgttcatccttggtatgacctccaagttctttgaacctcaaagagccaag

SEQ ID NO: 41869 - DNA, 201 bp, Homo sapiens
ctgagaatctctatttatgtctgaccccaggaaattccctttaagctgcttgtcagaggtgcatgctgagagcatgatgggaagatggagtcttccatccrctggtaaaatctggaatctgctctcatttcattttcactgaactgaaaataaggtaacagaccctcaggtctacctataagtaccttccaactgttccac

SEQ ID NO: 41870 - DNA, 201 bp, Homo sapiens
gatttatgaggcctaactcgcaagcgatgtgtgtctggattaagagaacctgagaatctctatttatgtctgaccccaggaaattccctttaagctgcttrtcagaggtgcatgctgagagcatgatgggaagatggagtcttccatccactggtaaaatctggaatctgctctcatttcattttcactgaactgaaaata

SEQ ID NO: 41871 - DNA, 201 bp, Homo sapiens
gccaccatgcttgggtaatttttgtacttttattagagacagagtttcaccatgttggccaggctggtctcgaactcctgacctgaagtgatccacccacstcagcctcccaaactgctggaatctgagaagttacgtgaaactagcgatgccctgggctaatgaaatcaggctccatggtggggaaggatgttgcggtgg

SEQ ID NO: 41872 - DNA, 201 bp, Homo sapiens
tctttcttttttttttttgaggtggagtcttcctctgtcacccaggctggagtgcagtggtgggatcttggctcactgcaacctctgtctcctggcttcaygccattctcctgcctcagccttccgagtaactaggattacaggcatccgccaccatgcttgggtaatttttgtacttttattagagacagagtttcacca

SEQ ID NO: 41873 - DNA, 201 bp, Homo sapiens
attattcccgctgccattcagttttactctgcacaaaatacagccaacatttttgcatttctttcttccttcctccttttcttctttctttccttccttccttcctttctcccttcatctatctttgttccgcttttgtttgtttttttttagatcgctgcatgctgccgcgttgggttaaccatggtagcattttaccat

SEQ ID NO: 41874 - DNA, 201 bp, Homo sapiens
aattattcccgctgccattcagttttactctgcacaaaatacagccaacatttttgcatttctttcttccttcctccttttcttctttctttccttccttccttcctttctcccttcatctatctttgttccgcttttgtttgtttttttttagatcgctgcatgctgccgcgttgggttaaccatggtagcattttacca

SEQ ID NO: 41875 - DNA, 201 bp, Homo sapiens
ccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtga

SEQ ID NO: 41876 - DNA, 201 bp, Homo sapiens
acaaagcatcagggggccgggagcagtagctcacgcctgtaatgccagcactttgggaggccgaggcgggcggatcacaagatcgggagatcgagaccatyctggctaacatggtgaaatgctgtctctactaaaaatacaaaaagaaattagctgtgcgtggtggcgggcgcctgtagtcccagctactcgggaggctga

SEQ ID NO: 41877 - DNA, 201 bp, Homo sapiens
gaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacg

SEQ ID NO: 41878 - DNA, 201 bp, Homo sapiens
ttttattgcatgctttgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgct

SEQ ID NO: 41879 - DNA, 201 bp, Homo sapiens
tatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactaaaagaaaaaaaa

SEQ ID NO: 41880 - DNA, 201 bp, Homo sapiens
ccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcc

SEQ ID NO: 41881 - DNA, 201 bp, Homo sapiens
gccacaggactatagcctgggcagttttgagtgctgcctctaccatgtaactagcttgccagtcaagtcattaactattcggggccttagtttcgtctttyctgaattggagccagtatacgtaattccaaaggttgcttttaagcgtaagtgagaatattggcagaaattcgttagcactgagagagggaatgtaaagtg

SEQ ID NO: 41882 - DNA, 201 bp, Homo sapiens
ttatgtaagacagaaggtattgtgcagtagccttgaagtcaggtgaccctttgggggtgtgtgtgtgtttgcttctttatattagcttttttttcattttragacagggtgttgctcttcctcagttgcccaggctggagatcagtggggtgattacagctcactgcagccacaacctcccaggttcaagagatcctccca

SEQ ID NO: 41883 - DNA, 201 bp, Homo sapiens
gtgaaaatgctggggatctgcgaaacattaaagttaatggccagaataaggctgccaagctcggtggaattgtacttaactggcatatcattctggttaaytgaactttccattaactcacagatctatcttttcatgcccccttctaaccccctactcaccacccacccagttcctcctagtgggcagtttgctgctgct

SEQ ID NO: 41884 - DNA, 201 bp, Homo sapiens
gcagtgaactaagatgccacaggactatagcctgggcagttttgagtgctgcctctaccatgtaactagcttgccagtcaagtcattaactattcggggcmttagtttcgtcttttctgaattggagccagtatacgtaattccaaaggttgcttttaagcgtaagtgagaatattggcagaaattcgttagcactgagag

SEQ ID NO: 41885 - DNA, 201 bp, Homo sapiens
gtcagaatgttatcctgctcagatggttgcatgggacagtgtccagaggaaggcctctgattccttccccagcattaggcaatattcaagtcttcagttcyatgtgtaggggagaagactttccttctgctccctaatgacagtggtacccacacccgtattccaccataaaatcttttttattcagtattaggaaaaaag

SEQ ID NO: 41886 - DNA, 201 bp, Homo sapiens
ttgtaaaccaaggtgaggacttaagattttattctagctgcagtgaggaaccagtgagtggttttaagccagagagagattgataagacatggaatgatayggtgtgatatatgaaatgacatgtttgaaatgatagatgacgtgattgtgatataatatcatgcggctgaggacaacactataactgctcggtagagaat

SEQ ID NO: 41887 - DNA, 201 bp, Homo sapiens
agtgcaagtttgttgtgaagaacacgtgccttggaattaacacctatggaagggaagaaaacgaagatggagtgggcagagggagaagctgactgagatgsagtccagcaagggtctcagtcaaccttatgaagctaaaagggcccatcagagctaatccctattgggctaatgtggccaggcttttataaacctgccttg

SEQ ID NO: 41888 - DNA, 201 bp, Homo sapiens
agagaaaaagacacagatgaggctattgggattaagggaaaatcaagtaaatcgagaggtaaagcactgtgcagaaatattggccagaagctatgaacagwtgccacagctgggctgaagagttacctgtgagccttccaggggtgtaagccaagagaaagacagttcaccaaatctatcgattaatagaaatcatccagc

SEQ ID NO: 41889 - DNA, 201 bp, Homo sapiens
tttcctctcccccttacaagggacatttatgctttctccctctacaaaacctgcatgcaaattatctgatggaattgacccatagtgggtgttctccactrgttcaacacacctgaattccggattcaagatgcaatcaccactactgttgttgtgtaagtattgctagagatggctgcagaatacctgggaaagctagct

SEQ ID NO: 41890 - DNA, 201 bp, Homo sapiens
acttaaaagtgtggaagcagagtgtcccaggcggaggaaacggtaaatgagacctctggtagtaagaagcagtgtagcatgtttgagacactgaagtccartggaacttgggcggaataaatgaagggaagattcaaggtgaaggctgagaggtgtgcatgggtctgatcacacagagccttgtaaaccaaggtgaggact

SEQ ID NO: 41891 - DNA, 201 bp, Homo sapiens
agttacctcccaccgagtccctcccatgatacgtggggatgatgggagatacaattcaagatgagattttggtggggacacagacacaccatatcatgtcytggcagccatctatattcaagacactattctaggtatgacataaaggatggcaaaaagtcagttacttaaaagtgtggaagcagagtgtcccaggcggag

SEQ ID NO: 41892 - DNA, 201 bp, Homo sapiens
tcaaccgcaacacaaatcttatatcattagatttcagtgatattgaatgtgggagatggaaccattttagtgcatttgatatgatgtgatgtggctttctscaagcctgagagtgcctgaaacccagagaggtcgtacgttgaccatgccacggggcccttcctggtaaatctaagcagaaatacaccatgcatgagacag

SEQ ID NO: 41893 - DNA, 201 bp, Homo sapiens
gttacagtgcttaggaagtgttagatgtactgtcatttcttcaacatatatgtcctatattagtctattctcacactgctagtgaagacatacctgagatkgggtaatttgtaaaagaaagaagtttaacggactcatagttgcacatggctggggaggccacacgatcatggcggaaggcaaaggaggagcaaaggggcg

SEQ ID NO: 41894 - DNA, 201 bp, Homo sapiens
ctgatgtactcttgctggcggtccatctgagagttcacataagtgtgagtgactattttttgacaacactacctttgggagaagatggtttcaaagaactwactgtatcaaatggaaagacaatgtgttttcccaacatgggagtatgtttctaagttgggatcagttcacgattcagagaaatgctctgccttcttgtct

SEQ ID NO: 41895 - DNA, 201 bp, Homo sapiens
aagcccacattttaaagggaatttggtatttttaacaaagcatcagggggccgggagcagtagctcacgcctgtaatgccagcactttgggaggccgaggygggcggatcacaagatcgggagatcgagaccattctggctaacatggtgaaatgctgtctctactaaaaatacaaaaagaaattagctgtgcgtggtggc

SEQ ID NO: 41896 - DNA, 201 bp, Homo sapiens
gtacattacagggacagtggttgggtctggagatgtcacccttagctgtttttcacaatgagaggttgttttatcataaataaatcaataaatggcagatkatacaccggagttactgagaaatataaaaaaaaaaaaagcccacattttaaagggaatttggtatttttaacaaagcatcagggggccgggagcagtagc

SEQ ID NO: 41897 - DNA, 201 bp, Homo sapiens
caaacatgtaataccaccctggtcttcaagtccactctcaaaaaaaaaaaaaaatttggcctttggcctcgtgaccaccaaatctgatttccatccaagargcaacattgtttgtgcttagaaggaattcctggctgggcatgatggttcacgcctgtaatcccagcgctttgggaggccgaggcaggcggatcacctaag

SEQ ID NO: 41898 - DNA, 201 bp, Homo sapiens
ataattaaccctctggggagactaatattagtttattagagacaatttctagttctgtttatttttaacactaaacgatttgttcagattggggaaaaaawttttttttttttttttggttgtggtggcgttggcttttacttggggttgacctttccttatcaaggacatacaaggtgaatagctgggtgataatatatg

SEQ ID NO: 41899 - DNA, 201 bp, Homo sapiens
tcccaattagtttcttcatgccataaggacaaaatccacatctcatactttttcaggatctgctctcacttccccaaacatgtaataccaccctggtcttmaagtccactctcaaaaaaaaaaaaaaatttggcctttggcctcgtgaccaccaaatctgatttccatccaagaggcaacattgtttgtgcttagaaggaa

SEQ ID NO: 41900 - DNA, 201 bp, Homo sapiens
gacagagtgagactttgtctcaaaaataaaatataaaataaaataaaaaggaagaaatagccagtagtgctttcttgtagacagagaagctggtgaaatgrtgtaaccaggctgggcatggtagctcacgcctgtaattcccagtactttgtgaggctgaggtgggcagatcccatgaggtcaggagtttgagaccagcct

SEQ ID NO: 41901 - DNA, 201 bp, Homo sapiens
atttatttattttcaagacatggtggcatgcaactgcagtgtcagctactccggaggccgaggcaggagagtcacttaagactgggagctcgaggcggcastgagcagtgatgactccactatactccagcctgggtgacagagtgagactttgtctcaaaaataaaatataaaataaaataaaaaggaagaaatagccag

SEQ ID NO: 41902 - DNA, 201 bp, Homo sapiens
tgtgctctcttaagccagtcggacctggttgttgtacactactgggtgtgtttaattgacttccagttttgttttgttttgttttgttttgttttgttttsaaacagtctcactctgtcgcccaggctggagtgtagtggtgtgatctctgctcactgcagcctctgcctcctgggtttaaggaattctctgccttagcct

SEQ ID NO: 41903 - DNA, 201 bp, Homo sapiens
cagcaaggtctttatgacctgtatcttgtgctgacctcctatgttatcctgtaacttagaatgcctgacctcgtgggaatgcagcccagtaggtctcaatsttattttacccagcccctattcaaaatggagtcactctggtttgaatgcttctgacaaacctctgagactaaggacaagatggagtctgttaggttagtt

SEQ ID NO: 41904 - DNA, 201 bp, Homo sapiens
tatatatatatatatatatataaaataatgcagaagttttatatatatataaagttttatatttatatctataaagttatatatatatatatatatatatwtatttattttcaagacatggtggcatgcaactgcagtgtcagctactccggaggccgaggcaggagagtcacttaagactgggagctcgaggcggcagtg

SEQ ID NO: 41905 - DNA, 201 bp, Homo sapiens
tctaaatccctgccagcatctgttagtgtttgaaggattaatgtgctaccctgtgtatgtctgcacttccagggaacagtgtagcatctgattacagatcktgggagagcaggagggaacaaggtgttttctgtgctttttcctacatgcagtcgttttggcctttttctgatttttcttgtctttatcccattctgtcta

SEQ ID NO: 41906 - DNA, 201 bp, Homo sapiens
atatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagt

SEQ ID NO: 41907 - DNA, 201 bp, Homo sapiens
tatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcag

SEQ ID NO: 41908 - DNA, 201 bp, Homo sapiens
aggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtg

SEQ ID NO: 41909 - DNA, 201 bp, Homo sapiens
gggtattggggatgagtctttgtgtggtggcaaacgggccctgtcttcgcttggcttcctcctaaaattcccaggacctcttcgggtcccagccctttctsttcccctgagattgcgcctcctcaccctctgtcttggatggaaagagttccaaggcagtccagtcaccccagtgaaaagttttctgatgaggtcaagcct

SEQ ID NO: 41910 - DNA, 201 bp, Homo sapiens
cagtgcaggacagtgtgtcattgcaggagaagacagaacccggccagatcctcccgctgccggcaagcggagtcagttactgggaagccataataattctktcttctagagaattttggcaaaaatgtgcctccatcttacatcaacaatttttcatctttctggaatttttatttccccttcccctcttgttccttttta

SEQ ID NO: 41911 - DNA, 201 bp, Homo sapiens
gcattacctggggctccctctggaaagaaaatggtggagaggttactggcctgatgacccagggacccaggcagtccttacagggacccagaatttcacawgcaaatgtgacctccaattaaagctggacttgattaaccccatttcccctcaaaagatgatacttgtaatgccgttccgatgaggccgtctcactccgta

SEQ ID NO: 41912 - DNA, 201 bp, Homo sapiens
agatatataatgatgcctatctgattctgtggtggtctggctttgatgtatgtatatgtgggcaggaatgtgtgtgcgtgtgtgtgtgcatgtgtgagctyctgtgtgtgtgttcatcacgtatccattgtgtctccaaggtcttatcaacagcaacaaaaggcctcctttgagatcaatcacattcattcgatgtttgtt

SEQ ID NO: 41913 - DNA, 201 bp, Homo sapiens
tgacactgcatttggggggaaggtaagggaactggggaaaagaaggcaaaatgatgacttaaagagactgatgaacccaaagctctcttgtgaagcccctkctagaataagtccgtctcacgttacagtgcttaggaagtgttagatgtactgtcatttcttcaacatatatgtcctatattagtctattctcacactgct

SEQ ID NO: 41914 - DNA, 201 bp, Homo sapiens
ctaatttctggggacacatattttgtcctggttagagagatatataatgatgcctatctgattctgtggtggtctggctttgatgtatgtatatgtgggcrggaatgtgtgtgcgtgtgtgtgtgcatgtgtgagctcctgtgtgtgtgttcatcacgtatccattgtgtctccaaggtcttatcaacagcaacaaaaggc

SEQ ID NO: 41915 - DNA, 201 bp, Homo sapiens
tggctctgtctccaattggctacgagggcttgtgtgtactctagttctctttccgtgacactgcatttggggggaaggtaagggaactggggaaaagaagrcaaaatgatgacttaaagagactgatgaacccaaagctctcttgtgaagccccttctagaataagtccgtctcacgttacagtgcttaggaagtgttaga

SEQ ID NO: 41916 - DNA, 201 bp, Homo sapiens
ctttccatctccctgatcagaaccattctgcgttcttagattcaacaaaatgtaatactccaccttgccagtatctagcgtgttttcagaaattgtgaacrgggtggaggtggagtactaactgcaatcagatgttttatttgtttatttatttttccttcttgcgttgctcttaagcccccactcttgggcaaggctctg

SEQ ID NO: 41917 - DNA, 201 bp, Homo sapiens
acatatgaatgaggggtagagggacacaaacattcagtccctaacacttggtcaagttacttaagcttggtaagcctctctcttcttactgagtcatgagsataataagatatacctgttagggttcttttgaggaataaatggaatttttaaagaattgtgccagacatgtaataattacttgataaactatagctatta

SEQ ID NO: 41918 - DNA, 201 bp, Homo sapiens
gctttgtttattttagccggtgcctttgtagagggaaaacagcttagcaagcatttagtaggtagatccaaagtccccaggagctgttgggaagtccatasgtgctgtttccattgctttttcattccttcatatattaatcaaggagtcagtcaatcaattaaacggatactattagcacctactgtgtgccgggcactg

SEQ ID NO: 41919 - DNA, 201 bp, Homo sapiens
ttttgtgacattcttagttgtgatctaccttatgttgtatacacatggtcactcacatacataggtatattattctgcaattgctgagtaattgatgatcsttcattctctctgtgattcataggctctctgggttggataaatcacttcggggaattatatctactagtatatttatgtcactagaattcctttgagaag

SEQ ID NO: 41920 - DNA, 201 bp, Homo sapiens
agcttacattttgtcatgagtaaaactgaaacagtaattcccatgtgctgagtttgctgtgaggattaaagacaaggactgttctaagcccggcatataaygggagcccattataagtgaactgaggtgttattttaatatataccttttaaagtttgagtgttaggcatgctgttgagtgaaagaagacagactgttacc

SEQ ID NO: 41921 - DNA, 201 bp, Homo sapiens
ctttggtaattcagtatccgaaaaacaatcagtgttttgtgacattcttagttgtgatctaccttatgttgtatacacatggtcactcacatacataggtrtattattctgcaattgctgagtaattgatgatccttcattctctctgtgattcataggctctctgggttggataaatcacttcggggaattatatctact

SEQ ID NO: 41922 - DNA, 201 bp, Homo sapiens
taagcagtcccatcacgaacaaattgccaaatgcaaggcctgagcaaaagacacagaaaggatttctttatcgtaagcacacttctctacattacctttayaatccaacaactctgctattagtaaattatagaaacaacttttgtaacactatcttgtttgcagagtatatgaaaaatttgaagttaaaattcagctcca

SEQ ID NO: 41923 - DNA, 201 bp, Homo sapiens
gtcggggagaaaaggacaaagtttttctcccgcaactgggccaccaaaccagcagagcctccagccagggtggtctcgaggaggcccattaccggctggastgacagagtgtgtcaagcctgcagctcgtcccgtgtctaatggaacagaaacaagcaccctgctgcccttgttttccagtggctcaccggggctctgcga

SEQ ID NO: 41924 - DNA, 201 bp, Homo sapiens
catgcatatacgtgggtgtacacacacaggtacacacaaatatatatgtgcctttggacaaaaaaaaatccccaggacagtctcatttggcttttaaaatrctgcagttgaataggaccgtagaggtggcctaaggcagccttccattcagggcacgcagatttggttcctcagctcccttcttctctatttctgagtcac

SEQ ID NO: 41925 - DNA, 201 bp, Homo sapiens
gctttgggagttcttgttaaccctgacaattcttgtcaaatatcttactcctgggctgtgctggggatggcagcagagtggggtggttggatgggaaggcrggaaagagctagcttggagatgatacgcttttccatccttgaataacttgggaaaaagtcaggagtgtggaatgaagaattggaatataaaggctgaggg

SEQ ID NO: 41926 - DNA, 201 bp, Homo sapiens
acataactcaaagtgcttgctttgggagttcttgttaaccctgacaattcttgtcaaatatcttactcctgggctgtgctggggatggcagcagagtgggktggttggatgggaaggcgggaaagagctagcttggagatgatacgcttttccatccttgaataacttgggaaaaagtcaggagtgtggaatgaagaattg

SEQ ID NO: 41927 - DNA, 201 bp, Homo sapiens
tcagcaatactctccagcagcaaaacccaatccgctcatattcttgcatttgctgcagcaaaacctgacctctctttgtgttacctgagtcttgacgaagwagactgaggaaaggcccccccccccccccaccaaattgtcccgttgtctcttggctggtcttgccagctggcacacagcttcctctgaccaccctgctag

SEQ ID NO: 41928 - DNA, 201 bp, Homo sapiens
tggaccctctgatgttgacaacatgatgtcaaagatggtgtttgctgttgtttcaaatgtcttatttcaaattcccaattagtttcttcatgccataaggrcaaaatccacatctcatactttttcaggatctgctctcacttccccaaacatgtaataccaccctggtcttcaagtccactctcaaaaaaaaaaaaaaat

SEQ ID NO: 41929 - DNA, 201 bp, Homo sapiens
tttatcccttctgttgatgcaattaaagctaatggatctcatatatatatatatatatatatatatatatatatatatatatatatatatatatttatatwaatatattttatatttaaaaatatttatattttatatatttttatatatttatgcaagtatatatctaaatatataaaatatatataaatatatacatat

SEQ ID NO: 41930 - DNA, 201 bp, Homo sapiens
cagccatgatgagcaatactctttttttgtttatttttgttgttactgctgtaagccactttcttctccctctccgttaaaatgcaacttaattggtaaartttagttgactagagatttcatttatttatttatttatttatttatttatttatttgtttgtttgtttgtttgagatgagtcttgctcttttgcccaagc

SEQ ID NO: 41931 - DNA, 201 bp, Homo sapiens
gaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggt

SEQ ID NO: 41932 - DNA, 201 bp, Homo sapiens
gggcaaggagctcatctttcacggtcatagacctcagttgcaacatctggaaaaagagctggttgggcatgccgggcaggcttttgtgacaatgtaagagsaagtgaagattgcatctcagtatgagacaccgtaagagcttgataaatggtggaccctctgatgttgacaacatgatgtcaaagatggtgtttgctgttg

SEQ ID NO: 41933 - DNA, 201 bp, Homo sapiens
ttttacctctgcaagcctcagttttctcatctgtaaagtagggataacattagcttcagccctcacaggcttagagtgaagtttaaataagaaaaggtatstaggctgggcgtggcggctcacgcctgtaatcccagcactgagggaggctgaggctggtggatagcttgagcccaggagttcgagaccagcctgagcagc

SEQ ID NO: 41934 - DNA, 201 bp, Homo sapiens
ggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatgg

SEQ ID NO: 41935 - DNA, 201 bp, Homo sapiens
cctgacaatgttagtgaagttgcttgcttgaaatttaccaggccaggcttatggctgtaatcccagaaactcaagaagctgaggcaggagaatccctatgrtctcttgagtccaggagtttgagaccagcctgggcaagatagcaaaatactatctctacaaaaaaatgaaaaaaaaaaaaaaaaaaaagcctgtcatagt

SEQ ID NO: 41936 - DNA, 201 bp, Homo sapiens
aaaatatttgtatctccccacaataaaagtctgtaccaattaagcagctactacccattcctcttccctaccattctaccttctgtctcagtaggtttgcytatttgggatattttatttaagtgggatcatacaatagcatcatgtgttcaaggttgacccacattgtggcatgtatcagtacttcattcccttttatca

SEQ ID NO: 41937 - DNA, 201 bp, Homo sapiens
tgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacat

SEQ ID NO: 41938 - DNA, 201 bp, Homo sapiens
gtggattacagaattgtgctgggtcctatggagtgtcagaaatagtgaagcttctggagcttcactgtccaatatggtagccacgtgtgactattaaaatrtaaattaattaaaattaaaagttcaattgctctgaaatagcagccacatttcaaatcttcagtagccagatgtggttattggctaccatattgggtagca

SEQ ID NO: 41939 - DNA, 201 bp, Homo sapiens
ttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctctctgggttcact

SEQ ID NO: 41940 - DNA, 201 bp, Homo sapiens
cttcttctaccttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctct

SEQ ID NO: 41941 - DNA, 201 bp, Homo sapiens
acttcttctaccttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctc

SEQ ID NO: 41942 - DNA, 201 bp, Homo sapiens
gaggagagtcaaatgggagtttctaccgatgctcttgaaaggatcttgttactcagatgtctctaagacaatgatcagtacccatctctcagagcctgtgyagccgtccatgcttgaggcatgagatgctgaagataaaggtccccagtggtccaggtttttccttctcagcttggaaagcagcaggaaaactgcactgca

SEQ ID NO: 41943 - DNA, 201 bp, Homo sapiens
cacacttcttctaccttgattcccagccttcttttcttttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtg

SEQ ID NO: 41944 - DNA, 201 bp, Homo sapiens
tcttgagcagccatgcctgcttccgaggtggtgctgcatgctattcaggaggacagaccatggatgggaatcctgagccacaactccttagcctcatgacrttgggcagatgactgagcttgtctgagttacaataaataaaaataccatgctgaatgatggcctagcatgacattgggaagtacagactttgcaggcagg

SEQ ID NO: 41945 - DNA, 201 bp, Homo sapiens
gaagctgaggcaggagaatcacttgaactcagaaggccaaggttgtagtaagctgagattgcaccactgcactgcagccttggcaacagagcgagactccmtctcaaatcaatcaaccagtcaatgtgtgcccccttttcctccaactcccaccccaaatccttgctgaatcatacctatccttcacctttataagcatct

SEQ ID NO: 41946 - DNA, 201 bp, Homo sapiens
tctgttggctgcataaatgtcttcttttgagaagtgtctgatcatatccttcgcccacttgggtggatgaagctggaaaccatcattctcagcaaactgtygcaaggacaaaaaaccaaacaccgcatgttctcactcataggtgggaattgaacaatgagaacagttggacacaggaaggggaacatcacacaccggggc

SEQ ID NO: 41947 - DNA, 201 bp, Homo sapiens
ctgagtttcttgtggaagtgggcttgtgttttgcttttgtagactgacactgagaatagcatccaaacatctttttcccaccaaggcatcaaactccatcrttaggaattccttcatagaatcaaagaatcagaaagagctgaaacatagaccacggacactcaaattgtttatcctgaaatgaatgggaaaacctaagct

SEQ ID NO: 41948 - DNA, 201 bp, Homo sapiens
atgagtactcactctacttttttagtttatatttttattttagttcatttcatttaagacagcgtctgttacccaggctggagtgcagtgacatgatctcrgctcactgcaacctacaccttctgggttcaagtgattctgatgtctcagcctccccagtagctgggattacaggcatgtgccaccacaccggctaatttt

SEQ ID NO: 41949 - DNA, 201 bp, Homo sapiens
taaagacagtgcctccttccaggacaacggtttggcagatttgcttgataaaggttggggtttgtaagcttggggctcctcagccatgactgaaacgtacyatgagcacggcatctaccgggctgttccacatcctccctgtgggactaggggccagggcaatgggaatcagtgcagaaataaagctcatgctgtttgctc

SEQ ID NO: 41950 - DNA, 201 bp, Homo sapiens
atccactggggttcggaatacaactgccctgcctcttgagcagccatgcctgcttccgaggtggtgctgcatgctattcaggaggacagaccatggatggraatcctgagccacaactccttagcctcatgacgttgggcagatgactgagcttgtctgagttacaataaataaaaataccatgctgaatgatggcctagc

SEQ ID NO: 41951 - DNA, 201 bp, Homo sapiens
ggcctcttgttcttcttcagctgttcctcagacatgccaggtgtgttcctgtctcagacgctttgcctttgctgctccttctgcctggagtattcttccaygtagcaccatgagctgttcttctccaaaaggctttgctcaactgacactttctcagtgaagctgtttctcaccactcactataaaatggcagcctgcctc

SEQ ID NO: 41952 - DNA, 201 bp, Homo sapiens
tcactgtcttttgcattatgtcatgggtggaaacatgcaccttccctgaccttttggcttggaacatggaagttcattgactttgttgcctagcagggcckggagctgggtttcttgcctgatcaatgtatatcattttgccaagagacagagtctgtgctggagagattgattccctggttatttatcttcctctgccca

SEQ ID NO: 41953 - DNA, 201 bp, Homo sapiens
gattgcagcaggttagagcacagcatgaagagctgacaatattgaccgactggccctctcagacaaagtttgccaacacccaggtgagcagatacacttatctgtgagcagacgtgattcaggggagattgttgtccctcctttcctaagaaaatgtggaaagatgagaatgttgccaccagtgctgatatggagcgtttt

SEQ ID NO: 41954 - DNA, 201 bp, Homo sapiens
tctggcagagaaacaatattgtgaatggaaatgggaggaacttgggtcctgaaaattacaccataccccagagcctggggtggattatttcaggacctttyttccttccttccttccttccttccttccttccttccttccttccttccttccttcctttctctctttctttttttattttttttttcagacagggtctcc

SEQ ID NO: 41955 - DNA, 201 bp, Homo sapiens
ggaagtggaggttgcagtgagccgagatcttgccattgttctccagcctgggcgacaagagtgaaactccatctcaaaaaaaaaaaaaaaaaaaaaaaaawttatgtcatttcgttgtcacagcgtcagcagaataaatcttagatcaagatgggattactgcgccactcccttcttcccagtctgtggtttagcacggga

SEQ ID NO: 41956 - DNA, 201 bp, Homo sapiens
aacggttatcagtttttgattctacacatacttcaaatactattaatgcaaaatccttctttagaaatgttacctaattccaatgtttcactttattcagygaagacattcctttgattattctggttaggtgttatgatgccaatttgcccacacattttttcttaggcgcctatgcttgcagtagacagagagttgagg

SEQ ID NO: 41957 - DNA, 201 bp, Homo sapiens
tgtggcacatacccctgtacatgtttgccaagactgctatatggtagagcttggaattcttaggagctttatcaggtaattgcaagtcccccacctccaasaaagcactctctaggtcaagaatcagcaaatgttttctatagaggcccgtaaaattaatattttatactttgtgggtcatatagtctctgtttcaattac

SEQ ID NO: 41958 - DNA, 201 bp, Homo sapiens
gcgatctcagctgactgcaacctccgcctcccgggttcaagtgattctcctgcctcagcctcccaagtagttgggattacaggcacatgccaccactcccrgctactttttgtatttttagtaaagatggggtttcaccacttttggccaggctggtgttgaacccccgacctcaggtgatctgccctcctcggcctccca

SEQ ID NO: 41959 - DNA, 201 bp, Homo sapiens
atggctgtatgacagattctagccatcaagtaaaatcagaaaccaacagcacgtttccttgaataccttttgctttctataaaatggtgtggcattgctgstattttcactcttccttcctaccctggatgctgatttgatgcttccagccttagcggttttcttgcttctaggactgaacagggaagagggaaaagtcaa

SEQ ID NO: 41960 - DNA, 201 bp, Homo sapiens
aagttagtttcttcccagagagaaagaccggtggctgtagtctgtgccccactcccagcctgtcctttctcagccgtggcttgtgtgcatccctggggccrgcatgttgctgcgagccccaatcgatcagtggagaaacgagctctggtgggcagtcaggcaaagcagatacacgtgcttcttttcagctttgttggaagg

SEQ ID NO: 41961 - DNA, 201 bp, Homo sapiens
cacaccactgcagtcaagcctgggtgacagggcaagaccctatatcaaaaaaaaaaaaaaaaaaaaaaatatatatatatatatatatatatatatatatrtatatgtatatgtatatataaatttaaggaagcatagaattgaagaggctattccaaggtcacatgacttttaagtggcagaaacaggggaattctgtct

SEQ ID NO: 41962 - DNA, 201 bp, Homo sapiens
acgccaccacacctggctaatttttgtatttttagtagagatgggggtttcaccatgtgggccaggctggtcttgaactcctgacctcaggtgattgaccyacctcggcctcccaaagtgctgggattacagtcatgagtcaccatgcccgaccagcaagaccccactgctattgtccagtgtggtaggtacctttgccta

SEQ ID NO: 41963 - DNA, 201 bp, Homo sapiens
ttcactgagggactaagagaaatagaaacagaggggattggccacacctgaagtcattctgtgttcaaatcttggctctaccacctatgatctgggagctsttagaggagttaatcgatgtagttaagactcaatttcttagtatatacaataggtgtaatagtaaaaattagatgactttgatgtgtgtaggtaagcggc

SEQ ID NO: 41964 - DNA, 201 bp, Homo sapiens
atgtatgtatgcatgtatgtatgtatgtttgagacagaatcttgctctgtcgcccaggctggagtgcaatggcaccatcttgacttactgaaacctcctcstcctggattcaagccattctcctgcctcagcctcccaagtagctgggattacaggcacgccaccacacctggctaatttttgtatttttagtagagatgg

SEQ ID NO: 41965 - DNA, 201 bp, Homo sapiens
tggagtgggatacagcaacaatctatattctgatttcagcaacactgtgcagtgtaattccatattatattacaccacatcttctgtgggtctttctttgrgggaagctaacattttaaaaggtttccctttgtaacctgtaaccccctctaccccaaaagtatattcaagagcgaaacttttggtatgacgatgtcttac

SEQ ID NO: 41966 - DNA, 201 bp, Homo sapiens
tgacagtccacttcattaagtggaggacagtgttttgattgctatttaatctgtttttccttctgtctgttcttggctatatggaattcactttgcctctsttcccgactcttcatatcccttatctcaaggtgagtatcgtcagaatcccggtacatttcaccagccaccttttatagaagcttagaaagatggaggcaa

SEQ ID NO: 41967 - DNA, 201 bp, Homo sapiens
cctacgttactgcacctgtttgagcctcagttttcctgtctgcaaaggagggatgatggtacttacctcaaagaattgtagttggatcaaatgagttggartgggatacagcaacaatctatattctgatttcagcaacactgtgcagtgtaattccatattatattacaccacatcttctgtgggtctttctttggggga

SEQ ID NO: 41968 - DNA, 201 bp, Homo sapiens
gggagtgctagggtaagtggaaaaagcacatgacttggaataaagacttagtacacatcccatgtctgatttatactaactagttcatggacctagcctasgttactgcacctgtttgagcctcagttttcctgtctgcaaaggagggatgatggtacttacctcaaagaattgtagttggatcaaatgagttggagtggg

SEQ ID NO: 41969 - DNA, 201 bp, Homo sapiens
caacggcaaaaaagagaattgcacagaggaacaccacctatcagagttcacactgagtttgcagattcatccttttgcttccagccatcccatggaatgcygttcttggaagggtcatctcatggtccattgtcggccctcttagaagagatttcaggccttcccttgtagcttgatagttacagggagtgctagggtaag

SEQ ID NO: 41970 - DNA, 201 bp, Homo sapiens
tttagtaaaacgcagtatcttcttccccagctgaaatagcgaaagggtctcttcaggctcctgggataaaaaccaggatccttcatgtgtctgagcaggcytcccaccatttgactgctgctcctttgtccagacacatttaacaccatctccctgcaccccttcactgggctccgaagctgcgttcacacggcacgtcat

SEQ ID NO: 41971 - DNA, 201 bp, Homo sapiens
ttgcctgtcatctgttgtttttctaatcttctagtaaacatttggaaagtgaaggtttaggcatgtatgtttctcttatgtaggaaggggaaataaggccwtgagattgcatgagttttctttccaagtttgtgcagatctgcacaatgattgaaatatttgcaacctgtagagcagcagggtatttatttggcagcaaac

SEQ ID NO: 41972 - DNA, 201 bp, Homo sapiens
cactgtttccagccacgggctatccagggaattggggacagtctgtaatgtatcttgagctaggaccatatccaaattactggcctttccagtttttcttwaaatagtagggtcagtaggtgaccacactcagaagccaagcctgcagcatcagggctgaggagcaaactctttctttggtctgaagcttcaaatatgaac

SEQ ID NO: 41973 - DNA, 201 bp, Homo sapiens
taataataataataataataataataataataataataaagaaagcgagagaggaggtagggaatgaatgccgaaagtggttccttgggtctgatgcccaygcttaaccgattcccagccaaacatttcacagttgtcttacgcacaggcgtaagatatgcatctatcttggtgtgcacctgagaagtagttatgtctaag

SEQ ID NO: 41974 - DNA, 201 bp, Homo sapiens
aatcttggggatggggggttccactggtatattttctttactgtttaagaaagctcaaaattctctctgctcttttccaagccaccaatcaaaactgacaytttctaagtgtcctcattgccctctgggaatgttcatggcctctgggagtccaagaactacctttacactggatcttcactgcttttactattgtgtggc

SEQ ID NO: 41975 - DNA, 201 bp, Homo sapiens
tccctttggaagcagggataagaagagggaaggtctcccagatgtaaatttctcataaatatttgagctccatttcagtaattctttcattctctgatctsttgcctaatcttctatttagcaagtactttccatgaaatagaaggctttaattgatagaattactaatttgaatagcttagcacagctcagcttgtaaaa

SEQ ID NO: 41976 - DNA, 201 bp, Homo sapiens
ggaagaacatacttcatacaaagctatgaagcatattggaagattttaggtgccctgtcttcctggatataaaatgactccaaactcagtgatactgatcrccctggcttcttttccacctttctcacttcattgtctttttgtgtgtttctgacatctgttgacaaatgggcaatcttggggatggggggttccactggt

SEQ ID NO: 41977 - DNA, 201 bp, Homo sapiens
cacggcacgtcattggcagctcatctcagaaggttccagctttgcctggcaaattctcctccttcctttagatcccatctctggtagacagagtaatgagycccgaagatgtccaggccctactcctaattccatggaacctataaatatgggaggttacatggcagatggggaattaaggttgcagatggagttaaggtt

SEQ ID NO: 41978 - DNA, 201 bp, Homo sapiens
aggacccttgccattaggaccaaacctcttccagctttctcagcagccacatgtcaccccctcttccaccctttgccctgccaccctccatcccctgataycctcctgccttttagttgccggtgcttggaaacctttgcaaagtctttttatggagatgccatgtcctttcaatggtgcgtttagccagcgccccgctct

SEQ ID NO: 41979 - DNA, 201 bp, Homo sapiens
gagatttactgaactcagtcgtttcacctggctggggaggcctcaaaattatggcagaaggcaaaggaggagcaaaggcacatcttacatggcagcagacmagaaagcgtgtgcaggggaactgccctttataaaatcaccagatctcatgagatttattcactatcaagggaacagcacaggcagatcccatggctttga

SEQ ID NO: 41980 - DNA, 201 bp, Homo sapiens
ttagatcccatctctggtagacagagtaatgagccccgaagatgtccaggccctactcctaattccatggaacctataaatatgggaggttacatggcagwtggggaattaaggttgcagatggagttaaggttgctattcactcatcttcagattgaaagatcatcctggattatctgggtaggcccagtcgaatcagag

SEQ ID NO: 41981 - DNA, 201 bp, Homo sapiens
gaccctcaataaggagaatcagagaaagaagaaataaaacatattactccattcccatacttctgtgaagaaatacccgagactgggtaatttataaagaraaagagatttactgaactcagtcgtttcacctggctggggaggcctcaaaattatggcagaaggcaaaggaggagcaaaggcacatcttacatggcagca

SEQ ID NO: 41982 - DNA, 201 bp, Homo sapiens
atactctatttcagttgagtttttagtttgctctgttacgtgaggacacatcacttgcacctcagtgtgagtttgaaagtgttttctctggagaataattytgaagaaataggccctccagatatcagtagtgacaggggtatcagtaatgttgattactaagttcttgccacaggtagaagccatgctactgcacaagtt

SEQ ID NO: 41983 - DNA, 201 bp, Homo sapiens
agccactgtacctggactccactatgccttcccctccccttccctcccttccccaccctaaagagtctcgctcttttccccaggctggagtgcagtggcastatctgggctcactgcaacctgtgcctcccggattcaagagattcttgtgcctcagccttccaagtagctggttttgcaggcatgcaccaccacacccag

SEQ ID NO: 41984 - DNA, 201 bp, Homo sapiens
ttgcccgttgacctccatataagtatctgcatttgctgcatcattcatgacatgtgaggcctttgacaaaccctcctatggtgcagcttcctccgagcagstcctaaggaagtgccagagtcagggctttcctctgcctgaattatcggagctcttggcttaatgtgggagaagagatgaatgatctgtccttctatgaaa

SEQ ID NO: 41985 - DNA, 201 bp, Homo sapiens
ggacacatttttaacatagacaccaaaagagaggctggaagagttgaccacttagaaatgtcacgagtgtctgtgaatagtgttgggggctgagaggcaaragaagaaaatagtcctaatgttgtacaagtagcaatggaaacaaacttgttaaaaaaaatttaattttgtttatgcatgtgtgcataaacaaagcaatag

SEQ ID NO: 41986 - DNA, 201 bp, Homo sapiens
ttcctacattcaacattgtactctaatatccagtaaagtgaaacaaacaaacaaataaatacacttttttcaagaaaaaataaatatctgtgatctcatcrtttgaccgtcagtattttcatttttgcatgtgccactttaatttccctaggcaacactagctagtggcccacaataagacgtagaaaacaagaccacgta

SEQ ID NO: 41987 - DNA, 201 bp, Homo sapiens
aacagtcagagtgtccaagtaatctgagctagaaagttccttctttcagagaaaagttataaaaagtatatttgccggatccaaaaaaaatactgtgtatsaactactgagacctgcataatgttttcttagtattctcactctttaaaagaaaaaagaaaacctgtaaaatttgggaacttaaactttttttgatatttt

SEQ ID NO: 41988 - DNA, 201 bp, Homo sapiens
acccacagaacactggctcctcatcacctccccaagcccagcccctggcaaccaccattctcccctactttgtctatgaattcgactactcttggtacctyatataagtggaatcacacagtgtgtgatgtgttcttttgtggctgacttatttatgatactggattctcagcatcatgggagttaggactgtctgtcgca

SEQ ID NO: 41989 - DNA, 201 bp, Homo sapiens
gttacatggcagatggggaattaaggttgcagatggagttaaggttgctattcactcatcttcagattgaaagatcatcctggattatctgggtaggcccmgtcgaatcagagatggggaaaagagaggcagatgggtcataatcagagaggtggctgagtaaagaggacttggcctgatgttaccagctttaaagaggga

SEQ ID NO: 41990 - DNA, 201 bp, Homo sapiens
gtcatggtgattgtcaactgtcttggcgctggtgagggggctgtttagcatggaaataggattataatgacacctgaggtctttttgaagtccttgggtcrgctatcttgcttctaacaaatctcagctggtctggttacagagggaactttttatcacaggtgtcctgtttcttaaagataagcagtgttattacagggt

SEQ ID NO: 41991 - DNA, 201 bp, Homo sapiens
cacatatcccacatccaggtgccagtcagggagctgcgatttaatttgctgctgaatgcacttttgaataaagggcctagaagatgcagtctcgaggaacsgaggccggttagagacaggctggcagctttgcctcctctcccaagacaaaggcctccccgcccccctaaatccagcacacaatcagctgctctccctccc

SEQ ID NO: 41992 - DNA, 201 bp, Homo sapiens
tcttgaaatgggcagtgaacttcccggaaccagagtgttgccttcctttttatccttttatggctgcttctgatcattgtcatggtgattgtcaactgtcytggcgctggtgagggggctgtttagcatggaaataggattataatgacacctgaggtctttttgaagtccttgggtcggctatcttgcttctaacaaatc

SEQ ID NO: 41993 - DNA, 201 bp, Homo sapiens
tgccccttatacattaaggtgcatgcaataaatcacttatgtaataaactactctatattatgtgggaaaaaaaaaaggagctggtggcagggggagagayttcaaattgagccagacctcaggcatgaagggaggggagagagggggaaatgtggaggaagggggcgtttgtgcagtgggaagttggagaaagtacaaat

SEQ ID NO: 41994 - DNA, 201 bp, Homo sapiens
aggctgcagctggttagaccagggctgtgcaaccctagagccattgccttgaccacaaagccacagtctcctagtcctaatattaagaggtaggaggtagrtagagattgtcccttaagccacattccattcttcatatttttgtacccattagagtagtgctgatcatttgccttcattgctggggtcccctaaatgcaa

SEQ ID NO: 41995 - DNA, 201 bp, Homo sapiens; identical to SEQ ID NO: 8528

SEQ ID NO: 41996 - DNA, 201 bp, Homo sapiens
agtggggcactcgattccggcaagagaaggcaaacaaaagaagccacaacagtctaggaagaaatctttaatttctattcagctttaaagagtttgagagmgttttttcccctctgttaacaaacgagttcaagtacatgccttcatattataaaagtacctgaaattgcctagaatagcagcatgcatagcttgttagta

SEQ ID NO: 41997 - DNA, 201 bp, Homo sapiens
atatgcgtatatatatacgtatatatgcgtatatatatacgtatatatacgtatatatgcgtatatatatacgtatatatacgtatatatatatgtgtgtrtatatatatataaaaatatatttaaataatgttaaggctagagtagaatgacatcatgggaaggcttattgaaacttggagtggattcgtagtctgccac

SEQ ID NO: 41998 - DNA, 201 bp, Homo sapiens
cagtgagactactatcattcattttcactccccgtaaacatcttctgtttctgttttagaagacattgctaatcccctcatgcactggctttgcgaatttmtttttcagcctgggtttgaaagcaaagtggtagtgactttttcctgatagctgctgaaaaggttccacagtatttggaccgctgcctgcttctaccctgg

SEQ ID NO: 41999 - DNA, 201 bp, Homo sapiens
ttaaggtgcatgcaataaatcacttatgtaataaactactctatattatgtgggaaaaaaaaaaggagctggtggcagggggagagacttcaaattgagcyagacctcaggcatgaagggaggggagagagggggaaatgtggaggaagggggcgtttgtgcagtgggaagttggagaaagtacaaatgaaagcctctctg

SEQ ID NO: 42000 - DNA, 201 bp, Homo sapiens
aaggcagagggtgtcacttccactgcatctttggggaaggcagtcaccactgtatagtcctgagctcactgggattaaggggaagggacacagactccacytctcgatgagaggagaagcgaattgatgggcagattttatcactgtcctggggcctttgctctttgcccttccctttgccaagaaagttccctgtactct

SEQ ID NO: 42001 - DNA, 201 bp, Homo sapiens
cctggggcctttgctctttgcccttccctttgccaagaaagttccctgtactctgcaatgctgagtacttctcatccttcaggtctactgcaagtgtcacytggccaacacaccatgccttcccagtctctggtgttactctctgcatactgtagaccatcatcttgtttgcatacttgtctgttatctctttatcatcct

SEQ ID NO: 42002 - DNA, 201 bp, Homo sapiens
gacgatgacccttggttggagcaatgtagtctaaatgtggttgcatcatcttctttcttcctttgccttcctcccttgctctttttctgcccctcatgcckgctccttcctcccacatcaccccacatttttttttctttctcctcaccatcaagaaatgttccagaatgccattattcttcgtcaccacggtcaggtata

SEQ ID NO: 42003 - DNA, 201 bp, Homo sapiens
ctggccaacacaccatgccttcccagtctctggtgttactctctgcatactgtagaccatcatcttgtttgcatacttgtctgttatctctttatcatccktctacccacatcaggcaattccaagagagaagaccactggttttgtttgatctagtccctgttgagtccctgtgcaccttcagaaccacatctagcaata

SEQ ID NO: 42004 - DNA, 201 bp, Homo sapiens
tgctgagaaatgatgatggtgacaatgatgacaatgacgatgacccttggttggagcaatgtagtctaaatgtggttgcatcatcttctttcttcctttgycttcctcccttgctctttttctgcccctcatgccggctccttcctcccacatcaccccacatttttttttctttctcctcaccatcaagaaatgttccag

SEQ ID NO: 42005 - DNA, 201 bp, Homo sapiens
tattcacagttgccgcccacactcaagagaggggattctataggaaatggaagtcttgggggccatcttgaatcctgactaccatagtctgtgaaatcccyatttcacagatgttgaaactgagacttagaagcattatgcaccatgccaaaggccatggaaggacagagcttgggcatgctcccgacaccaggtcatact

SEQ ID NO: 42006 - DNA, 201 bp, Homo sapiens
taaaggagtgacttgctctcagttctttgtcattcagctgctttaatattaatatgacacccgttttgggcttgaaaagttttccttctgctgagaaatgrtgatggtgacaatgatgacaatgacgatgacccttggttggagcaatgtagtctaaatgtggttgcatcatcttctttcttcctttgccttcctcccttg

SEQ ID NO: 42007 - DNA, 201 bp, Homo sapiens; identical to SEQ ID NO: 8540

SEQ ID NO: 42008 - DNA, 201 bp, Homo sapiens
ccatagtctgtgaaatccccatttcacagatgttgaaactgagacttagaagcattatgcaccatgccaaaggccatggaaggacagagcttgggcatgcycccgacaccaggtcatactgatgtcactctccctactcccttcactccctccagcacctggccttcacctgaaggtgctgaccttgctgtttgttggttt

SEQ ID NO: 42009 - DNA, 201 bp, Homo sapiens
atgacctttggttcctaaactggtggacataccaaggactaaaggagtgacttgctctcagttctttgtcattcagctgctttaatattaatatgacaccmgttttgggcttgaaaagttttccttctgctgagaaatgatgatggtgacaatgatgacaatgacgatgacccttggttggagcaatgtagtctaaatgtg

SEQ ID NO: 42010 - DNA, 201 bp, Homo sapiens
atgcacccggctagggacctctttaatggtcattcatttgggagatgacctttggttcctaaactggtggacataccaaggactaaaggagtgacttgctstcagttctttgtcattcagctgctttaatattaatatgacacccgttttgggcttgaaaagttttccttctgctgagaaatgatgatggtgacaatgatg

SEQ ID NO: 42011 - DNA, 201 bp, Homo sapiens
gtatcctgctgggctgagtggggagggattctcaagctgtacatagctgacacacaggtttctaaaaggttgtctttcacccccattttcagaagtaccasgttccacattttctgagcctttgctggctctctgataggaattgtgttacttctcagctgtccccatggctagcttaagactcagctctcttaagtcact

SEQ ID NO: 42012 - DNA, 201 bp, Homo sapiens
tgataataaacttctgtcatttttctggagttatgaaatgatggtatcctgctgggctgagtggggagggattctcaagctgtacatagctgacacacagstttctaaaaggttgtctttcacccccattttcagaagtaccaggttccacattttctgagcctttgctggctctctgataggaattgtgttacttctcag

SEQ ID NO: 42013 - DNA, 201 bp, Homo sapiens
ttatgttctcttctgataataaacttctgtcatttttctggagttatgaaatgatggtatcctgctgggctgagtggggagggattctcaagctgtacatrgctgacacacaggtttctaaaaggttgtctttcacccccattttcagaagtaccaggttccacattttctgagcctttgctggctctctgataggaattg

SEQ ID NO: 42014 - DNA, 201 bp, Homo sapiens
atatggtttggctgtgtccccacccaaatctcatcttgaattgtagctcccataattcccatatgttgtgggagggaccgggtgggagaatattgaatcaygggggtggttcccccatactgttcttggggtagtgaatgaatctcatgagatctgatggttttataagggggaaacacctttcacttggctctcattttc

SEQ ID NO: 42015 - DNA, 201 bp, Homo sapiens
ggtaaacatttacaaagtctgtgttttcagtatcatgccactgttctcacctgtttatgttctcttctgataataaacttctgtcatttttctggagttakgaaatgatggtatcctgctgggctgagtggggagggattctcaagctgtacatagctgacacacaggtttctaaaaggttgtctttcacccccattttca

SEQ ID NO: 42016 - DNA, 201 bp, Homo sapiens
atagaataaaatatcatcaggagcagctcatgtgaccagaatgtgacaaagtctttgctctacaggtcaagttgggacttactgaggagaaatgaggggamttcaaagtccaggttgcaccatccactttatagatgaggaaagtaagaacccacagcatcttgcacgtagaattcaatatatgtcctgcttcttgaatca

SEQ ID NO: 42017 - DNA, 201 bp, Homo sapiens
ctgtggactcctctgaaggatgatctggctggactattttttgggaaaaccactgtgtttgaatgtttgcatgtgtcctgttggcagaacaaatatcccasagaaggatcttcttatcttctgcttggggaaggtgtagctctgactgctagagttctagagccaagtgagggggagagttctgagtctctgcattcagta

SEQ ID NO: 42018 - DNA, 201 bp, Homo sapiens
tctaagctcgtgattaaataaattctgaccctactctgataaaagtgaacccttgtggctggtcgcagtggctcatgcttgtaatcccagcactttgggaygccgaggcaggcagatcacctgaggtcaggagtttgagaccagcctggccaacatggtaaaaccccacctctactaaaaatacaaaattagtcaggcgtg

SEQ ID NO: 42019 - DNA, 201 bp, Homo sapiens
ctgtaattccagcactttgggaggctgaggtgggaggatcactggaggtcgggaatttgaaaccagcctggccaacgtggcaaaaccccatttctactaaraaaaaaaaaaaaaaaaaaaaaaaaagtatatatatatatatatatatatatatatatatatatatatatatatatgtagccatgcatgggggcctgccct

SEQ ID NO: 42020 - DNA, 201 bp, Homo sapiens
cctgaggcataaatgggttttaagctccatacagtaaaacctagcatatgaaaacagttctggctgatgggttggtagaagtgatagatatagatacatayatacacatatatgcacagtaatagatataggtaaagaccttgatatatgtacatatattgtatgatacatatccatgcatatacgtgggtgtacacacac

SEQ ID NO: 42021 - DNA, 201 bp, Homo sapiens
tctgtaattccagcactttgggaggctgaggtgggaggatcactggaggtcgggaatttgaaaccagcctggccaacgtggcaaaaccccatttctactaraaaaaaaaaaaaaaaaaaaaaaaaaagtatatatatatatatatatatatatatatatatatatatatatatatatgtagccatgcatgggggcctgccc

SEQ ID NO: 42022 - DNA, 201 bp, Homo sapiens
aggatccatgtttgatccgggggaataaagctagagttgctttcttccttgtaatatgtataatgactcatgagagaattccccactgtcttccccacctragacctgagaggaggagaaggaagcttggagtcgctgccctgtggcctgaattggtcagtgaccaatcactcagacccagctgacaggctatacgcggac

SEQ ID NO: 42023 - DNA, 201 bp, Homo sapiens
gcatctctggaggctgagcacctagtagtgattccaggtacgtagcaggtattttacaggtgcttgttgcattaatgcactttattggtgatatggtttgkctgtgtccccacccaaatctcatcttgaattgtagctcccataattcccatatgttgtgggagggaccgggtgggagaatattgaatcatgggggtggtt

SEQ ID NO: 42024 - DNA, 201 bp, Homo sapiens
tgaccatccatctccagaatgattttcatcgtgcaaaactgaaacgctgtacccacagaacactggctcctcatcacctccccaagcccagcccctggcarccaccattctcccctactttgtctatgaattcgactactcttggtacctcatataagtggaatcacacagtgtgtgatgtgttcttttgtggctgactta

SEQ ID NO: 42025 - DNA, 201 bp, Homo sapiens
gggaagagatcacttcacagtttcctgaaccactagaaaaaaaaaatgttcataaatttatagccgctgacattgaagttggagaaaagagcatatctagyacctatgctatgtggagaacactctccatgtctttgaaaaataagcacaatacaaattatatttgaggatgacctgccaaagggttgattatcctggaaa

SEQ ID NO: 42026 - DNA, 201 bp, Homo sapiens
tggactctgtgggtagagacatggatatttttccttttataagaaaggtcttgtctttcctcagaaggcattgtgagcaaaataagggaagaaaaagagamgtagataagaaaaacaaatcacaatattgaagcaggacccgagtactatagccttcctcatattttggtatctggaaccgaggttgctaattaatgaccc

SEQ ID NO: 42027 - DNA, 201 bp, Homo sapiens
caaattttcaaaggaagaaatggaatggtgcaaccatggtacatgggaaggaggagggggacacacaagactgtacctatcatgggggcttcgacctcatstgggaaggtggttggagagagtgagtcctgacctgagctttggaacttatcaagttgagagagaaatttgataatttgtctattaacgtgtgaccttggg

SEQ ID NO: 42028 - DNA, 201 bp, Homo sapiens
caagtcattgaccttctctgaacctcagtatcctaggacttcagaagcgaaaggaagaataatgggtcttgagtatgcctagaattgagcaagctgctatscttgcaaaggccttggccagctgctcacccaccatgtccctctgttcccactccaccttactcatgcctagacttcttgctttttaaaaataatccaccc

SEQ ID NO: 42029 - DNA, 201 bp, Homo sapiens
gttttgttttgttttgcttgttgagcaagggaatgcggttcccctgtgtcggacttgtttcagaaagacaatgtcactgaggctggggcagggagattagstgagaggctcttgcagttatctgggaaggagctgtccataaaggcctgagttaagacagtagccctttgggttcgatttagtggtggctccccaaaagat

SEQ ID NO: 42030 - DNA, 201 bp, Homo sapiens
aactgtggactcctctgaaggatgatctggctggactattttttgggaaaaccactgtgtttgaatgtttgcatgtgtcctgttggcagaacaaatatccyacagaaggatcttcttatcttctgcttggggaaggtgtagctctgactgctagagttctagagccaagtgagggggagagttctgagtctctgcattcag

SEQ ID NO: 42031 - DNA, 201 bp, Homo sapiens
tagtgtttcaccagactgagcatcatcctcggtgcaggggagaatggctggtatttatgagtgaatggcagcgttttgacaggatgatgaataaatatgcygggcccagaggactccaggtgataagcatttctttgtggtctggtaagtgatagcacccattgcttaatttctctaaaatctgcatttgtcaattttgta

SEQ ID NO: 42032 - DNA, 201 bp, Homo sapiens
cctcaccatcaagaaatgttccagaatgccattattcttcgtcaccacggtcaggtatatcatcctaagggcagagggtgaaggtgcgtaattagtgtttsaccagactgagcatcatcctcggtgcaggggagaatggctggtatttatgagtgaatggcagcgttttgacaggatgatgaataaatatgctgggcccag

SEQ ID NO: 42033 - DNA, 201 bp, Homo sapiens
ttttttttctttctcctcaccatcaagaaatgttccagaatgccattattcttcgtcaccacggtcaggtatatcatcctaagggcagagggtgaaggtgmgtaattagtgtttcaccagactgagcatcatcctcggtgcaggggagaatggctggtatttatgagtgaatggcagcgttttgacaggatgatgaataaa

SEQ ID NO: 42034 - DNA, 201 bp, Homo sapiens
gacctccccaaagtgtttccttcccgtggcctcttctcccgatcagctgtttgttatctgagggattcgttaataaccaggacatctgattctcatcattrctcatcctctgctcactctcctttctaatgcataggcctttagccttttactttctacctttttgaatgctatacttttttgtaaaattttaattaggtt

SEQ ID NO: 42035 - DNA, 201 bp, Homo sapiens
cacacctggctatttttaattttagtttctgtagagacagagacttgctgtgttgcccaggctggtctcaaactcctggcctctcaagccatcctccagcmtcagcctcccaaagtgctgggattacaggcatgagccaccccacccagcccatgttaattttttcacctacaaaatgaaggctacaatatttactttgca

SEQ ID NO: 42036 - DNA, 201 bp, Homo sapiens
catgcccagctaattgtgtatttttagtagagacgggatttctgcatgttggtcaggctggcctcaaactcccgacctgagatgattcacttggccttggmctcccaaagtgctgggattacaggtgtgagccaccgtgcccggccagacccgtgctctttctcccaccactgccctgtgccaaccaccacccccactcct

SEQ ID NO: 42037 - DNA, 201 bp, Homo sapiens
aagacatctccttctcatatgtttaggcaagcgttgatgacatcaacctagccttttattttaaatcccctgtcaacgcaattagataatacaaaaataasaaaactataggaggttgaggatggggctgggggccaaggagattacttggtttgaaatgaataaattgtctatcgtaagggaattctttggtgcatttta

SEQ ID NO: 42038 - DNA, 201 bp, Homo sapiens
tgcatcttataagaaggacagtgcttaaaacagaaagaattgagtagaaattaagacatagcttgatttttttccaacagaatcatgaagtctgttcaatyttctttttaaaaagtaatttaatcttctagaagatatctacgtttattcaataatttcctaaggtagtcttcaaaacctaggagcctaggagatacatgg

SEQ ID NO: 42039 - DNA, 201 bp, Homo sapiens
atctcgtgagacttattcactgtcacgagaacagcatgggaaagacctgcccccatgattcagttacctcccaccgagtccctcccatgatacgtggggakgatgggagatacaattcaagatgagattttggtggggacacagacacaccatatcatgtcttggcagccatctatattcaagacactattctaggtatga

SEQ ID NO: 42040 - DNA, 201 bp, Homo sapiens
cctgattacctacatttattaatgaaaacaaccaagaatagttgagcccaaaagtacaaatcaatgtgctgaatcagtttatgatgtctccctaatttctscacatctgttgagctgtgatttcaaattccattccatttcttttcttttcttttcttttttttttttttggagacagtgtcttgctctgtcacccagcct

SEQ ID NO: 42041 - DNA, 201 bp, Homo sapiens
tcatggcggaaggcaaaggaggagcaaaggggcgtcttacatggtggcaggcaagagagcctttgcaagggaactgccctttataaaaccatcagatctcrtgagacttattcactgtcacgagaacagcatgggaaagacctgcccccatgattcagttacctcccaccgagtccctcccatgatacgtggggatgatgg

SEQ ID NO: 42042 - DNA, 201 bp, Homo sapiens
gcctcagtaactgttagctctcttattgctaccggacaagtgttcttattttcccttttcttcttcttccttttcctgttccttgcccttcctctttcgawgaaagtttacgccaaaaaggatgagctgggttgcagccagcattctggtttcacaggagcctaggagatacatggagaatattctgaggctaggttaaat

SEQ ID NO: 42043 - DNA, 201 bp, Homo sapiens
tgtcctatattagtctattctcacactgctagtgaagacatacctgagatggggtaatttgtaaaagaaagaagtttaacggactcatagttgcacatggstggggaggccacacgatcatggcggaaggcaaaggaggagcaaaggggcgtcttacatggtggcaggcaagagagcctttgcaagggaactgccctttat

SEQ ID NO: 42044 - DNA, 201 bp, Homo sapiens
aggtgattgaatcatggagaccgttcccccgtgctgtgagtgagttctcatgagatctgatggttttgtgcggggcttttccccactttgctctgtacttstctgtttcttctccttcttgccaccaggtgaggaaggacatatttgcttctccttccatcatgaatgtaagttttctgaggcctctgcagccctgtagaa

SEQ ID NO: 42045 - DNA, 201 bp, Homo sapiens
tgctcatagtttaagtcatcaggtggtgactggaggagccagaaggtccctttgggcctgtcctctcaccagcatcaactgcaccaaaaagatctcattcygattatcagggatgaacccccccactgggtgatcaggcaaactacatgcattttaaaaaactatatcctgctgggtgcagtgcctcatgcctgcaatccc

SEQ ID NO: 42046 - DNA, 201 bp, Homo sapiens
gcctcagtgatcttctataacataagttgatagtcaataattgcttaatgggaatcataaatatgagtttatttatatgtgtatatatatatatatataawatatatttccatgaatatactgaatgctaagccctccccactttttttttcttttttaaattcagaaatttctagttgtgtttattcccctcgtcagcat

SEQ ID NO: 42047 - DNA, 201 bp, Homo sapiens
aagggcctgtctctcaggaaagcagtgatttcctttcacaataaccctatccttactgttgaagacttgtggaaaagggacatggcccagggaaccagagyggtttgggaaagcactttgtcaagaggcttggggaccccagggtggaagctgccatgcgcatgaggctgtgttagcagaggcagtggcagaagaagacat

SEQ ID NO: 42048 - DNA, 201 bp, Homo sapiens
caagtccttccggggactttgctgccacagttgacagggggaggtatttgcataacttcaccacacacagctaagctggtgatcctgctgcttggcagcaycttcccagcgtacaacagaggaaaactgcctgttgtagttaaaaaaaaaaagagagagagagagagagactgatacacaaagagaatcagaaaggagtag

SEQ ID NO: 42049 - DNA, 201 bp, Homo sapiens
tcctggccaacctggtgaaactctgtctctactaaaaatacaaaaattagctgggcatagtgttgtgtgcctgtaggcctagttacttgggaggctgaggygggagaatcgcttgaacccaggaggcggaggttgcagtcagccgagattataccactgcactccagcctggtgacagagtgagactccatcttaaaaaaa

SEQ ID NO: 42050 - DNA, 201 bp, Homo sapiens
gatggctttctttccagtataataaagacagtgcctccttccaggacaacggtttggcagatttgcttgataaaggttggggtttgtaagcttggggctcytcagccatgactgaaacgtactatgagcacggcatctaccgggctgttccacatcctccctgtgggactaggggccagggcaatgggaatcagtgcagaa

SEQ ID NO: 42051 - DNA, 201 bp, Homo sapiens
aaacttctttccacaagagtaggtttataatttattttctttacattatctggataattacatttggtttgcttacatagatggaggcgaatggttttccratcttcaaaccaacctatatcacaaaagcattctgaaaactgggaagagatcacttcacagtttcctgaaccactagaaaaaaaaaatgttcataaattt

SEQ ID NO: 42052 - DNA, 201 bp, Homo sapiens
aaaggcattaatctttttggtatccaacatcttgaatgcttctgtgtcattttcctttctttttttttttcaaagcacttaattatttaaaaacaaaaatmcttctctgatcagagcatacctgccgtgctcaaagcacttgcttacttggaatgccataaattacatgaaggaattattcattgtatcacgaaacatacc

SEQ ID NO: 42053 - DNA, 201 bp, Homo sapiens
tgttttaaacccatctgtttttgtttctggtaactgtatccaaaagtaatacagaattttccgtaagaacatttattgtgtttccttctacccacgaattktcttatgctacacacacaacccactgaaatttcacctctattgtatgtggcttttctagaaacgtgtgcttctgggctttgtctcacacctcctggccag

SEQ ID NO: 42054 - DNA, 201 bp, Homo sapiens
tccccgttctggagagcctttgattataacatcagcctgtcatttggacctctgacctgaattatatgaatctgaaaaatctcttcctttcctatcgtgarttcggtcattgttataagccaagctttgcaaaggtggaacaccttggagatacttatctcctccttactctacccaagtaatgactcatccttttataca

SEQ ID NO: 42055 - DNA, 201 bp, Homo sapiens
atgagcagttgggagagtgcaggatccagttcaaaaggatctgtccccccgtgaaccccaggacagggtgagaggccacctgcacactttttttttgtcasctcacaccctgttggccctttgcaaatatttgtctttcctcatgcacgtggttattcccagaaagatccagtgaattgtctcctgaagataaaatacata

SEQ ID NO: 42056 - DNA, 201 bp, Homo sapiens
tgaaccccaggacagggtgagaggccacctgcacactttttttttgtcagctcacaccctgttggccctttgcaaatatttgtctttcctcatgcacgtgkttattcccagaaagatccagtgaattgtctcctgaagataaaatacataaaagggcgtttcaaagtataaacagtgattttaatgaaaaataagaagaaa

SEQ ID NO: 42057 - DNA, 201 bp, Homo sapiens
tgttaagatatttaacgggtgtttcattttcccagcaatgctataggacacagaaaggaacataaattgttacagagagaaagagggtaggtctgtgaatrgaattgaacaggtaggttgaacaagataaatgccgaggaagcaagtgtatttaaataaacagtagtttatggaaggctttggaaatccactatattaatc

SEQ ID NO: 42058 - DNA, 201 bp, Homo sapiens
ttttttgtcagctcacaccctgttggccctttgcaaatatttgtctttcctcatgcacgtggttattcccagaaagatccagtgaattgtctcctgaagawaaaatacataaaagggcgtttcaaagtataaacagtgattttaatgaaaaataagaagaaaatgcttatgatacaacattaggtggaaaacgaaggaaga

SEQ ID NO: 42059 - DNA, 201 bp, Homo sapiens
tgtaggcctaattctagcaatctcagcaactgtaggatttctctgcattggaggaagcaagactgaaggtcgtctggctttatggacaatgtgcttagaarttcatgccataccttaggtccagtcttgtgactgaaccaaccagacaggcctaggctctgccctaagtggtcagcctccgaggtggtagcacgcagggcc

SEQ ID NO: 42060 - DNA, 201 bp, Homo sapiens
aacatggataaactgaacttgatttcctgcattaaaaaaaattaaagaaatgaaagttctgactgttttattgtagctggggaattctttttgcaggtgaygctcatgttacggttttgaacccaggactttgcgttgcagttttgttcaggggttgcagaataccgatctgactttgcaggaatgactgtcttggtgcat

SEQ ID NO: 42061 - DNA, 201 bp, Homo sapiens
atcccccacagctttgggtggagaatttggaaaaaatgccttaagtctgccatttgtagaaccatattaagtagtgatttccatttgatgccaaaaaaatwtgccatttagtttcttcctaagaggcaatctgacaatttcgagtagactgctggagtctgacaaatttgaatgtattatggactgaataaatgtttattg

SEQ ID NO: 42062 - DNA, 201 bp, Homo sapiens
aggcccaagcgatcctcctgcctcagcctcatgagcagctgggaccacaggatgcaccaccatggccagataattgttttgcatctttggtagagacaagscttcactatgttgcccaggctggtctcgaactcctgagctcaggtgatctacctaccttggccccacaaagtgctgggcttacaggtatcagccactggg

SEQ ID NO: 42063 - DNA, 201 bp, Homo sapiens
tgttagagcagagagagtggcgaggattaatctagactgaaatgtgctaatcaagctgtctcagatgccattttctggatagggaggaacagcagttggcragtttaagagcaatatggaggaaccactggggattctatgcatgatcttaggggaagtagcattattatctccaacactggctgtttacattatcagaat

SEQ ID NO: 42064 - DNA, 201 bp, Homo sapiens
agaattgcttgaaccctggtaggcagaggttgcagtgagccgatgtcatatcactgcactctagcctgggcgacagagtgagactctgtctcagaaaaaamaaaaaaaaaaaaaaaaaaaaaaaaaggctttcctgaaaggtgattcacaggcctcttcggatcccttcgtgtttagcaatttggatttccacacagcctt

SEQ ID NO: 42065 - DNA, 201 bp, Homo sapiens
tctgagcgggaactgggcaattggaggttctttcccctcccgtgctggtgggagaattgtttagtaggtcataaagtggaatctccattccagtctgatcyggtcaattctggtaggacttcatccaagcacaaagaaacctttgttttcattcaagacttccctaaaaggtggctgggtgcggtgcctcaggcctgtaat

SEQ ID NO: 42066 - DNA, 201 bp, Homo sapiens
gatgtcttgagtgagaaaatgctctgaccaataagccaatgttcaattgacttcgaaatgttatgtgggataggctcattcagggtggtacggctgtagasaaaatgctatatgcattggctgggcgcggtggctcacacctgtaatcccagcactttgggaggccgaggtgggcagatcatgaggtcaagagatcgaaac

SEQ ID NO: 42067 - DNA, 201 bp, Homo sapiens
cccacatgcagtatttctatggtccaaataagtatctgtcggacttagaatatttaaattaggatttagttgaaagattatgttctatatctttttttttwaaaaaaaaggaagaaaaataaagctcttcctaaatttatttacatgttggagcaattctggcactgctaaataaggcaggaaattccattaagtttaaat

SEQ ID NO: 42068 - DNA, 201 bp, Homo sapiens
taccaaaaaacaacaacaacaaacaaacagacaaacaaaattaggccaggtgtgatggcttatacctgtaatcccaacactttgggaggctgaggtgggakgattgtttgagccccggagttcaagactagcctgggcaacatagcgagaccctgtttcttaagaaaaaagaaacatttaattaaaaattcagaattggaa

SEQ ID NO: 42069 - DNA, 201 bp, Homo sapiens
gcctaacaactgaacacattttatgaaatttgcaaatctgtttccaaacatgtttgaatggatttttatggtcttttaattaacccaataaaaatggtaasaacacagcaattttaagaaaataacagagccaagtattttttatagctatgcatgcaatccacattacacccacatgcagtatttctatggtccaaataa

SEQ ID NO: 42070 - DNA, 201 bp, Homo sapiens
agtacttggggttaatttagcaaaccccaggatccccagagggtccctcggtattgtggttttctcctcgcttccaccttatagtggctccaccaggaccycttgactcagccagcactccttctcaagtcacttcgcagcacaatccgtttgttgttgctgttgttttttcttttgttttgttttgggtttttttttttg

SEQ ID NO: 42071 - DNA, 201 bp, Homo sapiens
atttccaaggccaccagggagcagggaaagtcaccaaaagaccgctccttgaaaccaggcaagaagccatctttgcagtgagctgagaggtctgatggccrccagctgagggagggaattccccttttgtgccttcgggattgatagagaagcccagtggacttagcatctgggaatcccagattgatcttttctggatat

SEQ ID NO: 42072 - DNA, 201 bp, Homo sapiens
acattaaatcttccataatctgtgctagttcggcaaagaagccccaacgtcctcccaatcatagggcgcctgagctcttggtctcctatatcttatattcrttatagatgtcttatatccattcctgtatcctttgtgatgtcttgagtgagaaaatgctctgaccaataagccaatgttcaattgacttcgaaatgttat

SEQ ID NO: 42073 - DNA, 201 bp, Homo sapiens
acttttaaggacccttgtcatttcattggtctcagctggatagctatcaagggtcactttaaggtcagctgactagcaaacctaattctatctgcaacctkaattcatataacctggcgtagtctcgattttattttaattttttaattgaattcagctttacagtatcttttgtagggggtaattttagcttctttctcc

SEQ ID NO: 42074 - DNA, 201 bp, Homo sapiens
aagaactatgtgtgttttcacttcttctttctttagagaaaacaaatatcatctgccttgctaggtagttgtgagaaatgaggagataatatctttaaatmtcctacggtgatacctggaacatgatggtgcttgggaaatgtctcttcttctgaaatgaggctgcctcgaagactcactggaacccaagcaaagtgtctc

SEQ ID NO: 42075 - DNA, 201 bp, Homo sapiens
tatttcggtctgaaaccgctgtttggatagttttagaagttgaccatgaaaattgccttctggttgtaacttggatccccaggtttcaatctgtgggctamcgtttcttgggattttcagaaaggattggcttggctttttatcaaagttacacaacggctgtaaaaaataaataaaaaaaaagcaaaattagcactttat

SEQ ID NO: 42076 - DNA, 201 bp, Homo sapiens
gctgcagaacaaatcaccccaaaattcagtgattagtttataggtagccccatttcacccatctcattctatagctcaggttgaaagttgagtcatgaatyggggaacattcttctcttggtgtaaattagtcaccagtgtctcatagggttgggctgaaacttaacacatcccatcactttgattggctaaagtcagtta

SEQ ID NO: 42077 - DNA, 201 bp, Homo sapiens
atcttcactccatgtaattagttagctattgctgcagaacaaatcaccccaaaattcagtgattagtttataggtagccccatttcacccatctcattctrtagctcaggttgaaagttgagtcatgaattggggaacattcttctcttggtgtaaattagtcaccagtgtctcatagggttgggctgaaacttaacacat

SEQ ID NO: 42078 - DNA, 201 bp, Homo sapiens
tttatgaggctttttttaatctagaatatatggaaatcttttcttgaagcacaatataatattgaattgggaatgttgtctgacagtttccctcttaccgktgcatagaatgactctcctgtatgaatttttaaaagaaacttcaatatgctatgcatttgaaagggaagaagtaatcaccataatcttgaggtatctttt

SEQ ID NO: 42079 - DNA, 201 bp, Homo sapiens
gctgggcacagtggcccacacctgtaatgccagcactttggaaggccacagtcggcagatggcttgagcccaggagtttgattccaacccgggcaacataytgagaccccatctctactaaaaatacaaaaattagccagtgtggtatcatgtgtctgtggtctcaggggtctcaggtacttgggagactgaggagggagg

SEQ ID NO: 42080 - DNA, 201 bp, Homo sapiens
ttaaaagccagaaacaactggctgttagctgtcacaatattaatactagtgtgtgcaagtaagtttgttttctgcttctgtcttacacgttttacgggctrtcagtagatgcatctaataatcctaacactgtcatccttatacttgaggtcttattgtccacttctaccttagctatgtaaacagatgagtaacctactc

SEQ ID NO: 42081 - DNA, 201 bp, Homo sapiens
tttatagaaaaatataaatcaatactttcatgtctgtttgacgtgtttgggagctacagcaattgaggcttgccagtgtctggatgccccaccactaccamgccacttagctcagagtttgtttttttccttccaccatgtgaaatgttgctggttaaccagttaaaacggggagatggccatgattgcttttagattgcc

SEQ ID NO: 42082 - DNA, 201 bp, Homo sapiens
tcggaaagtaactcctgtccattgttccttgtgccatctttcttaagaaaacatgaggaggagcagggtgatgctagatggaagcaggagagcctggggtsttagtttcagtggctctgacttcagttttctcacctcgaaatctcccttctctgaacctttttgcgtgctcttctgtctgtctgatattcatcatctgac

SEQ ID NO: 42083 - DNA, 201 bp, Homo sapiens
ggtgtgtgcttaggggcagctttgagccagataacaattctagttgcgcatgcttccataagctgtttactctaggaaggagaatctctgttgggatcttytggggagtacttgcctcccaagtgcttaggctcccgctgctgacaagaccctctgcctggcaagccgtgcaggttggaatcctctgttagggttccaaag

SEQ ID NO: 42084 - DNA, 201 bp, Homo sapiens
ctgatgtctcagcttgaagtcaggcatagagaggcaattctttctcactcagccttttattttattcaggccttcaacagattgtatgaagccacccacaytgggaagggcagtctgctttactcatagtactaatcgaaacgttaatgtcctccagaaacgccttcatggacacactagagataatgtttaacataatat

SEQ ID NO: 42085 - DNA, 201 bp, Homo sapiens
tagagacaaggcttcactatgttgcccaggctggtctcgaactcctgagctcaggtgatctacctaccttggccccacaaagtgctgggcttacaggtatsagccactgggcctggcctgagttgataatttttgtcatttctttctcacttttctcaggaaaatcatgactgtaaaacagatcagttttgctttagttcc

SEQ ID NO: 42086 - DNA, 201 bp, Homo sapiens
gtgtctgtctgtatctttacacacctatgggtgtgtctgtctgtatctatacacacctatgggtgtgtctgtctgtacctatacacacctatgggtgtgtstttctgtatctatacacacctatgggtgtgtctttctatatctatacattatatgtactaaataatatatataaacactatagtatatagagtatacata

SEQ ID NO: 42087 - DNA, 201 bp, Homo sapiens
tctcgaactcctgagctcaggtgatctacctaccttggccccacaaagtgctgggcttacaggtatcagccactgggcctggcctgagttgataatttttrtcatttctttctcacttttctcaggaaaatcatgactgtaaaacagatcagttttgctttagttcccaccctcatcatcaacccctccccagctaccctg

SEQ ID NO: 42088 - DNA, 201 bp, Homo sapiens
ctcctgagctcaggtgatctacctaccttggccccacaaagtgctgggcttacaggtatcagccactgggcctggcctgagttgataatttttgtcatttmtttctcacttttctcaggaaaatcatgactgtaaaacagatcagttttgctttagttcccaccctcatcatcaacccctccccagctaccctgcaaaaga

SEQ ID NO: 42089 - DNA, 201 bp, Homo sapiens
cggtcaccttccagccagcaacattgggctgactccttcaatggccatgtctctggttctttgtcttttgcctcctcctcttacttttaaggacccttgtsatttcattggtctcagctggatagctatcaagggtcactttaaggtcagctgactagcaaacctaattctatctgcaaccttaattcatataacctggcg

SEQ ID NO: 42090 - DNA, 201 bp, Homo sapiens
gccaggctgaaatggagtggaaggcagccctggctggaagtcttgctgggaacctggagcgctgggaggtaaaactttacttggtgctggcagcgtcactwtgccagtctgtttcttcccgagcttcaggccatgctgatgttcaagttgaataaatgagagctaatgattttttaaggcgtttttagtgaattgccgtgg

SEQ ID NO: 42091 - DNA, 201 bp, Homo sapiens
agctcaggtgatctacctaccttggccccacaaagtgctgggcttacaggtatcagccactgggcctggcctgagttgataatttttgtcatttctttctyacttttctcaggaaaatcatgactgtaaaacagatcagttttgctttagttcccaccctcatcatcaacccctccccagctaccctgcaaaagagtcaca

SEQ ID NO: 42092 - DNA, 201 bp, Homo sapiens
agcatcatctttaactagacatcaacctggttttgaatcctttgagttttggcaaatagaaaattcatccagggccacaaaaaatatctataattttgacscagttgtagtctagagagatacttagttcaaaaagaattgtgttatcgtcatcaagcaaaacaacagtatatgctatcatctctgagatgtcacacgatt

SEQ ID NO: 42093 - DNA, 201 bp, Homo sapiens
gaaactggaggagcccgggaactgctttctcctctctaagagtcttggtggtttcttgtgtggaaatgaatgggaagttcaccctggttctgcaaaatggktgcgaaatgtaaaatgtatataccttctatcctactctttatgttccacaaattttggagggaaactgattaactctctagctaccatgttccaggtgcc

SEQ ID NO: 42094 - DNA, 201 bp, Homo sapiens
gagagatggggagtaggagaagaaaagccaaaggcagactttagtctggtttataatgctttaatatttttttgaaggaagaaaaatgttcattacttaaygtaataattatttttaaaaagcagcctggggggggggtattcatttttctgtggctgccataacaaagttcttcaaacttagtgtcttgagacaagacat

SEQ ID NO: 42095 - DNA, 201 bp, Homo sapiens
acgggacaagcttatggtaggtctgacctcagcattcagaaaaacaatgtgaaatttgtaatatgtgtcagaactggcaatcaacgccataaggacaataraataaaatacatttctccactttagtaaatgaggcttcatgcttcctatggcataacttttttgttgttgttgttttttcttttctttgaaacggtttta

SEQ ID NO: 42096 - DNA, 201 bp, Homo sapiens
agttttgaggttgaccttcagaacggcttcctgaataatacagaagtgaccctccaggaaggcccttccactgaagctacaactggagctaagcagatggrtaagccaaaaccacctccgttgctgtggccccatctccaccacaaggaagctggagaagggaccccagaaccggaagacaaaaaacttccttcacacact

SEQ ID NO: 42097 - DNA, 201 bp, Homo sapiens
agggagtcattattactctaccacaaccactaattctggacttcacgttccctcatccatagagcagggataacaatatcctccaggctatccgcggaagwagagaatataagctttatccagggggccactcagtgatgggagtcttccttatgaagctgtcccagctccatctctcaggactgaaatgtgggtaagacc

SEQ ID NO: 42098 - DNA, 201 bp, Homo sapiens
aggcaggaggatcacttgagcccagaagttcaacattatagtgagccactgtactccagctgggtaacagagtgagaccctgtctctgaaaaataaaaatwaaaaaaaaaattaagttagaagggagggattacgaccctcatgtgtatcaagaaacaagctccatgaagccccgtaggatggctcagcaccagaacgagg

SEQ ID NO: 42099 - DNA, 201 bp, Homo sapiens
gactgtctccaaaaaaaaaaaaaaaaaaaaaaagggcatggatctagatgccagacaatctgggtgcatatctttgctccaaaagcaaagattgtaaactstctttacaatctggggcaagttagctaatctctgcttcagtttgctccttagcaagatgggatgatattaccacttacctcagagagttgttaaatgggt

SEQ ID NO: 42100 - DNA, 201 bp, Homo sapiens
gtcatacaaccatatggtacctctctggcaactaatttcacctatttccttatttgtttaaaaattttaacttaaattttttcccctcaagatctatttayggatcatcagttttattttttcttttctttcctctttttcttttgctcccttttctccccactcttgactcttctctagtttttatatgcagtttgtatt

SEQ ID NO: 42101 - DNA, 201 bp, Homo sapiens
gaggcaggaggatcacttgagcccagaagttcaacattatagtgagccactgtactccagctgggtaacagagtgagaccctgtctctgaaaaataaaaayaaaaaaaaaaattaagttagaagggagggattacgaccctcatgtgtatcaagaaacaagctccatgaagccccgtaggatggctcagcaccagaacgag

SEQ ID NO: 42102 - DNA, 201 bp, Homo sapiens
ggcatgaaacttgatttgaccaatgaggcatttggaaacacggcacaagcaaaggcttgaaacgtgcttttatgttggtgcttgcccacttgctgtgctaygaacccttttacttctgggtgcgaacaagcccaggctagccttctgggcgatgagagacacaagaccatgtttccatattgccccagccaagagccaacc

SEQ ID NO: 42103 - DNA, 201 bp, Homo sapiens
aaatgtgttgtttgagatgaaccatcgtttcaaatgtcacttacttcttgttttataaagtatcattactcttttcttggacacagtctcatctttgaggwgtttgcagattttatctcctgtggacatttctacaaaatcaatcaacaaacttgagcagagaaatcatcatactagccacacacactctgcaggcattaa

SEQ ID NO: 42104 - DNA, 201 bp, Homo sapiens
tttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccat

SEQ ID NO: 42105 - DNA, 201 bp, Homo sapiens
agataccaataattaatatctatggttgattgtaaaaatggccaccaattcttccctgtcccctgcatatgtacatccttgcactgtgaaattgtagatcycgccctccaaaggtgaagttcgtttgtccactccttgaaccaggatggcatgaaacttgatttgaccaatgaggcatttggaaacacggcacaagcaaag

SEQ ID NO: 42106 - DNA, 201 bp, Homo sapiens
caacaccttaagtgctggctttctgaacctcttgcccacctaggcatgcctgctactttgaagtggcaagagttatctttgtctattacatcagcattccyaaacttacatgttaacataaacatggagctcagaggaaatgtgttgtttgagatgaaccatcgtttcaaatgtcacttacttcttgttttataaagtatc

SEQ ID NO: 42107 - DNA, 201 bp, Homo sapiens; identical to SEQ ID NO: 8524

SEQ ID NO: 42108 - DNA, 201 bp, Homo sapiens
ctttccttgactttgatgtctaggtctggatttcaagggctcagaaactctctcatgcatgtagttccctcctgctttgaatctctctgactttccttgaytttgatgtctaggtctggatttcaagggctcacgtgatgaggatagtttctttatcttaagggcaactgatgtggagtcttaattaacactggcaaaatc

SEQ ID NO: 42109 - DNA, 201 bp, Homo sapiens
aaaaaaaaaaaaaaaggacagggaaaatgtccaggaaggatgtggcttagctgaagatcagcttcagcttgatcccacgggaagctctggagggtgaattstacagcagagttggtcctgactgagaccagggcctggctgacctatggcagtcagcgatgagccagtgtctgctggggaagagggcggcgtggacatagc

SEQ ID NO: 42110 - DNA, 201 bp, Homo sapiens
tatgagcaaggcaaaagggacaatgttcaccctttggactggaagtaagaagcccctgcagttccaaatgactccacatttggaatgatttcacaaggagygcaaaagaagcctcttgtttgactttgcccacaaatgccagaggaggactcttctgagccatgccaataagaaaaatgagaatgccagcttaaataaatg

SEQ ID NO: 42111 - DNA, 201 bp, Homo sapiens
tggcagattgagtgtttggcaacggcccactttctggttcctagatgttcacctccttgctatgtcctcatatcgggggaggggcaaagggtctctctatytggcctcttttaagcccttaacccattcatgaaggctttgcctcaatgacctaatcacctcccaaaggccctacctcctaatatattatattggtgatta

SEQ ID NO: 42112 - DNA, 201 bp, Homo sapiens
tctcatagttcttgaggctgggaagtccaagatcaagctgctggcagattgagtgtttggcaacggcccactttctggttcctagatgttcacctccttgytatgtcctcatatcgggggaggggcaaagggtctctctatctggcctcttttaagcccttaacccattcatgaaggctttgcctcaatgacctaatcacc

SEQ ID NO: 42113 - DNA, 201 bp, Homo sapiens
ttgtttgtaagaatcagttgaggacagatgggactatttgcatggattggtgtcatgtttgaagtcagttaccagagggtttctttcaacagagtatcccmaaaaaaaaaaaaaaaaaaaaaaaaaaaaagtaaattgcacagaccccagcttaggacctggacttaatcttcatgatgtttgtaaagtaatacttcttgg

SEQ ID NO: 42114 - DNA, 201 bp, Homo sapiens
tccttatctgtaaggtggcagttacaataatacccacctcccagggttatatgtcaatgggttaggcacagacctaggaactcagcaaatggactactatsaagtattagctttttactgtttctggttttctgatttttgtctcctgttgtgaacatacgttgcttttgtaatatgaaaaataaaaaataaaagttaaat

SEQ ID NO: 42115 - DNA, 201 bp, Homo sapiens
tatacacttgagcttggcatttttcttaacgcagggctattttaggtgcactgcgcatgttggaggtgcccttgcaggtataggtaggcattgtccatccrtggtaaaaagcaatagaagaaattcttacccgatgcttaatgaattgccaggctggttaaaaaggataacccttgaaacctagggtgtccaactgctaat

SEQ ID NO: 42116 - DNA, 201 bp, Homo sapiens
gtgtccaactgctaatttatatagactggagatatttccatgcctcgcagcaaaatttttctttaaattcacagaagcagcagctatccagcattgtccarttgtgctgagtagctgtcattattgataaacatgtaactggtcatttgtattgttttgagtaggatatggcttatcaggatgcatagtagagaaaaatga

SEQ ID NO: 42117 - DNA, 201 bp, Homo sapiens
tttttgtacttttattgaccattcacatttcttcttttctgaactgcctttccatattctcggtccagctttctataagattgctctcatttactggtgakagctctgtgtaaattaaggaaaccatcaccaccttcgaatggctgactattgtaaatattttaatgtttgtcgtttgtttgcaaccttgtaattttttcc

SEQ ID NO: 42118 - DNA, 201 bp, Homo sapiens
gtgagccaccacacccagcctgggggagggtttgttaaagaactgtctgttttatcacatgaccacaagttaaaatgttgggcaatgtccctgaatgataycttttcattagtaactcacatggacccataatctctgaatttaacatgcttttcaggaatgtgttcatattttccacctataaaacctgttttagtaatt

SEQ ID NO: 42119 - DNA, 201 bp, Homo sapiens
ggccttactcgttttcaaatactcaaatgccattgagtcagatttcagaggcaaatggtgatacctcaggtttgaagttgcaagaagtcaccacatgcttrttatggaaatcgtcagggatatttattccctctcctgagaagcataattgagcctccaaaccacccatcaagatatccacctgtaaaatatttaagaact

SEQ ID NO: 42120 - DNA, 201 bp, Homo sapiens
atttaagaactggtactatgaagacatttcccttatgcaatttgttttccatctaagagcagaacaaggaaaatatagctgactataagttacaaaggcavactcttaagctacaaaatacatctcttcacaggagcacttggagaagggctgaaggcaaaccaaaagtgagcaacaaggagactagtgttctgaaacaga

SEQ ID NO: 42121 - DNA, 201 bp, Homo sapiens
ttacacgtttatggattgaaatggttctgctgaaattttaagtgttaacattgttcaaattttcattactaacacctctcacattgttagaaaacagtttyatgtttgacattttgatcatactaacctgggacattttatgctaaagttctcatttcatgccttaggaatcccctgcttattttgatttcagcacctttc

SEQ ID NO: 42122 - DNA, 201 bp, Homo sapiens
tctaaaccgatcatcacagaagatattttgtagtgatgaagaaagcttaaatgtctcatttgtcagattggtttaggtagaaaataaggatttccaccccytcatcgtggttcccttttagattttcttgtttgcttttctttaaagctgctgttactcaaacgacagtccgtaaactgcactttattttttataacagct

SEQ ID NO: 42123 - DNA, 201 bp, Homo sapiens
gactattaaaatgtaaattaattaaaattaaaagttcaattgctctgaaatagcagccacatttcaaatcttcagtagccagatgtggttattggctaccwtattgggtagcaccgatatagaacatttctaccatagtagaatgctcttttggatacatctgctttaaagcattagtccccaaagtgtgaaggatgaacc

SEQ ID NO: 42124 - DNA, 201 bp, Homo sapiens
gaccttaggtgatctgcctacctcggcctcccaaagtgctgggataacaggcgtgagccactgcgcctgtctacattttctgtctttactggtattatggygggaacccataaaccactgcgaggcagataccattttaagcaggaaaccttatttttttccgaagcacatttaaaaatattttccagtttatctattaaa

SEQ ID NO: 42125 - DNA, 201 bp, Homo sapiens
gtcccgtacttttcaatgtaagcatattggctctcaatttaaaaatgttattttttacagatagtacacagatgcactgacacaggtaccctctccagtcytctgatggtcaggaattgtgtgcagtatgcagtacattccaaagtcaggctggccatttccccagggagagggtccatgttggaacctttgctccttgtg

SEQ ID NO: 42126 - DNA, 201 bp, Homo sapiens
acttgtttcctgtgagggtgccaggaaactttacaatgaacttcgtgaattaaacctctaccagatgaatagaggtggtggcatggtagcagaaattaggrttaaaaaaatggtttttgatttatgaaaaatttttctgcaggaaattttgatttgttctttgtggattctgaggataaaattaagaccaacattgaggat

SEQ ID NO: 42127 - DNA, 201 bp, Homo sapiens
tgaagttgtttagataaatgtgccaggtgctaagctcagggttattaggaataataattcagtgaaaggaaatttggatgacatgaactcatttccattakacttgagccacacaaatcaatgggaaaagaaacagctgaatccaggataatatctggctatttggagtgggcatgataatggagggagattggggaggta

SEQ ID NO: 42128 - DNA, 201 bp, Homo sapiens
ttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaacc

SEQ ID NO: 42129 - DNA, 201 bp, Homo sapiens
ctctgaaagatttatctctttcgattcatctgtaaagtaaaaataaccgtcgtcgtcatttctcaagcgtgacgatactgttacacgtttactgcatattstgcataccaagcacatatccgtcacacgcagtgtggccaacttccgagaggccggcattcagccaaacagcctgaagaaccaggagaaatgcctgagttt

SEQ ID NO: 42130 - DNA, 201 bp, Homo sapiens
caatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgag

SEQ ID NO: 42131 - DNA, 201 bp, Homo sapiens
cactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccaggg

SEQ ID NO: 42132 - DNA, 201 bp, Homo sapiens
ttcagccaaacagcctgaagaaccaggagaaatgcctgagtttccaaatggcttatggtaagttgttgctgccactatgagtagcctacttgcatttctayttaatggcttttccccatatttgatggtatgttaaacagtcaatcattcattttctaaattaaagcctgtcctgaaaacgtgctcagtgctattgactgt

SEQ ID NO: 42133 - DNA, 201 bp, Homo sapiens
ggatcttaaagtccaacctcaaggcccagcgctgccacttaacagctctgtgaccctgtaaagtcactcagcctcattgagtcccccatcctcccctgtgyagaatgaggctaatgctagtgctcatttcatagagttgctacaataatcaatgagataatgtgcataaagatttacatacataataactgctcaataaag

SEQ ID NO: 42134 - DNA, 201 bp, Homo sapiens
ggtaggcttctctctaaataaatggaaatactaactgtccctggctcatagagctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggc

SEQ ID NO: 42135 - DNA, 201 bp, Homo sapiens
caggtgggaacagggttacagagcaaagtaattagatgccctttagatgctcttagttaaagaccatgcaaaaaggatgaaatcttttgatcatgttcttyacaatattagaggtaaaacatgaactcaacgcttttaggaagaaacaactggattgcgttttctattttattgacagaaactagatggggaggccagggt

SEQ ID NO: 42136 - DNA, 201 bp, Homo sapiens
aaaataatattaccggagaaacaatgagtaacatgtataggattttttttttttttttttgacggagtcttgctctgttgcccaggctccagtgcagtggygtgatgttggctcactgcaactccgcatcctggtttcaagtggttcttctgcctcagccttccaattagcggggactaccagcgcatgtcaccatgcctg

SEQ ID NO: 42137 - DNA, 201 bp, Homo sapiens
tttagaaaagaaatctagaggaaaaataaagcgcttctaataaagcgcttctcgtagatgccaggaaaacacgattcttgtttcttctctgagtgagtttstgttttgtttttgtgctttgtggctgtccgtgggccaagttgtctcacgcgattagcatgccagcatattttctgttaaagaaagaaagaaaaaagaaaa

SEQ ID NO: 42138 - DNA, 201 bp, Homo sapiens
aagtatatgtagcaaccaaacagtttcttctttcctaaaactcaaagtgagtcagacttcttaggcttgtagatgttgaggactaagctttgctctttatmttctctttatggatttccctttggaagcagggataagaagagggaaggtctcccagatgtaaatttctcataaatatttgagctccatttcagtaattct

SEQ ID NO: 42139 - DNA, 201 bp, Homo sapiens
taattatctgtatggctttggacgagttgcttttgatctctgatatcaggtaggcttctctctaaataaatggaaatactaactgtccctggctcatagarctctgtgagggttaggcaacaatgcttacaaagctctccatgcagagcctggcaaatcgtaacctctcaataaatgctagtcattgatgtcacttgaata

SEQ ID NO: 42140 - DNA, 201 bp, Homo sapiens
ttcatgggatctggatgaattaatgtgttatgtgtttgtgctaagtatgaatgtatggtgaggagtgtgtgtgtgtgtgtgtgtgtgtgtgtgtgtgtgtgcattaaatgttttaacacaacattgccaacccttcccctagcagcaccgtgggcaaagcataaagggatgatctggcagcagccccacttgggttttcta

SEQ ID NO: 42141 - DNA, 201 bp, Homo sapiens
aaagtgagtcagacttcttaggcttgtagatgttgaggactaagctttgctctttatcttctctttatggatttccctttggaagcagggataagaagagrgaaggtctcccagatgtaaatttctcataaatatttgagctccatttcagtaattctttcattctctgatctgttgcctaatcttctatttagcaagtac

SEQ ID NO: 42142 - DNA, 201 bp, Homo sapiens
aatacaaaaaattagccgggagtggtggtgttcgcctgtagtcccagttactcaggaggctgagccaggagaatcgcttgaacctgggaggtggaggttgyagtgagccgagatcgtgccgttgcactccagcctgagtgacaagagcaacactccatctcaaaaaaaaaaaaaaaaaaaaaaggacagggaaaatgtcca

SEQ ID NO: 42143 - DNA, 201 bp, Homo sapiens
tctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcc

SEQ ID NO: 42144 - DNA, 201 bp, Homo sapiens
tttcatgggatctggatgaattaatgtgttatgtgtttgtgctaagtatgaatgtatggtgaggagtgtgtgtgtgtgtgtgtgtgtgtgtgtgtgtgtgtgcattaaatgttttaacacaacattgccaacccttcccctagcagcaccgtgggcaaagcataaagggatgatctggcagcagccccacttgggttttct

SEQ ID NO: 42145 - DNA, 201 bp, Homo sapiens
atgtggccgggcgcagtggctcacgcctgtaatctcagcactttgggaggcctaggtgcgcagattacgaggtcaggcgattgaggccaggctggccaatrtgatgtgagaccccatgtctactaaaaatacaaaaaattagccgggagtggtggtgttcgcctgtagtcccagttactcaggaggctgagccaggagaat

SEQ ID NO: 42146 - DNA, 201 bp, Homo sapiens
gttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaaga

SEQ ID NO: 42147 - DNA, 201 bp, Homo sapiens
gccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtat

SEQ ID NO: 42148 - DNA, 201 bp, Homo sapiens
ctcatctctttagattagtgattctatattggtgagggagtggaagagaaatgtgggtgtgttgactatattctccacagaaactttttgaagtagcatcvtcactcagcacagaacattttgacaatacacttccagggcaggtggtttcttactatgtccctccctacccccacatactttgggactcagaatgtaggg

SEQ ID NO: 42149 - DNA, 201 bp, Homo sapiens
aagagtggcttagaacagggaaaatgtggccgggcgcagtggctcacgcctgtaatctcagcactttgggaggcctaggtgcgcagattacgaggtcaggmgattgaggccaggctggccaatatgatgtgagaccccatgtctactaaaaatacaaaaaattagccgggagtggtggtgttcgcctgtagtcccagttac

SEQ ID NO: 42150 - DNA, 201 bp, Homo sapiens
tggcatggcctttgtatgacacttccttctagccagactcggatttgggggcatcatatttgggatggctgcaccgcaaacaggaaaggccacaggacagytcacaggttctctctgaacagaagcctgtgagcacgtgcctgtcatttaaaagctgcatggcactcttccccctgcatgcgtttctctcaaggtgtccct

SEQ ID NO: 42151 - DNA, 201 bp, Homo sapiens
tgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggta

SEQ ID NO: 42152 - DNA, 201 bp, Homo sapiens
tgacaatacacttccagggcaggtggtttcttactatgtccctccctacccccacatactttgggactcagaatgtagggagtgtactctcgagggatgcrgcccatacgtgaatgcatggaggcagcatataaggttgcaaagcactgaccttctctttttatgattcccatttattccatagactgtgaagtctgcctg

SEQ ID NO: 42153 - DNA, 201 bp, Homo sapiens
ggaaatgagaagagtggcttagaacagggaaaatgtggccgggcgcagtggctcacgcctgtaatctcagcactttgggaggcctaggtgcgcagattacraggtcaggcgattgaggccaggctggccaatatgatgtgagaccccatgtctactaaaaatacaaaaaattagccgggagtggtggtgttcgcctgtagt

SEQ ID NO: 42154 - DNA, 201 bp, Homo sapiens
taagttttaggaaagaattctttccagctttccatcctgaacctgctggtctccaggctcgttcctgcaaatatttcacagaggagtaagagccacattcktgctggctttccaattcattctcctctcttcgagtccacctcttaaaacttcttagtgctcttgcaagaaactcatgtcttttgtcagggagaatggcat

SEQ ID NO: 42155 - DNA, 201 bp, Homo sapiens
atgctttcagaaaggaaatgagaagagtggcttagaacagggaaaatgtggccgggcgcagtggctcacgcctgtaatctcagcactttgggaggcctagrtgcgcagattacgaggtcaggcgattgaggccaggctggccaatatgatgtgagaccccatgtctactaaaaatacaaaaaattagccgggagtggtggt

SEQ ID NO: 42156 - DNA, 201 bp, Homo sapiens
ctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaaga

SEQ ID NO: 42157 - DNA, 201 bp, Homo sapiens
tctatcatgaattggctgtgaggtgtgacattgaaaaagtgatttagcctttgttcccctccaggtccttatctgtaaggtggcagttacaataatacccmcctcccagggttatatgtcaatgggttaggcacagacctaggaactcagcaaatggactactatgaagtattagctttttactgtttctggttttctgat

SEQ ID NO: 42158 - DNA, 201 bp, Homo sapiens
cgtcaatctgctatgatccttttatggttctgacgttgcagttttatttttgcatgtttctagagacatcaggaggggatcttttcgggatgtggcttcaraaaggagcctgttggatggtctcttactagtggtcagcaaagaacagttcttttgtaaattgcactgcattaagagcattcctgtttccatctcattgat

SEQ ID NO: 42159 - DNA, 201 bp, Homo sapiens
gctcagttacttttttcctgtttttttttcacttttgtcttcctgacttttttcttccatccctatttatgaaaacaaaaagataactaaattgaaaccttgacaatgtaatttgtcagaggaaggcagcctgttttataagctcaggtgatttcatttttgttcacctgtttatttcatgacacttgcaggaaaaagaag

SEQ ID NO: 42160 - DNA, 201 bp, Homo sapiens
atacaattaatttagattttttaaaaggcttttgagaatattcggagaacctaatatattttgagacctgacatttattttaaacgtgaaaagcaatttasaaaattgcacatactctataaatacacttctgttataaaaatagacacgtacggccgggcgcggtggctcacgcctgtaatcccagcactttgggaggcc

SEQ ID NO: 42161 - DNA, 201 bp, Homo sapiens
atatttaataaatattttggggccttgtagtgtttgttgccaactactcaactctgccctcatagtgcaaaaacaggcataaacgatatgtaaaggagcargcatggctgcgagaaactttatttatggatactggaatttgaatttcatatacattttcatgtgtcacaaaatattattctttcccccccgcccccaacc

SEQ ID NO: 42162 - DNA, 201 bp, Homo sapiens
ttcttgggctagttggtatagcttccttctcagctcattctgcaaggtttgctttggaaaagtctgtgcatctgagctctctcttgccatatcaggaaccsaagtcagaaataaaggctacagatgctcaaaatctgcagtattcaatctttttaaggcccagcatggtgtctcatgcctgtaatcccagggctttgggag

SEQ ID NO: 42163 - DNA, 201 bp, Homo sapiens
gtcgatatgctagagtgatgtgaaaaaaataataaaagcgagatatttcatggcaaagcgatctcagggtaaacactgcacaccagtaagtattcttgggkcaaatgggaaaagggttaaaatgaccagatctccagagatctcactcactgtggtgaagacagcgccaagccatgagggctccgccccagtgattcaaat

SEQ ID NO: 42164 - DNA, 201 bp, Homo sapiens
aaatacaggcctttcccatttcacagtgtttctagctcccctttccaatacatctctctctctctttctctctctctctctctctctctcacacacacacmcacacacacacacacacagccaaatcagacaccaacataaactgtagagttaacattctttttccaccctcacactttttttagctccgatctgtgttca

SEQ ID NO: 42165 - DNA, 201 bp, Homo sapiens
aatgctacattttctcggatttgacattttcagtgatggagaactattatattttgtaaatggaaataccactactaaaaacagaaggctataaatagaaygatatccttcgtttccaaagtcgatatgctagagtgatgtgaaaaaaataataaaagcgagatatttcatggcaaagcgatctcagggtaaacactgcac

SEQ ID NO: 42166 - DNA, 201 bp, Homo sapiens
attcagtacatatttataaaaccacacttacatttaaatacaggcctttcccatttcacagtgtttctagctcccctttccaatacatctctctctctctktctctctctctctctctctctctcacacacacacacacacacacacacacacagccaaatcagacaccaacataaactgtagagttaacattctttttcc

SEQ ID NO: 42167 - DNA, 201 bp, Homo sapiens
gcaatgatgcccagagcatttatctttgatgctgggaatgcgttcattttctttatcttgccattactgtacctctattgggaaatttactctctcttcakagataggatccgattcagtacatatttataaaaccacacttacatttaaatacaggcctttcccatttcacagtgtttctagctcccctttccaatacat

SEQ ID NO: 42168 - DNA, 201 bp, Homo sapiens
gaacagaactaacatcagaatcatctgaatcatcagaattgtgtattttggaaaaatcggattcatcaaatgaatcttcagccaacaactgttcgagaatkatgttaacatcacatgcaggaatgctacattttctcggatttgacattttcagtgatggagaactattatattttgtaaatggaaataccactactaaaa

SEQ ID NO: 42169 - DNA, 201 bp, Homo sapiens
atatccttaggtttaagatacaggcaccacaacataaaccacccccagagtacacatgcatgggtgtaatttggtgccattctcctcccttttgcccccaycaaaatgaagtttttagtgtaaatgtcatgtagattttaaccaaaggttgattggagggtctgagtttctcagctaaatgaaggcatgaggactgtatcc

SEQ ID NO: 42170 - DNA, 201 bp, Homo sapiens
agcattcattaagtgttccctcctattatatccttaggtttaagatacaggcaccacaacataaaccacccccagagtacacatgcatgggtgtaatttgktgccattctcctcccttttgcccccaccaaaatgaagtttttagtgtaaatgtcatgtagattttaaccaaaggttgattggagggtctgagtttctcag

SEQ ID NO: 42171 - DNA, 201 bp, Homo sapiens
cccccaccttattctaaataatgactttcttaaaactacatgttttgggggaatgtcctgcaatattgctttacatctttttatttttttattttattttwttttttttgagacagagtctctgtctccaggctggagtgcagtggcacaatctcagctcactgcaacctccacctcccgggttcaagcgattccactgcc

SEQ ID NO: 42172 - DNA, 201 bp, Homo sapiens
ctagtatttgccaaaactagaggatgaatgagtgatgggtaagagagttctcagaaaaatggatataaacaatattgtaaatcatatttggaaaataaatrctagaatcattgaatccctgagttatagaaaaatttattaatagcgctatctggctactttttaaagtgtggacatcctcgatgtattagctatgcatct

SEQ ID NO: 42173 - DNA, 201 bp, Homo sapiens
tggggcactgagatctatgcatgttgtgggcccactttaagaaaaggagtcaaacatttagtgtggaatactggaaggggtccctagacatgaagggcctyttcaacctaccttttgttggcttcaaggttatgccatattttgcaaagtcaagttggagatggctctcgatatgcatgagtgtgttagactgcttttctt

SEQ ID NO: 42174 - DNA, 201 bp, Homo sapiens
cccttgctggctgcagttgatttgttacttaccgtgaggttatcatagctttgcagagactttgtgatggggctgtcaacagagagagagagagagaaagraaagaaagaagtgccaccagtccattttgttccactcaaatgtagatcgtaatttttaggtttgtaattactgatgagaagaatgcctgagccagaactt

SEQ ID NO: 42175 - DNA, 201 bp, Homo sapiens
tcttttttttttctaaccactttcccagtgagacttcagttttcattctccccttagcagctttcaaatatgtacgtaacacaaatgttacatgtttgagmatttaaactgaatttggacagggcttctatttccagaaccttctaactctatttctttgtgacctgatagtcttgctctccagggtaaaagaagaggatg

SEQ ID NO: 42176 - DNA, 201 bp, Homo sapiens
ctcctaacatgtcatctgaaatctgggaccacagttccggctggaacacttgtcactaaagctgctgataagcaaagggtgtatcactggtatgggtaacwgttgtgggaggaggaggggtctgacagatagccggatgattttaatgtttatattccactggggtaagctctaacaaagacccatcatttcccagataac

SEQ ID NO: 42177 - DNA, 201 bp, Homo sapiens
gggcagatgcagccattcagttgacttcctgtggacaccagagatgacaggcccctgtccccagcttaccatccagcatataaggcatatatgcccctttscatgaagtataatctaatgagaacagttggagaaggtcaggcaaaggggacaggacaggaactcaggaggaggggatatttagacttacagacctgccct

SEQ ID NO: 42178 - DNA, 201 bp, Homo sapiens
aggagcagaggacaggatggctttctttccagtataataaagacagtgcctccttccaggacaacggtttggcagatttgcttgataaaggttggggtttstaagcttggggctcctcagccatgactgaaacgtactatgagcacggcatctaccgggctgttccacatcctccctgtgggactaggggccagggcaatg

SEQ ID NO: 42179 - DNA, 201 bp, Homo sapiens
ctgtcttcattcaacaaatatatttcggtctctgttagatacagtgtatctctgttagatacagagcattctgttagatacagagaatctctggtagatayaaagtattctgctattctgatcttcctgttagaagatcagatttacagaagtctacatttgctctcaagggaccttcagtctgtttggagcaatctcttt

SEQ ID NO: 42180 - DNA, 201 bp, Homo sapiens
ggctctccatccttcaaaatccagctcttggcctcatatcttccacaaagccttcccagacctttactcacctgggccattaatcaccttccctctcagtyagctcctacaccatgagtgcttttgtatggtgactgtctggttacaaggtcatcttttcccctggatgagacgccccttggggaaaggaccaagttttat

SEQ ID NO: 42181 - DNA, 201 bp, Homo sapiens
tccatccttcaaaatccagctcttggcctcatatcttccacaaagccttcccagacctttactcacctgggccattaatcaccttccctctcagtcagctsctacaccatgagtgcttttgtatggtgactgtctggttacaaggtcatcttttcccctggatgagacgccccttggggaaaggaccaagttttattccct

SEQ ID NO: 42182 - DNA, 201 bp, Homo sapiens
ggcctcatatcttccacaaagccttcccagacctttactcacctgggccattaatcaccttccctctcagtcagctcctacaccatgagtgcttttgtatsgtgactgtctggttacaaggtcatcttttcccctggatgagacgccccttggggaaaggaccaagttttattccctgtttaaccttggcctgacaaccta

SEQ ID NO: 42183 - DNA, 201 bp, Homo sapiens
gaaggcaatactattatgctcattcataattaaggcaattgaagcccagacccttccagtagctttcctgaagtcaagttgccagtgcattggacatactrggctgtagttccagggcagcctggctctggtgtctttgctgcaatgacaatatctccccatttctctgtttaaataccacacactccccatatggtttct

SEQ ID NO: 42184 - DNA, 201 bp, Homo sapiens
gccacaacagcctcttcttttctcttaaatcttccagcaattcttcaactttgcctgtatatttatcatacaacataatcctagtatttagtaaatgcttrgtctttgatttcttattttcaaatgcatgtctttagaaccagaatgtgtgtagctgttttctggcctgaatttgggctgagatgatgagaagtttagttg

SEQ ID NO: 42185 - DNA, 201 bp, Homo sapiens
attctggaacacgaaggaggtatgaaaagggcttcactcgtttcatggaaaagctcagaacagtttgtcgacttggaaacacaggccctgacagcgtaccmaggtcaccctgcccttcaatcctgctgatagcccaagttaacatcctcccatgccttggccttcccagaacaaacatggctttggacgcctttgggtggt

SEQ ID NO: 42186 - DNA, 201 bp, Homo sapiens
gcaagaattctggaacacgaaggaggtatgaaaagggcttcactcgtttcatggaaaagctcagaacagtttgtcgacttggaaacacaggccctgacagygtaccaaggtcaccctgcccttcaatcctgctgatagcccaagttaacatcctcccatgccttggccttcccagaacaaacatggctttggacgcctttg

SEQ ID NO: 42187 - DNA, 201 bp, Homo sapiens
atggcaagaattctggaacacgaaggaggtatgaaaagggcttcactcgtttcatggaaaagctcagaacagtttgtcgacttggaaacacaggccctgasagcgtaccaaggtcaccctgcccttcaatcctgctgatagcccaagttaacatcctcccatgccttggccttcccagaacaaacatggctttggacgcct

SEQ ID NO: 42188 - DNA, 201 bp, Homo sapiens
ttcaaaagttgctgccttccaaggggaaaaggtctggtcttgtaatttctggtctgtgcgtgctgtataaggaagaaggtttgggtagggaagcaacagastacccactagtgagagggaggacaccgctggtctgtgctcaacagccaggccagcaccacatgaataaagcatgatggcaattgcctgactctgtcctcg

SEQ ID NO: 42189 - DNA, 201 bp, Homo sapiens
tgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaa

SEQ ID NO: 42190 - DNA, 201 bp, Homo sapiens
tacagagaataggagagaaaatagagctccaaggtggaggaaaagacaactgagaggaggctattgtgatgttttattaccataaactgccaagggttagycgtagccctccatctgccagctaattccggtttcattaatatgaatattctcacgcttccagaaggaaattcttggaatgttatggatctctgtagcagg

SEQ ID NO: 42191 - DNA, 201 bp, Homo sapiens
cttcagtgctttttcaggactatgttatagaatacttatggggcatacgtgtaaatgaactgtcaaccttaaaatctaaacaaacagcttgtttgtggttygtcctgaaatcctccctgctcacaaaacagccagctacttggttttctaaaagacgtaattttgcaggcagacttcgtagagccattctgtgcagaagaa

SEQ ID NO: 42192 - DNA, 201 bp, Homo sapiens
gatctctgtagcaggcacatgcaacgtccagtgcttccctgctggtaatgtggcggttttattatgcatgccatacccatgctctctatttcctcgatagrccttatagaaatcaccatgcttccttttagaagaaaatgatggtatcacatggagaacgagctgaggagcttgacaatcttggcaaggcttatcaaaaga

SEQ ID NO: 42193 - DNA, 201 bp, Homo sapiens
ttttttttttttttttcttcagtgctttttcaggactatgttatagaatacttatggggcatacgtgtaaatgaactgtcaaccttaaaatctaaacaaamagcttgtttgtggttcgtcctgaaatcctccctgctcacaaaacagccagctacttggttttctaaaagacgtaattttgcaggcagacttcgtagagcc

SEQ ID NO: 42194 - DNA, 201 bp, Homo sapiens
gaagcacacacagctgttatcttccagaaacactgcttacagaggtaattgctcacagattttagggtttacagcaggtatcacaggatttcaaatttaaraggggggtgggggcctgtgttcaaagtcttaagaatatccaagggatgtatgatgtatgcataattacctgaaattgaaactactgtagtttaaacactt

SEQ ID NO: 42195 - DNA, 201 bp, Homo sapiens
gccagcgctcatttaattttacataaacatgctctttgaagctgaagcaaatgtgaccgattttcaaagtgataataaaatataaaaacagttcttggaawtatttctgaacagaactaacatcagaatcatctgaatcatcagaattgtgtattttggaaaaatcggattcatcaaatgaatcttcagccaacaactgtt

SEQ ID NO: 42196 - DNA, 201 bp, Homo sapiens
tgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctatt

SEQ ID NO: 42197 - DNA, 201 bp, Homo sapiens
aacatgatcccacttaatcctccacttcacaattctgaaaagtcaacaaatttggcccatggtagagaggaggaaaccaagacttgaaacattaaataacrtgtccaaagtctcccatttcagagacaggggcatttggctccaggtttttctgactctagacagtagtttgtttttagcacatcaaatgtctgagacttg

SEQ ID NO: 42198 - DNA, 201 bp, Homo sapiens
ggtaaaatcaacaagatttggccaacagctctgaaggggatgacaggcgtggtgaatggagaaggaaggacagaaggctagtttgggacttctggcttggmcagtgtattgtgtagtggaaccatcgctgaagataggaggagtccttttcagtcatactgaattcatgacgcctgtggggcacccaagtggaagtcatcc

SEQ ID NO: 42199 - DNA, 201 bp, Homo sapiens
ggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagaca

SEQ ID NO: 42200 - DNA, 201 bp, Homo sapiens
ttactgtaaggtatctaagacttctgggtgtgggttttaaatatattttggatgagctttgttcatgtttacacatggccaccaggtcggccacaaagctrtggctctggtcagtctgactctctttagcaggaatcacgtgacaatctgtgtctgtgattagctccgtggatattactaggtagatttctcacttgtcct

SEQ ID NO: 42201 - DNA, 201 bp, Homo sapiens
atcctatgccaaacttcctagcctccacctgtaccctgaattggccctagcctagttttccaaactttatccccaggtggttgaactttctaagtttcccsaagctgatcagtgttttggggtggtatggaactcagaatagatcactttttttattgactaactctgaccataagtatgcttctgtgcgagcctgacctc

SEQ ID NO: 42202 - DNA, 201 bp, Homo sapiens
agaggacagagtgggtggcacaggcattgcggaggcagaaatttacgtggcttccatgcccattggtgtgaggagtgaggggtgatcagggatcccagtgrcttgaaagtataacaaaagtatgactagatccaggaaatacagctggagagacccaagtctgcacagaaaaggtttacagagcccaggcacacagatgac

SEQ ID NO: 42203 - DNA, 201 bp, Homo sapiens
aggttgaaggaatgagtgcgtgtatcttgtcaaaggaaatcacaagcccatgtaaactcgctcttgcttccgtcacctcgtgctttgaaacataaccacartgtgctgaggtttcacattgttacatcctacaagcgtgcttacctgcatcaccttgctgggctgtttcagcattggaatatcactgggaatctcaagttc

SEQ ID NO: 42204 - DNA, 201 bp, Homo sapiens
gagcctcacactccctggacaaagacatgaaaaactctggatgatttggaagggagatctagaaatggtgaaaggactggcaagtgcctctgtgctgataytgtacctgggctcagtggtctggctaaaggagaggtgctggggccaggtgacaggcgagtctctatacggcaggcccaaaaaatggaggtgcaggcttca

SEQ ID NO: 42205 - DNA, 201 bp, Homo sapiens
tcctcctccttccccctccttccccctctctttttccttttctttctatcatcatccatagctctcttgccccattgttttaaacccatctgtttttgttkctggtaactgtatccaaaagtaatacagaattttccgtaagaacatttattgtgtttccttctacccacgaattttcttatgctacacacacaacccact

SEQ ID NO: 42206 - DNA, 201 bp, Homo sapiens
tccccagtaaccagtacagtgccagatacagagtagtaaccctacattctagcgtaggcaaatattctagtatttgccaaaactagaggatgaatgagtgrtgggtaagagagttctcagaaaaatggatataaacaatattgtaaatcatatttggaaaataaatactagaatcattgaatccctgagttatagaaaaat

SEQ ID NO: 42207 - DNA, 201 bp, Homo sapiens
aaattaggttatatgcgtgaagttcgtagagccagggtctgggcattaatacgcatttagttactgtcgctcctgtgatctgcacaattattgtcattatyttcccttcctcctccttccccctccttccccctctctttttccttttctttctatcatcatccatagctctcttgccccattgttttaaacccatctgtt

SEQ ID NO: 42208 - DNA, 201 bp, Homo sapiens
tgtcacatttaaaaatgaaatttttcttgaaaatgttcacatccttcccccagaaattctagatttataaatttctcccaaggaaatcattaggtgctacmtgaaagtttatgtatcaggtaatgatcacaaaattataatcacaaattaaaatagccataatgtctaataattcgacattagtgacagagatgatactac

SEQ ID NO: 42209 - DNA, 201 bp, Homo sapiens
aaatctcataatgttttaagaaagtttatgaatttgtgttgggccagattcaaagttgtcctgggccgcatgtggcccaccagccatggtttggacaagcytagtctacaggttcttcaagaggggcttgagcatttgaaagacttctagtgggagagatcacaaggtacaagtagaaaatcctgggctggcctgagaggc

SEQ ID NO: 42210 - DNA, 201 bp, Homo sapiens
tttttttttttttttttttttttttactttcaccaggtatttttttgtggagtatgcatttaattcacatttacaaattggtttctgtttttaactaaagrtactttttcagcagaaatgatgtgtatgatgtcatatctaacttgtgatctcactggtatttgatgttaagcctcaaaatcatcaaattttttttacggc

SEQ ID NO: 42211 - DNA, 201 bp, Homo sapiens
ctataaatctttctgctataaagacacatgcacacatatgtttattgcggcattattcacaatagcaaagacttggaaccaacccaaatgtccaacagtgrtagactggattaagaaaatgtggcctttgcctcttttaaaaagttctaagttgctagccagtcggaacaaatacagaatgtgaggtccctttccagccaa

SEQ ID NO: 42212 - DNA, 201 bp, Homo sapiens
tggctgcacataatatacaattgttgatgagctaaaaaaaaaaaaatccccaaaaaatctcataatgttttaagaaagtttatgaatttgtgttgggccasattcaaagttgtcctgggccgcatgtggcccaccagccatggtttggacaagcttagtctacaggttcttcaagaggggcttgagcatttgaaagacttc

SEQ ID NO: 42213 - DNA, 201 bp, Homo sapiens
gtcgaagcagaaaggagttgcagcttctggccagtagaattaattatttattatccttttcataaatactttccgaggccgacataactgaaaattgctcrggctgtttgaaaacacacacacacagttttccagtggctaatttgaaaaatgtcaccgtattagttttcatttacatctgtcaggaaacatatctataca

SEQ ID NO: 42214 - DNA, 201 bp, Homo sapiens
catcctcagaactcctcccagtgcctctcaatggctaaaccaaccaaaggttggagctcaaggaagctcctgaggctatctttacaggtcagccagttggraacagagttgacggagaggggacaggaggtgactagatttggaaggaaaattagaaaacttttggccgggcatggtggctcatgcctgtaatcccagcac

SEQ ID NO: 42215 - DNA, 201 bp, Homo sapiens
agaaattaagcagaaaacagaggtctcaatttgccttttcagcgtgaatgcagactcttacattcagtgctgggagtctttcttgagggacagtgagagcraggaagggtttccattctccgagatggatggttgcattagtatttatttcctttttgtttttccttaggatgagaaagaaggcagtggagcccttttcct

SEQ ID NO: 42216 - DNA, 201 bp, Homo sapiens
atactgagatcctggtgtgcacaggaaaagagctaacctttgtggatgaaattgtagagtcactacctgcatttgctgtagctcttacaattattttattyttggaagacatcgagagcatggtccaaagctgcataggttgcaagtgggtagaggcagaatttctctccaggcctggtggattctaaagctgtttactct

SEQ ID NO: 42217 - DNA, 201 bp, Homo sapiens
gtgaccctgtagaatgcactgaagcaaaaataacaggtaatgctaatcataaagttttacaaatctcctgaagagtcttgttggtttccgtgttgatgaarcaggaaatttccctgacccctttgcaggcaggaagtggagtgcggatgctggaactagctggctgctttggtgccagtagaggtgaactgcactctcttg

SEQ ID NO: 42218 - DNA, 201 bp, Homo sapiens
gaatgctgttaataagagaaatgaaaggatgatgggagatgtgcacccagcaatgtctgtcttgtggtcctgaagtctaactctaatcctggctccactayctggaccatgacaggttgtttaattgttctagttagagtgttctcctatgtaaatagggataataattggatgtatggcaggatttgggggaggattaaa

SEQ ID NO: 42219 - DNA, 201 bp, Homo sapiens
aagtggatttaaaattactttttactgctaatggggcatctgtcttcattcaacaaatatatttcggtctctgttagatacagtgtatctctgttagatasagagcattctgttagatacagagaatctctggtagatacaaagtattctgctattctgatcttcctgttagaagatcagatttacagaagtctacatttg

SEQ ID NO: 42220 - DNA, 201 bp, Homo sapiens
ttcaccgtgttaggcaggatggtctcgatctcctgacctcgtgatccacccacctcggcctcccaaagtgctgggattataggtgtgagccaccatgcccrgccctcagagtgttttaaaatgcatactattaaatacctaggattataaagggagccagctatacttacatatagttctctctgtgaccctgtagaatgc

SEQ ID NO: 42221 - DNA, 201 bp, Homo sapiens
cgaatcacagttgtaattcacatttttctccaccaattctgataacttgcattaagaaattgactgtgtaagttaaattttagatcaataatgcaaattgsaagacctagtacaggccaaggcctcattatatctgagtagggctttaagaaagcaagaaagaatcgcttgaacctgggaagcggaggttgcagtgagttg

SEQ ID NO: 42222 - DNA, 201 bp, Homo sapiens
tttcaccgtgttaggcaggatggtctcgatctcctgacctcgtgatccacccacctcggcctcccaaagtgctgggattataggtgtgagccaccatgccmagccctcagagtgttttaaaatgcatactattaaatacctaggattataaagggagccagctatacttacatatagttctctctgtgaccctgtagaatg

SEQ ID NO: 42223 - DNA, 201 bp, Homo sapiens
tatatatatatatatatagttataatgtggtgggttctcgaatcacagttgtaattcacatttttctccaccaattctgataacttgcattaagaaattgmctgtgtaagttaaattttagatcaataatgcaaattggaagacctagtacaggccaaggcctcattatatctgagtagggctttaagaaagcaagaaaga

SEQ ID NO: 42224 - DNA, 201 bp, Homo sapiens
acacctggcaattttttttttatttttagtagagatggggtttcaccgtgttaggcaggatggtctcgatctcctgacctcgtgatccacccacctcggcytcccaaagtgctgggattataggtgtgagccaccatgcccagccctcagagtgttttaaaatgcatactattaaatacctaggattataaagggagccag

SEQ ID NO: 42225 - DNA, 201 bp, Homo sapiens
gtatgtgggcccatttgccatgtgtgtgtgtgtgtctgtctatctatctatctatgtatatatatatatatatatatatatatatatatatatatatatasttataatgtggtgggttctcgaatcacagttgtaattcacatttttctccaccaattctgataacttgcattaagaaattgactgtgtaagttaaatttt

SEQ ID NO: 42226 - DNA, 201 bp, Homo sapiens
catgccatcacacctggcaattttttttttatttttagtagagatggggtttcaccgtgttaggcaggatggtctcgatctcctgacctcgtgatccaccsacctcggcctcccaaagtgctgggattataggtgtgagccaccatgcccagccctcagagtgttttaaaatgcatactattaaatacctaggattataaa

SEQ ID NO: 42227 - DNA, 201 bp, Homo sapiens
cagattggtatcatgctttatgtgtgttcattctagtcctgcacgtgtagaaatgtaagattttaatgtatggtaaggtagatagatagatacatacatasatacatacatacatacatacatacatacatataaaattaggtaagaggatacttttaatgtatggtaagctatgattgcaccactgcattctagcctagg

SEQ ID NO: 42228 - DNA, 201 bp, Homo sapiens
cgatgtgttgttttctttgttcttttttttgagacagggttttgctgtcacccaggctggagtgcagtggcagagtctctgtgcactgcagcctccgcctyccaggttcaagtgatcctcctacctcagcctcctgagtagctgggactacagttgtgcgctaccacacctggctaccgtgtcttgttttcaatgcagtat

SEQ ID NO: 42229 - DNA, 201 bp, Homo sapiens
gcatagaatgtttatatggtggccaaaaaagcagattggtatcatgctttatgtgtgttcattctagtcctgcacgtgtagaaatgtaagattttaatgtrtggtaaggtagatagatagatacatacatacatacatacatacatacatacatacatacatataaaattaggtaagaggatacttttaatgtatggtaag

SEQ ID NO: 42230 - DNA, 201 bp, Homo sapiens
aaagtcatatcttacatggttggcagcaggcaaagagtgagcttgtgcagggaaactcccccttataaaaccatccgatctcgtgagacttgttcactatsacgagtaaagcacaggaaagacttgccctcatgattcagttacgttccaccggggccctcccacaacacatgggaattgtgggagcgacagttcaagatg

SEQ ID NO: 42231 - DNA, 201 bp, Homo sapiens
aaaaaaaaaattagttatctctgccctttgggaggctgaggcaggtggatcacttgaggtcaggagtttgaacctagcctgggcaacatggtgaaaccccrtctgtagcaaacatacaaaaattagctgggtgtggtggcgtgcctgtaatcccagctattggggaggctgaggcaggagaatcactcgaacccgggaggt

SEQ ID NO: 42232 - DNA, 201 bp, Homo sapiens
cctcttcattgtccccttcatacaaatagatagcttttagtgagcagctactctgcctggcactgttctaaacacatgacaccaatagctcactcagattsccgcctctcaacagggaaactgaagcacaggaagtttcagtgatgcacttaggcaaccagtaagtggcagggtcggcattgaggtcaagactggttggac

SEQ ID NO: 42233 - DNA, 201 bp, Homo sapiens
aacagaatatcctaatcttgcaagtggcatatcatgttccttcttttttaagagagaaggagaaattcctgcagatcatcagggactgaggctaactgaarctttggaatggatacagtgctactctcagctgaaagcacaaatcacttccatcacgtatatgagattcctacttgcagcactgcagaggggtgataagca

SEQ ID NO: 42234 - DNA, 201 bp, Homo sapiens
attctacggtggctctttacccattgccatcattttgtaggcagtgagtgcccgcatcagtgggcgttttatgttgcaccattttctgagcaatgtctttsgtccaccattaagcatttgtggccgcccaccccacaatatgctttgctttctgctttcagaaacaatactggtgacctgttttaagaaaagctgaaaagc

SEQ ID NO: 42235 - DNA, 201 bp, Homo sapiens
ggggttgccagagaacttacacaggagcgtttctgctggaatcagctcgatgcctcttgaggacagagactcccagaggaaggagcgggcagccatccttrctgtgctgcagcctccacaggtgacacctcctggtgtgggagggacccaggtgaacagggtctggagtagacccccagcaaactacagcagtgttactgg

SEQ ID NO: 42236 - DNA, 201 bp, Homo sapiens
ccaaagcctgtgtttttcttgctcacatgtgagtcttctccttgcttcaaccctccccgctgacagccacaagactctgcctccctgcagcctgtggaacrtaatattcgttgggatcatacattgaccaaagatccgccatgtctttgcaactaacatactcactcatgacttcacgtggctatgtacaagaccacatct

SEQ ID NO: 42237 - DNA, 201 bp, Homo sapiens
ccatgctcaggagatgtcagccttttccattgtctccccgcccccaccgccagccctgcttaaattatcccctctttttaaacagaatatcctaatcttgsaagtggcatatcatgttccttcttttttaagagagaaggagaaattcctgcagatcatcagggactgaggctaactgaaactttggaatggatacagtgc

SEQ ID NO: 42238 - DNA, 201 bp, Homo sapiens
agatttggagtcagatgtcatattcctgccagcaggtttagcagtcgtgggactagggaagtggcaatggcaggagcaactggaaatgtcttttttttttyctcctttttcctgaatatggaaccaaagcctgtgtttttcttgctcacatgtgagtcttctccttgcttcaaccctccccgctgacagccacaagactct

SEQ ID NO: 42239 - DNA, 201 bp, Homo sapiens
tcctttcacaataaccctatccttactgttgaagacttgtggaaaagggacatggcccagggaaccagagtggtttgggaaagcactttgtcaagaggctkggggaccccagggtggaagctgccatgcgcatgaggctgtgttagcagaggcagtggcagaagaagacattgcaaacctgcaaaagcaacctctgaggat

SEQ ID NO: 42240 - DNA, 201 bp, Homo sapiens
aaccctccctaagcagctattgagcctcacactccctggacaaagacatgaaaaactctggatgatttggaagggagatctagaaatggtgaaaggactgscaagtgcctctgtgctgatattgtacctgggctcagtggtctggctaaaggagaggtgctggggccaggtgacaggcgagtctctatacggcaggcccaa

SEQ ID NO: 42241 - DNA, 201 bp, Homo sapiens
cctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactggcaagtgcctctgtgctgatat

SEQ ID NO: 42242 - DNA, 201 bp, Homo sapiens
cattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagaga

SEQ ID NO: 42243 - DNA, 201 bp, Homo sapiens
ccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctat

SEQ ID NO: 42244 - DNA, 201 bp, Homo sapiens
aagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagac

SEQ ID NO: 42245 - DNA, 201 bp, Homo sapiens
cactatgccagcaaagttgagtagttgggatggagactgtatggcccataaagcctaaaatactctctgctcctttccagaaagcttggcaacccctactrtcatctccacgtctgcctttgttcttcttatttgtcccttccctctgaaggcaggatagcatagggtgaccataagactctctggaactagcctgcttga

SEQ ID NO: 42246 - DNA, 201 bp, Homo sapiens
ttcttatttggagatgctgttcctctcaagtgggaaaaatttggttatctcaggtggtaaagatgcctttgtttaaaatattcttctgttagtggggacawtaatactactaatttctagtactgacgcttctcatgcaatttaatcagtaggaacctgtttgcatgttcatttgaggaagtaccaaagccaaaagtagct

SEQ ID NO: 42247 - DNA, 201 bp, Homo sapiens
taaaaattgtatgaaattcaaatttcagtgttcataactaaattttaaaaacttttattgaagttccagagagatctgaagtagttttattggaacacagycctacacaccttcatttataagctatctgtggctacttttgcactatgccagcaaagttgagtagttgggatggagactgtatggcccataaagcctaaa

SEQ ID NO: 42248 - DNA, 201 bp, Homo sapiens
tgcaaatgtgtgaggaattatagttgaaaggggaaagaacatttcagtttttcatttcctgcgtcactgtttttcttatttggagatgctgttcctctcamgtgggaaaaatttggttatctcaggtggtaaagatgcctttgtttaaaatattcttctgttagtggggacaataatactactaatttctagtactgacgc

SEQ ID NO: 42249 - DNA, 201 bp, Homo sapiens
gcatggtggtgcatgcctgtaatcccagctacttgggaggctgaggcaggagaattgcttgagtctgggaggcggaggttgcagtcagctgagattgtgcygttgcactccagcctgggcaacaagagcgaaactccatgtcaaaaaaaaaaaaacaacaaaaaacacgaatatctttttttgtcagctccatgagggcac

SEQ ID NO: 42250 - DNA, 201 bp, Homo sapiens
caagaagtgtgttttggggaaacactccaggtagtggtacatagaatcctagcacaagatcagtgactgggtgagtttgacattgtagatgcaaatgtgtsaggaattatagttgaaaggggaaagaacatttcagtttttcatttcctgcgtcactgtttttcttatttggagatgctgttcctctcaagtgggaaaaat

SEQ ID NO: 42251 - DNA, 201 bp, Homo sapiens
gggaggctgaggcaggtggatcatgaggtcaggagttcgagaccagcctgaccaacatggagaaaccccgtctctactaaaaatacaaaattagccgggcrtggtggtgcatgcctgtaatcccagctacttgggaggctgaggcaggagaattgcttgagtctgggaggcggaggttgcagtcagctgagattgtgccgt

SEQ ID NO: 42252 - DNA, 201 bp, Homo sapiens
gaggccttcctgaaatgtgttgtcaggcttgctcctgtgtgatggctggcactggttttatgctttccaattattctttgcacatcgttatttattattaytgttattattatttgacatggagtcttgatctgttaccaggctgcagtgcagtggcatgatctcggctcaccacaacttcagactcccagggttaagcga

SEQ ID NO: 42253 - DNA, 201 bp, Homo sapiens
aggagggactcataggacagcctagcatctgaggaaatgagtgcctcctggcccagaatgggggatctcagcagcacactacaatatccactacagtttcytgggcttgctctgaagccatgcctctctaacttcagggtatattcatgtaagtgaggtgcagggatgggggaaagggagaaggtaaagctacaaaggtaa

SEQ ID NO: 42254 - DNA, 201 bp, Homo sapiens
cgcccggccagagggctattctttgtcttttatttgctttgagtctggtataaccatgtggcacatacccctgtacatgtttgccaagactgctatatggyagagcttggaattcttaggagctttatcaggtaattgcaagtcccccacctccaagaaagcactctctaggtcaagaatcagcaaatgttttctatagag

SEQ ID NO: 42255 - DNA, 201 bp, Homo sapiens
tgtaaccaattaccaatctgaaaatccttgaatccacctgatatggtttggctgcatccccaccccaaatctcatcttgaattgtaatccccacaatcccsacatgtcaagggagagaccaggtggatgtaattgaatcatatactcccgatagtgagttctcacgtgatccgatggttataaataagtgtttggtagttt

SEQ ID NO: 42256 - DNA, 201 bp, Homo sapiens
agtcccagctactcgggagactgaggcaggagaatggcatgaacctgggaggcagaggtagcagtgagccaagatcgtgccactgcatcccagcctgggcracagagtgagactccgtctcaaaaaaaaaaaaaaaaaaaaaagataatgatgaaaataatagaatattgatgagaacacccattactctgctcattgttc

SEQ ID NO: 42257 - DNA, 201 bp, Homo sapiens
gaacctttttgatgcctccaggcaatttcctacaagctctaatatcttcctctttactcccatatgtggtatctctggtaccctatatatcattcactcarctgtttgttttgaaccacttattttggcaagacttcttcagacaggagagccctgagagctcttcaaaggctgggcctgatggtgtttgtcagagaggtt

SEQ ID NO: 42258 - DNA, 201 bp, Homo sapiens
ggaaaaggtgctactggcatctagtgggcaaaggccagggatagtgctaaggatcctgcagtgcaaaggagcatgcccaccacaaaatatcagcagtgccsaggttgggaagctctgtgccattgtgcaaagattcaaggtggctatgtcacaggactggtacatgtccttttttttttttttttttttttgagacggagt

SEQ ID NO: 42259 - DNA, 201 bp, Homo sapiens
attccctgtaaattttgctccttcccacaaccccagtgagccccactctgtcccataattccctgtaaatctcactccttcccacaatccccactgagtcscattccttcccacaattccctgtaaatctcactccttcccacaatccccactgagccccactccttcccacaattcccagtgaaccccacttgtgtagtg

SEQ ID NO: 42260 - DNA, 201 bp, Homo sapiens
caaaacattcaagaggtgacttgggtgctgttaaaggcattcagttttataaaagaagcagagcatcaaggtttggaaaatttgcagtctgattgtgcgayagaaaagaaaaacccattttctggggagaaattcaagctggctgcagaaatttgtgtaagtggcaaggaacctaatgttaatctcgaagaccatgaggaa

SEQ ID NO: 42261 - DNA, 201 bp, Homo sapiens
ccatgtatgtgtcagtcctactatgcaccttacagctcactaaccctgtttaataatgtatgttgctacatttaatctttatggtagcctcatgaacaggytcttatttagttcagtggttcttgatcaggagtgatattgcctgccagggaatgcatgtcaatgtctggagacatctggggttgtcagttcaggagggta

SEQ ID NO: 42262 - DNA, 201 bp, Homo sapiens
aatgtctgcagggtaagcacactgttttgcactccacacaattcacttcacaatatttcatagagactttttcatattaatatataaagagatatatacgygtgctgcttcacgataatccattgcagagctggtctgtaatttattcaagcattctttgttgatggatgttagggttgtatccattattttgctattatg

SEQ ID NO: 42263 - DNA, 201 bp, Homo sapiens
ttccagagcgtcttcctgatgttgcatagagcactcacacctaacagatctcagaacttgtatcttttctgggtggctagactgaaaaatccattttcttrtgagtgagccagaggtctgtctcttgcggcatttctgcttttgagaacctcccgtttcctgaaaggcaccagaccccaagacagctctgctgcctgattg

SEQ ID NO: 42264 - DNA, 201 bp, Homo sapiens
ttagcattgtgataaataatatttaatatatagtaagggaggtcaaagtatgaactattttgattttttatgggtttttttttttttttttaaagaatgcrttgattttgtttttctttcttttttttttttttttttgaggcaggccttaggtctggcacccaggctggagtgcagtgacgtgatcaaggctcactgcag

SEQ ID NO: 42265 - DNA, 201 bp, Homo sapiens
gctataaagttttagctagacagcgaatcaaggtggcaacacatggtgggttcttaaataatagttgtcatttgagtgctttctatatgatgtacatttcmttttgcactttacaaataacctcttcctttttctgtttaatcttaaaaaagatcccgggaggcaggcgttattgtgcccatttcctggataaggagaatg

SEQ ID NO: 42266 - DNA, 201 bp, Homo sapiens
tatatataaattctgagtaagtattaaccaaagaaatggaacatcaatattggttcccagtctagttcacaggtgttatcaagatggttacctttctaagkgtctttttatttcactagttccaaaagagtatctctcaaaatattaggtagtatttagtcaacactttaacacataacttgtttttttttttggcataag

SEQ ID NO: 42267 - DNA, 201 bp, Homo sapiens
gtctactgaattatgtgggattcaacaggggatacaaatggatttgaattctgtaactgtcatattgtggtccggagagggtggaaactgaagtatccctytgcgtcgccacatctgtcaaaagtcctcagcgctccccgcaatccatgtctggtggaagcgcgaggtggtgaggatggaaagggcatgcgttgacttcat

SEQ ID NO: 42268 - DNA, 201 bp, Homo sapiens
agttcacagggatgccttcggtccagacactatgaccgttgacgaaggatttgaaatattttgagaactctgaaataatgcacaccagaaacgtccagctsaaaacaaaaagggaacaagatgacattttgcaatcccatgcacgttgcaggcgcgttgaatgtgaaggtcagtagtacttcagagggcaggcctgttgcc

SEQ ID NO: 42269 - DNA, 201 bp, Homo sapiens
ctttaaaaatacagcctgcttgccatctcacgacttttcccttaatgcaacaaagaaatatgtgtttggctgtgaaatctttttttttttttttttttttkttttttgctgtggagcgcaaaatgttcatttatctctggatggtttgtttctggccacctgccctaagtgtatctgaatattgtaacggtgatcacttct

SEQ ID NO: 42270 - DNA, 201 bp, Homo sapiens
tggtctcaaactcctgacctcaagtgatccacctgcctcacctcccaaagtgctgggattacagtcgtgagccaccgtgccggccactttcatctttctgwttaactgaaaagtatcaagcaatgcttacatgtaactgcactttctcatcaactgcaaccataatttagctatggatacaagagttgggcacaaatccat

SEQ ID NO: 42271 - DNA, 201 bp, Homo sapiens
aggtggatcacaaggtaaggggtttgagaccagcctggccaacatggtgaaaccccatctctattaaaaatacataaattagtcgggcatggtggcatgtrcctgtagtcccagctgctcaggaggctgaggcaggagaatcactcgaacccgggaggcagaggttgcagtgagcctagactgcaccattgtactccatcc

SEQ ID NO: 42272 - DNA, 201 bp, Homo sapiens
cttatgagtcacttatgcccttgaagagtgagtgatgtatcaaaatatgtctgtctttattgtttcactttcatccttctttttttggagatggagtcttsctctgttgaccatgctagaggtggcgcgatctccactcaccgcaagctccgcctcctgagttcaactgattctcctgcctccgcttcccaagtacctggg

SEQ ID NO: 42273 - DNA, 201 bp, Homo sapiens
cactttgagaggctgaggtaggtggatcacaaggtaaggggtttgagaccagcctggccaacatggtgaaaccccatctctattaaaaatacataaattastcgggcatggtggcatgtgcctgtagtcccagctgctcaggaggctgaggcaggagaatcactcgaacccgggaggcagaggttgcagtgagcctagact

SEQ ID NO: 42274 - DNA, 201 bp, Homo sapiens
tggaaaccagcccaggcaacatagtgagacctcatctctttaaaaaaaaaaaaaaaagaaagaaaaattagctggcatggtggcacatgcctgtagtcccmgcttctggggatgctgcagcgagccatgattgtgccactgctctctggcctgggcaacaaagagagatcctgtctccaagtctgtctgtctgtctgtctg

SEQ ID NO: 42275 - DNA, 201 bp, Homo sapiens
cctgtaatctcataatctcagcactttgagaggctgaggtaggtggatcacaaggtaaggggtttgagaccagcctggccaacatggtgaaaccccatctstattaaaaatacataaattagtcgggcatggtggcatgtgcctgtagtcccagctgctcaggaggctgaggcaggagaatcactcgaacccgggaggcag

SEQ ID NO: 42276 - DNA, 201 bp, Homo sapiens
ctatttacaccacggaaacaggcaaaaactactgatcaagccttcactgttttgtttatattgtcttgacttagaaagtgattgcaatgttaataatgcasattaaattgaagcgtacagtgcctataaaccattacattatgaatagtataaaaaattgaggaagccgtgtggctcacaaattcagcactttgggaggcc

SEQ ID NO: 42277 - DNA, 201 bp, Homo sapiens
aagttcaaagaaaggagtaaatcacgaccaggcacagtggctcgcgcctgtaatctcataatctcagcactttgagaggctgaggtaggtggatcacaagstaaggggtttgagaccagcctggccaacatggtgaaaccccatctctattaaaaatacataaattagtcgggcatggtggcatgtgcctgtagtcccagc

SEQ ID NO: 42278 - DNA, 201 bp, Homo sapiens
gcaagtaaagaattataattaagagaaccagaagggcctgtctctcaggaaagcagtgatttcctttcacaataaccctatccttactgttgaagacttgyggaaaagggacatggcccagggaaccagagtggtttgggaaagcactttgtcaagaggcttggggaccccagggtggaagctgccatgcgcatgaggctg

SEQ ID NO: 42279 - DNA, 201 bp, Homo sapiens
aagtagcgtcgacattatgaaatgcacaagaagttttcctgcccccaaccggtaactctctcctgcagtaatcaatgttggcacctgtttaaccacttttrtgtcttacgtgcacgctgttcggtactttgactttttttcttaatattataacatggaggccaggcgcggtggctcacgcctgtaatcccagcactttgg

SEQ ID NO: 42280 - DNA, 201 bp, Homo sapiens
ccaaagtgctgggattataggcttgaaccaccatccctggccttgatactgatattttattgtcctaactgacagttttgtctgcccagcattttcccccrtcacccttgtactatcccattttcctttgccatgcacctgtcttcctcttcaggattgatcacaaaatcaaaaccattcctaccagccagaggtgggcac

SEQ ID NO: 42281 - DNA, 201 bp, Homo sapiens
caaaccaggtgtcattgccctccccaccctaccttgctcccctggagtgtatcctgattcttttgaggatcacttgatcctgattttttttttatgtgtawagatgggatttcattatattgcccagactggtcttaaactcctggcctcaagcaatccagccacctcggcctcccaaagtgctgggattataggcttgaa

SEQ ID NO: 42282 - DNA, 201 bp, Homo sapiens
ggaggctgaggcaggagaatggcgtgaacctgggaggcggagcttgcagtgagccgagattgcgccactgcactccagcctgggcgacagagcaagactcygtctcaaaaaaaaaaaaaaaaaaaaaaaaaaaagtgccatgtatattttgattacaaaaaatttcatgcggtgttactttctttttattggtagagggtc

SEQ ID NO: 42283 - DNA, 201 bp, Homo sapiens
tggctgcctgcaagggaggctgggaaatatagtttgctgtgtgctgggtgggtgggagggagcgtccacattagtgaacagccaggcagtcgctgcctcamatttctttagggttatcctttcattccagcaattgaatttgatttgcactgtttcacttctctacaagggtgtaaaaagtagaggttcctcttgaaagaa

SEQ ID NO: 42284 - DNA, 201 bp, Homo sapiens
ccccgtctctactaaaaataacacaaaattagctgggcatggtggcgggcgcctgtagtcccagctactcgggaggctgaggcaggagaatggcgtgaacstgggaggcggagcttgcagtgagccgagattgcgccactgcactccagcctgggcgacagagcaagactccgtctcaaaaaaaaaaaaaaaaaaaaaaaa

SEQ ID NO: 42285 - DNA, 201 bp, Homo sapiens
cgaatatttgggacccactgggagtttgtgccaaaccaggtgtcattgccctccccaccctaccttgctcccctggagtgtatcctgattcttttgaggawcacttgatcctgattttttttttatgtgtatagatgggatttcattatattgcccagactggtcttaaactcctggcctcaagcaatccagccacctcgg

SEQ ID NO: 42286 - DNA, 201 bp, Homo sapiens
gagatcgagaccatcctggctaacacggtgaaaccccgtctctactaaaaataacacaaaattagctgggcatggtggcgggcgcctgtagtcccagctaytcgggaggctgaggcaggagaatggcgtgaacctgggaggcggagcttgcagtgagccgagattgcgccactgcactccagcctgggcgacagagcaaga

SEQ ID NO: 42287 - DNA, 201 bp, Homo sapiens
ctttagccaaggaagaaatgacaacgaatatttgggacccactgggagtttgtgccaaaccaggtgtcattgccctccccaccctaccttgctcccctggrgtgtatcctgattcttttgaggatcacttgatcctgattttttttttatgtgtatagatgggatttcattatattgcccagactggtcttaaactcctgg

SEQ ID NO: 42288 - DNA, 201 bp, Homo sapiens
aaagtcaatttggacactttaaaagtgagcctcaaaaaactgctgaattttcccaacattgtgttttgagcacttccacgtgactttggtagcataaagamtttagtcttttcaagaggcaaagtaatataccacttttcgcttttttaatggtgagagccaaggtcaatctgaatttttctttttctttcttcctttttt

SEQ ID NO: 42289 - DNA, 201 bp, Homo sapiens
tgagtctcagctgaccaagctctaaaatgagcataaccatatcagtttgtgtttcctgttacagggagaaaagactgagataactaaagtacctgattgastaactgctctctgaaggtggaggctggactgcttcactggacagggtggcctggggttattctagtgcagtggtagctggtgacaaaactcaaagaagat

SEQ ID NO: 42290 - DNA, 201 bp, Homo sapiens
caagggaacctttccccaaagcccctcaacacacttaggctgacatctccttgaccagaactgtatcaaatttacatagcctcaaatgaagcatctgggamcaccaggattgggtgtttaggccatggaagagtaacagcccagtacacaactgtctccagtggccagcacgtagaccttccctcacactttccactctct

SEQ ID NO: 42291 - DNA, 201 bp, Homo sapiens
taaggcagatggaaatgtcttgtaactcagtaaaacagtttagaaatttaaagcctttggagagagtaagtattgagaaggcacatctctacgttgttgaygtgaaggagttgcaaggtcgggtagatgggatcagtgccaggtctaatgggcttcatttgcaagacctaatttctagcagatcatggtgtaagcctcaaa

SEQ ID NO: 42292 - DNA, 201 bp, Homo sapiens
tgcttcttacgtgtcacgcactgtgataagtcctaggattatagaagtcaataagctatgatgcctatccttaaggagagaaacacatataggataggaamatagcttgccatgtctgatagatattaggcattcagtctctctctctctctctctctctctgtttattatagatagaaataaaaaaattataaatagaaa

SEQ ID NO: 42293 - DNA, 201 bp, Homo sapiens
ttatgtcattggctacaactcagtcacatgaccatggctgcctgcaagggaggctgggaaatatagtttgctgtgtgctgggtgggtgggagggagcgtcmacattagtgaacagccaggcagtcgctgcctcaaatttctttagggttatcctttcattccagcaattgaatttgatttgcactgtttcacttctctaca

SEQ ID NO: 42294 - DNA, 201 bp, Homo sapiens
tcagcttgttttgctcctgcatctttgcatcagctgggctttctgccctaggctggacatgggtggggcactttagctggggtggttctcctccacatgtstctcatcttcctgggaccagcagggctagaccagacatgactttcttatggcaagggcagaaatgcaagacagcaactcaaaacacataaggactttcaa

SEQ ID NO: 42295 - DNA, 201 bp, Homo sapiens
aggaggtcaggaagtcattgatgtgggctccctcctggagtgcgtgttgctttggtagggagctcgctttggctgtgggcagttcctgaggagggactcayaggacagcctagcatctgaggaaatgagtgcctcctggcccagaatgggggatctcagcagcacactacaatatccactacagtttcttgggcttgctct

SEQ ID NO: 42296 - DNA, 201 bp, Homo sapiens
ctgtgctgtgggagatgcgaatgctccagtcaatcccaaggaaactctgaagctggattattcttcagagatgcaaggaggtcaggaagtcattgatgtgsgctccctcctggagtgcgtgttgctttggtagggagctcgctttggctgtgggcagttcctgaggagggactcataggacagcctagcatctgaggaaat

SEQ ID NO: 42297 - DNA, 201 bp, Homo sapiens
actttttatttcctttgtggagtccagcccctttgcttattctcagcacaaaagaggcagtagagtgagaagaacgtgaacttcagagcccacccatcccktttcacatttgaatcgcaactctgtcattcaccagctgtgcatccttgggaaagtcacttagcctctctgagctctaatttcctcacagggccgcaggac

SEQ ID NO: 42298 - DNA, 201 bp, Homo sapiens
gcctctcactttttatttcctttgtggagtccagcccctttgcttattctcagcacaaaagaggcagtagagtgagaagaacgtgaacttcagagcccacscatcccttttcacatttgaatcgcaactctgtcattcaccagctgtgcatccttgggaaagtcacttagcctctctgagctctaatttcctcacagggcc

SEQ ID NO: 42299 - DNA, 201 bp, Homo sapiens
tgcttctagctggtcgaaggtcctgtgggagctcacgtttttctcaatcactgatgaccatttgagacataatttggagaaggtttctatcaaatcctagytggactgcagtgaaatgttttcaaactagagaagcaccaaataggccatgataaagaataaataccacctaccccaacctggcaaatgtgtgctcaccca

SEQ ID NO: 42300 - DNA, 201 bp, Homo sapiens
ttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcc

SEQ ID NO: 42301 - DNA, 201 bp, Homo sapiens
agaatataaaattttgttctattttattttaaagctctggttacatatggtcaagttgcttcccaaaaagcgtctctgtcaggatgatcttatgaacgacsttagtacctcaattttactgtcccatccttttttcctccttccttgcctccttccctctctgcctccttccttttcttcccatttccttccttccagcat

SEQ ID NO: 42302 - DNA, 201 bp, Homo sapiens
cagccctgcattcagggataccaacttgggtgctgaaaagcagcgatggcaggactatttacaccacggaaacaggcaaaaactactgatcaagccttcaytgttttgtttatattgtcttgacttagaaagtgattgcaatgttaataatgcagattaaattgaagcgtacagtgcctataaaccattacattatgaata

SEQ ID NO: 42303 - DNA, 201 bp, Homo sapiens
gcaggaactcgcttgaacccgggaggcggaggctgcagtgagctgagtttgcaccactgcattccagcattggtgacagagcgagactcagtctcaaaaamaaaaaataatataataataataataatcgcacctcaatactccgtagccattttaccgcatgtgactattagctgtgcttttgcggttatctacgtctgt

SEQ ID NO: 42304 - DNA, 201 bp, Homo sapiens
ctctactaaaaaatacaaaagttagccgagcgtgatggccagcacctgtagtcctagctacttaggtagctgaggcaggaactcgcttgaacccgggaggyggaggctgcagtgagctgagtttgcaccactgcattccagcattggtgacagagcgagactcagtctcaaaaaaaaaaaataatataataataataataa

SEQ ID NO: 42305 - DNA, 201 bp, Homo sapiens
ccagccctttgggaggccaaggcaggcagatcacctgaggtcagaaattcaagaccagcctggccaacatggcaaaaccctgtctctactaaaaaatacaraagttagccgagcgtgatggccagcacctgtagtcctagctacttaggtagctgaggcaggaactcgcttgaacccgggaggcggaggctgcagtgagct

SEQ ID NO: 42306 - DNA, 201 bp, Homo sapiens
cctacccaaggtctggtcattgctatacttgagttcttttcaggctcaagatctctacctttttgtgttttttttttttttgtacagagtcttgctctgtygtccaggctgtagtgcagtggaacaatctctgtatgctccctgcaacctctggctccaggtttaagtgattctcctgcctcagcctcccaagtagctgga

SEQ ID NO: 42307 - DNA, 201 bp, Homo sapiens
tttgactccctccacccccggaaggtatattcagagtctccaagactgcctccgcctactcacatgtttatggcccggtgagaccgcatcctccctttctmtatctgtcccttttctggatgcagggacacagaatcccctaagtgggaagagctttggagtggaggctgttcaaagttctgtggtgattaattattacct

SEQ ID NO: 42308 - DNA, 201 bp, Homo sapiens
attactatatatatatatatatacacatatatatatatacacacatatatatatatatatatacacacacacacacatatatatatatatatatatatatwtttttttttttttggagatggagttttactctgtcgcccaggctggagtacagtggcgcgatctgagctcactgcaacctctgcctcccaggttcaagca

SEQ ID NO: 42309 - DNA, 201 bp, Homo sapiens
gatacctagactctgctgggctctagagaagtgctgggctacagcgcccagtgccctacctcttggggccagccagcctcaccaaaaaatcaggcttctgkcttgctccaaactcaggaagttgctgggaagtctggctagcaacaccctcattcccagtcctggccatgcctctctgctctccctagcacagggagcatg

SEQ ID NO: 42310 - DNA, 201 bp, Homo sapiens
gatgttttattagggtggtgcaaacgtggtttttgccattactatatatatatatatatacacatatatatatatacacacatatatatatatatatatayacacacacacacatatatatatatatatatatatatttttttttttttttggagatggagttttactctgtcgcccaggctggagtacagtggcgcgatc

SEQ ID NO: 42311 - DNA, 201 bp, Homo sapiens
tagatttggcctgggcagcccagggagactgttcgagcactggatacctagactctgctgggctctagagaagtgctgggctacagcgcccagtgccctasctcttggggccagccagcctcaccaaaaaatcaggcttctggcttgctccaaactcaggaagttgctgggaagtctggctagcaacaccctcattcccag

SEQ ID NO: 42312 - DNA, 201 bp, Homo sapiens
tgtagcaataattaataagctggatagcctgatagcctgatgttttattagggtggtgcaaacgtggtttttgccattactatatatatatatatatacayatatatatatatacacacatatatatatatatatatacacacacacacacatatatatatatatatatatatatttttttttttttttggagatggagtt

SEQ ID NO: 42313 - DNA, 201 bp, Homo sapiens
tggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcag

SEQ ID NO: 42314 - DNA, 201 bp, Homo sapiens
gtttgatagatttcttttatgattaattctcctattaagttttaatgacttcaaagatacaaagctagaaactacaaaactaggcatggttaataaataastgaaataccaggtgtatagaaatgcatctgtggaaaaatgaaatcatatattctctaggatatattaggaaatggctctttggcaagtctagagggtaaa

SEQ ID NO: 42315 - DNA, 201 bp, Homo sapiens
atgtagcaataattaataagctggatagcctgatagcctgatgttttattagggtggtgcaaacgtggtttttgccattactatatatatatatatatacrcatatatatatatacacacatatatatatatatatatacacacacacacacatatatatatatatatatatatatttttttttttttttggagatggagt

SEQ ID NO: 42316 - DNA, 201 bp, Homo sapiens
tttgcatttttaaaactgaaagaacatttccacaccattagaaataagatttcttcttaaaaatattcacaaggtgcaaacacttacatgtgtatatgcaygatttcaccaccagggggcattgtggtttgactgtccagttaaagagcctgtgttctatcagtttacccagaaactagaaggcctgcgagtatttctgat

SEQ ID NO: 42317 - DNA, 201 bp, Homo sapiens
aaaacaaagctcattcctctaaaagaattggtatgtttttttttttttttttttggtggtggttgtttaatgaggaggacattataaagtattatatttcstttccttaccttggttgccaggaagctcagaactttaaacattaaaatgtttaagtaaccagctcacttcacgtttcggatcagctttctttttcttaac

SEQ ID NO: 42318 - DNA, 201 bp, Homo sapiens
aaaatggaaaactccaggggaagagggtctttacttagggagttggcatttgttggaatttcccaagaacatttcatgattagtgacaggttatcttctastttacctgaaggctatggtcactcaacaaattttgtgttgcttcttacgtgtcacgcactgtgataagtcctaggattatagaagtcaataagctatgat

SEQ ID NO: 42319 - DNA, 201 bp, Homo sapiens
aaataaagacttgtgaaggtaaaactgtagcttacagtgtgcgactgtttaccttcttttggtttcttctcatttaataggttggtcatctctctgctggstttttcccccttttttctcccttctgtagaataacatgtggaccattaactatgatgctacttcttagctgcaaggggggaaaaatggaaaactccaggg

SEQ ID NO: 42320 - DNA, 201 bp, Homo sapiens
ttaaaacaaaactgtgtagcagtgtgttatagccacaggaactcctcagccaaatgttaagttaatgcaatgaaaacatttgtaaaaacattatcaagctrcaaaagaactagaaatgctagatactccctagtagctgggtgttcaaaaacacttgtcattctcacagttatatttgtggtatcttagtggtcattcacc

SEQ ID NO: 42321 - DNA, 201 bp, Homo sapiens
agaggaggaggaggaacttctcaggaagaagtggcagttccctcctttgtttcttatctctactgtttagcagccactctccaaagcctcttgctgggaaygtggccatcatagaagtaaatgagacatctctttcatctgcaccaacctccttattaagaccttatcagttacctgtagattctcccactgttgtacttg

SEQ ID NO: 42322 - DNA, 201 bp, Homo sapiens
aaggccctgtttccaagtaaggtgacattctgaggtactgggcttaggacttcaacatatctttttggggggacacaattagaccaatagcaactgtgctrtaaaagagatgttgctttttatcattgatgctatccagatgcatagcaatcattcaacaagtcattcgaaagaaataggtatttcctgagggtctagtat

SEQ ID NO: 42323 - DNA, 201 bp, Homo sapiens
gaaacaattcagcaactctcttacagatttttatcatcatcccattcataattgattccaaacgtgcatgaatctttcaagataagtgtcttattgattaycctgaaaacaagcgatcacttggtgtcctgagattcgctcactgccctcccctgattaccgtaaacagagatgttgatgagaagaaatgtcactttcttt

SEQ ID NO: 42324 - DNA, 201 bp, Homo sapiens
tgaaaatgttttaagagttctttgtcttaccttaggttcctccaaaaacagaaccagagaaaaagacatatttatgcataatttgggatgtgattacaaasagagggatggggaattcaggaaggaaggagaggcaatataaaaatgtgttttttagttagtcattactagaggcaactagtgctcaactccaggcacttt

SEQ ID NO: 42325 - DNA, 201 bp, Homo sapiens
ccttttttagagataaagcctcaccctgttgcccaggctggagtgcagtggcgtgatcacagcccactgtagccttgacctcccaggctcaacctatcctyttacctcagcctcttgagtggctggaaccacaagcagatgccaccatgcctggctaactttttttttttttttttttttttgtagaaacagagtctctct

SEQ ID NO: 42326 - DNA, 201 bp, Homo sapiens
tgggcgtactggcaggcgcctataatcccagctactcgggaggctgaggcaggagaattgcttgaacccaggaggcggaggttgcagcgagctgagattgygccactgcactccagcccaggcgatagagtgagactctgtctctaaatacataaataaataaaagtagagagtaagttttctgtattgaaaatgttttaa

SEQ ID NO: 42327 - DNA, 201 bp, Homo sapiens
tatagcatctgaatttgaaaacctctactaattcatgaggcaatctatttgataatggcatgatttagttagtgttccttttttagagataaagcctcacyctgttgcccaggctggagtgcagtggcgtgatcacagcccactgtagccttgacctcccaggctcaacctatcctcttacctcagcctcttgagtggctg

SEQ ID NO: 42328 - DNA, 201 bp, Homo sapiens
aagtgctccgtaaatgtcagcatctattattatcatttgtgtttttttttccccttctctgccttcctttctctccctccttggtctgcttcctcctgttrctatcagagcctgcctgcctcatccttgttccagccttgatggtgatgatgattgtggttgctgttgctatttgtttttttggtttgtttgtttgttttg

SEQ ID NO: 42329 - DNA, 201 bp, Homo sapiens
tcaaatgcgcgtttaatcttcttaagctcaacttcatgcaagagacctaggaattcacagagtgaagatgatttctccattcccttctccgagcagagctsttgaagaagatgggagttaggagaagtgaatcttttgttttcgaagcctttgtccttgtgagtctcttaattggggtgtcttgtaatgcaaagtctttaa

SEQ ID NO: 42330 - DNA, 201 bp, Homo sapiens
ataagtctaatttagtagccagctaaaggatatctgtgaacccttcgcaaagagtaatctattgaaaaggaacaacaaaaaagtatatctgtgaacttatkaaatgactttaatcatatgaaaatcagccatcagccttattagagtggttgattttttttttaatctaagagctttcttggttattttctgttcttaatc

SEQ ID NO: 42331 - DNA, 201 bp, Homo sapiens
ataaatatttattgagtagtaagcacatgcaaggcattgagggtggggagggaaaaagacacaaattgtccttaccctcatggattcaccatctatttaamggccacaaatacttgtgtgagaagcaagtcttaatagtctgaagtattttcttagattcccttgagccgcaatgctgaaaagcttatggtggttttgcta

SEQ ID NO: 42332 - DNA, 201 bp, Homo sapiens
gaacaaattgccaaatgcaaggcctgagcaaaagacacagaaaggatttctttatcgtaagcacacttctctacattacctttataatccaacaactctgstattagtaaattatagaaacaacttttgtaacactatcttgtttgcagagtatatgaaaaatttgaagttaaaattcagctccacgaatactgcagtggt

SEQ ID NO: 42333 - DNA, 201 bp, Homo sapiens
agctcaccggggagtgtttctcccagttcctccccagtacacagaaaaacaaagctttctgtctcaccaggaggactccacggtgagcatagcttggctcmgcccagcaggagattttgaaccgactctggtagattcttcctgcagccattcagctcccacctctttctctcaaaaagaaatccagggctgggtgtgtgt

SEQ ID NO: 42334 - DNA, 201 bp, Homo sapiens
gttgcccctaggatcatttttttcaaagctaatgtctgccacaaatgggagttttaataggttataattcatatgacttagtgttaaacctctacgttggkattcttaaatttaacatggataaactgaacttgatttcctgcattaaaaaaaattaaagaaatgaaagttctgactgttttattgtagctggggaattct

SEQ ID NO: 42335 - DNA, 201 bp, Homo sapiens
gtatggggtggggaaggggggggggataaagatattaatttggaagcatttgattgctccattattttatcatcttcccatggaaatgttttcataacgcsttgttttttaattattattattattttttgagacagagtctcactgagtcgcccagggcggcggtgtgatctcggctcactgcaacctcagtctcccagg

SEQ ID NO: 42336 - DNA, 201 bp, Homo sapiens
tttgacaatagatgttagctaggagagataagaaatggagcaagggaggggtttcatcccgccgtgttcatttgcttggctgtcctgaaattgcgaatacrcagttgttacctgctcccggtgggaggggggggatatttatttggcatcttgcaattgataggagctgagtgattttagtaggtagtttaactccttaaa

SEQ ID NO: 42337 - DNA, 201 bp, Homo sapiens
tggaagagttgacagagatttgcaggtgaaaaagaaaagaaaaaaaatacagatacgtgtatatatagagaaagacaaaaacttgtctgctagaaacctasggagagagatggtattgcccctgggacattggactttctgtttccagcatggtctgtcgtcttccataatggcatttaattttggaaaaattgcctgagc

SEQ ID NO: 42338 - DNA, 201 bp, Homo sapiens
ttttggattctgtgtggaagagttgacagagatttgcaggtgaaaaagaaaagaaaaaaaatacagatacgtgtatatatagagaaagacaaaaacttgtstgctagaaacctagggagagagatggtattgcccctgggacattggactttctgtttccagcatggtctgtcgtcttccataatggcatttaattttgga

SEQ ID NO: 42339 - DNA, 201 bp, Homo sapiens
gatagtaggtaaattaatggaggaagggagtcaactaaacaatttatttgagcaattaatggaggaagggagtcaactaaacaatttattagggctttatktaaagccctagggttagttggttggttggttttgttttgttttgttcctttttttttttgccaggggatgctgtggttgaatttccctctgtggtgagag

SEQ ID NO: 42340 - DNA, 201 bp, Homo sapiens
gtgattttgataaactaaatgcatctttaattttactcacagcaaagcgattctttattttctctctaaaagcataattgatgtgccatgatctttgtctktgcatttttaaaactgaaagaacatttccacaccattagaaataagatttcttcttaaaaatattcacaaggtgcaaacacttacatgtgtatatgcatg

SEQ ID NO: 42341 - DNA, 201 bp, Homo sapiens
gcagtgatgtctatgacactgggcaagtgtcttaaaatgttgtgcatcagaaaaaagtcatcattgccaaggccagcagatctcgaaaagggggctgggayacgttggtgatttttttcatgctctacttacagtatgactcgtaactgttaatggctgagctcctccttaggtgaagaaggaaggcaatggcgttttcta

SEQ ID NO: 42342 - DNA, 201 bp, Homo sapiens
tgaaaaacttttttggagcagcacctgcatgttgtaaaaacacaaaataaaaaaaaaataaataaaagcagaccccttggttcagatatctttgtttgtgwaaatgttttggcattctttgtgaaaatcttcagattttcaagagcttaagatgacctcctctagccggctgcagcagtgtctaggtatctgtgaatgtgt

SEQ ID NO: 42343 - DNA, 201 bp, Homo sapiens
gtttatgccactgcaacattttagaatcacctgggaagcttttgaaaactcccagcatcatgaagcatggtctcttgccttggggtcagtgtctgtcaacrtggcttttgctaaagagccttcccctatgagaagtgaggcaggagaaggcggagtgaccacaagatgccctgatggtgccaagctattattataaatgaa

SEQ ID NO: 42344 - DNA, 201 bp, Homo sapiens
agtttatgccactgcaacattttagaatcacctgggaagcttttgaaaactcccagcatcatgaagcatggtctcttgccttggggtcagtgtctgtcaaygtggcttttgctaaagagccttcccctatgagaagtgaggcaggagaaggcggagtgaccacaagatgccctgatggtgccaagctattattataaatga

SEQ ID NO: 42345 - DNA, 201 bp, Homo sapiens
aagggacattgttgtttcactaattctgtaaaggagagcagcggcatttacttaggccgattccccattctctctttctgtttttaaacagagacagatcytgctctgttgcccaggctggagtgcagtggcatgatggcatgatcatagttcactataatctcgaactcctggtttcaagtagtcttcctgccttggcct

SEQ ID NO: 42346 - DNA, 201 bp, Homo sapiens
tgtctctactaaaaatacaaaaagaaattagctgtgcgtggtggcgggcgcctgtagtcccagctactcgggaggctgaggcaggagaatggcatgaacaygggaggtggagcttgcagtgagccgagattgtgccactgcactccagcctgggcaacagagcaagactccatctcaaaaaaaaaaaaaaaaagaaaagaa

SEQ ID NO: 42347 - DNA, 201 bp, Homo sapiens
tcgagaccattctggctaacatggtgaaatgctgtctctactaaaaatacaaaaagaaattagctgtgcgtggtggcgggcgcctgtagtcccagctactygggaggctgaggcaggagaatggcatgaacacgggaggtggagcttgcagtgagccgagattgtgccactgcactccagcctgggcaacagagcaagact

SEQ ID NO: 42348 - DNA, 201 bp, Homo sapiens
tggtaatattgtcatatggtgatcccactgtggatagatacgcaagagagaaaatccagaagaaagcatttcactgaagcctggggacatttctggtgacwaatggtgctgatggcacagtgagaacgggagagggcagaagcaatgcacagatagaaagggtgtcacctgcgcattgaaaaatcccagtgccataacaat

SEQ ID NO: 42349 - DNA, 201 bp, Homo sapiens
agggacagtggttgggtctggagatgtcacccttagctgtttttcacaatgagaggttgttttatcataaataaatcaataaatggcagattatacaccgkagttactgagaaatataaaaaaaaaaaaagcccacattttaaagggaatttggtatttttaacaaagcatcagggggccgggagcagtagctcacgcctg

SEQ ID NO: 42350 - DNA, 201 bp, Homo sapiens
acttcgcaatgcctgctgaattttacctattctgtaagtctttttgggaaccgttgagcccctcttctcttagttgcctttagcctttgtttttattatgrcaattggtatgaaatttttccttttcattacttcttttattcagagcacacctctggcttatctcttcattctctgtttagtttcatattttactttaat

SEQ ID NO: 42351 - DNA, 201 bp, Homo sapiens
attacgtttataattttcagttactagttaggtaaagaatcaaaattaataaacacatttatagttctcagagattccttgagagaggaacatctttaaayggataaccacagtcttctaaacacctgaaagggtgtcttttgctgaattatggagttttagttttgctttagaatttttggatgattagacttgtacttc

SEQ ID NO: 42352 - DNA, 201 bp, Homo sapiens
atggctgtcagaagtctttctttagaaatttaaccatatttttaatggtgggcattgcagtcaacaatagtacagactttgcaaagactattttttttttkgggtgcagtgaatacttcgcaatgcctgctgaattttacctattctgtaagtctttttgggaaccgttgagcccctcttctcttagttgcctttagcctt

SEQ ID NO: 42353 - DNA, 201 bp, Homo sapiens
gatggtcatgttttactttgaagcaatctgtgcttggtttatttttttcagtgagtgtggattacgtttataattttcagttactagttaggtaaagaatmaaaattaataaacacatttatagttctcagagattccttgagagaggaacatctttaaatggataaccacagtcttctaaacacctgaaagggtgtcttt

SEQ ID NO: 42354 - DNA, 201 bp, Homo sapiens
ctgtagatgccttccatcttcttaagagattttgtgcctcttgcacaggtattatccctaagatgtgttttcttcaatgtacctagactgtttccttaaaraattgcttttgtatggtacggctctatgtgtctgtgtttctcatgttggttaggagaactaacccttgtgacgaataagaaatggcaaacattgttaatg

SEQ ID NO: 42355 - DNA, 201 bp, Homo sapiens
ggccactgtgcccggccaggaagatggtcatgttttactttgaagcaatctgtgcttggtttatttttttcagtgagtgtggattacgtttataattttcrgttactagttaggtaaagaatcaaaattaataaacacatttatagttctcagagattccttgagagaggaacatctttaaatggataaccacagtcttct

SEQ ID NO: 42356 - DNA, 201 bp, Homo sapiens
ttgtgagaaatgaggagataatatctttaaatctcctacggtgatacctggaacatgatggtgcttgggaaatgtctcttcttctgaaatgaggctgcctsgaagactcactggaacccaagcaaagtgtctctgcatttcactccgagccatcgacttctgttctgaatgttaaaatgcaggtggctgtgagggagtctt

SEQ ID NO: 42357 - DNA, 201 bp, Homo sapiens
gattccaaatttacagtcaatggactgtagatgccttccatcttcttaagagattttgtgcctcttgcacaggtattatccctaagatgtgttttcttcartgtacctagactgtttccttaaagaattgcttttgtatggtacggctctatgtgtctgtgtttctcatgttggttaggagaactaacccttgtgacgaat

SEQ ID NO: 42358 - DNA, 201 bp, Homo sapiens
gaaggatcatgggaggggaggagcgtgagttcctcttaagtgaatataaaccagggggtaggaaacaacatgagatgaggctggcgagagagaaggatgcyaggtgaggtgctgtggtgcgccagagactgcggaagtggctttctaattaagaaacagaagccaggaaactcctgtacttcaaggttttggagtgggaaa

SEQ ID NO: 42359 - DNA, 201 bp, Homo sapiens
aaaggagattctcctgcttcagcttcccaactagctgggacaacaggtgtgtgccaccacgtccagctaatttttgtatttttattagagacggggtttcmccatgttggccaggctggtcttgaactcctaacctcaagtgatctgcccgccttggcctcccaaagtgctgggattacaggctcacgccaccatgcctag

SEQ ID NO: 42360 - DNA, 201 bp, Homo sapiens
gtagctttgttgattgttgatattacttatgaactttcttgcttttcagaaaccaccaccacaaaagaggcagtaacattagtattacattatacatcttmggcatttttttcctttgcccttttcgtaggtttttgtttgtttgttttttcttgtcagccacttcatcatgtttggtctctcgtctttggctgtgttttt

SEQ ID NO: 42361 - DNA, 201 bp, Homo sapiens
atgcagtcagcttcactgaatgacagagatatgatctgagaagtgtgtcaggcagtgtcatcgttgtgcgaccctcataggatgtacttacaaatcctacrtggtataacccattatacacagaggctgtatgggatagcctgttgcttccaggctgcaaacttgtatagcatggtaccgaactgaatactataggcagtc

SEQ ID NO: 42362 - DNA, 201 bp, Homo sapiens
aattatatattatacacacaaacatacacacacgcacacaccaaatttaaaaagacagatacataggcagttgttatgcagtgtttgaaataaatttattkccagctatgggtcatttggaaaaagatcaatatgatgcatcaacataacaagtaaatggaaatgaatacaaccgcatggttttctgaaagcacggtttcc

SEQ ID NO: 42363 - DNA, 201 bp, Homo sapiens
tgcccttgtggaggatacaaaacacaccaaaatgcagtcagcttcactgaatgacagagatatgatctgagaagtgtgtcaggcagtgtcatcgttgtgcraccctcataggatgtacttacaaatcctacgtggtataacccattatacacagaggctgtatgggatagcctgttgcttccaggctgcaaacttgtatag

SEQ ID NO: 42364 - DNA, 201 bp, Homo sapiens
gaaggcagccatctgtaactagtaggagggccctccccaagaacgtgaccatgctgccaccttgaccttggactttaagcctccagaactgtgttaaagamatgtctgctatttaagccactcggtccatgatattttgttgctgcagcttcagctgactatggcttatgtctatcaaggaacatagttgcactgaggttg

SEQ ID NO: 42365 - DNA, 201 bp, Homo sapiens
ggtgagaaggagctggcagtgtgaatagccaggggaaaagtgttttgggtagaaggaacagaaagtgaaacggtgccctggcaaggcaaagattattcatkgctgaagagactatgttgcccagatgacttgttcatgtaatctgtgatttttaaatttagaattgaggtttgaagggaagtattgctcctttctttatct

SEQ ID NO: 42366 - DNA, 201 bp, Homo sapiens
aaagacaaaacagaaaaaggaggagaggacacagaggagaaggctctgtgaagtcagaggcagagattggagtgatgcgtctacaagccaagagatgccayggtcatgggcagcccccagaaacgaggagagaaacctggcacggtttccacaaggagtcacccctgccaacaccttggtttcagacttctggtctcctga

SEQ ID NO: 42367 - DNA, 201 bp, Homo sapiens
gaaggcgggcggggcaagctttggaaagcacgggcaggtaaggacagggtttcaaaggtgagaaggagctggcagtgtgaatagccaggggaaaagtgttktgggtagaaggaacagaaagtgaaacggtgccctggcaaggcaaagattattcattgctgaagagactatgttgcccagatgacttgttcatgtaatctg

SEQ ID NO: 42368 - DNA, 201 bp, Homo sapiens
actgattaatcacagttatagagtagacataacatttttattaaactctcagtgagcaggaaaattagcacttcctgcaataacgatactaatttcattastgaacgttttcatttataaagtgcttcttccttatcttgaaccttttatcctcttcttattgaccaaagagagggcatatctttgggagctgctaataaa

SEQ ID NO: 42369 - DNA, 201 bp, Homo sapiens
gtatagtgatgggtctctcatggctcacgtattaactgtatttgttgttactgcttctcaggcactctgttaagaatgcagggctcttcctcagactcagsgcggggcctgggctttacagcaatggttttcagtttgtaatctctctcaaggaagggagaggagcacaaagctgccttgactgccagcaccatcagaaaa

SEQ ID NO: 42370 - DNA, 201 bp, Homo sapiens
gttggagaaaagggggaaaaagttaaatgttaatgattcttttcgtaactgcaattttatcggctcctttttgtacatatatgattatgaagcaatttgcrtgaaatttacaccttttcaaattttgaaaattgccttgttgaaaaagaatcgctgtacttctcaatactacactgattaatcacagttatagagtagaca

SEQ ID NO: 42371 - DNA, 201 bp, Homo sapiens
acaaaaggccaaccccattagacagtggccaagggaggtgaactaaagttggtgctgtgaacagggctaatggtttgtgatttacccataagtggaaggtrtactccggctgctcctttaatattttatgattagcagtagaggtgtgtctgggggaaagagtcagcttattttatttatttattaattttttgagatgga

SEQ ID NO: 42372 - DNA, 201 bp, Homo sapiens
agttggagaaaagggggaaaaagttaaatgttaatgattcttttcgtaactgcaattttatcggctcctttttgtacatatatgattatgaagcaatttgyatgaaatttacaccttttcaaattttgaaaattgccttgttgaaaaagaatcgctgtacttctcaatactacactgattaatcacagttatagagtagac

SEQ ID NO: 42373 - DNA, 201 bp, Homo sapiens
tccagaatcattggccctggctctactcctggaaacccagtccatctctaatccctttgatttccaatgggaggcaaatccaggggagttctagactgtckagaatattgtaccaagaacaaaaggccaaccccattagacagtggccaagggaggtgaactaaagttggtgctgtgaacagggctaatggtttgtgattt

SEQ ID NO: 42374 - DNA, 201 bp, Homo sapiens
gcggcgtgatctctgctgactgcattctccatttcccaggttcaagcgattctcctgcctcagcctcccaagtagctgggactacaggcccctccacaccscacaccgccaccacgcccagctgatttttagtggagacagggtttcaccatgttggccaggctggtcttgaactcctgacctcaagtgatcggcctgcct

SEQ ID NO: 42375 - DNA, 201 bp, Homo sapiens
cagcggcgtgatctctgctgactgcattctccatttcccaggttcaagcgattctcctgcctcagcctcccaagtagctgggactacaggcccctccacascgcacaccgccaccacgcccagctgatttttagtggagacagggtttcaccatgttggccaggctggtcttgaactcctgacctcaagtgatcggcctgc

SEQ ID NO: 42376 - DNA, 201 bp, Homo sapiens
ttttaaggcagcaggactaagaaggtaaagacatgtactaggcgggtcagcatagtggtggccctcgtctgacacacatatttcaggaggggtcacccctsccgtcttccatgttggggtgctcttctctggcaacccactatgggtactccactgctggccttcatgcaggtggaaccacaccgggaagacccaagccga

SEQ ID NO: 42377 - DNA, 201 bp, Homo sapiens
ggcacagaacgagcactgtgtgtgtgttacagaaatatatgtgggtgggtgtgtttctgttttccgtaattccagctaggcaaagacatatttaacaaaarccttctgggctgatgagcatcctcagaaagtaggctgagggagctcttttaaggcagcaggactaagaaggtaaagacatgtactaggcgggtcagcata

SEQ ID NO: 42378 - DNA, 201 bp, Homo sapiens
agcatctggggctgtacacgtctttgtactgcacactgtagggtatccaggattcctggccctgccccatgatataccagcgccatgttgtcatcaaaacraccggaaatgccttttgtgtctccctacttccctttttaacatgtcagcccttggtctcgatattcacatctatatttttccttatcccgttaatatatg

SEQ ID NO: 42379 - DNA, 201 bp, Homo sapiens
tcatgccctgtgtcacctgactcaggcaccattagcatctggggctgtacacgtctttgtactgcacactgtagggtatccaggattcctggccctgcccsatgatataccagcgccatgttgtcatcaaaacgaccggaaatgccttttgtgtctccctacttccctttttaacatgtcagcccttggtctcgatattca

SEQ ID NO: 42380 - DNA, 201 bp, Homo sapiens
ttaacactatgcagaacgatttcctcgtattgttgaaaactcttggtaggggttttttttttaattggctggaagcacttcatcatatagttgtaccaaartttgcttaacatcccccttattactcagcctttgggtggtatccagttctttgctttgataaataatgctgagatgaacatctttctgcatggctctttt

SEQ ID NO: 42381 - DNA, 201 bp, Homo sapiens
atgctctacctcttccctttgctaagtggcaattttggaccttctgtgaccgtgcaaacatgcagattatacatgcactataggagtggaatgtatgtgayttaatagcgtaatattttgtccattattttaaaacttgctttatttggtcaagacatacggaacacgtatagatcaaacaaaaatttttaaaaatgcttg

SEQ ID NO: 42382 - DNA, 201 bp, Homo sapiens
aattcttaaagttctggagcctgggaagtccaagagcaaagcaacggcagattcagcttctgttgagggctcgttccctggctcatagatgatgacttctygctgtgtcaacttagtgggaggggataaagcagctctctggggcttcttttagaaaggcacaaatccactcttgtgatctaatcacctttcaaaggccct

SEQ ID NO: 42383 - DNA, 201 bp, Homo sapiens
cagaaatgtaattcttaaagttctggagcctgggaagtccaagagcaaagcaacggcagattcagcttctgttgagggctcgttccctggctcatagatgrtgacttcttgctgtgtcaacttagtgggaggggataaagcagctctctggggcttcttttagaaaggcacaaatccactcttgtgatctaatcacctttc

SEQ ID NO: 42384 - DNA, 201 bp, Homo sapiens
aatgtctccagacatttgcttctgtcccctggggatcaaaatcacccctggttgagaacttggggtaatttaagtggtgctccggtaaaggccattcaacwtgactcactgtgttgatgttatgttttctaacattgactttcctttaaaccatagggttcgaaaccgccaagtcttttgccctccatggtgcacatgtga

SEQ ID NO: 42385 - DNA, 201 bp, Homo sapiens
ctgacctcaaatgattccctgcctccacctcccaaagtgctgggattataggtgtgggccactgtgcccggccaggaagatggtcatgttttactttgaascaatctgtgcttggtttatttttttcagtgagtgtggattacgtttataattttcagttactagttaggtaaagaatcaaaattaataaacacatttata

SEQ ID NO: 42386 - DNA, 201 bp, Homo sapiens
gtcccacaattggcaagtgccataaatatattataggccattatactttctacagtatctttaattgatatgccccatgtctaagaaaaaaagtagtttttcatgatgaaggtgatgaactacttctttccattattctatttcccccttttcttcttcaggctttaaagatatcataataccatttacatttactgttta

SEQ ID NO: 42387 - DNA, 201 bp, Homo sapiens
tgtgcttataagaaaagatatagaaagattagtagtagactgttgtgttctttttttttttttttttttttttgagatagactcttgcctgtcgcccaggytgcagtgcggtggcatgatctcggctcactgcaacttttgcctcctagattcaagcgattgtcctgcctcagccttctgagtagctgggattacaggcgc

SEQ ID NO: 42388 - DNA, 201 bp, Homo sapiens
cgccatcagatgaatggaggtttcttatgctgtggcgaaacccagggggtcaagcccctcggacatgacgtactgcaaagtgaggatgtttcattgatttrtatttttaaaattaaaaataattatttaagctgcatctgtgtgcttataagaaaagatatagaaagattagtagtagactgttgtgttcttttttttttt

SEQ ID NO: 42389 - DNA, 201 bp, Homo sapiens
agtgacagcccattcggagggttttaggcctgtccttagagaggcttgttatttcctctttcggtactttgttgcaacctagttcaccgccatcagatgartggaggtttcttatgctgtggcgaaacccagggggtcaagcccctcggacatgacgtactgcaaagtgaggatgtttcattgatttgtatttttaaaatt

SEQ ID NO: 42390 - DNA, 201 bp, Homo sapiens
ggctgatgttcatcgcacagtgacagcccattcggagggttttaggcctgtccttagagaggcttgttatttcctctttcggtactttgttgcaacctagytcaccgccatcagatgaatggaggtttcttatgctgtggcgaaacccagggggtcaagcccctcggacatgacgtactgcaaagtgaggatgtttcattg

SEQ ID NO: 42391 - DNA, 201 bp, Homo sapiens
agaggctgatgttcatcgcacagtgacagcccattcggagggttttaggcctgtccttagagaggcttgttatttcctctttcggtactttgttgcaaccyagttcaccgccatcagatgaatggaggtttcttatgctgtggcgaaacccagggggtcaagcccctcggacatgacgtactgcaaagtgaggatgtttca

SEQ ID NO: 42392 - DNA, 201 bp, Homo sapiens
tgtaaattcaagagaataataacttctctgtcacatactgttttgtacagatcaagtaaaacaatgtgtgaaatgctgtaatgaagaagtccaatagtgtrtgaatataaggttgctggcgtttggggaaaaatcatagttatagaagaaagactcctaaagggaagattagggttggaagaagatggaggaagagagtaa

SEQ ID NO: 42393 - DNA, 201 bp, Homo sapiens
aggatgaagcggaaaacctgagccacaaggcagtagaggttggacgagacactcattccgaaggcgggtgtgtatgtgcaaactgtataatttttttcttsttttctatctgctagcaaagtgggtaagttgacccatgacatggtccactggagggaccacatttgtgactctagcaattaagcctcccttctcatctgt

SEQ ID NO: 42394 - DNA, 201 bp, Homo sapiens
tgggccctaaatccaatgacggttatcctcatgagaagaggaaagcagggggcacagtggtgggtgtgcctgcaatcccagctactcgggaggctgcggarggggcatcacttgagcccaggagttcattgccagcctgggcaatatagcaagaccccatctcttaaaaaaaaaataacaccaaaagacaaaacagaaaaa

SEQ ID NO: 42395 - DNA, 201 bp, Homo sapiens
ttgcagaggaggggggcacagatgcctccagtggcccaagactcccctttacacattgccgttcccttgccttctactcctcttttcattacccttatcargattctgcagcccagggtgctgcttgttgatggacatcttcacctgactttctccctggtccaggtgcattttaagcatggaaggtgacacttgccattc

SEQ ID NO: 42396 - DNA, 201 bp, Homo sapiens
agtggaaattgtaatatttaagtattaatacctctgtttaaggttcattttgaacgccttggtgaccctatgtttttttctttgttttttgttttgttttktttttttttgttttttttttttgtttttttgagatgaagtcttcctctgttgcccaggctggagtgcagtggcgcattcttggctcactgcaaccttcgc

SEQ ID NO: 42397 - DNA, 201 bp, Homo sapiens
tggactctgatggatctaatcgaggattaggatggaggtaggtgggaacatatttagaaggatgccctgtggtttttctccttcctgctatttatatttcyctctctgtctttcccacctgtttggtgatgaggaaggagctgtgtactggtttgaaacctattcacgacatagtggacccaacaccaagtgtcttattgt

SEQ ID NO: 42398 - DNA, 201 bp, Homo sapiens
tactgcaaaacaggactcattagcaggagctcataaaatgaaactggcagtgagctcatatggaagaggcatcacgggcaactcggcttggctcaccagcycctgagctgcccccgagtgaccgctccagccttctttccttccacctctccctcttggccaacttcatgcttcagccaaagtgaactgagctcaccaggc

SEQ ID NO: 42399 - DNA, 201 bp, Homo sapiens
actaaacgatttgttcagattggggaaaaaaattttttttttttttttggttgtggtggcgttggcttttacttggggttgacctttccttatcaaggacrtacaaggtgaatagctgggtgataatatatggtcccatgatcatcaaccaagcaccaacggaagccttttggaagtgcacagtattgtttaacacacaaa

SEQ ID NO: 42400 - DNA, 201 bp, Homo sapiens
tggcgtgatctcagctcactgcaacctccgcctcccgggttgaagtgattctcctgcctcagcctcctgaatagctgggattacaggcgtgagccactatrtccggctaatttttgtatttttcgtagagacagggattcaccatgttggccaagctggtcttgaactcctgaactcaagtgatccgcccaccttggcctc

SEQ ID NO: 42401 - DNA, 201 bp, Homo sapiens
ctgtagcaaagatgtactgtttcccactgagaagaatcaaaaatagaaaagtgcttccttgtctctctatattgttattaaaacaagtagatgcattttcrttgaatcaaggcagttttcctttataaaatgtcctatttcatatcactgttcaaacttgacatccacatttgagttggtttaaaatatcactgttttgtt

SEQ ID NO: 42402 - DNA, 201 bp, Homo sapiens
gtcacatgaggccatcagttgaatttcatgcctgcatgtaggtttagattttaattacttttttatggtgtcagcataacaaatgagagtcatacaaactrttgtttaatgacaaagtgggtcaaacccataattaaaaaaattaataatagatttttgttctacttgaggttttgtagcattacgtaaagcttgaaaact

SEQ ID NO: 42403 - DNA, 201 bp, Homo sapiens
agttccagctcatccaccctgcctctgtggctgagtcggggagaaaaggacaaagtttttctcccgcaactgggccaccaaaccagcagagcctccagccrgggtggtctcgaggaggcccattaccggctggagtgacagagtgtgtcaagcctgcagctcgtcccgtgtctaatggaacagaaacaagcaccctgctgc

SEQ ID NO: 42404 - DNA, 201 bp, Homo sapiens
tgtataggtgaaagcatagaatacatagggtttggtactatccagttttcaggcatcactgtgggtcttggaacgcatctcccgaggataagggggggctrctgtcagtgtgaacctgattagatctcaactgaaacttttttgtcacatgaggccatcagttgaatttcatgcctgcatgtaggtttagattttaattac

SEQ ID NO: 42405 - DNA, 201 bp, Homo sapiens
tgtaatcatagcagaaactcacatgtgtgtgctttctatgtgccaggcatgaggctgaagtcatacattcattatttgttaatcccaccctaagtgatagktgtattcatcattctcagtatcagaagaagaaactgaggttcagaatgacccagtaaagatcacaagcccaaccctggtgaagggcgtgattggcagaag

SEQ ID NO: 42406 - DNA, 201 bp, Homo sapiens
gcatctgaaaatactaattttgagagagagagagtgtgagagaccacatttacataacttttatacagtacattgttatagttctattttattattattgktgatctcttactgtgcctaatttataaattaaaatttatcctaggtatgtatgtataggtgaaagcatagaatacatagggtttggtactatccagtttt

SEQ ID NO: 42407 - DNA, 201 bp, Homo sapiens
caagttcaaaatcagtctcacctggtcaagatgtcagtagggcttgttccttctggaggctctaggggagaatctgtttccttgcgtttttcatcttctasaggcctcctgcattccttggctcttggccccttcctctggcttcaaaccagcagtttaatatcatcacatctcctttactgattcctcttccgttgtccc

SEQ ID NO: 42408 - DNA, 201 bp, Homo sapiens
tcacgcctgtaatcccagcactttgagaggccgaggcgggtggatcatgaggtcaggagatcgagaccatcctggctaacaaggtgaaaccccgtctctastaaaaatacaaaaaattagccaggcgcagtggcgggcgcctgtagtcccagctactcgggaggctgaggcaggagaatggcgtgaacccgggaagtggag

SEQ ID NO: 42409 - DNA, 201 bp, Homo sapiens
gatagctgatttgttataaacaaattaccaaaaacgtactggctttaaacaacacatgcttatcatgttgcagttctggggagtcacaagttcaaaatcastctcacctggtcaagatgtcagtagggcttgttccttctggaggctctaggggagaatctgtttccttgcgtttttcatcttctagaggcctcctgcatt

SEQ ID NO: 42410 - DNA, 201 bp, Homo sapiens
cattaaatttttttttttttttaatgtttgagatggggtctcactgtgttgctcaggtgttggtctcaaactcctgggttcaagtgatcctcccaccttakcctcccaaagtactgagattactggtgtgagccactgtgcccagatgctattagcaagtatgaacaaattagatattttcagtctactcttctgtggtaa

SEQ ID NO: 42411 - DNA, 201 bp, Homo sapiens
tgcctctaagtttgaagtctaactccatcactgtgtttctttcctcttgctgatagctgatttgttataaacaaattaccaaaaacgtactggctttaaasaacacatgcttatcatgttgcagttctggggagtcacaagttcaaaatcagtctcacctggtcaagatgtcagtagggcttgttccttctggaggctcta

SEQ ID NO: 42412 - DNA, 201 bp, Homo sapiens
ggcagagatggggaaggtgctgttcccttcctcctgggaagggcaaagaaagcagggtggtcctcccatccccgtgaggaaggaagagcctcattcatgcygagaccctgatggagaactgggtccagggataatgttttgtgttcctgctcatgggactggtgtgttattgtcaagggatcttacaggccttgcttccca

SEQ ID NO: 42413 - DNA, 201 bp, Homo sapiens
tctccctcacaaggatcaggtggcaggatctaatgggaggggtagagagtgagtgttaacacacagagaacccaggagacctttctcagaggtctcatatsaagaaaagatcatttctcctaagcaatcaatttctttttaaatctgaacctcatatctgagaatattcccttcttttatctggccactcgggagctcaaa

SEQ ID NO: 42414 - DNA, 201 bp, Homo sapiens
cctgccgtgctcaaagcacttgcttacttggaatgccataaattacatgaaggaattattcattgtatcacgaaacataccttccagtctcccgagtagtstattaggctaagtatggtcttttaaattattactttaaaaataaaagataatggaattatagcattaaatacattttgcaaatgatcttctagtaggatt

SEQ ID NO: 42415 - DNA, 201 bp, Homo sapiens
atttgtgtcctggttggcagatattaagtccacagataccaataattaatatctatggttgattgtaaaaatggccaccaattcttccctgtcccctgcayatgtacatccttgcactgtgaaattgtagatctcgccctccaaaggtgaagttcgtttgtccactccttgaaccaggatggcatgaaacttgatttgacc

SEQ ID NO: 42416 - DNA, 201 bp, Homo sapiens
ctgttaggacattgtaattattttgtattacttaggaaaacttttatgattctactcttttaatttttttaataattactttatgacttcttcattagggwttctctcctccagtgcgtacgcagatcttctgaaaaggaatctgacaaatttagttgctgcatttttctaaattgctttcaagactacccagcacttcag

SEQ ID NO: 42417 - DNA, 201 bp, Homo sapiens
tatccaggaggaatgattagtgatctgattcattaatatcccttgttattaagaactgtctgtatttgtgtcctggttggcagatattaagtccacagatwccaataattaatatctatggttgattgtaaaaatggccaccaattcttccctgtcccctgcatatgtacatccttgcactgtgaaattgtagatctcgcc

SEQ ID NO: 42418 - DNA, 201 bp, Homo sapiens
tacctctggaggccccaggctgggactttgggtacagatgcacaggagacctttgccccaccccgtcacggctgggcctactcagttccacgtctttgagktttcacgcggaaactggatgtttcttacatcctcagctgcaggcatggggaagagacgcacatcagccattaagaaaaaggtatgcagtctacatgcctc

SEQ ID NO: 42419 - DNA, 201 bp, Homo sapiens
gttcaggaacagaactgacaggtattgaagccaaaaattgaacaataacaacgtaggagggagaatccaaagatagtatgtgttcaggatacgggcactcrtgtgggtgaacacacacacacacacacacacacgcttttttttttttttctttttttttttctcctattgcaatagaacgtaaaggtagatttttagaac

SEQ ID NO: 42420 - DNA, 201 bp, Homo sapiens
ggatgacaagtggatacttaagaaaaagtgtattttggagaaagttgcaataatacctactagagattgtgtcctccctcaaaatcggagtgccatccgcsctccatgagtctgacactttgtaggtgctttataaatatggattgaagcaaatgagtgacgttcatatgatgttttgcagttttttcaaagtgggtttta

SEQ ID NO: 42421 - DNA, 201 bp, Homo sapiens
aaaaaaaaaaaaaaaaaaaaaaaaaaaagaaagaaagaaattacaggtaggctagagcacggatgagcaaactgtttttataaaggaccagagagtatatrtttcaggctttgcaggccctatgacgtctgtcacaattcacttctgcctttctactgcaaaaacagccatggacaattcataaattaatgtgcatggccg

SEQ ID NO: 42422 - DNA, 201 bp, Homo sapiens
ttgattaattaaaggacccaagagctaaaagggagaagtagctgcatgcttgccacttagtaatattttgataagtatttttgggatgaatgcaatgacgsatgaatgaatgaatgaatgaataacataggctacagtattttgtcttcttggttagggaccttgagtaaactgaggagtctgaggggaatgccatggaag

SEQ ID NO: 42423 - DNA, 201 bp, Homo sapiens
agaagcaccattttgaattagttctgtaagtatgtgtttgaggtagaaatagagttttaaaaaactgtctgttcatatagttcatctgcttaataagtaarcagctctttcaaatcaccaagctcaaataaaacaaacaaataatgggacaattggcaaaactctaaaaagtgatacaaaagaccaagggatatttgaaaa

SEQ ID NO: 42424 - DNA, 201 bp, Homo sapiens
caaaagtactaaatgttaccattttccttactttgttcaggctgctataacagataccataaactaggtagcttataaataacagaaatgtaattcttaamgttctggagcctgggaagtccaagagcaaagcaacggcagattcagcttctgttgagggctcgttccctggctcatagatgatgacttcttgctgtgtca

SEQ ID NO: 42425 - DNA, 201 bp, Homo sapiens
aaaaaaaaaaaaagagaaagaaaacagattaatacaatgatctgtgagatattgggactgttcttattcccatttcacagatgagccactaactggctcckggcaggacagtgaataaggggcacaacagagacacaaacacatggctaaccaatggtctcatccgtcagccacactgcctgtctcagcatgggccctgtg

SEQ ID NO: 42426 - DNA, 201 bp, Homo sapiens
cttattcttttacaaaaagggtcagcagactttctgaaaagggacagatagtaaatattttaggctttgtggaccatagggcctgtgtcaaaagtactaawtgttaccattttccttactttgttcaggctgctataacagataccataaactaggtagcttataaataacagaaatgtaattcttaaagttctggagcct

SEQ ID NO: 42427 - DNA, 201 bp, Homo sapiens
ttgaaggaaagttttggctacccagttgttagctgctgaagtttaactgtgcattctaagcacaccagtattttattacatcatacctgggcagcagatarttttagtaaaaccttgaaaagatatgactattgggaagaaatttgggattctatcctttttctctccattcttctctcctgcaccaagtttctaagctcg

SEQ ID NO: 42428 - DNA, 201 bp, Homo sapiens
tacttattcttttacaaaaagggtcagcagactttctgaaaagggacagatagtaaatattttaggctttgtggaccatagggcctgtgtcaaaagtactmaatgttaccattttccttactttgttcaggctgctataacagataccataaactaggtagcttataaataacagaaatgtaattcttaaagttctggagc

SEQ ID NO: 42429 - DNA, 201 bp, Homo sapiens
acaaaacaccgagggctttaaggaggcatagtggtatgttcagctgtattttctcataatatagagtcataggaaacctgagccttggcatttgtaaggcraaaagacccctggaaaagagtaatatagtaattcatctttatttgaaaagtatatcatcatccatttatttccccactggcataatccaggccgactttg

SEQ ID NO: 42430 - DNA, 201 bp, Homo sapiens
aagttaaactgatgtctgtgtgtcttcatgtcattaaactttgaatctacggacatgtctttttctttctggcatagtttggaggtcttcattttgtgatwgaatacaaaacaccgagggctttaaggaggcatagtggtatgttcagctgtattttctcataatatagagtcataggaaacctgagccttggcatttgta

SEQ ID NO: 42431 - DNA, 201 bp, Homo sapiens
tgagaaagttaaactgatgtctgtgtgtcttcatgtcattaaactttgaatctacggacatgtctttttctttctggcatagtttggaggtcttcattttrtgattgaatacaaaacaccgagggctttaaggaggcatagtggtatgttcagctgtattttctcataatatagagtcataggaaacctgagccttggcat

SEQ ID NO: 42432 - DNA, 201 bp, Homo sapiens
aggttacagtgaaccgagatcgtgtcactgcactccagcctaggcgacagagcgagaccctgtctcagaaacagaaaataaaacaaacaaaaaaatactaytccatagctgactattttctgaaatgattttgttacttttctaatgagaaaaaaatagatctcgtgtgtggagggaattgaagatgtaatttcagactct

SEQ ID NO: 42433 - DNA, 201 bp, Homo sapiens
cccccaaagggggatttctaacacagaaagcaacataagtgggtagtcctggccaatggcagctacgttccacaaagtgactcagggatccaggctgcagmcacttagtggttccattctccctgctgatatctgcatccagtcatctggtatttcttaccagccttaacctcattctattggtaagcactagtcacatgg

SEQ ID NO: 42434 - DNA, 201 bp, Homo sapiens
tgtttgcacacctgtgttgcaaatgtattagttaggataggctgagctacagtaagaaatagcccccaaaatgcattatagctgaaacccccaaagggggrtttctaacacagaaagcaacataagtgggtagtcctggccaatggcagctacgttccacaaagtgactcagggatccaggctgcagacacttagtggttc

SEQ ID NO: 42435 - DNA, 201 bp, Homo sapiens
ttccttagcttcatgcctttgaattttagcagaaatgttacctgctctatgaaactggattttccctttgtctccattccctaagctgcacattagagcasctgttacagtttgaagtgacccctatatggattgtttgcacacctgtgttgcaaatgtattagttaggataggctgagctacagtaagaaatagccccca

SEQ ID NO: 42436 - DNA, 201 bp, Homo sapiens
cccatgggagctccaactctgtttggtcccaatgtgccctttttgtctcactccttcctcccacacatcctgctccccactcccctaattactcatgattscactaacagccacatcctttcacacctctgagcttttggtcatgctgtaatctctacctgagttccattcctgcctccacccttgcctgtcaaattcctt

SEQ ID NO: 42437 - DNA, 201 bp, Homo sapiens
ttatctttgggactgctataatgagatccacttagatctagctataatggaattttgtttagtggttctctgatttaaacatgacttttatccttttcagmtatcgtttcattaacatcactacctctttttaaatcctaatgttgtcatggaagcctgtgtaggggctgaccttgaagtctctgaaagctgaacactcag

SEQ ID NO: 42438 - DNA, 201 bp, Homo sapiens
ggcagcaccactgccatggaaattctccagggccgggatttcactggcaaagtggttgtggtcactggagctaattcaggaataggtaggctcttcacttmgttatttatctttgggactgctataatgagatccacttagatctagctataatggaattttgtttagtggttctctgatttaaacatgacttttatcctt

SEQ ID NO: 42439 - DNA, 201 bp, Homo sapiens
tcagtgggccccagttctttcaggtttaaggaataagcattttggtctatgaaaaatggggtttgcctaaagtataagattgtcttatatttataaatgcytgtgttcattgctgtgggttcactgctttctcttttgggcagccatataaataaaagaaccacctacttggacccaagactggcgtttactgtggatgat

SEQ ID NO: 42440 - DNA, 201 bp, Homo sapiens
gcattaatatcacctgggaattcaataaaaatgtacattcccaggcccccaccccagacctactgaatcagcactggggtggggcttgcaatctgcgctckaatagtcatccaggggatcctgatgttccctagcttgagagcctcccgtctagagcaggggctgtctcctttgcctgtaaagggctagataatatgtttt

SEQ ID NO: 42441 - DNA, 201 bp, Homo sapiens
tgcctgattccaggatgctctaacctggccacgcatcccccgtggattctcagctgttgtgtgtttcctcctcaggtggccactgtgtctggtgctcaccyacattttggttcatcctgactttgcctcagcctccccattctgcatttctcccacggcttctcccagccctggcccagtgacactgtaatgtggactgtg

SEQ ID NO: 42442 - DNA, 201 bp, Homo sapiens
agagtgcagtggcacaatcatggctcactgcagctttgatctcttaggctcacgtgatcatcctcctacctcagcctcccaagtagctgcgactacaggcrtgtgctatcacacttgaaattttgtttagtgtttgtagagatgaggtctaactatgttgcccaggctggtcttgaactcctgggctcaagtggtcctctt

SEQ ID NO: 42443 - DNA, 201 bp, Homo sapiens
aaaaaatatgagaaggttcctgcccttaagaggtttaggatccagctgaagaatcaacatgtgcacatgaaaaaaaatggccgtgccctctaatgtcatakgaggtcagcgtatgaatgacgttgggtgcctgccctgcatatacatatgttctttgagctcattcaagggagaattcccatggattggcacaaccagtat

SEQ ID NO: 42444 - DNA, 201 bp, Homo sapiens
gcccctgagaccagtgctaggattatttccattttgcagatgaggggatggagattaaggagtggggtcacttgaccaaaggtgcacagcgcacagctagrtgccctatgggaaggtcttactgcatctcttaactacctcttgggaccagttaggaaccagtgcttaatgaaacactttgaagttacatctgtggaaaga

SEQ ID NO: 42445 - DNA, 201 bp, Homo sapiens
gctccaccagcttcttgtggaaggctgggtattatccaggcctgcccacagtcatccggaggcctaaacccctccctgtggtgctgtgtttcaatggtcaygtacgttgtccgctttcatgctcctcccgtactcctggttcctctttgaagtacgtagtagatagtggtagaagaaatggtgaaagttttaaagtctttg

SEQ ID NO: 42446 - DNA, 201 bp, Homo sapiens
tattgacctatgtttttaattataactttgggtggtggtctgaaatgaaatgttaagtttgacgcaaaaataggactagtttgtgtaactgatttgttcaraataacagcttacatttctcagagctttttgtatgccaagtgctatgcgaaaccctggatgtacaatattcttatagtagcccctgagaccagtgctagg

SEQ ID NO: 42447 - DNA, 201 bp, Homo sapiens
tatgcagtatatgtgctaaattactttttttgttgttgttgagatggagtttcgctcttgttgcccaggctggagtgcagtggtgtgatcttggcttgccrtgatctctacctcccaggttcaagcgattctcctgccgcagcctcccgagtagctgggattacagacatgtgccaccacacccggctaattttgtatttt

SEQ ID NO: 42448 - DNA, 201 bp, Homo sapiens
ttatttcttttcaatactctgaatatcactggagcagctgcagattcagggcagtatggggtggttcaggaacagaactgacaggtattgaagccaaaaaytgaacaataacaacgtaggagggagaatccaaagatagtatgtgttcaggatacgggcactcgtgtgggtgaacacacacacacacacacacacacgctt

SEQ ID NO: 42449 - DNA, 201 bp, Homo sapiens
atttaatacaattgattactttttagaagagttaatttttacttattactgtggattttttgttttttaacagtcacaccgaggagaagactcagtgggawcatccaaaaactggaaaaagaaaacgagtggcaggaggtttgtatgttgttgtctaaggatcttggatggaagcattaagtagatgaggaaatgtcactg

SEQ ID NO: 42450 - DNA, 201 bp, Homo sapiens
ttgacaatactttcctttcagtctattttcctgtgtatggggtaagtgttgcccttctgcaactttccttttattttatttatttatttcttttcaatackctgaatatcactggagcagctgcagattcagggcagtatggggtggttcaggaacagaactgacaggtattgaagccaaaaattgaacaataacaacgta

SEQ ID NO: 42451 - DNA, 201 bp, Homo sapiens
ttgcctaggctggtctcgatctcctgggctctagcgatcctcccgcctcggcctcccaaagtgctgggattacaggcgtgagccaccgtaccccgccactycatggattcttgagggcagagttttttggagccaggcttcaagcacatttgatgtgtgcctatgagataaagactgcttttaatggcaggcaaggaaaat

SEQ ID NO: 42452 - DNA, 201 bp, Homo sapiens
cccccgtgcattagctatttattgtatacaccagctgagatgccagggcttggctggctctcagctggagggctcactctctggaccttgtgtccgtcccygctggccctcagttctctggatcagggttgaaaggctgaaattctttgggtgttagcttaggatgcctctgatccatcctaacccgacattcccttgatc

SEQ ID NO: 42453 - DNA, 201 bp, Homo sapiens
aggtgattctaatctatgcaaggatgtgaaccactgctgcctttggtggcaaggtagaggaaaaacaaccaagttctgatgagttcattcaagacacacayaggtattatgtgacaggcctttggctggcactggttataccgaggcaaataagagccagttgtcatccttaggacccaatcttattagggcacagtgaca

SEQ ID NO: 42454 - DNA, 201 bp, Homo sapiens
ctaccgctcccggcctttttttttttttttttttttttttttttttaaagacagggtctcgctccgtcgcccaaactggagtgccgtggtgcgatctcggytcactgcaacctctgcatgccgagttcaagcgattctcgtgtctcagcctcccgaatagctgggattacaggcgcccgccaccaggcctggctaatttcg

SEQ ID NO: 42455 - DNA, 201 bp, Homo sapiens
ttggagaggcctgtttccatacatagctctttgtcagttgctcacactcggtcaatacttgccttcctttgaggccatctgcactcactgacaatctgatygctcccctgaatggaggtgaaagcatgcaagctaggagttaagatctttaactcagggaagaccctgtctatggaagtgctgagctcttcagtgtcatca

SEQ ID NO: 42456 - DNA, 201 bp, Homo sapiens
gatctcggctcactgcaacctccgcctcccgggttcacgccattctcctgcctcagcctcccgagtagctgggactacaggcgcccgccaccacgcccggmtaagtttttgtgtttttagtagagacggggtttcaccgtgttagccaggatggtctcgatctcctgacctcgtgatcctcccgcctcggcctctcaaagt

SEQ ID NO: 42457 - DNA, 201 bp, Homo sapiens
ctcccattttacaccctgtttattgatactaagaagagcctccaactgaataagaactaatgacttctgcctgccatcattttggaatgtccaattccccrttctggagagcctttgattataacatcagcctgtcatttggacctctgacctgaattatatgaatctgaaaaatctcttcctttcctatcgtgaattcgg

SEQ ID NO: 42458 - DNA, 201 bp, Homo sapiens
tctctggaaatctctagcttctcaaactgtttcgtggtggagtgccttttgggcacaggagaaggaaataagagcctcgcgaggtttgggaatgctgcctstagctctcacactgcatgcagaattcctactctgagagctcactttatctcaaaaacccatgcatattctgcatctactctgaattccgcagtgttgtgt

SEQ ID NO: 42459 - DNA, 201 bp, Homo sapiens
tctgactttccttgactttgatgtctaggtctggatttcaagggctcagaaactctctcatgcatgtagttccctcctgctttgaatctctctgactttcmttgattttgatgtctaggtctggatttcaagggctcacgtgatgaggatagtttctttatcttaagggcaactgatgtggagtcttaattaacactggca

SEQ ID NO: 42460 - DNA, 201 bp, Homo sapiens
ccaagctcattcaggatgctggcaggattcagatccttgaagttgtaagactagggcccctgtttcctactgacttctgctggtggctgccctcagctccsagaggcaacccacattccttgacttttggccccctgcatctcaaagccagcaacagaaactctcttgtgcatggagtcccctcctgctttgaatctctct

SEQ ID NO: 42461 - DNA, 201 bp, Homo sapiens
ggctgggacaacatgcccactctcaactaatttttgtagccatggagatttggaagtctggcaagtcttgggtcacatgatctaccttacagctgttactrcagacctcccaaagctcacgaactgagagtcaggaggcgtggttcccctaactcaaatcagaatttcgttatcaaaagaagagagggatggttctgtggt

SEQ ID NO: 42462 - DNA, 201 bp, Homo sapiens
tcccttgaacctgggaggtggaggttgcagtgagctgagatcacgccattatactccagtctaggcaacaagagtgaaactctgtctcaaaaaaattaatrataataatgttacaataataataatgttagtgatacatatcattttgaaaccagttcttaagcaattaaaaaaaagcagctatggtgattgagtttttgt

SEQ ID NO: 42463 - DNA, 201 bp, Homo sapiens
aaattgctgaagtgcttctcagtgatgaaatgttacagatcagtttgaaatccaactttattcaacataagaaagcctatatactctggagcttaaagacwgaccttttcacttactgtaaggtatctaagacttctgggtgtgggttttaaatatattttggatgagctttgttcatgtttacacatggccaccaggtcg

SEQ ID NO: 42464 - DNA, 201 bp, Homo sapiens
taaaagttgaacaactctgccttaatggcgctaatttttaatatgcctcattctagttgcttgaattgaacgaaggcatttgaaaattgctgaagtgcttstcagtgatgaaatgttacagatcagtttgaaatccaactttattcaacataagaaagcctatatactctggagcttaaagacagaccttttcacttactg

SEQ ID NO: 42465 - DNA, 201 bp, Homo sapiens
atcccagctctttgggaggctgaggcaggtggatcacctgaggtcaggagtttgagattagcttgaccaacatagtgaaaccccgtctctactaaaaatamaaaaattagccaggcgtggtggcgcatgcctataatcccagctactctgggcctgaggcaggaaaatcacttgaacctgggagacagaggtttcagtgag

SEQ ID NO: 42466 - DNA, 201 bp, Homo sapiens
cttcaagattaagaagggactagccgggtgtggtggctcacgcctgtaatcccagctctttgggaggctgaggcaggtggatcacctgaggtcaggagttygagattagcttgaccaacatagtgaaaccccgtctctactaaaaatacaaaaattagccaggcgtggtggcgcatgcctataatcccagctactctgggc

SEQ ID NO: 42467 - DNA, 201 bp, Homo sapiens
cttattacctggtgacacgtgtttctagttattgacctatgtttttaattataactttgggtggtggtctgaaatgaaatgttaagtttgacgcaaaaatmggactagtttgtgtaactgatttgttcagaataacagcttacatttctcagagctttttgtatgccaagtgctatgcgaaaccctggatgtacaatattc

SEQ ID NO: 42468 - DNA, 201 bp, Homo sapiens
ttctcctgcctcagcttcccgagtagctgggattacaggcatgtgccaccacgccaggctaattttgtatttttagtagagacagggtttctccatgttgktcaggctggtcgcgaactcctgacctcaggtaatccgcctgccttgccctcctgaagtactgggattacagacatgagccaccgcgcccggccacagagc

SEQ ID NO: 42469 - DNA, 201 bp, Homo sapiens
ttcagggataccaacttgggtgctgaaaagcagcgatggcaggactatttacaccacggaaacaggcaaaaactactgatcaagccttcactgttttgttwatattgtcttgacttagaaagtgattgcaatgttaataatgcagattaaattgaagcgtacagtgcctataaaccattacattatgaatagtataaaaaa

SEQ ID NO: 42470 - DNA, 201 bp, Homo sapiens
acttccctactaggtagagcaatgattccagaagtttataataattggaaagtgtattagtcgattctcacactgctataaagacattcctgagactgggmaatttataaagaaggaaggtttagttggctcgtggttctgcagactgtataggcttctgcctctcgggaggcctcaggaaacttacagttatggcagaag

SEQ ID NO: 42471 - DNA, 201 bp, Homo sapiens
cccacttccagagggtttttcttttttttttttcttttgagacggagtcttgctctgtcgcccaggctggagtgcagcggcgcgatctcggctcactgcarcctccgcctcccgggttcacgccattctcctgcctcagcctcccgagtagctgggactacaggcgcccgccaccacgcccggctaagtttttgtgttttt

SEQ ID NO: 42472 - DNA, 201 bp, Homo sapiens
gccaagagcatagaggtggaattgttgtgtgagcctgtagagtccgtgttcttacccactgcatgatgtctgatcatcgtcaattttctttccatttggayagatgaatggtaacacttccctactaggtagagcaatgattccagaagtttataataattggaaagtgtattagtcgattctcacactgctataaagaca

SEQ ID NO: 42473 - DNA, 201 bp, Homo sapiens
ctctactaaaaatacaaaaattagccaggcacagtggctcatgtctgtaatcccaaatgcttgctcgggaggctgaggcaggagaatcacttgaatctggkaggtggaggttgtagtgagctgagattgcaccactgtacttcagcctgggcaacagagcaagactctgtctcaaaaaaaagaacaaaaaaaaaaaaagaa

SEQ ID NO: 42474 - DNA, 201 bp, Homo sapiens
gtataatccacagcactccttctgaatacgttacgtaaatggaaccctcgcaacagtcttatccccattgtagagatgagaaaactgaggcatacagaagrgatggaactaggccaagagcatagaggtggaattgttgtgtgagcctgtagagtccgtgttcttacccactgcatgatgtctgatcatcgtcaattttct

SEQ ID NO: 42475 - DNA, 201 bp, Homo sapiens
actaccacgcccggcaaactaaaaaaataattatttttggtaaagacaggggtcttgcgatgttgcccaggctgttctcaaactcctggcctcaagtgatmctcctgcctcagcctcctaatgtgtttggattacaggcatgagccactgagcccggcctagctaccctgtctgagttgtgcccactacacaaaggtgtca

SEQ ID NO: 42476 - DNA, 201 bp, Homo sapiens
tgtatctagtaattgctatgcacttatatgtatagaagcgtataatccacagcactccttctgaatacgttacgtaaatggaaccctcgcaacagtcttayccccattgtagagatgagaaaactgaggcatacagaagggatggaactaggccaagagcatagaggtggaattgttgtgtgagcctgtagagtccgtgtt

SEQ ID NO: 42477 - DNA, 201 bp, Homo sapiens
gcctcctcaggtaattagctatcctttctttcttttattttccttccttccttccttccttccttccttccttccttccttccttccttccttccttcctycctccctccctccctccctccctttctttccagattctggacctattccagacttactaaaggaaattctctaaaggtgaggcagttttttaaagacagc

SEQ ID NO: 42478 - DNA, 201 bp, Homo sapiens
ctctatttctttgtgacctgatagtcttgctctccagggtaaaagaagaggatggaaatggctgtggggcgcctgaggtgggccctggcatgatggcaagwtgccgttctgggttcactgggatggctcaaggggagtttggaaaccctcctaacatgtcatctgaaatctgggaccacagttccggctggaacacttgtc

SEQ ID NO: 42479 - DNA, 201 bp, Homo sapiens
ccttgtttgcccttccccgtgcctcttatgaagctcaggccttttggcagtcagaggcctcaatggtgcctgtgtccacagggctggctgtcctcaccgtsaagtctagatctccctgctaacttacactgtgctcaaaacacacacacacacacacacacacacacacacacacacacacactggctgtcctcactgtca

SEQ ID NO: 42480 - DNA, 201 bp, Homo sapiens
acctcagcctcccgaatagctgagactacagacatgcaccaccacactggctaacttttaaattttttgtagagatggggtggtgggggtcggcggggggsgggggggggtctcactatattgcccaggctggtcttgaactcctgggctcaagcaattctcctgccttggcctcccatagtgctgggattacagttgtga

SEQ ID NO: 42481 - DNA, 201 bp, Homo sapiens
ggatcacctgaggtcaggagttcaaaaccagcctggccaacatggtgaaacccccgtctctactaaaaatacaaaaattagccgggtgtggcggtgcatgmctgtaatcccagctacttgggaggctgaggcaggagaatcccttgaacctgggaggtggaggttgcagtgagctgagatcacgccattatactccagtct

SEQ ID NO: 42482 - DNA, 201 bp, Homo sapiens
cagcaaggtatgtacggtttaaagtgtaatcaattttgaggttgtatacaaggatatacatgataaatacaagtagtagcatttttagtaaaggctgttayaaaatactgtatttatggcctattccattctttttatagctcattaatgtagaaaacaaacacagtgtatccatcttctcagacggtttaaaattccctt

SEQ ID NO: 42483 - DNA, 201 bp, Homo sapiens
gttcagaggctgcaggaatgattcaaagtctgactgatttatgtgcattgggcattttgttgatgtcattcagattaatgatggcactgaaaatgtgtaayggaaatgagaagtttgtatcctgcctgctataccatgattccaatttaagagggggtaaaaatattgcactttttaatctattgttttttgaaagagact

SEQ ID NO: 42484 - DNA, 201 bp, Homo sapiens
tggaaatgtagacacccaaacacccttcatggattcccagctgctgagagtttgaatagtatgtgaagtctgtagagacaaaattgttgttttccccagtygtaaagtgtgcaatattatccttgcaaaattgtctgtttattttttttgcccttttgggggacaaaatgtctttatgttaaattgttttattattgttat

SEQ ID NO: 42485 - DNA, 201 bp, Homo sapiens
cgtgtgaatgtattgcagaaatggacaggacaattctcagcccattcatcttacagacctcaagtgaacaggcacaaaacaacaggctccaccctccttcycccctctatctcatactttacctcaatttatgacttggcttacaatccgttgcagaaagcctagctccccagcttctcctgaatctacgtttttctattt

SEQ ID NO: 42486 - DNA, 201 bp, Homo sapiens
cagcccaggaaggagctttaatttgagtaattgttttcactaattcatcttcacagaaagaaataatatgatcaccttcggttagtaaacaaaacaaatasgcaaacaggtttacaggctgaggtgggctggatcacttgaggccgggagtttgaaaccagcctagctaacacggtgaaacccttctctactaaaaataca

SEQ ID NO: 42487 - DNA, 201 bp, Homo sapiens
gtgttcttgcctggcttattgagctccatggtaaatgttcagaggctgcaggaatgattcaaagtctgactgatttatgtgcattgggcattttgttgatrtcattcagattaatgatggcactgaaaatgtgtaatggaaatgagaagtttgtatcctgcctgctataccatgattccaatttaagagggggtaaaaata

SEQ ID NO: 42488 - DNA, 201 bp, Homo sapiens
tgggtaccttgcatcctcctttgttcccatactaacccctacaaccatggtcattttgtggttatctgtttaattctctgctggctattccaggctgtcasctccctgactacaaggactttgttgctcacaatcatatccacggcatccacacaagatctggccgctacgtggaaggacacatagttccgtctggcttgg

SEQ ID NO: 42489 - DNA, 201 bp, Homo sapiens
caactggagatggttgtcttcttttttattccatgaaacaaattgattaatgtgtcgagggagcaaggtggtacttatacctacccagcctgcttgtgtgkgtctcaaggtggagagaggctgtggaaacaatagagagaatagcatggaaggccacgttgcaattaaacaagattgggaaagaagacgggactaaaatca

SEQ ID NO: 42490 - DNA, 201 bp, Homo sapiens
gtctcaaaaaaaaaaaaaaaaaaaaaaatctgtgttcttgcctggcttattgagctccatggtaaatgttcagaggctgcaggaatgattcaaagtctgaytgatttatgtgcattgggcattttgttgatgtcattcagattaatgatggcactgaaaatgtgtaatggaaatgagaagtttgtatcctgcctgctatac

SEQ ID NO: 42491 - DNA, 201 bp, Homo sapiens
gtgtttcaccaggttggccaggctgctctcgaactcctgacctcaggtgatctgcccaccttggcctcccaaagtgcagagcaggaatttcattggatttstacactgctgctttttcagagcctggaacagtgccaagcacatagtcggccctcagtgagcatttgttgactaacttaggtcacagatgtggggctgtga

SEQ ID NO: 42492 - DNA, 201 bp, Homo sapiens
attttcaactggagatggttgtcttcttttttattccatgaaacaaattgattaatgtgtcgagggagcaaggtggtacttatacctacccagcctgcttktgtgtgtctcaaggtggagagaggctgtggaaacaatagagagaatagcatggaaggccacgttgcaattaaacaagattgggaaagaagacgggactaa

SEQ ID NO: 42493 - DNA, 201 bp, Homo sapiens
gacaaccttttctgcccttaatcacctctcacagatgagaatccacccaagaagaagaaaaaaaatcagccccttaaaatgctgactagtaacatcagttyttggaaggatactatttttgtttccattctgtctttatagtttgaacttttccttttcatagtctgtaaatattcatcatctcagagccttttgaattgc

SEQ ID NO: 42494 - DNA, 201 bp, Homo sapiens
tctcaatgtggttttgatttgcatatctctaatgatcactgatgttgagctttttttcatatgtttcttggctgcatgaatgtcttgagaagtgtctgttyatgtcctttgcccactttttaatgggattgtttaaaacaaactattcttaaggctttcttagggtaacatttggagaacattggctcattcccaaacata

SEQ ID NO: 42495 - DNA, 201 bp, Homo sapiens
tttgagacaggagtctcactctgttgtccaagctggagtgcagtggcgcgatgtcagctcactgcaacctccgcctcctgggttcaaacaattctcctacstcagcctcctgagtagctgggattatagtcacctaccaccatacccagctaatttttgtattttttagtagaaacagtgtttcaccaggttggccaggct

SEQ ID NO: 42496 - DNA, 201 bp, Homo sapiens
tgattgtgagaagtccacattgctccatttggacttcctttttgtagtgggctattagattttgcctctgcttgtttctgaatacccaagcttgctaacamagggaaagaccaattatcatgattattattatttaccttaagacctgattctacctatctatgatcacatagacatttggaagcaaagagaaatgctttt

SEQ ID NO: 42497 - DNA, 201 bp, Homo sapiens
aattcaactcagaggtcagcttcactgcctgccctgtggagtcgactctgtgtcccacccttcaggaatacggcttaataataagatgataaggattcgtrccagggattggcaaatgacagtcattttctgtttccttaagtaaaattttattaaaatacagctccactcattcatttatatattgttcatatctaatta

SEQ ID NO: 42498 - DNA, 201 bp, Homo sapiens
cagcctcccaaagtgcagggattaaggcgtgagccaccgagcccagccggcaaacttactttaaaacacattgcaataaaataaaaagaaaagggattgtsctaagtgagaagcagagatgaaaatgtggaaggatgattgtgagaagtccacattgctccatttggacttcctttttgtagtgggctattagattttgcc

SEQ ID NO: 42499 - DNA, 201 bp, Homo sapiens
agctcctccctcctgctagcatttttctttgagtagttttattaatgagaaaagctgttgagcaccagagcaaccccgcctcttctaaataccatctgacrtatacattcagcagaggaaaaatgatgtgaggtctggggcttgctttaaaatactttggggccagacacagtggctcacacctgtaagcccagtgctttg

SEQ ID NO: 42500 - DNA, 201 bp, Homo sapiens
aggctggtcttgaactcttgacctcaggtgattcacccacctcagcctcccaaagtgcagggattaaggcgtgagccaccgagcccagccggcaaacttaytttaaaacacattgcaataaaataaaaagaaaagggattgtcctaagtgagaagcagagatgaaaatgtggaaggatgattgtgagaagtccacattgct

SEQ ID NO: 42501 - DNA, 201 bp, Homo sapiens
caatcctcctgcctcagcctcccaagtagcttagaaccacaggcatataccaccatacctggacatgtttttaactttaatttttatttttgtagagatgwggtctccctatgttgcccaggttgctctcaaactcctaggctcaagcagtcttcccaccctggcctcccaaagtgcaggcattttaggcatgacccatcg

SEQ ID NO: 42502 - DNA, 201 bp, Homo sapiens
ctacccccgcccccgggttcaagcaattgtcgcacctcagcctcccaagtaactgggattacaggtgcccaccaccaagcccggctaatttttctattttmaatagagatgaggttttgccatattggtcaggctggtcttgaactcttgacctcaggtgattcacccacctcagcctcccaaagtgcagggattaaggcg

SEQ ID NO: 42503 - DNA, 201 bp, Homo sapiens
ctgtgcctcctcaggtaattagctatcctttctttcttttattttccttccttccttccttccttccttccttccttccttccttccttccttccttcctycctccctccctccctccctccctccctttctttccagattctggacctattccagacttactaaaggaaattctctaaaggtgaggcagttttttaaaga

SEQ ID NO: 42504 - DNA, 201 bp, Homo sapiens
ctgacccagtgctaggcacgtgagagtgagagggatggaatgcttgcaggagttgccttggatatcacacactgacttgggagacacacatagcgacagawaattacaacatagggacacccggggaaaatgtagacgaggtttaggggttgctcagaggaggaattaactctataaggaagtattctgataatggctttc

SEQ ID NO: 42505 - DNA, 201 bp, Homo sapiens
ttcttcatcaactttggccaaaccttcgtggattcctgtgtgctgattattagtgccttgcctacaaatttttaatacattgacttatctaaatattcctscatgcacactccccaatctaagaaaaatgtgagatgttgggaaatgtttccaagaatagaccaaaggattagtcagcctagagaagtgaactttaagagg

SEQ ID NO: 42506 - DNA, 201 bp, Homo sapiens
gtctgactccagaagcactttcctcttttgcctcctaatacattttcttatagggagcatcctgcaatacaactgttaagaccacttaatgttatctttgrattaaaaatggtaccactctcataaatcaatgagtttcataccctaaattatgccagattaagaaaatgaaatctgactgtaaattacttctctaggagc

SEQ ID NO: 42507 - DNA, 201 bp, Homo sapiens
aaaagttgctatcatgtccttcaataacccagtctaaccatgtttttccagtggaaatgattcccggtagaatgtcctatgttccttttgcacatttctcmttacaaacatcatctcatttaatcctcaccacaaaactgatagtgtcatctccaatttatagttgaggaaatagaggatcagagaagctacgtgatctat

SEQ ID NO: 42508 - DNA, 201 bp, Homo sapiens
tccaggtactttcacctctaggctcttacctggcttttgtgaagcccctcagggaagaggaggaaagctgggcaagggggaggggtaaaccaagtcccagsaaagtcattccagtttcccaagatcccggagcttgtttgtatccagctgagatccagttgagaccagaattcactctctccacacctccatcagctgtgg

SEQ ID NO: 42509 - DNA, 201 bp, Homo sapiens
gtatacaagtttctgtgtggacatgttctcacttttcttgggtatatacttaggggtggaattgctgggtcatatgatcagtctaggtttaactttttgaygaactgacaaactgctatccacagtggctgcctgtaccattttacagaaaatctctgcttttaatacttctggatgtgttctaaggcactaggcttttca

SEQ ID NO: 42510 - DNA, 201 bp, Homo sapiens
aacttctgagtggtgagtataagtgtgattattatattattcttagtatttggtttttttctgtagtgtgtagtttccctccatgacactgagggctcagrtggctctgaccttggagacagggagacatttagtgaaggaatgggaggtaaggagctggcatctctggtgtgtccatcatgcactgacctgcactagatg

SEQ ID NO: 42511 - DNA, 201 bp, Homo sapiens
tccacccacctcggcctcccaaaatgctgggataacaggcatgaaccaccatgcccggccatcagaaatattttatttcactattttaaaaaattagcaargaagcaaatatgacaaaatgctaacaattccaaaatgctaataacttctgagtggtgagtataagtgtgattattatattattcttagtatttggttttt

SEQ ID NO: 42512 - DNA, 201 bp, Homo sapiens
gattacaggtgtgtgctaccacggccggctaatttttttgtattttattagagacggggttttgccatgttggccaagctgatctggaactcatgtgctcragcaatccacccacctcggcctcccaaaatgctgggataacaggcatgaaccaccatgcccggccatcagaaatattttatttcactattttaaaaaatt

SEQ ID NO: 42513 - DNA, 201 bp, Homo sapiens
gaccttgtgtccgtccccgctggccctcagttctctggatcagggttgaaaggctgaaattctttgggtgttagcttaggatgcctctgatccatcctaasccgacattcccttgatctctcctgatctgtgagcatcctggcccttcttttcttttcagttttaatttttgcgctggctccaaccccttttcattcctga

SEQ ID NO: 42514 - DNA, 201 bp, Homo sapiens
tcatgtcacaagatcttgttgatgtgcatgcattcattcattcaacaaatattattgagcatctaacataagccgggtgctttgctagggacagaatgctrtacaaggtccctgtcctcatggggaccgtatgttgggaagacagatgataggcatggaaatgaagagacaaaccactccgacttcagcccaggaaggagc

SEQ ID NO: 42515 - DNA, 201 bp, Homo sapiens
aaaatcatgtcacaagatcttgttgatgtgcatgcattcattcattcaacaaatattattgagcatctaacataagccgggtgctttgctagggacagaakgctgtacaaggtccctgtcctcatggggaccgtatgttgggaagacagatgataggcatggaaatgaagagacaaaccactccgacttcagcccaggaag

SEQ ID NO: 42516 - DNA, 201 bp, Homo sapiens
tattgatctagactgcctgctactttcatttaccatgttactgctcgtgggattacaggcacaaaggtttcataaatttcaaatgaaatatgaacatttgktgtcaaagtactgttaaggtatgaaaaccctgctagtattagttcccttttgttattattctattattattattattattgtgtttacatccacaggcaa

SEQ ID NO: 42517 - DNA, 201 bp, Homo sapiens
tcacagcctggatgcatgtatgaataaacttctaccattaagtccctgaattatttaagcactgccagtgattctatataaaccgttcagtaaaatgaatkgcatatgcgtatgtttcaagagctccagcagcctacccaggatggcttgatgttgtctcttagcaccgtatcaatacctgggggttttcaaatattgcag

SEQ ID NO: 42518 - DNA, 201 bp, Homo sapiens
agctcatgcctgtaatcccaacactttgggaggtcgaggcaggaggatctcttgaggctaggagctcgagaacagtctgggcaacatagcaagtctctgtstctacaaaaaatacaaaaattagctgcgcgtggtggcgcgtgcctgtagtcctagctactcaagaggctgacatgggaggattgattgagcccaagaggt

SEQ ID NO: 42519 - DNA, 201 bp, Homo sapiens
gaaaggctccttctcatccttcagagctgagcttacatgtcactgcccaagagaccttcttaactgtgggtgtcccctcgaccttgtactagtcaccttgyttctctgcttcttcgtgcttagccttggctgtgtactcctccttgttggccctgtctcccttgcccaggttgcagatgtcatggggcagcttgttcatct

SEQ ID NO: 42520 - DNA, 201 bp, Homo sapiens
tgcctaccaccatgtttctgaggcctccccagccatgtggaactgtaagtccagttaaacctctttttcttcccagtctcaggtatgtctttatcagcagygtgaaaacggactaatacagtgaggaaatccatgtgttaggaagggagtgtggttgtacttcaacctggaactgtctaactcctaaggttttattaatat

SEQ ID NO: 42521 - DNA, 201 bp, Homo sapiens
agtctaggtagagggaacagtgagaggagagaccccctgcatggcctgtccaggggcctgtgatctttgtgagggtccaggaatgtgaaggttaaggcagsgaagggaggacccatttcaaggatttctgtgccttgccgagaagcttgggctctgttggcagagccagagagtggcattcattcagcttgtgaattctgg

SEQ ID NO: 42522 - DNA, 201 bp, Homo sapiens
gggtcagttcaggcactgtgcgtaaagcacatagcaccgtgtctagtaggtactctctgttccttaactgtcgttccttgattgctcttaagatacgacartgcctcttatatcggcaccttagaatcacctaggaaatgtcctaaatacacgttttgggtctccatagagaacctactgtagccgactctcaactttggg

SEQ ID NO: 42523 - DNA, 201 bp, Homo sapiens
aaaatgggttgatatgagggtcagttcaggcactgtgcgtaaagcacatagcaccgtgtctagtaggtactctctgttccttaactgtcgttccttgattrctcttaagatacgacagtgcctcttatatcggcaccttagaatcacctaggaaatgtcctaaatacacgttttgggtctccatagagaacctactgtagc

SEQ ID NO: 42524 - DNA, 201 bp, Homo sapiens
ttttcacctgtaaaatgggttgatatgagggtcagttcaggcactgtgcgtaaagcacatagcaccgtgtctagtaggtactctctgttccttaactgtckttccttgattgctcttaagatacgacagtgcctcttatatcggcaccttagaatcacctaggaaatgtcctaaatacacgttttgggtctccatagagaa

SEQ ID NO: 42525 - DNA, 201 bp, Homo sapiens
tatttttcgagatggactttcgcttttttgcccagcctggagtgaagtggcatgatctcggctcactgcaaactacccccgcccccgggttcaagcaattstcgcacctcagcctcccaagtaactgggattacaggtgcccaccaccaagcccggctaatttttctattttcaatagagatgaggttttgccatattggt

SEQ ID NO: 42526 - DNA, 201 bp, Homo sapiens
cctggtggcagtattggtggtcacagctggcaaagggaagtgtggctgcccggagagcttggctgaggttggaacgtgggagtttaagagagcaaactccmacagcttggtgcagagagaaaagtgtagaaaggtcgggtgtcatacagcagagggctgtgatgctctactgaggagtggaagtgtttttctgagggcatc

SEQ ID NO: 42527 - DNA, 201 bp, Homo sapiens
caggttttaggcaataataagtgagcagtatggcgccctaatagaaggagggatgcctgtggccaatatacacggctcaaagttgaccatgatagagaagytttccctagaaggtctgtgagggaggaggcctgggagagacagcagggtgaccagagtaagtgaagtcaccgaggtgccaatgagtgtggccctgcaggt

SEQ ID NO: 42528 - DNA, 201 bp, Homo sapiens
gcaggttttaggcaataataagtgagcagtatggcgccctaatagaaggagggatgcctgtggccaatatacacggctcaaagttgaccatgatagagaasctttccctagaaggtctgtgagggaggaggcctgggagagacagcagggtgaccagagtaagtgaagtcaccgaggtgccaatgagtgtggccctgcagg

SEQ ID NO: 42529 - DNA, 201 bp, Homo sapiens
caaatatcttactcctgggctgtgctggggatggcagcagagtggggtggttggatgggaaggcgggaaagagctagcttggagatgatacgcttttccayccttgaataacttgggaaaaagtcaggagtgtggaatgaagaattggaatataaaggctgagggcggacctaattttttttttaaggattaagaaaaaag

SEQ ID NO: 42530 - DNA, 201 bp, Homo sapiens
aggttcacatgataaatattttctgctttgtggcctacaaggtacctatcacaactactaagctatcatgcattagtgaaagcacatagataatctataarccaatgggcatggttgtgtgacaataaaactttatttagaaaaacaggtggtagactggatttagcttgtgggttgtagtttgctggcctctggtcaaga

SEQ ID NO: 42531 - DNA, 201 bp, Homo sapiens
gaggttgcagtgagctgagatcacaccactgcactccagcctgggtgacagagcaagactgtctcaaaaaaaaaaaaaaaaaaaaaaaaattcaacatacsaattttgcgaggacgcaaacatttaatccgtagtactgatgtggatatgatttgagctaagactctgctgttgattctcttcaaaaacttggcagtagcc

SEQ ID NO: 42532 - DNA, 201 bp, Homo sapiens
atttgaaaaaaaaaaaaagtcaccaagttgtttccaattgtttttgtaaatttgcttagtcattttcagagacaaaaatttgggaaaaggattgtagaatsactggcttcccaaaaccacttggtgtttacaaagttatcaaaaacgggctgggaccactgatggtaataacaaaacctggggccctgaatcgtgtattct

SEQ ID NO: 42533 - DNA, 201 bp, Homo sapiens; identical to SEQ ID NO: 8530

SEQ ID NO: 42534 - DNA, 201 bp, Homo sapiens
agtgtgctgaatcatgttttaaacataattatatccggaatgcacttacccatttgaaaaaaaaaaaaagtcaccaagttgtttccaattgtttttgtaartttgcttagtcattttcagagacaaaaatttgggaaaaggattgtagaatgactggcttcccaaaaccacttggtgtttacaaagttatcaaaaacgggc

SEQ ID NO: 42535 - DNA, 201 bp, Homo sapiens
catcaggggagccaagtggacgctaatcaccaccgtgcctggagagttgcctttcagctggtgaatttactattgccaactcctgcattcttattagtctrtaagattgaggtcgtttattggtgatcacttgtagatatatatttatataaatctcttagcccagaatctccataaactgtttttcatgatgtggatacc

SEQ ID NO: 42536 - DNA, 201 bp, Homo sapiens; identical to SEQ ID NO: 8531

SEQ ID NO: 42537 - DNA, 201 bp, Homo sapiens
aagtgtgctgaatcatgttttaaacataattatatccggaatgcacttacccatttgaaaaaaaaaaaaagtcaccaagttgtttccaattgtttttgtaratttgcttagtcattttcagagacaaaaatttgggaaaaggattgtagaatgactggcttcccaaaaccacttggtgtttacaaagttatcaaaaacggg

SEQ ID NO: 42538 - DNA, 201 bp, Homo sapiens
ttttcaacgagagttcagaaccacaccatacgggcagtagtccgcattttcaacatttcctaacagcacaattgttaggtagctaacaattgaattgactrtgtcaggtagacttatttttcgagttgtgctggttaactgcaatccaagtttaggaagcaaactaccaatttcatttaatagaatgagctaaccaaggca

SEQ ID NO: 42539 - DNA, 201 bp, Homo sapiens
ttccaatgataaatcctccctcctttgtcacagagccactgtgtactttcatagaccatcctatttttcaacgagagttcagaaccacaccatacgggcartagtccgcattttcaacatttcctaacagcacaattgttaggtagctaacaattgaattgactatgtcaggtagacttatttttcgagttgtgctggtta

SEQ ID NO: 42540 - DNA, 201 bp, Homo sapiens
tataactatctgcatttcaggtacagtgatctcctttaaaaaggctgcgtcccagcagcatagaccagctttacctcccagcgtagtcttcagacaagttrgggtattgccgaagtccattcttgactttttttaatagtgcaaacaaatcatcttgtttttaggaaaacatgaaattataaagaaattgacttcaatcac

SEQ ID NO: 42541 - DNA, 201 bp, Homo sapiens
aatctttcggtctaagcaaattaatgtcatttttataactatctgcatttcaggtacagtgatctcctttaaaaaggctgcgtcccagcagcatagaccarctttacctcccagcgtagtcttcagacaagttggggtattgccgaagtccattcttgactttttttaatagtgcaaacaaatcatcttgtttttaggaaa

SEQ ID NO: 42542 - DNA, 201 bp, Homo sapiens
aatcaactcaattaccagccctctcagacattttcataatgttttctggtagttgctctcctgtgaaaatctttcggtctaagcaaattaatgtcattttyataactatctgcatttcaggtacagtgatctcctttaaaaaggctgcgtcccagcagcatagaccagctttacctcccagcgtagtcttcagacaagttg

SEQ ID NO: 42543 - DNA, 201 bp, Homo sapiens
accaaggtcatactaatcaactcaattaccagccctctcagacattttcataatgttttctggtagttgctctcctgtgaaaatctttcggtctaagcaarttaatgtcatttttataactatctgcatttcaggtacagtgatctcctttaaaaaggctgcgtcccagcagcatagaccagctttacctcccagcgtagt

SEQ ID NO: 42544 - DNA, 201 bp, Homo sapiens
aggatcgcttgcatccaggaggttgaggctgcagtgagccatgactgtggcactgcacttcaacgtgggcaacagtgtgagaccccatctccaaaaaaaaragcagtatagtcagtaagaaagaaaacaaactaacagtcaatattgtggctgctctcaatgttctttaaacggatcacattgccacttttttctctttgt

SEQ ID NO: 42545 - DNA, 201 bp, Homo sapiens
gttcagaggcagtgaaagcgtgcttctcaggactcattgtccagaagattctgcctacagctggttttacgcagagaagtagcacacaaacccagtccatsatttcttatttgactctgtcctgtttactctgtcagggtgaaaagcacaggccaagctcggctagtcaaagcattactttgtcacaggcaggcttggctt

SEQ ID NO: 42546 - DNA, 201 bp, Homo sapiens
tagtcccagctactcacctgtagtcccagctacttgggaggctgaggcaggaggatcgcttgcatccaggaggttgaggctgcagtgagccatgactgtgscactgcacttcaacgtgggcaacagtgtgagaccccatctccaaaaaaaaaagcagtatagtcagtaagaaagaaaacaaactaacagtcaatattgtgg

SEQ ID NO: 42547 - DNA, 201 bp, Homo sapiens
gtattctgttccctctttgctagttcagaggcagtgaaagcgtgcttctcaggactcattgtccagaagattctgcctacagctggttttacgcagagaastagcacacaaacccagtccatgatttcttatttgactctgtcctgtttactctgtcagggtgaaaagcacaggccaagctcggctagtcaaagcattact

SEQ ID NO: 42548 - DNA, 201 bp, Homo sapiens
ttcccactgcagccggtagcatattgcttcataaatgtctataaaaaaatacgaaaaatagaatcagagcaaattcagcatagacctccttgggatgtttwttctttgtttatgttggtgttttgttttgtgttgtttcagctggggtgcagttgtattctgttccctctttgctagttcagaggcagtgaaagcgtgctt

SEQ ID NO: 42549 - DNA, 201 bp, Homo sapiens
agccagacatggaatcctttcttatgattaatgcagctaaatttcccactgcagccggtagcatattgcttcataaatgtctataaaaaaatacgaaaaayagaatcagagcaaattcagcatagacctccttgggatgtttattctttgtttatgttggtgttttgttttgtgttgtttcagctggggtgcagttgtatt

SEQ ID NO: 42550 - DNA, 201 bp, Homo sapiens
cctttgcttgttaccagaagagtcgcccagttgtggcagagatcatctagctcgcaaaactgtaaatatttactctttggcctttcccagaaaaaagtgcsgactgctatgttagatactccagttcattcaaagtgatatcaccctaacattctctaaattagccacagcttagatgaaatttaggcaaatggaatgccc

SEQ ID NO: 42551 - DNA, 201 bp, Homo sapiens; identical to SEQ ID NO: 8539

SEQ ID NO: 42552 - DNA, 201 bp, Homo sapiens
gtgccgactgctatgttagatactccagttcattcaaagtgatatcaccctaacattctctaaattagccacagcttagatgaaatttaggcaaatggaaygccccaggccccaggaagactgtggcagcacattgtatgtaactgttggggatgttgcctgaaaccccccccttttttttaggcagctgcaaggattaga

SEQ ID NO: 42553 - DNA, 201 bp, Homo sapiens
caggatgtctctgacctgcagaggggctggcaaggtgggaggcatccagaccatgttacagaactcagtaatcagagcctgtgctggagccaccagcatcycaggaccaccatgtgaacctcctgacaggagcaggctcctcaatgactgaaatgaatctcagcagaactcctgtgattcataagtgactcatttactaac

SEQ ID NO: 42554 - DNA, 201 bp, Homo sapiens
tggagaagaaaatgtgatcatgataaccattcccgccattactggagcctggaccagccggccagatttccacaggatgtctctgacctgcagaggggctrgcaaggtgggaggcatccagaccatgttacagaactcagtaatcagagcctgtgctggagccaccagcatcccaggaccaccatgtgaacctcctgacag

SEQ ID NO: 42555 - DNA, 201 bp, Homo sapiens
gtgaccgagtgagactctgtctcaaaaaaaaaaaaaaaaaatggagaagaaaatgtgatcatgataaccattcccgccattactggagcctggaccagccrgccagatttccacaggatgtctctgacctgcagaggggctggcaaggtgggaggcatccagaccatgttacagaactcagtaatcagagcctgtgctgga

SEQ ID NO: 42556 - DNA, 201 bp, Homo sapiens
ctaaaattacaaaaattagctgagtgtggtgacgctcacctatagtcccagctacttgggaggctgaggcaggagaatcacttgaacccgggaggtggagrttgcagtgagccaagattgtgccactgctctccagcctggtgaccgagtgagactctgtctcaaaaaaaaaaaaaaaaaatggagaagaaaatgtgatca

SEQ ID NO: 42557 - DNA, 201 bp, Homo sapiens
cgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattaga

SEQ ID NO: 42558 - DNA, 201 bp, Homo sapiens
gagagagcagaaaatgtagcccatgggagggaggagacaaacctcaagaggaaaaagttcccaacacttgcatgtcttacttctttaacctcatagaaccyaacaaataagttataagaaagggagaagaggccgggagtggtggctcatgcttgtaattccagcactttgggaggccagggcgggtggatcacaaggtca

SEQ ID NO: 42559 - DNA, 201 bp, Homo sapiens
taactagacattgctgttttttttttaacctccttgctaataatcaatgtgattcatttgtctttacaaaaacaaaccattcttttgttttgttttttttycttcaacttttactttaatttcaggagtatatgtgcaggatgtgcaggttttttacacaggtacatgcgtgccatggtggtttgctacacagatcttccc

SEQ ID NO: 42560 - DNA, 201 bp, Homo sapiens
aggagctgggctttagcctttaaaatcgtgggtggatagggccatctggtgtgcagttgtgtaactagacattgctgttttttttttaacctccttgctartaatcaatgtgattcatttgtctttacaaaaacaaaccattcttttgttttgtttttttttcttcaacttttactttaatttcaggagtatatgtgcagg

SEQ ID NO: 42561 - DNA, 201 bp, Homo sapiens
ttgacagtccacttcattaagtggaggacagtgttttgattgctatttaatctgtttttccttctgtctgttcttggctatatggaattcactttgcctcycttcccgactcttcatatcccttatctcaaggtgagtatcgtcagaatcccggtacatttcaccagccaccttttatagaagcttagaaagatggaggca

SEQ ID NO: 42562 - DNA, 201 bp, Homo sapiens
cacctgacctcaggtgatctgcctgcctcagcctcccaaagtgctgggattacaggggtgacccaccacacccagccagagtcaagtatttcaagtattaragttgtctgcctgcctccctgtctccctgccttccttccatctgtttgttatctgacttaatctttgaaataacccaatgatacatgatatgcattttct

SEQ ID NO: 42563 - DNA, 201 bp, Homo sapiens
tctgtgcacaggcagtattagaggagtggcttaccaaatagatcttgatcgcagacacggaaaaaaggattattcctccccttttatcaagagccgtaagwccttggaaaatgcaaagagggggaaaaagaagaaaaacagcaacgagtttattggagagttaacacttaaatactccagtacattgagtgtgacatgcct

SEQ ID NO: 42564 - DNA, 201 bp, Homo sapiens
ctctaatccataaaagccgtttgaaatttccattaggagatttgcacaagtggttaaaattagtcatgcattcttggtctaaactgcaggaagggtatctytactgtgaaaatgattatgacatgttaaaactgtgtaatagtaagcagacagttttccgagctgctgggtgaattctggaaatgctctattattttctcc

SEQ ID NO: 42565 - DNA, 201 bp, Homo sapiens
tgccctccttggcctcccaaagtgctgggattataggcgtgagccactgcacctggccagtagtagacttttgatagggtttttttttctcaaggtgtagrtttggctaggaagtcatagaaaatgctctttttttttttttggagatggagtctcactttgtcacctaggctggagtgcagtggtgtgatctcagctcac

SEQ ID NO: 42566 - DNA, 201 bp, Homo sapiens
aaatgctgttcaagccatacgtcaccattggaaggttgccaaactgtgctttgcacacacatgctgtctgcacgccttgtatttttctctttgcttagtcytgctcatgctctctaaacaccccagacatcatatctctttaagaaactctggctgagtcccataatgttctggggcaacttctgtcttcccttttccctc

SEQ ID NO: 42567 - DNA, 201 bp, Homo sapiens
ttatcatttgctaatagagatctttgaaagaaaattcaaagattgaagtttgtattctcctaaactcctgcaaagaagtcctgtgcaaggatcgttcactmgtgttctgcatcgttcttcttactcaactctcccgagaggcattgtggacgcctgtggggttggtttttggcacccatccctgaccccttcttctccagg

SEQ ID NO: 42568 - DNA, 201 bp, Homo sapiens
ttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctct

SEQ ID NO: 42569 - DNA, 201 bp, Homo sapiens
cattatggtacataaaagagctttctatcgcttttttacattatagtagttattcgttattattattattattattattattattattattattattattwctgagacaccgttttactctctctttgcccaggctggagtgaaatggcacgatcgcagctcactgcgacctccacctcttgggttcaagtggttcttctg

SEQ ID NO: 42570 - DNA, 201 bp, Homo sapiens
acagtcgtgatttagggcatgaagagctcactcatcaagatgtatgtaattcagattttctgagtgtttaattcggcgtctttggtcacaaggaacagagktttacttgtgccacctcttctaagaaaaaggtttactgtaagagataatgttggcaagctgaggaaaggaggcagttttgggtaactgtctcttgcgatc

SEQ ID NO: 42571 - DNA, 201 bp, Homo sapiens
ttttaagctaccacacagatgcaggaaactaatataccctttaatgattttctccatggcctttctgataatcctttcatccttcatctcccctgtcgccsttttctttgctttgctttgcttgcttttttttttttttttttttgagacggagttttgctcttgtcgcctaggctggagtgcaacggcacaatcttggtt

SEQ ID NO: 42572 - DNA, 201 bp, Homo sapiens
attgttttaagctaccacacagatgcaggaaactaatataccctttaatgattttctccatggcctttctgataatcctttcatccttcatctcccctgtygccgttttctttgctttgctttgcttgcttttttttttttttttttttgagacggagttttgctcttgtcgcctaggctggagtgcaacggcacaatctt

SEQ ID NO: 42573 - DNA, 201 bp, Homo sapiens
attaacaacttgagtaatttatcaagttcagattctttttttcctccagaaatgctgcttttggtacactgagaggtcattcatttaaagtttgtccttgscaattccttattgaatagattccattttattttatttacattttgtacaaagctgataaataactgaaaccaaattagctcaaactggttatatttctgg

SEQ ID NO: 42574 - DNA, 201 bp, Homo sapiens
aaaaaaaaaaaaacaaacaaacaaaaaaaaaaaactccttcttcatttgttatagttccaggatagagtgtgtacctgtatagagagagtcaggcagatayaggtgtgccctccttccaagatgtgtgatggtgggcaactttctttgcatctctgagcctctattttctctatataaaatgagagagaaaaaaataattc

SEQ ID NO: 42575 - DNA, 201 bp, Homo sapiens
gagaggctgtggaaacaatagagagaatagcatggaaggccacgttgcaattaaacaagattgggaaagaagacgggactaaaatcatgccttgaagatgyttatcatatgaagttgaccttgagaccccaagaccggcttcagttttccacaatgcggctattatgagaaaaacagtgactaactgagcactgtgcataa

SEQ ID NO: 42576 - DNA, 201 bp, Homo sapiens
tggccaggagactaggcattcatagtggggcgtcctttaaggtctgaagaggacagtgaccatccaccacaggcaaacatgtgtgtgttaaaaaggaatgrcgttttggtctgtgctacaactgggatgaacctcaaacattacgctggacgtggtggcttacacctgtaatcccagcactttgggaggctgaggcaggta

SEQ ID NO: 42577 - DNA, 201 bp, Homo sapiens
atttgtgagcaaactctcagtgtgggcaggtgacaatttctgcaggtattttccccccattttaacttgtgcgatatagttccctattttgttttgttccrcctcgatcacaacagctgccacccgaggtttaaagatactgttgtcctcatcttcagaacaagggttacgtttgctgtatctggagaaagtccatagttt

SEQ ID NO: 42578 - DNA, 201 bp, Homo sapiens
tacgtctctgcagagcttacaagttattcaacagccagatttctattctgatatgcccttttagttttcaaagcatcgaaaaagggtaatctttagaaccraagtatttgcaaaactcctagacttgaataaggtatttttgaatttgaagagctaagaacccatcaaatcaaaatgctaataattcttccaagtcaaaag

SEQ ID NO: 42579 - DNA, 201 bp, Homo sapiens
gcctcccaaggccaagcccgccagccacacacacctttgtgagaattaagaaaagatgccccctcctcttggggcccacagctcctccacctgggcacccrgcctggtgaacagggtgcaggctgggatttagccctaccttgcttttggaccattgagctactaagttggagcaacaaggcttgggaatttttctttgat

SEQ ID NO: 42580 - DNA, 201 bp, Homo sapiens
ccaaagggaagaaaatagtgcggaatcttttctccaggtttcaggacccatgtctgttgtccttcctttaccttaacttcagcagggcaagaatggttcargccacattagaaagcagttactttctcacccaattttaaaggagaaaggtagatgcggtgggttctagggatttcagtgacgtaacaggtgtttcccagg

SEQ ID NO: 42581 - DNA, 201 bp, Homo sapiens
gcaagtgtgatcattcaggtaatcaaagtaactacagaaacagaggtatggattagctagtcattgcagatgtggcattgagcatataagcgtggtgtacwtcttagaacttcatctggaaatgcctgtgggggagttggatttcaagatcatcgtcaatgtcatgtcactgtaatttcatttacattaatcagattagtt

SEQ ID NO: 42582 - DNA, 201 bp, Homo sapiens
cagctaggaagtagcaaagatggaatttgacccaggtctgactccagaagcactttcctcttttgcctcctaatacattttcttatagggagcatcctgcwatacaactgttaagaccacttaatgttatctttggattaaaaatggtaccactctcataaatcaatgagtttcataccctaaattatgccagattaagaa

SEQ ID NO: 42583 - DNA, 201 bp, Homo sapiens
ggttcccacaagagagaagtagacagagacctctggaagtttaaaaatatatatgttgggatttcatagatgaggtgagcaaaaaattggccgggaagaamtattaaggaggagatgatcagaaacattttcaaaatacctggaacaaacaaagaaccacatttcaagaaaaagacagagaaacaagactagcaaatagag

SEQ ID NO: 42584 - DNA, 201 bp, Homo sapiens
ttagagacaaagtgttttacttatggccagtagatggaattctaaggtccgatgtcggtttgccatgacttgggcattggtttctgttcggctctgtttasggggctgtgggatgggtacatagacactcgtctacttgaacttccagggactcgggaggcctgcagttgaataacaagagaccgtgctggtgagaggtgg

SEQ ID NO: 42585 - DNA, 201 bp, Homo sapiens
agatacaagaaggccacatgtggtggttcacccctgtaatcccagcagtctgtgagactgaggcagaaggattgcttgagaagtttgagattggcctgggmaatatagcaagatcccaaccctattaaaaaattaaaaatgaaaataaaattttaaagaaaggtatttctccccttcacggtaatttggagccaatacttc

SEQ ID NO: 42586 - DNA, 201 bp, Homo sapiens
caagcgattcttctgcctcagcctcccgagtagctgggactacaggcacacgccaccacgcctggctaatttttgtatttttaatacagacagggtttctmcatattggtcagggtggtctcgaactcctgacctcatgatctgcccgcctcaaagtcccaacgtgctgggattacaggcatgagccaccacgccctgcta

SEQ ID NO: 42587 - DNA, 201 bp, Homo sapiens
tctaacatttgctgagatcctgctgtataccgggaacagaacatatatggtttcatttcatcctcccattatcaccgtgaggcctcttccgcttatctatkgctgagtaacaaggtgtacccctcaatttactggcgtaaaacgacaacagttttattacatctcatgattttctgggtcaggactctggatagggtttgg

SEQ ID NO: 42588 - DNA, 201 bp, Homo sapiens
tctgcgtaactcggcctcccaaagcactgggattacaggcttgagccactgtgcccggccatctttctttttcttcctctccttctaccttgcccaccatrgcttaatttcaccagaatatcatcattatcaacatcattatttctagttcagatcattctaaaaatagagcagtcattttcttctatataagtcccaggt

SEQ ID NO: 42589 - DNA, 201 bp, Homo sapiens
ttttcactaggtttaagtgagaatatttgtgagcaaactctcagtgtgggcaggtgacaatttctgcaggtattttccccccattttaacttgtgcgatayagttccctattttgttttgttccgcctcgatcacaacagctgccacccgaggtttaaagatactgttgtcctcatcttcagaacaagggttacgtttgct

SEQ ID NO: 42590 - DNA, 201 bp, Homo sapiens
acacagttgttcacaaacatattgatatcagaccttatagcagtcctattggctagatcagttattatgaatgtgttttatagagtaggaaacagagatgygacgtgacttgcctaagaacacacagcagttctgaaactcaccctgtgctaatctgacctcgtgaagaaattgagcaaactaggctccagggagaaacga

SEQ ID NO: 42591 - DNA, 201 bp, Homo sapiens
agcctcaaactagaacgtggcttttgaacggtgaacattccacaaacatttaatacagagatggctgtggggtgggggctgggggctgggggcctggaagrggagaaggggcaccagaaggagaaatgggaggaaagggcgagtgagatagcaaagagaactcagaaagtaataaagccctgcagtaatcagagggctgag

SEQ ID NO: 42592 - DNA, 201 bp, Homo sapiens
cgtattcagcaaccaaaattttatcacttgcctgatactgcctggtgagcaggtggaaatgtagacacccaaacacccttcatggattcccagctgctgasagtttgaatagtatgtgaagtctgtagagacaaaattgttgttttccccagttgtaaagtgtgcaatattatccttgcaaaattgtctgtttattttttt

SEQ ID NO: 42593 - DNA, 201 bp, Homo sapiens
aaaatgctaacccatatgggagaaatttccaaagaattaaaaccacccaccaggaaaatgggaaagtctcccctccacacacacacacacgcgcgcgcgcrcacacacacacacacacacacacacacacaaaatcaccaaatcacacctgaacaagaggaagaaaattaaactcattgaggagataccatcttttttaaa

SEQ ID NO: 42594 - DNA, 201 bp, Homo sapiens
cccattaaagaacacagctcatggtcggtccattaactactaattatcaaaacagtgggtgaaaacgatgtttggaaatagctgcgactctcgcgtgatasgaaaatatctgtgatttcgattgcgacaaacacacagatgcttctcacacgatcgcagtgcattgcctaaatgacagtaatgctaaactccagtcagatg

SEQ ID NO: 42595 - DNA, 201 bp, Homo sapiens
ttagcgagatattgtctctactctcaagaaactcgctttctttgggaatcatcacctgtttttgtgtcacggaccccttgggcatttggtgccctttgcasaataatggttttgaatacataaaacgcacgggatcacagaggaaaccaatcatattaaaatacagttgtcaaaatattaactcatgggatctagtaacaa

SEQ ID NO: 42596 - DNA, 201 bp, Homo sapiens
gaacatagacccagaactgccatcttttctaatttttttaaaaattagaggctaaaagttttggcttataaaaatggtatttcctgagtttttacaattayagtattaagatattcctaggtttttgtttgttttcgagacgaagtttcgctctcatttcccaggatggagtgcagtggtgcaatctcctccgcctcccag

SEQ ID NO: 42597 - DNA, 201 bp, Homo sapiens
ggtgctagggtaaggcacgcaggatgcaagattagcgagatattgtctctactctcaagaaactcgctttctttgggaatcatcacctgtttttgtgtcayggaccccttgggcatttggtgccctttgcagaataatggttttgaatacataaaacgcacgggatcacagaggaaaccaatcatattaaaatacagttgt

SEQ ID NO: 42598 - DNA, 201 bp, Homo sapiens
gcagtaaaatagtttttcagtcactttgccttcatttgtttgacattcttggaatatttgggctctacaaggtgctagggtaaggcacgcaggatgcaagrttagcgagatattgtctctactctcaagaaactcgctttctttgggaatcatcacctgtttttgtgtcacggaccccttgggcatttggtgccctttgca

SEQ ID NO: 42599 - DNA, 201 bp, Homo sapiens
aaatcaggatgctcaggaaataccttgtttggaataggaataggctcctccctttttttctcacttgccttgattgctctgtattaaaattcataaaggcycatgaattatcaattagatagcatttggtttgttatttttagtttcttcctatagcaggcatgtatgcatgtgttaaaaatggaagtagcgtcgacatta

SEQ ID NO: 42600 - DNA, 201 bp, Homo sapiens
actttgcagattttgctttcaaactctctagctgcggtttgagtgattaatttcaggatccatcctatttcttagaggaagccactctgatctaccctgtygtctctttatattcaagatatcctttatagagctctcaaattacttttgggaagaaggagctatttaataaaatacaacttaagtgaaaacacattccat

SEQ ID NO: 42601 - DNA, 201 bp, Homo sapiens
ggtcttctaattctctgtgatgaagttcaaactgaagactgttactagtgtcgtgtttgtttctttttctctctcttttgttttgtttgtataaaatgccrgggatgaagggatccacttaataaaaaggcccattgtgttcagggagcagcctgttctgccaaatcacacaagggcatgtgttttcatgacattattgct

SEQ ID NO: 42602 - DNA, 201 bp, Homo sapiens
aatctcagttccttttattagaaaaaaaaaaaaaaacaactcccctggagcctttgtaccttctgcagtttggggttgttgtcctttttgcttggtgcacrggaatacttggtgatgttctttttaaaactgccctcacattgtatcctggaaagttcatttacctgtacccggagttggaacttctcttccacatctttt

SEQ ID NO: 42603 - DNA, 201 bp, Homo sapiens
agacaggtggaagttgatgctaaagattggcgttaaattgagtaaaccattcatgtagtaaataagataatttgtttctgccccccaaaagattaaaatayagatttttttcaaagtctgtttttttaacacctacggtccctgaatatgttcgattgaggtttgtgtctgtaatttggaacggctttttgttgcaactaa

SEQ ID NO: 42604 - DNA, 201 bp, Homo sapiens
agagttgacggagaggggacaggaggtgactagatttggaaggaaaattagaaaacttttggccgggcatggtggctcatgcctgtaatcccagcactttygggtcagttgagtctaacataggggtgtccaaacttttggcttccctgggccacattggaagaaaaagaattgtctttggctgcacataatatacaattg

SEQ ID NO: 42605 - DNA, 201 bp, Homo sapiens
tacctgcaattctttgtacatatgaaatttaatatggtgagattggcatctagctgctgctagagatagtgctcataataatttttaacattgattgagtrtggataataatccaggagctgtgctaaacgttttacaacacattatctcacttaatttcacaactccataaagtagttttcacttagttgagggatgaaa

SEQ ID NO: 42606 - DNA, 201 bp, Homo sapiens
aatctctagggacagaccgaggtttgagagttcctgctcctgatctcaggggaatcctgaattacaggtgttaacctgattagccccagcccagctcttcrttaattacctgaagtgaatgggacagtttccaatactcagcacaaaggcgtgcgcagtgactctgtggcgtactatctatttggccttggaaagttactc

SEQ ID NO: 42607 - DNA, 201 bp, Homo sapiens
cacaaatgtgatccttctggaggccagaagatagattcagtgggccccagttctttcaggtttaaggaataagcattttggtctatgaaaaatggggtttkcctaaagtataagattgtcttatatttataaatgcctgtgttcattgctgtgggttcactgctttctcttttgggcagccatataaataaaagaaccacc

SEQ ID NO: 42608 - DNA, 201 bp, Homo sapiens
agtaggagatatatcttacttaaaaaaaaaaaaaacaaacaaacaaaaaaaaaaaactccttcttcatttgttatagttccaggatagagtgtgtacctgkatagagagagtcaggcagatacaggtgtgccctccttccaagatgtgtgatggtgggcaactttctttgcatctctgagcctctattttctctatataaa

SEQ ID NO: 42609 - DNA, 201 bp, Homo sapiens
aacccctccacagcctctgctataaaggaatttacatcttgggtctgtaggagtcctcacaaagcacaacgtcctactccactttatcagaagttatctasgttacttgaagatgaactgaggccccgtaacagtagcgattgccccctcatgcccatttctccctgaacccactcagtcagacactgtcagtccccatgg

SEQ ID NO: 42610 - DNA, 201 bp, Homo sapiens
cttcctggccgtgtctagggcctctatgctgacttcctcctctgtggatcctgcagggttcacatctgcaggctgacaacatgaggcctcggggaactttstaagggtagctgaggattctcccaaatcaagatttccaagtcatatagaccaaggcttcatacattcattcatttaacaaacataccaagtgctacatcc

SEQ ID NO: 42611 - DNA, 201 bp, Homo sapiens
ggttgtttgggagggaatgataatgacaagaacagcagcggagtcagcagctcatttactgagggcttatgggccatacgtggaaaatattttgcatgtaygttttgattcaattctcaaagcagtccttgggagtagatgctattaatatctctactatacagataaggaaagtgaggctagagaggatatataatttat

SEQ ID NO: 42612 - DNA, 201 bp, Homo sapiens
tcaattctggtcttcaccatctgccaatgtgagttttagtttctctataaacttttaaactttaaactttttttcttttttttttgggggggggggcaatscattcttaacccccttccagtttttctcagcctattcttgtttgtttttgttttctatttctgtttcattgagatgcatacaaaatggaagatggccaac

SEQ ID NO: 42613 - DNA, 201 bp, Homo sapiens
aggccctggggtggaaacacactcgatgtgttcaagggagagtaagtggtgaatgggtttggagccaacagggataatagacaacgctatcaagagggggsccaaccacacatgtgcagccactgtatgacgtctggattttccttgacttatggtgatcactattgggaggtggtaagcaaacaggtgacataatttgaa

SEQ ID NO: 42614 - DNA, 201 bp, Homo sapiens
tgctgggattacaggcatgagccatcacgcctggtgaatggtgtcattttgatgtactgagccatctcagtttttccagcaaccttccctcacctttgtgstcagctagaaggtcagttaacacatgggatgggaattcttgccaatgtccttcgtaaaagaagaacttctccttcactcacatgtcctgatacttcctca

SEQ ID NO: 42615 - DNA, 201 bp, Homo sapiens
tcctccaaatatgatacacaaattgccaatgaatacataaaagatgttcaatctcattagggaaatgcaaatgaaagccacaatgagattccacttattgmtaggatggctaaaataaaaaagtcagataacaaatacttacaaacacatggagagatgaaagttcaaatacagtcctggcggaaatgtaaaattgtatgg

SEQ ID NO: 42616 - DNA, 201 bp, Homo sapiens
tgcatagtattctatcatatggatatattctaaatgtaataattcctcaatggtatatttagtttactttatatttgctgctttagtttgtcacaaacacygtggatagccttgtatatatttattttgttgtatagttcttattggtacagtatgatttttcacaagtatacaattactttctgagaatttagctttttg

SEQ ID NO: 42617 - DNA, 201 bp, Homo sapiens
gagcatgaccctgggggcctctggaacagctgctcacacactccctttaggaggcccaggctctcaggggaggcccatagtgcagctaggagctagagttktaggatgaagaaattacaggtaagaacacagccccattttaagaaataccagtgatttctgtttttccttgttcttctttccctcagtattttattaaca

SEQ ID NO: 42618 - DNA, 201 bp, Homo sapiens
agaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctg

SEQ ID NO: 42619 - DNA, 201 bp, Homo sapiens
agctggtgacaaaactcaaagaagatgtaactagagaaaaggtactcagtgcagcctctgtgagctaccaccactgcctctagttttccagaaaaccaccmctgaccactctctgtacagatgcgctcaagcgaccataaccaccagtgttcctaacaatgcgcctattgacttcttatttcaatagatatccagatttat

SEQ ID NO: 42620 - DNA, 201 bp, Homo sapiens
gcctcctagattcaagcgattgtcctgcctcagccttctgagtagctgggattacaggcgcccgccaccacacccagctaatttttgtatttttagtatakacggggtttcaccatgttggccaggctggtctcgaactcttgacctcaggtgatctgccctccttggcctcccaaagtgctgggattataggcgtgagcc

SEQ ID NO: 42621 - DNA, 201 bp, Homo sapiens
gggcagccacatagacaacatctaaatttttgttgctttcctgggtcttgccctgtccttactgtttcccttgggcacgctgttcaccccttaggacatastacagtaaccttttcccaccaccgtgggaggactgtgattttgtaaatgtcctctgatctctcctctttgcaggcgcagtgacatttatgcacactggct

SEQ ID NO: 42622 - DNA, 201 bp, Homo sapiens
gtttcttgtagcaggtcatgaagaggaatgaaatactataatcacagagcttgcagaagctgcctggaggaccagttagtctattttttgtacatgaggayactgaggctcagagaaagtgaggtcattgagtcacttgagttcttgttgagtgttctttcctgctgaggtgtcctaggtgcctcttaatgcctttaacat

SEQ ID NO: 42623 - DNA, 201 bp, Homo sapiens
caatagaaacaccaagaacatggattcatcaaaggaaaaatgttgaagtttccatttttatgcttcctggtaatccttcagcccttgatggaaatttccaracctaaaccagtgaattaagagtatggggaagaggagccctcatacagttctgttaaatggtcctttaatattcttcttcagagtgacgggtaccccttg

SEQ ID NO: 42624 - DNA, 201 bp, Homo sapiens
gggcctaggcccaagcaaccaggactccctgtagtcaaccccactcctcaatttttggcacccatgttattccacctcaagatcatgtcctcttttaaccyctctgaatatgctcctcctgtgatacccatagggaccctgaacctctagtcctcaagagcagtcattcacccctttggactatggatccctttgcaaccc

SEQ ID NO: 42625 - DNA, 201 bp, Homo sapiens
atgtcactgagtacatccttgctgtttttcatgaattttccactgagtcgcaacatgccactggccagtgaaggtcaggcaggaaacagattaacaacatstcataccacaatgtcaaaatacttaaaagtgtttacagatgccagtgacacccagtgaatctaaaacaagaggaccagagcagaagtaaaactattcttg

SEQ ID NO: 42626 - DNA, 201 bp, Homo sapiens
gttggaatgttgcagggaggctgggctaaggtgttctgttcctgtctctggttcaaaggaaaggaatagcctagacctaaaggattctgtctggtagctgkttgctcttcgcgcctgtgctttgaatggtgaataccctcggcgggaggcaggcacctgatgccactgcccccgccccacctgcccccgccccgtttctca

SEQ ID NO: 42627 - DNA, 201 bp, Homo sapiens
gcatccaccaagtgcctggtgcagactggatgctcaataagtctttggtgggtccatgtattgaattggaatctgcacattatggccattatttaggtttmttgtgtcctaatctatgtcactgagtacatccttgctgtttttcatgaattttccactgagtcgcaacatgccactggccagtgaaggtcaggcaggaaa

SEQ ID NO: 42628 - DNA, 201 bp, Homo sapiens
gtgcttgctttgggagttcttgttaaccctgacaattcttgtcaaatatcttactcctgggctgtgctggggatggcagcagagtggggtggttggatggraaggcgggaaagagctagcttggagatgatacgcttttccatccttgaataacttgggaaaaagtcaggagtgtggaatgaagaattggaatataaaggc

SEQ ID NO: 42629 - DNA, 201 bp, Homo sapiens
atcgtgtccagcctaaatggcattcttggaagtaaaaccacaggggatctgttggaagtggcatgatggaggaattttaaaagaattgaacaaataaaatrgtcagagctcaaaaattgagtactgcttcgtttctcccaaataaccatcaccagacaaacaggtgtgtgtgtgggtgggggaggtggcctggtggtactt

SEQ ID NO: 42630 - DNA, 201 bp, Homo sapiens
ctgtccttactgtttcccttgggcacgctgttcaccccttaggacatactacagtaaccttttcccaccaccgtgggaggactgtgattttgtaaatgtcytctgatctctcctctttgcaggcgcagtgacatttatgcacactggctttgaggctcattgatcttttgttttatttgcctttgctgaggcaggggcagg

SEQ ID NO: 42631 - DNA, 201 bp, Homo sapiens
gtctcaaggaactatgataagtagcaaacaatatcccagaaaaatctccagtcaaaaatccactggaggccaggtgcgttagctcatgcctgtaatcccarcactttgggaggtcgaggcaggaggatctcttgaggctaggagctcgagaacagtctgggcaacatagcaagtctctgtctctacaaaaaatacaaaaat

SEQ ID NO: 42632 - DNA, 201 bp, Homo sapiens
gttttgagtacttagtactttttagtatgatttatttaatagtaaccttatataatgtttttcttttaattgttttattgagatgtatttcatacactttmcaataagcccatttgaagtgtaacattcaactttttttagtatattcgcatggttatgtaattttcatcaaaatctaattttagagtatctttttgtccc

SEQ ID NO: 42633 - DNA, 201 bp, Homo sapiens
aaagtggagttggggaacacgttattatatagtattttcaccacacacaggatacagtcaatgacttcaagagcataggtaacagtaaaatgtagtaaaasaatttagaagtcatgagttttgagtacttagtactttttagtatgatttatttaatagtaaccttatataatgtttttcttttaattgttttattgagat

SEQ ID NO: 42634 - DNA, 201 bp, Homo sapiens
cattcttctgcctagagtatgccttttccttcaccaaaccaagtggctctttcggaagacttgcctgaatcctagaccccttctctctacaaccttcagtstgagttgggtaccttgcatcctcctttgttcccatactaacccctacaaccatggtcattttgtggttatctgtttaattctctgctggctattccaggc

SEQ ID NO: 42635 - DNA, 201 bp, Homo sapiens
ggtggaattgttgtgtgagcctgtagagtccgtgttcttacccactgcatgatgtctgatcatcgtcaattttctttccatttggacagatgaatggtaayacttccctactaggtagagcaatgattccagaagtttataataattggaaagtgtattagtcgattctcacactgctataaagacattcctgagactggg

SEQ ID NO: 42636 - DNA, 201 bp, Homo sapiens
tgatgctagctgctataacaaataagcacgcctgtgcacagttgctcaaagatagtagaagtttatttcttgtttatgtaagatccataatgactcttgcyaattagcaggctgctctcttccaagtggtaacccagggactcaagctcttttcatcttgtggctcagccgtctgacacatgtggcttccagcactgccct

SEQ ID NO: 42637 - DNA, 201 bp, Homo sapiens
cggtccccatccacttgacccaccatacctcaagccacttctggctccatgctctttctttccttagggttttgaaacatgttcttcagcctagaatactsctcctccactcttaatttctacccatcctgcaaaactcagtctgaacagcacacgtcaaggaagcagttttggtctctcagattatatgaagctctccaa

SEQ ID NO: 42638 - DNA, 201 bp, Homo sapiens
actggctttttgagcctctagagtggcaggcgaactctgattttgaggaaaaaggatagggtaatggtgttgacacaggcactgttgaatacgtatgtacrtattttaatagttttctcattaatcaaatggaaatgctatcgattttataggatcgttgtgagaagaagtgagaattgaaatgaaaggcatctagtcttc

SEQ ID NO: 42639 - DNA, 201 bp, Homo sapiens
aggctcagttaatgataaattgttatcaggagacccagcagtttctgctttttctaccctcctctttgacctctatttaaactaataggttactgggtttsaacatgccatgcagtgggaagaggcgggaaccccactgagctgtcctctaagtgaatcatgcccactatttggttgtgaggctgtggactttacttttca

SEQ ID NO: 42640 - DNA, 201 bp, Homo sapiens
gtattaatagtagggagacagtaagcaagcaaggctcagttaatgataaattgttatcaggagacccagcagtttctgctttttctaccctcctctttgasctctatttaaactaataggttactgggtttcaacatgccatgcagtgggaagaggcgggaaccccactgagctgtcctctaagtgaatcatgcccactat

SEQ ID NO: 42641 - DNA, 201 bp, Homo sapiens
tctcgatctcctgacctcatgatctgtcagcctcagcctcctaaagtgctgggattacaggcgtgagccactgcgcccggccggggatcttgtattaatartagggagacagtaagcaagcaaggctcagttaatgataaattgttatcaggagacccagcagtttctgctttttctaccctcctctttgacctctattta

SEQ ID NO: 42642 - DNA, 201 bp, Homo sapiens
cattttccccagacctaacctcgatttgtgctccaggtctgagcagaaatgttattccctccagaaagccttccctggatgttgagggatgaagttgtagscccctcccgaatgcgtcctcagaactcgctggttctcgtcctcgccctcagcatacttgctcattgtttgtttccatctctatcatctctgtgagccctt

SEQ ID NO: 42643 - DNA, 201 bp, Homo sapiens
catgccagagtgaaaacgcgaaagaaaataaacaggcagcactgaggaattatacacttgagcttggcatttttcttaacgcagggctattttaggtgcastgcgcatgttggaggtgcccttgcaggtataggtaggcattgtccatccgtggtaaaaagcaatagaagaaattcttacccgatgcttaatgaattgcca

SEQ ID NO: 42644 - DNA, 201 bp, Homo sapiens
cgatctcggctcactgcaaacctctgcctcccgggttcaagcaattctcctgcctcagactcccgagtagctaggactacaggcgcgtgccaccacacccrgctaattttttgtattcttagtagagacgaggtttcacggtgttagccaggatggtctcgatctcctgacctcatgatccacccgcctcggcctcccaaa

SEQ ID NO: 42645 - DNA, 201 bp, Homo sapiens
ggttgcagtgagccgaggttgtgccactgcactccagcctggctgacagagggagactctatctcaaaaaaaaataataaaaataataaaaaaaaaattayatgaaaaatagagacaaagtctcgctttgttgcctaggctggtcttgaactcctgggttcacgtgatcctcctgcctcggcttcccaaagtgctgggatt

SEQ ID NO: 42646 - DNA, 201 bp, Homo sapiens
accctggacagatggattttctaaaattacagaggaaactagatctgtaactctgtacatttactcctgtgccagtaacaatggcaatattttaatactgwaataaattttttcttatgcatttgctataaattagtaaatctgtgtaaagctgcttattgcatcatcatgtagaatttctacatcctgcagaagtttaag

SEQ ID NO: 42647 - DNA, 201 bp, Homo sapiens
tggttaattaaagcttattgtatgccatgggccattctaagaacttccatccacccaaaagcactatgaaatagatgttgttatttcactgatggaaaaasaagcacagagaggctaaggaatatgctgaagcttgcacagctagtaaatggcagaacattcagactggaattcagacttatacactcacattcataccac

SEQ ID NO: 42648 - DNA, 201 bp, Homo sapiens
atttattgtaatggtaaattacactaataataatctggggatgaaaacagggcaggcagtgaaacctgaatctcagctggacgatgaatgagttttaatgyaagtgtatcgacgtgctgtactcctaacacattatttgttatctgaaatttagatttccttgggtgtcctgcctttttttttttttttttttttttttga

SEQ ID NO: 42649 - DNA, 201 bp, Homo sapiens
ctgtggaactatgagccaattaaacctcttttctttataaattacccagtctcaggtaattctttatagcaatgcaagaatggcctaatacatggtctctsagcaggattattgtagaggggactgatgttgaagaatggaaaagaaggcagtgtcagagaatgctgaagagtgtggatcttaaagtccaacctcaaggcc

SEQ ID NO: 42650 - DNA, 201 bp, Homo sapiens
atggaaaggatctattcctagaaaggatccattcctagaagaggaattctgtacaatatggccaactttctctctgttgaggttgaaccatttgacacatytcgctagcattgggaaaatccccattttcctcactatccatttttcttcctctctttccttcctcttttcccttcttcctctttttttttcttttctttc

SEQ ID NO: 42651 - DNA, 201 bp, Homo sapiens
ataaacagaaattagctgggcattgtggtatgtacctgtagtcccagctactcaggaggctgaggtgggaggattgcttgagcctgggaagtcaaggctgyagtgagcaaagatcacaccactgcagtcaagcctgggtgacagggcaagaccctatatcaaaaaaaaaaaaaaaaaaaaaaatatatatatatatatata

SEQ ID NO: 42652 - DNA, 201 bp, Homo sapiens
tagagggtggggagagagttcagtatgtcaggactgctacatttatgagtgtgggtctttattgaagtctctctttgtagccaatccttttttttttttttaatttttaaattttaaattcttacttttagatatgggggtctcactctgttgcccaggctagagttcagtggcacaatcatagctcactgcaacgttgac

SEQ ID NO: 42653 - DNA, 201 bp, Homo sapiens
tgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccac

SEQ ID NO: 42654 - DNA, 201 bp, Homo sapiens
ttattgatttgtaattcaacaacttcaacatcttaccaagaagaatgtgcagttattctagcaggagaaacaatgcaattagagcctgcgagatgaaatcmaattgttttataatgagaaattagggaattcgaggcagacattagctgtgtaattgtggaaagggaagaactgtagttagagcatattagaaatctggcc

SEQ ID NO: 42655 - DNA, 201 bp, Homo sapiens
ggaagatgtgatttcattcttcatgcttgtaaattattatttaagctgtgaataccctctcttttcccactgaagttgtggttgtaagattctcagagttragcagactcggcaacattacagaaaaaaaatcaagatgtaaaaaggatttagacgtctggacgtggtggctcatacctgtaatcccagcactttaggagg

SEQ ID NO: 42656 - DNA, 201 bp, Homo sapiens
atctgatgggtgtatcaggagtttccgcttttgcttcttcctcattttctcttgccactgccatgtaagaagtgccttttgcctaccaccatgtttctgargcctccccagccatgtggaactgtaagtccagttaaacctctttttcttcccagtctcaggtatgtctttatcagcagcgtgaaaacggactaatacagt

SEQ ID NO: 42657 - DNA, 201 bp, Homo sapiens
caatctatatgtccaacgccattcgtagaccccctttgataatctccactaagcagacatactcgatacatcttcactaatgagttctgacttcataaaawgtattaatgacttctttttgaaagtaagagtgctttgaataccagtcgttattgctttagaagttcataaaagcaaaagcacagtatttcccccagtgtt

SEQ ID NO: 42658 - DNA, 201 bp, Homo sapiens
gccagtgattctatataaaccgttcagtaaaatgaatggcatatgcgtatgtttcaagagctccagcagcctacccaggatggcttgatgttgtctcttarcaccgtatcaatacctgggggttttcaaatattgcaggtggccgaagcctttgtgttgaggtttctgtagtgtttatccatttgtgaaaccaggcctcaa

SEQ ID NO: 42659 - DNA, 201 bp, Homo sapiens
tattgaatgaagacatgaaagcatttggtggaaatagggcacacacatgaatatattcacagttgcaaactcagaaggatactcccaacctggttctttgkcttgtccctccatctgggtgctttccagtcacagcctggatgcatgtatgaataaacttctaccattaagtccctgaattatttaagcactgccagtgat

SEQ ID NO: 42660 - DNA, 201 bp, Homo sapiens
cttgtggttccttgtagtaatttgcatccactgaccctcccactcccctgctactctgttccttgactataaatctccagctgtctttattatatttggarttgagccctatctctctcccctattgcaacagccttgacccctgttgaaataatcctgcataaagtcttccttaccattttaacaaatgtcaaggtaact

SEQ ID NO: 42661 - DNA, 201 bp, Homo sapiens
gttggaatactcctacccttgtggttccttgtagtaatttgcatccactgaccctcccactcccctgctactctgttccttgactataaatctccagctgkctttattatatttggagttgagccctatctctctcccctattgcaacagccttgacccctgttgaaataatcctgcataaagtcttccttaccattttaa

SEQ ID NO: 42662 - DNA, 201 bp, Homo sapiens
caggacaggtgccctcctcagcggagacaactgtccccctccatcctgcaggagttttgcagccatccttccagccactgcttctctaccggggcaaattytcccccaagggataattgataatgtctgaggcatttttaattgtcacaacttggggaaggggcaagggattgagggagagtgctcctggcatctggtggg

SEQ ID NO: 42663 - DNA, 201 bp, Homo sapiens
atagaaacttttgccttcattatatcacctttacaccccaggacaggtgccctcctcagcggagacaactgtccccctccatcctgcaggagttttgcagmcatccttccagccactgcttctctaccggggcaaattttcccccaagggataattgataatgtctgaggcatttttaattgtcacaacttggggaagggg

SEQ ID NO: 42664 - DNA, 201 bp, Homo sapiens
tgagagaatagaaacttttgccttcattatatcacctttacaccccaggacaggtgccctcctcagcggagacaactgtccccctccatcctgcaggagtwttgcagccatccttccagccactgcttctctaccggggcaaattttcccccaagggataattgataatgtctgaggcatttttaattgtcacaacttggg

SEQ ID NO: 42665 - DNA, 201 bp, Homo sapiens
ccaccatattgagagaatagaaacttttgccttcattatatcacctttacaccccaggacaggtgccctcctcagcggagacaactgtccccctccatcckgcaggagttttgcagccatccttccagccactgcttctctaccggggcaaattttcccccaagggataattgataatgtctgaggcatttttaattgtca

SEQ ID NO: 42666 - DNA, 201 bp, Homo sapiens
gtacaaatgaacttgctacttggtttgctgccaattgctgccgaaacaggagttatttaaattagtaaataatttttgaaatcttcttagaatgtcacagsccacaattcaaattcacagaccaggaatggttattatttctatatatcttaaagttttctgcaatagaaatgcatttcaaatataagctagaaaaaaaaa

SEQ ID NO: 42667 - DNA, 201 bp, Homo sapiens
tcttctcaggcttccaaccactatgtttggaaatgaaatatgccttgaaggaaaaaagctgccaaatgctggccttgcagtttttgcagatcttggccccmaaaattcttagtcatagtgcccttctgatgccttcaaacagatatgggtgtgtatgcacgtgtgttattttgtccatcttttctaattgttctcagtagg

SEQ ID NO: 42668 - DNA, 201 bp, Homo sapiens
gagcttctctttgttcccatatgtttcagtgaagcagttatagcttcagaaaagagggagccaggaaatacacttgtaattcatcactccttttatagtcmgagcataggaacactcatagtatgtatcagaaactagtgaacacatgttgttttacagctctgtctgcaaaattgcatcgtgggcctctttggggagtgt

SEQ ID NO: 42669 - DNA, 201 bp, Homo sapiens
agatggttctatgttgtcaggggctgccctgttcatggtaagatgttttgtaatgcctggtgtttacccactagatgccagtaggactctaccccacaacygtggccactgaaaatgtctccagacatttgcttctgtcccctggggatcaaaatcacccctggttgagaacttggggtaatttaagtggtgctccggtaa

SEQ ID NO: 42670 - DNA, 201 bp, Homo sapiens
tgacagagtgagactccatctcaaaacataagtaaataaataaaaaataaatataatacagacacaggcttttctccccacctcttttaattcttgaaagraacagtaacaagctcctattcctgtttccttgccaggagaagtattgttttcatataaatcatttgtgacagaagctccttatttttaagtggaaaatgc

SEQ ID NO: 42671 - DNA, 201 bp, Homo sapiens
ccaagtcttttgccctccatggtgcacatgtgatcttggcctgcaggaacatggcaagggcgagtgaagcagtgtcacgcattttagaagaatgggtaagygcttgactgttgttgttttttttaattgtcaaatacacatgccgggctaaccatatggagatttcagtggagtgtgtaaagtttattgctcttggaatca

SEQ ID NO: 42672 - DNA, 201 bp, Homo sapiens
agtgggttgcgcctgtaatcccagcactttgggaggccaaggcgggtggatcacctgaggtcaggagttcgagaccagcttggccatcacagtaaaacccygtctctgctaaaaatacaaaaattagccaggcatggtggtgtgggcctgtaatcccagctacttgtgaggctgaggcaggagagtcacttgatcccgggg

SEQ ID NO: 42673 - DNA, 201 bp, Homo sapiens
aggaacatggcaagggcgagtgaagcagtgtcacgcattttagaagaatgggtaagcgcttgactgttgttgttttttttaattgtcaaatacacatgccrggctaaccatatggagatttcagtggagtgtgtaaagtttattgctcttggaatcatgtctttatttttaaagtcatcttcactttgtttgtcttatgaa

SEQ ID NO: 42674 - DNA, 201 bp, Homo sapiens
taaaaacagaaacagagcagtccctttgcttccgaatgcagccctcccattggaatcactttggaagaatctggatctgcgtgttacccagtcttactttkcaggcagtcccaggcaggaaggcccattagtgaaaagagccctgcatatgctgtgggtcatcacagctgctgctttgcacatttaggagatatttgtgga

SEQ ID NO: 42675 - DNA, 201 bp, Homo sapiens
agagtccctgtgcttcccagtttactctggagacgactgaggctcacagaggttaagccacctacccaggctggcaccgcacactttgttcagagtgggcytggcatacggcatcagttcagcctggccctagacccttttcctcccacaaccatattgcccccagtggagagacaggaaagcagggaagggggcaattgc

SEQ ID NO: 42676 - DNA, 201 bp, Homo sapiens
tcctttaactcatttattaagaaaaataaaacgtggtgaacgcccatgattgcaactaggagactgttatgcttatggttgttaagattagaaagaaggargctttaaccctatctctgatttcttacttttctctgtctatgtagaagttgatgttgatacgtgtctacataaatatttactaagggcttgcattagtct

SEQ ID NO: 42677 - DNA, 201 bp, Homo sapiens
ttccctttggtggccatttaggttgtttgcattgttttgctatttgttattccaagcaatggtgtttcacagttctctctttcttgcatcagtctttcttrcgatatcatctgatattgggcctaaactatgctgctgtgagcattctttatttacgtatttgtgagtaaatgcctggggcagaatcttagcactggactc

SEQ ID NO: 42678 - DNA, 201 bp, Homo sapiens
agaatctaattttactgtgcattttcttgattattagtgaagctaaacattattttttattgatgtgttaacaatttctttcttttgcaaatgatctattmatgttctgtgactgatttctatcttggtgtctttacgtttgtgaatggtaagaatttttatgtgttcaggaactatttaaatgttcaagacattaacctg

SEQ ID NO: 42679 - DNA, 201 bp, Homo sapiens
aaatactgggattacaggcatgagccatgtccagctgccttgtttttttctttgaagagaatgatagaccttccataggaaaaatgttaaatatgtgtgtrcagaaataaagatttcaaatatttttgcaagatattttttctaataccacttttttctacattttccataatttagtgaagatagtaaattaacaaagtg

SEQ ID NO: 42680 - DNA, 201 bp, Homo sapiens
atgaaggacgctattttaatggggtgatttttttcttctcactacattcttgctcactccccactttttatgtccggtggccataggctggtgagaacttkattttgaacagttgaaggtctgctgttagggacgtgctaatctagggaattgtactgaactcgtgggagcatgttagtatcagatgtgtgccttgtccgt

SEQ ID NO: 42681 - DNA, 201 bp, Homo sapiens
attaagggaaaatcaagtaaatcgagaggtaaagcactgtgcagaaatattggccagaagctatgaacagttgccacagctgggctgaagagttacctgtsagccttccaggggtgtaagccaagagaaagacagttcaccaaatctatcgattaatagaaatcatccagcagcagtgccactgtaagatgttcaatacgt

SEQ ID NO: 42682 - DNA, 201 bp, Homo sapiens
gagtttcactctttcaatcaacgtacgtgactacccagaattaaactggaatgctgttaataagagaaatgaaaggatgatgggagatgtgcacccagcartgtctgtcttgtggtcctgaagtctaactctaatcctggctccactatctggaccatgacaggttgtttaattgttctagttagagtgttctcctatgta

SEQ ID NO: 42683 - DNA, 201 bp, Homo sapiens
gtaggtttttcaataagaaggaaatttagcttccttctactttggtgccccatgatgatgtgcatcttttttatttctgcatcatatccatatagtgatawcatgtataatgatgtttaagaagacagttttttttgtttaaattgttataaataagtaagtgtatgcaccactatgccatgtagcatatcaagattattt

SEQ ID NO: 42684 - DNA, 201 bp, Homo sapiens
cccctgggcaggtgcatgagggggtcccaggcaatcaggctcttctcaaacctgaattatacccggcctcagggtataggggtcaggcagctgtttgacargattcttgcaaatgtttttggtttctctgtctactcattacgtacactctgccagaggttgaaaactcaatgttgagatcacatacatcctgaaaacact

SEQ ID NO: 42685 - DNA, 201 bp, Homo sapiens
cccaaagcttgctgtcccctgggcaggtgcatgagggggtcccaggcaatcaggctcttctcaaacctgaattatacccggcctcagggtataggggtcargcagctgtttgacaggattcttgcaaatgtttttggtttctctgtctactcattacgtacactctgccagaggttgaaaactcaatgttgagatcacata

SEQ ID NO: 42686 - DNA, 201 bp, Homo sapiens
aagcacgggggtttatgtgatggctccacagagcagtgaaaagactcccgccctactgctcgcaacctcagatgtccctgggcactagcccatctgtatgkctttaaaaaaaataaattaaatttttaaaaacatgactttctggccaggcgcagtggctcatgcctataaccctgcacttagagagggcaagacagaagg

SEQ ID NO: 42687 - DNA, 201 bp, Homo sapiens
ggcacaatctcgactcactgcaactttcacctcctgcgttcaagcaattcttctgcctcagcctcccgagtagccgggactacaggcacgcgtcaccatgyccagctaatttttgtatttttaatacagacggagtttcaccatgttggctgggatagtctcgacctcctgatctcatgatctacacacctaggcctccca

SEQ ID NO: 42688 - DNA, 201 bp, Homo sapiens
cacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtc

SEQ ID NO: 42689 - DNA, 201 bp, Homo sapiens
ttctgcctcagcctcccgagtagccgggactacaggcacgcgtcaccatgcccagctaatttttgtatttttaatacagacggagtttcaccatgttggcygggatagtctcgacctcctgatctcatgatctacacacctaggcctcccaaagtgctgggattacaggcatgagccaccgtgcccgacctcccgagtcat

SEQ ID NO: 42690 - DNA, 201 bp, Homo sapiens
ggccaccatggtgaagccccgtctctactaaaaatacaaaaaattagccagctgtggtggcacatgcctgtaatcccagctactcgggaggctgggacagragaaccactggaacctgggaagcggaggttgcagtcagccgagatctatgccattgcactccagcctgtgtgacagagcaagactttgtctcaaacaaac

SEQ ID NO: 42691 - DNA, 201 bp, Homo sapiens
accatgcccagctaatttttgtatttttaatacagacggagtttcaccatgttggctgggatagtctcgacctcctgatctcatgatctacacacctaggmctcccaaagtgctgggattacaggcatgagccaccgtgcccgacctcccgagtcatttcttatcttgttgctccaatttccattcccactgacagtgtag

SEQ ID NO: 42692 - DNA, 201 bp, Homo sapiens
tttcgtttgttctgtttcccactgagagaattttctagctttatgtggagaaaacagtattggaaattattactcagttcaagaaaacctcactgagcacytaccatgtaggtgctcatcccgataccactatcaggccctttggaccagttgcaaggatgcaggatgaggaaggcaatgtgagaaaacagaaggagcacc

SEQ ID NO: 42693 - DNA, 201 bp, Homo sapiens
gcttgcagtgttcttgggactagcaggagggcgtgtcaaaattgtaaaactctgcctatttgatgtaatatttgaaactagaaaggtaaaattccagggaygctagtgacactatggtaacctgattgtacagtgacattcatgtttaaaccagtcttggaagataatgctgtagcacaactgtttttgcatcattaaatt

SEQ ID NO: 42694 - DNA, 201 bp, Homo sapiens
tcaaaaaaaaacaaacaaacaaacaaaaaaaaaacaaaacacatgctggtgcacacataaatttggaagaaatgctctttaacccagtatgagcacgtggkattcttatcctcattttacagatgaggaaattgaggcacagacagattcaataactacgtgactcacagagataaccgtgtagcagaatcaggaattcag

SEQ ID NO: 42695 - DNA, 201 bp, Homo sapiens
cccaagatgatgattatggaaactcaaattttgcaccagaagctgtagttaccatttcattccattgcaccattcataccctgcagagaggatgtgaagtygtaaggccttcttgctctggtgacatctgttaggcttcgtctctatatcatcccccaactccttgacccttgatatttgctggtctacttcacttcaggt

SEQ ID NO: 42696 - DNA, 201 bp, Homo sapiens
tgcatctgtgaagattccatttctaaataagatcacatgctagggctgggcacggtggctcatgcctgtaatcccagaattttgggaggccgaggcaggcrgatcacttgaggtcaggagtttgagaccagcctggccaaaatggcaaaaccccttctctattaaaaatacaaaaattagccaggtatggtggtgcgtgcc

SEQ ID NO: 42697 - DNA, 201 bp, Homo sapiens
tttcttttttttttttttgcattttccagacgagccaagggatggctcagaagggtgaaggaactcacccgaattgcacagctggtgagctcagagtcagkctccttgcttggtccatctggcttccaaactccaagtctgtctgctccaccccatggcccatctttttaccatgtttagtatcaatgttcatactttgca

SEQ ID NO: 42698 - DNA, 201 bp, Homo sapiens
ccaggatgacctcattttaccttaacaagttgcatctgtgaagattccatttctaaataagatcacatgctagggctgggcacggtggctcatgcctgtartcccagaattttgggaggccgaggcaggcggatcacttgaggtcaggagtttgagaccagcctggccaaaatggcaaaaccccttctctattaaaaatac

SEQ ID NO: 42699 - DNA, 201 bp, Homo sapiens
tggtgccctcacctcttaagacaagcacctatcgttttcctgtgtattccaagaggccagtgtggctggtggaataagatgttttcctgttttcaagatgsagtggactctcttttatttagcagcagtgtctatgtgttaggaatccatgtgagttctctaagtctgggacaacgataggtgtgtctgagtcctgcatta

SEQ ID NO: 42700 - DNA, 201 bp, Homo sapiens
agggactcaagtcattggatttagggctcactggaatccaggatgacctcattttaccttaacaagttgcatctgtgaagattccatttctaaataagatyacatgctagggctgggcacggtggctcatgcctgtaatcccagaattttgggaggccgaggcaggcggatcacttgaggtcaggagtttgagaccagcct

SEQ ID NO: 42701 - DNA, 201 bp, Homo sapiens
cagtatctattggagttgggcttctgttgctttatttctcggggtctggcatatcccactccctgtcttgagatctcaggacctctgaggggcattgcatktaaagaacaagagcttattaggtatcaaaacatacttcatgaacagctacagcaagacctcgacattccagtgtagagctcttgaaagaccccagtgggg

SEQ ID NO: 42702 - DNA, 201 bp, Homo sapiens
tggtcagagagggctggtatgggaagaggggcaggtggctctcccttagagttactatttgactcacccctgacttcccagaatgtgtcttgagtctattmccctctcatatgggaggggtgacccaagtatgtttgtggcaaccaaaatgtctccaggcattgccagatgtctcttgggggtgcaaatcgtccccagttc

SEQ ID NO: 42703 - DNA, 201 bp, Homo sapiens
ttaaaagtcctggttcaggctgggacttctgctcagggtctcatgaggctgaaatcaaagcgtcagccagggatggggtcttatcagaggcccttggttaytaacagaattcattttcttgtaactgtaggactgaggtgcttgttttcttgctggctgttgactgagggccccttgcagcccctagaggctattctcagg

SEQ ID NO: 42704 - DNA, 201 bp, Homo sapiens
acctgtcccaggccttgtcttccagccccacaaacgtgcacctgcagccggagaccagggggccccgatcaggtggcagggcctttaattggagccacgtktgtataatgagcagcgcacacacacaaaggcgagctaaaaatgtctccacccttctaaatatgggatgccttggccaggtattgagtcagctctgtgacg

SEQ ID NO: 42705 - DNA, 201 bp, Homo sapiens
gagcagcgcacacacacaaaggcgagctaaaaatgtctccacccttctaaatatgggatgccttggccaggtattgagtcagctctgtgacgccagtgcarttatcccgattcagcatcagatttattcaccattaaacatgttctaacttgattgcaaacaagccttgtattatttagagggatccacggagctggcaga

SEQ ID NO: 42706 - DNA, 201 bp, Homo sapiens
gctggagtgcagtgacatggtgatggctcaccacagcctcagcctccctgggctcagtcgatcctcccacttcagcctcccaagtaactgggactactgtsatgtgccaccatagccagctattttttttgcattttttagagatgagtttttgccgtgttgccgaggctggtctcaaactcctgggctcaagctattcac

SEQ ID NO: 42707 - DNA, 201 bp, Homo sapiens
aggcatgctactttatatggcaaaagggaatttgcagaagctaagcactttaaaattattatctccttaaacctcactgcagagttataaggaaagcactrttatcagatgaagaagtagatttcatcaagtgactcacccggtatcatatagctgcttagcggcaaaaccaggatgtgaatggagagctctttctcggat

SEQ ID NO: 42708 - DNA, 201 bp, Homo sapiens
ctgggactactgtgatgtgccaccatagccagctattttttttgcattttttagagatgagtttttgccgtgttgccgaggctggtctcaaactcctgggstcaagctattcacctgctttggcctcccaaagtgctgggattacaggcatgagccaccatgcccggcccccttttttaaaaaacaaaaaaacaaaaaact

SEQ ID NO: 42709 - DNA, 201 bp, Homo sapiens
gcagccacaggaacccatcattcctgctacccaaggcctccattgcctggttttctgttgtcagaagagttcattttcaggtccttcaccagatattttaraagctcatcaaggaaaggacgtttgaagaaaaacaaataaacaaaaacacaaaatcaaggacgtattgatttctgagaattcctcctgggttttgtttgt

SEQ ID NO: 42710 - DNA, 201 bp, Homo sapiens
acccactgcaagtttgaggtggtcctcaaacccatcctcatggctgatatttgctagaaggacttgtggcacttagcagaagctattgtatttacagttamagtttattacagggaaaggatacaggttaaaattagatcggggaagagacaaatggggcaaagtccaagacaagtaccagatgtgaagcttctattgtcc

SEQ ID NO: 42711 - DNA, 201 bp, Homo sapiens
taagatgccacaggactatagcctgggcagttttgagtgctgcctctaccatgtaactagcttgccagtcaagtcattaactattcggggccttagtttcstcttttctgaattggagccagtatacgtaattccaaaggttgcttttaagcgtaagtgagaatattggcagaaattcgttagcactgagagagggaatgt

SEQ ID NO: 42712 - DNA, 201 bp, Homo sapiens
acaagaggtcacattgccttttctagcttggaaggtggcgcaaataactgcttgaggctccctctcttgggccaagcttgactctggattttcattgttgkccttttttattaaaacaggttttgtttttttgtgtgtgtgttattttgttttttgtttttttgtttttcgggggctggagtagtgtgcagagcctggcgg

SEQ ID NO: 42713 - DNA, 201 bp, Homo sapiens
ccactgagcacatcctcgtggatcttcctggctctccttacaaggggttccttccaaacccaagcgccacaatccttaggcagattgctctgacacagaasactggtgagttctagacttgatgtgtttcatgggaaacaggaagacatttaggggaggctgtagatacacagccgctctgtttagggaaggctgtcgata

SEQ ID NO: 42714 - DNA, 201 bp, Homo sapiens
ataatttgcttaagtgtgcacaaggtggaaggtcacgcaaggaagctttttattagttgtgtactgaatggatcaatagtgatttgaatactataaatctrtccgttaacaggtttatttcttcatcagatattaattccagagggtttcacccattataaaatggacataaagcctggggtggtgatggtgctgcctctg

SEQ ID NO: 42715 - DNA, 201 bp, Homo sapiens
tgaaaatgttagcaatatagtaatgaacaaaacagatgttatctctacccttatggtttttatattttaataaaagtggcagaaaagaaataggtaaaacwataaactgagctctttggagaagaggcccacgttcttttcagattctgatttctccgtgatataaatagttttttaggtgatcacttgtttttaatgtac

SEQ ID NO: 42716 - DNA, 201 bp, Homo sapiens
tggccccaaccaattaaatagtgaaatgtcgactgcattcaggcccttcctggtctgcagacagacttgtgttagttcattttcatagtggtgtgtatgtrtctttagactttaactgacagattcccacagtgagtagagtagggagttatcaattacatggttagctaggcgctgctattgtatgctctatggcttctt

SEQ ID NO: 42717 - DNA, 201 bp, Homo sapiens
tcttcacctgggtgggcgatttgaatagagctcacagccctgaaaaccctggttttcagactctttattggtaaatgaagtcagcttagtgatatgagaawtatgaaacataaatccctttgtaaaaatataaaataatcttacaatcatcatcgtcatcctcatcatcgtgttccttcacaccagcggtatttatggtat

SEQ ID NO: 42718 - DNA, 201 bp, Homo sapiens
tttcaatagagttgatatcgggtctatttattttgtgggagtgaagggatagggatagtactgacagcattatgtgattgcagcctcattgataagcatcrgaaataatgactttaacattattttcagatagggagcactcagtaccaaccattatattaggctcatgggctcaacattttgctgtgcttttcatagata

SEQ ID NO: 42719 - DNA, 201 bp, Homo sapiens
ctgtaatcccagctactcgggagcctgaggcaggagaatcacttgaacccgggaggtggaggttgcagcgagtcaaggtcacgccagtgtactccagcctsggtgacagagcgagactccgtctcaaaaaaaaaaaaaaaaagaaaaagaaaaagaaaaaggtgtttggaagccatgtcccatgaattccaaatacaattg

SEQ ID NO: 42720 - DNA, 201 bp, Homo sapiens
attgataagcatcggaaataatgactttaacattattttcagatagggagcactcagtaccaaccattatattaggctcatgggctcaacattttgctgtrcttttcatagatactgacacctgtgttttcattttgttgttgttgttgttttccctgccgggaaactgccgcatcctgtgttttcatggcatgatattaa

SEQ ID NO: 42721 - DNA, 201 bp, Homo sapiens
tacattattatgaggattattttctacctagatcaggtataaggtggatgtattattggcattcctaggactgttttaaaggaagtacctatgaggcctcrtgataagccagatgtccagaagccagcttgagaccagggctcctggtcacttaaaagatgtttggggctgggcgtggtggctcacacctgtaatcccagc

SEQ ID NO: 42722 - DNA, 201 bp, Homo sapiens
tggggagtattgctagctattcccatagggagtgagagagagtgtaagtaaaatgcaatggcaggcacagggatggttgccattatcagttacattattakgaggattattttctacctagatcaggtataaggtggatgtattattggcattcctaggactgttttaaaggaagtacctatgaggcctcatgataagcca

SEQ ID NO: 42723 - DNA, 201 bp, Homo sapiens
cattttgttgttgttgttgttttccctgccgggaaactgccgcatcctgtgttttcatggcatgatattaaggaacgatgggtaggatgctgaggagtaarttgctcgcacttttaaagacttctgcaaaactccacctacttttaggctccttaaaattcagtgactttatgagctggtatagcttcactgtttgtggga

SEQ ID NO: 42724 - DNA, 201 bp, Homo sapiens
tcagttgggatcagaaggccacaaagttttcttatattttaagcatcaaagtagcaccactgtacagcatctttacttaatctgccctctttcacgtgtgkgcatccctggcatgcttaaacaagaaaggcaaatgagagagagcgagtgagtgtgagcgagagagccctgaggtgccagaaggctgtggttcctttgtgt

SEQ ID NO: 42725 - DNA, 201 bp, Homo sapiens
tttggttttttttgtattttagtagagacgggatttcaccatgttggccaggctggtctcaaactctggacctcaaatgatccaaccgcctcggacttccraagtgctgggattacaggcgtgagccaccgtgactgacctgtttttaatttttttagagacagagtttcacactgtttaccagattggagtgcagtggtg

SEQ ID NO: 42726 - DNA, 201 bp, Homo sapiens
ttctgtatagtattggattttcaataaataaagtatgatataaacaagtctgcaaaccagcaagaactatataagccacttgctcaagtcaataagcgcaygctcacaaaggaacgtaaagttctgaagttcttctttggggcgtttgcaaaatgtcctattattgtcacctgcaggtggggggttggatattcctatttg

SEQ ID NO: 42727 - DNA, 201 bp, Homo sapiens
tcactgcaaactccacctcccaggttcaagggattctcctgcctcagtctcccaagtagctgagattacaggcgcccaccaccaagcccagctaatttttktggttttttttgtattttagtagagacgggatttcaccatgttggccaggctggtctcaaactctggacctcaaatgatccaaccgcctcggacttccaa

SEQ ID NO: 42728 - DNA, 201 bp, Homo sapiens
cacagctgggagataacggggtggatccaagatttgcagctggtgtgtgggtgatgccggaagattggcctttttcaaggacttagacaagtattgtactsatacattatttgcatttatttgtatgaatacttctgggttcctaatatgagggtacctaaaaagtacatccgctgcgcttcttgtaatctgagggagttg

SEQ ID NO: 42729 - DNA, 201 bp, Homo sapiens
gcaatggcatgatctcagctcactgcaacctccacctcccaggttcacgcgattctcctgcctcagcctaccaaatagctgggattacaggtacacaccaycacacctggctaatttttcatattttaagtagagacggggtttcactatgttggccaggctggtcttgaactcctgaccttgtgatctgccctcctcagc

SEQ ID NO: 42730 - DNA, 201 bp, Homo sapiens
ttgttctttgatcattgtctttgtgtcttctccttttttttttttttcctggccaccgctcgcagtcttgaaccgaatctttcaaactttatatccatgtracctttgtataatgagggctgtgattaactgcagagttttaaagagtgaaagtcaagcataggtggctggctctgaaccatcactcccaataatgtgaaa

SEQ ID NO: 42731 - DNA, 201 bp, Homo sapiens
atactcataaatatgcattcatattttgtgtatgagtacacttgttaatttacatgtatgtcttgatttatatacattgttctatacctttccttttcccrtaattttatggattacatttattttcatttctgtatatttagttaattcttttaaaaggctgcctgttatcccattgtctgtcttcaccatcatttactt

SEQ ID NO: 42732 - DNA, 201 bp, Homo sapiens
gactgggaagaaaaagaggtttaactggacttacagttccacatggctggggaggcttcagaatcatggtaggaggcgaaaggcacttcttatatggtgtmagcaagagaaaaatgaggaagaagcaaaagcagaaactgcctgataaacccatcagatctcttgagacttattcactatcatgagaataggatgggaaag

SEQ ID NO: 42733 - DNA, 201 bp, Homo sapiens
agtgatttgcccaccttagcctcctaaagtactgggattacagacaagagccactgcgcagacggacatatgaatttttaatttgatatcattgtgatcartttgaagatccacatatggctgagggctactctaatgagtggtgcagctccaaggcagagagatggctgtgattaaccaatgaatgagggaacaaatatc

SEQ ID NO: 42734 - DNA, 201 bp, Homo sapiens
cccaccttagcctcctaaagtactgggattacagacaagagccactgcgcagacggacatatgaatttttaatttgatatcattgtgatcaatttgaagakccacatatggctgagggctactctaatgagtggtgcagctccaaggcagagagatggctgtgattaaccaatgaatgagggaacaaatatccaggcagaa

SEQ ID NO: 42735 - DNA, 201 bp, Homo sapiens
ggtatctccctgccctggtctgaaagctgccacttgccgcccaccgcacagccccagggctttagctcactgtgcaggaagaggccttcctctgtgcatcstcccacagggtcgagagtgaatgccttgcctttaaaaataaaatgcatacgcctgtcctcatgcgctctgatctgccagcaggctgtgctggggagtggt

SEQ ID NO: 42736 - DNA, 201 bp, Homo sapiens
ctaagagtaaaacgcatgtccccccatgaagtcactcaaagctcaggcgtgtgcaacagggacagcaaaagcacacacaatgatggccagagacactgctyagtgtactgtcttccaccgggacagcccactcaccaagggttaggtcctgtgctgactgggtcccgggtctcctcggaggtcggtttgcatcacgtggat

SEQ ID NO: 42737 - DNA, 201 bp, Homo sapiens
ctgggtcccgggtctcctcggaggtcggtttgcatcacgtggatacactaatctacccaagttgacttggagaaccaatctgaaatcagatgggagctccmggaagcaaagcaattgcaggttcatttgttacttttattgtctcatttcttcttatttttttagcccaattgcctcctacatggggaaggttggggtcct

SEQ ID NO: 42738 - DNA, 201 bp, Homo sapiens
gtatggtcttaggccctggaataagacagtgtaggaaacacagaaggtgcctgatttcctgggcctagctaaggggaaaaagcgagacaatggggtcagakgaagctcagctgaacagatgaagttgagatgaacagaattccagtgccaccatgatttccagccgtgtgaccttccacatgctttttgatttttcttgaa

SEQ ID NO: 42739 - DNA, 201 bp, Homo sapiens
agctcagctgaacagatgaagttgagatgaacagaattccagtgccaccatgatttccagccgtgtgaccttccacatgctttttgatttttcttgaactmacttttcctttgtttgcaaaatagtaacaatattttccttccaagtgatggtgaggatttaagagttaacctgagtgtctgctgcatagtaggtgctcaa

SEQ ID NO: 42740 - DNA, 201 bp, Homo sapiens
cgtgtgaccttccacatgctttttgatttttcttgaactcacttttcctttgtttgcaaaatagtaacaatattttccttccaagtgatggtgaggatttmagagttaacctgagtgtctgctgcatagtaggtgctcaataaactataacgtctttatttcttttccttccaatgagaagtcacttcctggagggaagcc

SEQ ID NO: 42741 - DNA, 201 bp, Homo sapiens
gtttgcaaaatagtaacaatattttccttccaagtgatggtgaggatttaagagttaacctgagtgtctgctgcatagtaggtgctcaataaactataacstctttatttcttttccttccaatgagaagtcacttcctggagggaagccacctccaggaacagtcctggttcaactcatgaggagggtcactggttgggt

SEQ ID NO: 42742 - DNA, 201 bp, Homo sapiens
cagtgtgatcttggctcactgcaaactccacctcccaggttcaagggattctcctgcctcagtctcccaagtagctgagattacaggcgcccaccaccaarcccagctaatttttttggttttttttgtattttagtagagacgggatttcaccatgttggccaggctggtctcaaactctggacctcaaatgatccaacc

SEQ ID NO: 42743 - DNA, 201 bp, Homo sapiens
cttttctgactgctcaaaacagggaataataaacagtcagagtgtccaagtaatctgagctagaaagttccttctttcagagaaaagttataaaaagtatwtttgccggatccaaaaaaaatactgtgtatcaactactgagacctgcataatgttttcttagtattctcactctttaaaagaaaaaagaaaacctgtaaa

SEQ ID NO: 42744 - DNA, 201 bp, Homo sapiens
tcagagtgtccaagtaatctgagctagaaagttccttctttcagagaaaagttataaaaagtatatttgccggatccaaaaaaaatactgtgtatcaactmctgagacctgcataatgttttcttagtattctcactctttaaaagaaaaaagaaaacctgtaaaatttgggaacttaaactttttttgatattttaatat

SEQ ID NO: 42745 - DNA, 201 bp, Homo sapiens
tgtcacccaggctggagtgcagcagtgtgatcttggctcactgcaaactccacctcccaggttcaagggattctcctgcctcagtctcccaagtagctgarattacaggcgcccaccaccaagcccagctaatttttttggttttttttgtattttagtagagacgggatttcaccatgttggccaggctggtctcaaact

SEQ ID NO: 42746 - DNA, 201 bp, Homo sapiens
gaatacactagtaggtacagcaggagagcatgtagaagaggatagatgtagaaaatcgggacggcatgttaggaatatagataggaattactaaggaaaaktgtatttttgtggaattctttgaactcgttactattagtaaacggtgagttttggttctactcttcaatgagtttaagatgaaggaaatcattaaatagt

SEQ ID NO: 42747 - DNA, 201 bp, Homo sapiens
atatggtgtcagcaagagaaaaatgaggaagaagcaaaagcagaaactgcctgataaacccatcagatctcttgagacttattcactatcatgagaatagsatgggaaagaccggcccccatgattcaattacctccccccgggtccctcccacaacatgtgggaatcctgggagatataattcaagttgagatttcggtg

SEQ ID NO: 42748 - DNA, 201 bp, Homo sapiens
tacaaaattagccagacatggtggtgcatgcctgtaatcccagctactcagaaggctgaggcgggagaatcatttgaacctgggaggtggaggttgtggtragctgagatcacgccattgcactccagcctgggcaacgagcgaaactctgtctcaaaaatgaatgaatgaatgaatgaatgaatgaaatactacttctcc

SEQ ID NO: 42749 - DNA, 201 bp, Homo sapiens
taccctggaacttaaaagttggtgaaagaaagaaggggccgggcatggtggctcacgcctgtaatcctaacattttgggaggtcgaggcaggcagattgcytgagctcaggagttgaataccagcctgggcaacacggtgaaaccccgactctactaaaatacaaaaaattagccgggcgtggcagtgtgtgcctgtaatc

SEQ ID NO: 42750 - DNA, 201 bp, Homo sapiens
tggctgattcatgtcatgagagatcctgagtcagaaccacccagcagctaagccacttctgaatccttgacccacaaaatatggtaagataccaaatggtkactgttttaagccactatgctctgggggaatttgtgatgtagcggtagataactatcacaggatccatggcctcaaggggagaaggatccttaagagaga

SEQ ID NO: 42751 - DNA, 201 bp, Homo sapiens
gagtgtctggagttgccaacgtcctctccttgggtcatgggtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagtgc

SEQ ID NO: 42752 - DNA, 201 bp, Homo sapiens
ggcagctggagagcgtgcagactcaggagccaagacctgccttgccttccctggagttaatgaatcagtgtgaatgaagagcacagtcttcttttaaatgrcaggggaaccgtgcacttatttaccggcaattctcagattctaattgttccgactacaatgcgtcctgtaaaccgggtagctgggagaaacttcaatgca

SEQ ID NO: 42753 - DNA, 201 bp, Homo sapiens
agagtgtctggagttgccaacgtcctctccttgggtcatgggtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagtg

SEQ ID NO: 42754 - DNA, 201 bp, Homo sapiens
tttattgtgggacatttagagaatctcagactagcaggtgttagattaaacagaggagaaacggtccttgtggtgataaaacttccctacgcaaggacaartagagaaacaactgtagatgaagcagccagtctcaggctggggcagcacgccctgcgataggttaaggtttattttagacaaatatttaaaatgcagcta

SEQ ID NO: 42755 - DNA, 201 bp, Homo sapiens
agcgtgcagactcaggagccaagacctgccttgccttccctggagttaatgaatcagtgtgaatgaagagcacagtcttcttttaaatggcaggggaaccrtgcacttatttaccggcaattctcagattctaattgttccgactacaatgcgtcctgtaaaccgggtagctgggagaaacttcaatgcatctttgtaatg

SEQ ID NO: 42756 - DNA, 201 bp, Homo sapiens
gagagtgtctggagttgccaacgtcctctccttgggtcatgggtgtgtgtgtgtgtgttttcttcttgttgttgggtttttttttttttttttttttttttttggcttttgcgcctatggtgacttttagcgaatggatactattgaaggaatgtttcacttccaaatccagatctctgacttcccttgaaaatttggagt

SEQ ID NO: 42757 - DNA, 201 bp, Homo sapiens
caaatgtttacatggggctgtggaccattttgtatcattggaggagaagccagggcacttggcaggggtgttcatgatgataatcaggtggctgggtggastcaccatttgtggcatcctcaaagacttgccaacatagacatttttggggagacagaaacacagaaataattctgcagtgctttaaagaatctgttaaaa

SEQ ID NO: 42758 - DNA, 201 bp, Homo sapiens
aataactctgtgttgagaaatattcctgtctgtaatcccggcactttgggaggctgaagcgggcagatcacctgaggtcaggagtttgagaccagcctggscaacatggtgaactccccccaaccaacgacccttcccatatctactaaaaatacaaaaattagctgggcatggtggtggggacctataatcccagctact

SEQ ID NO: 42759 - DNA, 201 bp, Homo sapiens
cacagaaataattctgcagtgctttaaagaatctgttaaaaatcaagtttctttcagtcatgtatgatccattgggctttatataacttttagcctttgcyttgcagggacagcaaagatgtgagcaaatttgtgcaaacctaatagggtgaaaaattgaggtatgaattagtaaagtcatttgtccttctggaaagagtt

SEQ ID NO: 42760 - DNA, 201 bp, Homo sapiens
taatggatttttagcctcaagtttctggaattctaagagggcctgaaaggtaagtgctcacttactgaggtgtgtgaacaaaaacaggcaacctagctcarcaagtaagaatggagtggcatctccccacctgctctggagtcatgtgtttgcttctggaagggaggcaagaggcattcaacctcctgttaatttggttgc

SEQ ID NO: 42761 - DNA, 201 bp, Homo sapiens
gcactttaaatgcattaattcagttcatctttatgacaacactatgagatagctaatattatgaatcctattttcagatgaaagactgagtcttagggaasaaacagccgagagatgaaatgccacagggatgtctaggttcaaacagcaacagaggtgcgtaccatagggatgtggaagccttgcttgtcttgttcctct

SEQ ID NO: 42762 - DNA, 201 bp, Homo sapiens
gggatgtctaggttcaaacagcaacagaggtgcgtaccatagggatgtggaagccttgcttgtcttgttcctcttggtataaccccagtgagtagcatagygcctggtcaattggagggatttggtaaatatttactgagtgagtgagagggtaaaacagctgagccatgggagttataacttgggcagcagtaatcctgc

SEQ ID NO: 42763 - DNA, 201 bp, Homo sapiens
tcattctggagcagtgggagccgactgtgatgcagagtggactcataatccagcttgattttgagggacagaaacctgggcctttaggtagaatgaacagsttaaaaggctgcacctgagagtagggggcatatgggtaaatccagctgtacccaagagttgggggcatatgttagccctactgggtaaatccagctgcac

SEQ ID NO: 42764 - DNA, 201 bp, Homo sapiens
tactggggctaaagatttggcttggagtttcctggtagtcaaggcaaaaaagggaaacaaaactagttacagagtttctcggacctatgagcaaaaggatktccatttctaatcggaggcagaggtatcatggccttcaagaatcttccggttaaacacggtactgaaatttgattttattgtctatcgttgagtccctag

SEQ ID NO: 42765 - DNA, 201 bp, Homo sapiens
acttaattcactgggtgactgcatccataccaagcacacagccgtgatcagttagcctctcacttctctactaatccccactgtggggaagagctcatcaytaacatgccttatctgacatgtggcaataacttctgcctttcttatgtcatctgcatggttgcagtggatagtcactggacaattgatgaacaactacta

SEQ ID NO: 42766 - DNA, 201 bp, Homo sapiens
tcatcattaacatgccttatctgacatgtggcaataacttctgcctttcttatgtcatctgcatggttgcagtggatagtcactggacaattgatgaacamctactacatgctagatctctccctggggagagtgcttgtctttgaaacagtcaaaggaggaaggaagaaaagagaggcagaacaattataataaagcaac

SEQ ID NO: 42767 - DNA, 201 bp, Homo sapiens
ccttatctgacatgtggcaataacttctgcctttcttatgtcatctgcatggttgcagtggatagtcactggacaattgatgaacaactactacatgctaratctctccctggggagagtgcttgtctttgaaacagtcaaaggaggaaggaagaaaagagaggcagaacaattataataaagcaacttaacccattgaga

SEQ ID NO: 42768 - DNA, 201 bp, Homo sapiens
aaactatggagtcttaagtccaaccagtggttatgaattccggctctgccacttgctataatagctgtatcaccatgagcgataacttaacctctttgtgsctcagtttcttcatatataaaatggggatcatgatagtctctgtcccaggggagttaggaggattaaatgcaacagtaatccaaccacagtatgaaaaga

SEQ ID NO: 42769 - DNA, 201 bp, Homo sapiens
gtccagtgcttggccagtacaaggccattatatatttgttgaatgaatgaattcgtgaatatgtttataaagacaaggaaacgccattctgcaaatctacrtgcagtaaaatagtttttcagtcactttgccttcatttgtttgacattcttggaatatttgggctctacaaggtgctagggtaaggcacgcaggatgcaa

SEQ ID NO: 42770 - DNA, 201 bp, Homo sapiens
tgaggtggcacatgtcagcggctttgctcagaagcacccagggatgatggaaaaggcaaccgaaagggctcagcttctgcagatagagtctgtgctttgcrctttctggctttgtgacctttctgcaggttacttctctcccctgagcatcagtttactcagctgaaaaatgcatctgctaataatacctatggcataggg

SEQ ID NO: 42771 - DNA, 201 bp, Homo sapiens
ctgagcatcagtttactcagctgaaaaatgcatctgctaataatacctatggcatagggtttggggaggattaaataagataatgtaaatagagtttagcrtggtactgtgtatatagccagcactcactgctgttggcttattgaaaaaacaaaaataatacctacaataaccacaatatagcaacagcaatcatgttca

SEQ ID NO: 42772 - DNA, 201 bp, Homo sapiens
gtcattagatatatgcacacacttgacctaatggaaagcttgaaagcaattggatgggaaaacagtccatcttgttggaaggctgtcaagctgtgtaatamaagaattactgttctccctttgcatttatgcattgcatgtctctgttgaattcagagtgctttatagacctctgatcagcttccagcatcctcttggtat

SEQ ID NO: 42773 - DNA, 201 bp, Homo sapiens
gattctgccgataaacatcatctggacggaatgaagctgagggccaatagtttagaggctcagcacccgactggagagagagagagagagagagagagagwgtgtgtgtgtgtgtgtgtgtgtgtgtgcgcgtgcatgtgtatacgctggtgtttaggtgggcttgagaaaagtgctgactttgtgaacgaggaggaggga

SEQ ID NO: 42774 - DNA, 201 bp, Homo sapiens
tggattctgccgataaacatcatctggacggaatgaagctgagggccaatagtttagaggctcagcacccgactggagagagagagagagagagagagagwgtgtgtgtgtgtgtgtgtgtgtgtgtgtgcgcgtgcatgtgtatacgctggtgtttaggtgggcttgagaaaagtgctgactttgtgaacgaggaggagg

SEQ ID NO: 42775 - DNA, 201 bp, Homo sapiens
ttgaggcaggagaatcatttgaacccaggaggcggaggttgcagtgagccaagattgcgccactgcactccagcctgggtgacagagcaagactctgtgttaaaaaaaaaaaaaaaaaagttctaaatcagtggattctgccgataaacatcatctggacggaatgaagctgagggccaatagtttagaggctcagcaccc

SEQ ID NO: 42776 - DNA, 201 bp, Homo sapiens
agatattcccctttcttctaaatatacttgaccaccaccattcaggttcttctattaaccctcctatatttgccaaccctcaacctgttagaaacaagaawtgggactctggagtagatgttagcaacatcatgagctcaaacccctccagcttacagcggagacagtgaggtcctgtaggatgaggttggagagcaggaa

SEQ ID NO: 42777 - DNA, 201 bp, Homo sapiens
tgggcctttaggtagaatgaacagcttaaaaggctgcacctgagagtagggggcatatgggtaaatccagctgtacccaagagttgggggcatatgttagycctactgggtaaatccagctgcacccaagagtagggggtatatgttagggctagtgcgtaaacccagctgcacccgagatatggggtatacatgagtgct

SEQ ID NO: 42778 - DNA, 201 bp, Homo sapiens
cgggtgtggtggcgtgtgcctgtaatcccagttactcgggaggctgaggcaggagaatcgcttgagcctgggaggcagaggttgcagtgagctgagatcgygccactgcgctccatgctaggtgacagagcaagattccatctcaaaacaaaacaaaacaaaaaaacaagaagttaaggattgcagagcataagtatcttc

SEQ ID NO: 42779 - DNA, 201 bp, Homo sapiens
ggtatacatgagtgctattgggcaaatccagctgcacaggagagtaaggggcatatgttagggctagtgggtaaacccagctgcacctgagagtaggggtrtatgttagggcttgtgggtaaatccagttgcacctggcagttggggcatatgttagggctagtgggtaaacccagccgcaccggagagttgtgggtatat

SEQ ID NO: 42780 - DNA, 201 bp, Homo sapiens
gtttatgcgctgcttggtttccatggatacctgaggtaatagcctccttcctctcattgaagagtgaatgttgctcagttacttttttcctgtttttttttcacttttgtcttcctgacttttttcttccatccctatttatgaaaacaaaaagataactaaattgaaaccttgacaatgtaatttgtcagaggaaggcag

SEQ ID NO: 42781 - DNA, 201 bp, Homo sapiens
gagtttgagagcaatctggccaacatggtgaaaccctgtctctactacaaataaaaaattagccgggtgtggtggcgtgtgcctgtaatcccagttactcsggaggctgaggcaggagaatcgcttgagcctgggaggcagaggttgcagtgagctgagatcgtgccactgcgctccatgctaggtgacagagcaagattc

SEQ ID NO: 42782 - DNA, 201 bp, Homo sapiens
tacatgagtgctattgggcaaatccagctgcacaggagagtaaggggcatatgttagggctagtgggtaaacccagctgcacctgagagtaggggtatatsttagggcttgtgggtaaatccagttgcacctggcagttggggcatatgttagggctagtgggtaaacccagccgcaccggagagttgtgggtatatgtta

SEQ ID NO: 42783 - DNA, 201 bp, Homo sapiens
aatatagtttgctgtgtgctgggtgggtgggagggagcgtccacattagtgaacagccaggcagtcgctgcctcaaatttctttagggttatcctttcatkccagcaattgaatttgatttgcactgtttcacttctctacaagggtgtaaaaagtagaggttcctcttgaaagaatttcctccccatctaattaggaata

SEQ ID NO: 42784 - DNA, 201 bp, Homo sapiens
gcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtga

SEQ ID NO: 42785 - DNA, 201 bp, Homo sapiens
gccatgttggagagggatccaacatttattatccccattttacagatgaagaagttaaggtggccaggcatggtggctcatgcctgtaatcctagcacttygggacactgaggtgggtggatcacttgaggtcaggagtttgagagcaatctggccaacatggtgaaaccctgtctctactacaaataaaaaattagccgg

SEQ ID NO: 42786 - DNA, 201 bp, Homo sapiens
agctgcacctgagagtaggggtatatgttagggcttgtgggtaaatccagttgcacctggcagttggggcatatgttagggctagtgggtaaacccagccrcaccggagagttgtgggtatatgttagggccagtgggtaaatccagctccatctgagatatggggtatacatgaatactagtgggtaaatccagctgtac

SEQ ID NO: 42787 - DNA, 201 bp, Homo sapiens
cacagggcagctgtattccaggtacttggtgactcttggttgcgatctgatgactggctcacagtaggaccatgacgtgagcagatttgtagtcctgcatraatgaaggaaagaaagaaatctgacaactcattgattcagattcacagactctgcattttgaaccagaatacacccgagcaattacctagcacaaaatct

SEQ ID NO: 42788 - DNA, 201 bp, Homo sapiens
agcaaggtgttgatagaaccccttagtgtcctcctcataccacagacactctcttcccccacttacttggccaattttttttttttttttttttttttttkggtggagtctcgttctgtctcccaggctggagtgcaatggtgcgatctcagctccctgcaacctctgcctcccatattcaagggattctcctgcctcagc

SEQ ID NO: 42789 - DNA, 201 bp, Homo sapiens
cacctgagagtaggggtatatgttagggcttgtgggtaaatccagttgcacctggcagttggggcatatgttagggctagtgggtaaacccagccgcaccsgagagttgtgggtatatgttagggccagtgggtaaatccagctccatctgagatatggggtatacatgaatactagtgggtaaatccagctgtacacgag

SEQ ID NO: 42790 - DNA, 201 bp, Homo sapiens
agtcatgtccctagtccctgtctccgtatattttctccttctcttattagtttatcttttccaaaatgggctgtttcgtctctgatcctgatttatttttrttttaattaaataatttatttttctgagacagactgtcgctctgtcgccaaggtggagtgcagcggtgtgatcttggctcactgcaacccccgcctcccg

SEQ ID NO: 42791 - DNA, 201 bp, Homo sapiens
atgtaagtgtagctccaatgtgagttgttacttgtagagaacagctatgtcaaaaccacaccaaaaacgatttggaaaggaaataatttgactggtcattktgtttatccatcaactgagttggattgatatatttttcctttggccttcaaaggaaatttgagcattcattcattcatccttttagagaaatattctcta

SEQ ID NO: 42792 - DNA, 201 bp, Homo sapiens
gaaatgacagtgattggaggtggtttatttttttttaagtctgcttactcggaaaaataaaacaaagttgacaacctgatttcagacctcccaattttttsttaaaaaaaataaaagtcttcttggtccatgaaatccagaaactggagaccaaactagcaaattcgcaaggagctgcttgatagaaaaacacttgagatc

SEQ ID NO: 42793 - DNA, 201 bp, Homo sapiens
tagataactcaagagactcaatcaacttcgtgtttaatgttttcgtaagaatacttcagaggcagtggtgtaatcgtccaagagtacacacaggcctgatygccaaagccagttttcttcaggcccagcacgtcctgacctcctcactcctctgcccactctctgtttactcactcccattttcattcattgattctgtta

SEQ ID NO: 42794 - DNA, 201 bp, Homo sapiens
tggggtatacatgaatactagtgggtaaatccagctgtacacgagagtagggggcatatgttagggctagcaggtaaacccagctgcaccccagagcaggkgtatacatgagtgctagtgggtaaatccagcagacgtccggactgtgcttgagggtgtcatcgagagagagaaggttgatccgaagttagtaaaggcttt

SEQ ID NO: 42795 - DNA, 201 bp, Homo sapiens
caatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaa

SEQ ID NO: 42796 - DNA, 201 bp, Homo sapiens
agatattccagctatggcaaactgcggaagaattaggacagatgtatgacttatttcatataaagctaaatcagtttaatttatatgattgtcctttattmtgagattatgttcaacagatattttcagtgttaaaatattcttttttttttttttttttgagacagggtctggctctgtcacccagggtctagcacagtg

SEQ ID NO: 42797 - DNA, 201 bp, Homo sapiens
ccaagagtacacacaggcctgatcgccaaagccagttttcttcaggcccagcacgtcctgacctcctcactcctctgcccactctctgtttactcactccsattttcattcattgattctgttattctccactaagttttctgggtggtcagcccaggaagcctcagcctgcttccagatagttctcctcagagttagcgg

SEQ ID NO: 42798 - DNA, 201 bp, Homo sapiens
ttggaggtaagtataaaaaccttcttgttttctactacttaaagctgaaaacccagcttgggttggctttgcttctaatatccttcttcctttttgtttcrtaagtaattgtcctgaagcctgtcgagataaatgtatactgaaagagaaagacacagaggagagacaggcatacagagaaagagagacacgcagacacac

SEQ ID NO: 42799 - DNA, 201 bp, Homo sapiens
acaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaa

SEQ ID NO: 42800 - DNA, 201 bp, Homo sapiens
atggggtcataagacattggtgaggttaggccttcctttgtctcccaggagcacacttgatagcaatgtagggtgaattccaaatctgtgagttagtgccrtatatagcagtgttgtcagtaagatttctcactggcatctctgcttcccctcttgactctcttgaaatcccttcttcaggcagaagttggagtcatttct

SEQ ID NO: 42801 - DNA, 201 bp, Homo sapiens
ttaccagacacatctcactttatggagcctggggctattggtaatatgcatttctttctcatcttgatcgtaaaatgatcttagaaaggtttctgagaatwtatagagtttaagacagcaataagacaactaattaattaaacaggaaaaggggatgttgtgctcagagaggaagtgtgggtctcataagggctttcacaa

SEQ ID NO: 42802 - DNA, 201 bp, Homo sapiens
ccccatcaacatgatggcccttggaaaggactcttttagcctccgcgagttccttttccgcaccaggctccacttacgaaggactgcaaaaacttgctaaygtcatcagtctgaaaggattgagctgtaaaatgtgttatgggggcctaagcaacgcatctggaatttagccttcccaagttcaaatccggtttatgccac

SEQ ID NO: 42803 - DNA, 201 bp, Homo sapiens
cacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaaca

SEQ ID NO: 42804 - DNA, 201 bp, Homo sapiens
atgaacctgggaggcagagcttgcagtgagccgagattgcgccactgcacttcagcctgggtgacagagcgagaatctgtctcaaaaaaaaaaaaaaaaaraaagaaagaaagcaaaggttttttcctcccaagaactcatggtccaagttttggtttttaaatatgcatctatgacagcacggatcacatagtgcattga

SEQ ID NO: 42805 - DNA, 201 bp, Homo sapiens
tccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaa

SEQ ID NO: 42806 - DNA, 201 bp, Homo sapiens
ttaatagtaataataatatctaccacccactaggggtctatgtgtgtatgtgttgggggcggtgtggctggggagggaagcaaggcctgtattatggcccragctcaagaatattcgggcaagagcagatacaatgcctgtatttctcatcacttttgggtggcataggaccagttggttatgagcgtgaaaggttttctt

SEQ ID NO: 42807 - DNA, 201 bp, Homo sapiens
ttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtga

SEQ ID NO: 42808 - DNA, 201 bp, Homo sapiens
tttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtg

SEQ ID NO: 42809 - DNA, 201 bp, Homo sapiens
atttatttattcttttagggacagggccttacgctgctgcgtaggttgtggtgcagtggcacagtcacagctcactgcagcctcaaactcctaaggtgaasagaccctcccaccttagcctcctcagtagctgagactacaggtgcgtgctaccgtgcccagctgatttttaaatttttttttctttgttttgagacggag

SEQ ID NO: 42810 - DNA, 201 bp, Homo sapiens
cttcagcctgggtgacagagaaagactccatctcaaaaaaaaaaaaaaaggtagagatggtggagtggtgacatttggtagataatatagctctgcagaamttttcattgcaaaatgaaaattcttcattgttattataattacttcaaggagcaaggccattttgtgtaagctatcctgggcctccctgcctcccatttt

SEQ ID NO: 42811 - DNA, 201 bp, Homo sapiens
aattcttcattgttattataattacttcaaggagcaaggccattttgtgtaagctatcctgggcctccctgcctcccattttacaccctgtttattgatastaagaagagcctccaactgaataagaactaatgacttctgcctgccatcattttggaatgtccaattccccgttctggagagcctttgattataacatca

SEQ ID NO: 42812 - DNA, 201 bp, Homo sapiens
tgaaaaatctcttcctttcctatcgtgaattcggtcattgttataagccaagctttgcaaaggtggaacaccttggagatacttatctcctccttactctmcccaagtaatgactcatccttttatacagaatgtctcttttttgatttagatgtctttttttgatatagatgtctcttgatatagaagcatttctcggga

SEQ ID NO: 42813 - DNA, 201 bp, Homo sapiens
ttctcctgctctgcctcccgagtagctgagactacaggcacctgccacgacgcctggctaatttttgtattttcagcagagacggggtttcaccgtgttasccaggatggtctcgatctcctgacctcatgatccacctgccttggcctcccaaagtgctgggattacaggcgtgagccaccacgcccgactgctttattt

SEQ ID NO: 42814 - DNA, 201 bp, Homo sapiens
tcaccgtgttacccaggatggtctcgatctcctgacctcatgatccacctgccttggcctcccaaagtgctgggattacaggcgtgagccaccacgcccgrctgctttattttcctttgtgttcctaatacctggcccagtgtctggcaaatggaaagttcccctggatgtagttgggtgacactatgagtgtatcgttag

SEQ ID NO: 42815 - DNA, 201 bp, Homo sapiens
ttttcacgcggaaactggatgtttcttacatcctcagctgcaggcatggggaagagacgcacatcagccattaagaaaaaggtatgcagtctacatgcctsttaatttcctccacatacacagtaaacccatcatgtccatcagcaccattgtcaaaacatctgtgcaccagtaaagggttctgatgtgtgataaatttat

SEQ ID NO: 42816 - DNA, 201 bp, Homo sapiens
catcagccattaagaaaaaggtatgcagtctacatgcctcttaatttcctccacatacacagtaaacccatcatgtccatcagcaccattgtcaaaacatstgtgcaccagtaaagggttctgatgtgtgataaatttatttagctattactcatctgaagttatactattttaggatcttggggcagtgaggactttgga

SEQ ID NO: 42817 - DNA, 201 bp, Homo sapiens
tagtataaagactgtagattcatcaaacattgtttactgtcttcaaacttcaacagtgttttaactatcaaatagaaaatcgaaaggaagcataaacgcayatggtcactttactggtataataggggccaagagccgttgtgttttataatttcttgatgatcctggtggtaggtaagccaaccgctatgaactctgatg

SEQ ID NO: 42818 - DNA, 201 bp, Homo sapiens
tttatatttttagctaaattaaaatactcacattcccattattttttagaggttgtaagctaagtaataacattctagaaactctctgttttttgaaaggkcatcaccactgttgaaggcgctaatgggagatcctaagtttcaggctctgctacagacgtcaggtcccctaggagttgggctgcctttgctctcctctcc

SEQ ID NO: 42819 - DNA, 201 bp, Homo sapiens
agagtgtgctgtgtcagggtgtttcattgcattttcatatttgtcatttctctttggagcgtgtcttttggtgccacggaaaagggctggattttctatcrggtacaataggtacctgcagggcttagggtacaagagcttgtcggggacctgcacacatgtttgagacctgtaaaaatattgctggctctgaattatgga

SEQ ID NO: 42820 - DNA, 201 bp, Homo sapiens
aactatattttcttcctttttttgtatgcctccccatgcaaggataattacacagaataagcactgagatgcctgttgatggatttattccagcaattttwtttttttagctctctttgtctggaactttgcaaaataaacaccatggtcactccgtgctttgtgagtgacgtgctagaatggaatttcactgttttaaat

SEQ ID NO: 42821 - DNA, 201 bp, Homo sapiens
gtgatttcagggtgttgggctctgacaagatgatgccgacttagacagtgttagtcaacatcaaatgtctggatcaagagaggcaagaatcccgtggattkggcgttggccagaacttgtctggaatcttgttttctgccttgagtgtcacctgttgagagctctgttgacaaactggcatttgtccttgggagagtagcc

SEQ ID NO: 42822 - DNA, 201 bp, Homo sapiens
ggcacctatgttaactctatttcattttggaaaagttgagtagacaaaaggtgcagagtagagtatgcagtgatttcagggtgttgggctctgacaagatratgccgacttagacagtgttagtcaacatcaaatgtctggatcaagagaggcaagaatcccgtggatttggcgttggccagaacttgtctggaatcttgt

SEQ ID NO: 42823 - DNA, 201 bp, Homo sapiens
gacctcggtgctcacggtaatgcttccttccaccatatcagaaggtcctcagcagccgcagccacttaacatgctcggtgcttctctgtaggaggattttkaaaaagcaggaactgtcagggtcccaaatgttcagtggcacttcagccagaggtaggatagggattttgaagtgtttggagaagtgttttcatatttgaa

SEQ ID NO: 42824 - DNA, 201 bp, Homo sapiens
ggaggcacctatgttaactctatttcattttggaaaagttgagtagacaaaaggtgcagagtagagtatgcagtgatttcagggtgttgggctctgacaaratgatgccgacttagacagtgttagtcaacatcaaatgtctggatcaagagaggcaagaatcccgtggatttggcgttggccagaacttgtctggaatct

SEQ ID NO: 42825 - DNA, 201 bp, Homo sapiens
aagctctcaaagtgactttttattttattttttatttttacatggagtctcgctctgttacccaggctagagtacagtggcgtgatctcagctcactgcartctccatctcccaggttcaagtgattctcccgtctcagcctccagagtagctgggattacaggcacccaccatcacgcccagctaatttttgtattttta

SEQ ID NO: 42826 - DNA, 201 bp, Homo sapiens
catttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtg

SEQ ID NO: 42827 - DNA, 201 bp, Homo sapiens
tgtgtcttctcccccatttatttatttaatcatttatttatatcacagtacactcatggacatttattttatgctttatgttataatcctatactactttrtttattttgttgcttaaatttttccagatggaacaatttggtcttcaaaagttgctgctgttggctcctgtgttcttgtgatgtacacacatcatggtgt

SEQ ID NO: 42828 - DNA, 201 bp, Homo sapiens
gtttaacctgacagttgatcaattgatatcctttgacttgttggaattttattctttacattcgtcttttaaaaagctttattttatgccagatgcagtgmctcatgcctgtaatgtcagcactttgggaggctgaggcaggtggatcacttgtggtcaggagtttgagaccagcctggccaatatggcgaaaccctgtct

SEQ ID NO: 42829 - DNA, 201 bp, Homo sapiens
tcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgt

SEQ ID NO: 42830 - DNA, 201 bp, Homo sapiens
ttggaggagtgttgctgtgcccagctcacgcttgtggagtggggatttaatgttctcactcttcgagggtagagtatctgcataaactacttggaattctrcatggaatatttgtgtcttctcccccatttatttatttaatcatttatttatatcacagtacactcatggacatttattttatgctttatgttataatcc

SEQ ID NO: 42831 - DNA, 201 bp, Homo sapiens
aggctgaggcaggtggatcacttgtggtcaggagtttgagaccagcctggccaatatggcgaaaccctgtctctactcaaaatacaaaaagttagccgggygtggtggcacgtgcctgtaatcccagctactgaggaggctgaggcaggagaattgcttgaacttgggaggcagaggttgcagtgagccaagatcgtgcca

SEQ ID NO: 42832 - DNA, 201 bp, Homo sapiens
gagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatg

SEQ ID NO: 42833 - DNA, 201 bp, Homo sapiens
ggctgacacaggcagatcacttgaggtcgggagttctagaccaacatggtgaaaaccagtctctactaaaaatacaaaaaattagctggccgtggtggtgygcacccgtagtcccacctacttgggaggctaaggcaggagaattgcttgaaccgcggaggcagagattgcaatgagccgagatcgcgccactgcactcca

SEQ ID NO: 42834 - DNA, 201 bp, Homo sapiens
ccacaggacactactgtgcatttgcctgtgatttgccattgggttggagtacttctcctgagtttctgcagtgttctaggtatggtcttaggccctggaawaagacagtgtaggaaacacagaaggtgcctgatttcctgggcctagctaaggggaaaaagcgagacaatggggtcagaggaagctcagctgaacagatga

SEQ ID NO: 42835 - DNA, 201 bp, Homo sapiens
tgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagat

SEQ ID NO: 42836 - DNA, 201 bp, Homo sapiens
gctcagtctttgaagggttacagaaacagtttcactagaaggtgtgacattgtgtaacagaaatcggttccttaacctgccaaagggaagaaaatagtgcrgaatcttttctccaggtttcaggacccatgtctgttgtccttcctttaccttaacttcagcagggcaagaatggttcaagccacattagaaagcagttac

SEQ ID NO: 42837 - DNA, 201 bp, Homo sapiens
gtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggaga

SEQ ID NO: 42838 - DNA, 201 bp, Homo sapiens
tctgttgtccttcctttaccttaacttcagcagggcaagaatggttcaagccacattagaaagcagttactttctcacccaattttaaaggagaaaggtaratgcggtgggttctagggatttcagtgacgtaacaggtgtttcccaggcattaagacctagtaaggtttccatttccattaggtattatggatgcattcc

SEQ ID NO: 42839 - DNA, 201 bp, Homo sapiens
ctgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactgggga

SEQ ID NO: 42840 - DNA, 201 bp, Homo sapiens
ccaattttaaaggagaaaggtagatgcggtgggttctagggatttcagtgacgtaacaggtgtttcccaggcattaagacctagtaaggtttccatttccrttaggtattatggatgcattccaagaatttaattactataacatcacttcattcattgtaattccttactagagttatgagaacttgggattgtgtggtt

SEQ ID NO: 42841 - DNA, 201 bp, Homo sapiens
caagtttctgtgtggacatgttctcacttttcttgggtatatacttaggggtggaattgctgggtcatatgatcagtctaggtttaactttttgatgaacwgacaaactgctatccacagtggctgcctgtaccattttacagaaaatctctgcttttaatacttctggatgtgttctaaggcactaggcttttcattaag

SEQ ID NO: 42842 - DNA, 201 bp, Homo sapiens
caagaatttaattactataacatcacttcattcattgtaattccttactagagttatgagaacttgggattgtgtggtttcttattcaatcgattaaaagstacttgctatagttttctaactagctatttatatgaaatttagtacttgtcaatatgtattaaatcaatacagttatatttatcaaagtggtgagaagag

SEQ ID NO: 42843 - DNA, 201 bp, Homo sapiens
acccttgtatccttgttttgtttcgtttccctgcaaacattgttttagttgagatgaaattcacgtaatatacagttaaccattttaaagtgtacacttcrgtggcatttagtgaactcagtgttatgccaccgtcacctctttttagtttcaaaactttgtcatcaccccagaaaagcatacacataaagtcatcactgc

SEQ ID NO: 42844 - DNA, 201 bp, Homo sapiens
tacttgtcaatatgtattaaatcaatacagttatatttatcaaagtggtgagaagagtttacatctgaacatagaatagattgcttgccttggccgggcgygggagctcacacctgtaatcccagcactttgggaggccgaggcgggcagatcacgaggtcaggagatcgagaccatcctggctaacacggtgaaaccccg

SEQ ID NO: 42845 - DNA, 201 bp, Homo sapiens
gattacacccaccaccatgcccggctagtttttgtatttttagtagagatggggtttcaccatgttggccaggctggtctcaaactcgtgacctcaagcartccacccgccttggcctgccaaagtgctgggattacagacatgagccacctcacgtggttgagattttttcactttaagaaatgctttttctgtcacctc

SEQ ID NO: 42846 - DNA, 201 bp, Homo sapiens
tgttgttaaggatgaaatgaaaagtccacagcataagcttgacacataaaataagcacccgatgaatactgactaaagagagaggaggagtaggggagagraggagagaagagaggaaatgaaaatgtttctgaataagttatgtctaagttttttcactttttattttttattgttttcaggacagggtcttgttccatt

SEQ ID NO: 42847 - DNA, 201 bp, Homo sapiens
gccacaggacactactgtgcatttgcctgtgatttgccattgggttggagtacttctcctgagtttctgcagtgttctaggtatggtcttaggccctggartaagacagtgtaggaaacacagaaggtgcctgatttcctgggcctagctaaggggaaaaagcgagacaatggggtcagaggaagctcagctgaacagatg

SEQ ID NO: 42848 - DNA, 201 bp, Homo sapiens
tcagttggcatgcgatatgcttctcaggcagtaatttagagactgtcaattcctgagagccgctggggaactgagcaatcgtctgcatttcgtcgctttarcccgagctgggtctttgagctggcagagaccaagatctttttctgggaagggatggtcctatttaaggaaggccctggattttgtcaagtttgaaaggtt

SEQ ID NO: 42849 - DNA, 201 bp, Homo sapiens
atcttggcagatacttagctgaattccatcgatttagtgataaaatgggaacagtagtaatggtgcagattagagaaaaaaatgtgatttgtgcattcatwtgtctgtgtgtacatatatgtatatgttctgtgtatatgtagacatgtatagatgcatgtgtgtacgtatacacgcacacatacataaattgtgtacata

SEQ ID NO: 42850 - DNA, 201 bp, Homo sapiens
tcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgtagt

SEQ ID NO: 42851 - DNA, 201 bp, Homo sapiens
agggagtgaatgaatgagggatttgcagcttgaacgctgtactttgaaacagttccagattcatgaaatttctttttaatgcagaagatttcttatgtgaktaactgaatgggaattgatgctttgtggaatgaaatggattgagtacagagtgtgggatcaagaacttttaggcactgtgagtataagagggaaaccagg

SEQ ID NO: 42852 - DNA, 201 bp, Homo sapiens
ctcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgtag

SEQ ID NO: 42853 - DNA, 201 bp, Homo sapiens
ttattatgtaggtattcatatagcatttaaaatgtaatcattttaaaatgtagaaatcacttttagatcgtagaccataaaaaaacagcaggaaaaactasatggttggctggatttggccaagttgacatagagagccaatccctcatctccagcagggcttttactcaatgatacagtgcgcatgaattgcttggggga

SEQ ID NO: 42854 - DNA, 201 bp, Homo sapiens
agagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgcgca

SEQ ID NO: 42855 - DNA, 201 bp, Homo sapiens
ttgaacccgggaggcagaggttgcagtgagccgagatcacgccactgcactccagcttggcgacagagtgagtctccatctcaaagaaaaaaaaaaaaaaacaaaaacctgccctgcccagccatgcccaaacagagtggccagcagtcagcttagtgtgggcagagctcagggaattattctgcagtgcagctaacatct

SEQ ID NO: 42856 - DNA, 201 bp, Homo sapiens
aatcgcttgaacccgggaggcagaggttgcagtgagccgagatcacgccactgcactccagcttggcgacagagtgagtctccatctcaaagaaaaaaaamaaaaaacaaaaacctgccctgcccagccatgcccaaacagagtggccagcagtcagcttagtgtgggcagagctcagggaattattctgcagtgcagcta

SEQ ID NO: 42857 - DNA, 201 bp, Homo sapiens
tgagagcatgctagtctccgaacggcctgccagggtgcctgacagccagagccacctaatgggcctatttgatcctggagttgctgtaatggcaagaaaawccatggcctccagccccagtgttgaagttttgacgctaatgtgatgataattctcttttctttgactggggacttgcctttgtttatctttttttgttgt

SEQ ID NO: 42858 - DNA, 201 bp, Homo sapiens
cagccttgaagacctggaataaatcccacttggtcatggcatatatgtttttttatacattgttggatacagtttgctaacattttgtggatagctcaccracttttattcagaaaacatccgtctcagtttagtgcccaacaaggaaagcatactgtttgttgggtgggttccatttttgtggttaggagaagaatatag

SEQ ID NO: 42859 - DNA, 201 bp, Homo sapiens
attttctgagctggtgatgagctgcagggggcctctcccagcccccgcactggttgcacttttaaataagagaaaaaaacagtgataggactgacctgcgygtagaagtttcaagttacaagaaaaacacttcacaggatccaaatccttaaagtcctgaaggaaacagagagcatatacaccagctttcgccacccaatt

SEQ ID NO: 42860 - DNA, 201 bp, Homo sapiens
caacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttata

SEQ ID NO: 42861 - DNA, 201 bp, Homo sapiens
ttttttttggcaagattaagtgagatcttccatttgacatgcctggctaattggcagtgcccaacagatagaaactattggtattgtaaggactgcttatygggtacatatgctgtgccatgggaggtggaggtgctgtcatgctgaacccctattaacctcaataggaaaggcaccaggttcaagagctgaagaagacac

SEQ ID NO: 42862 - DNA, 201 bp, Homo sapiens
tccttctcctcctcctcctctccttttcttttcttttcctttccttcttcttcctttcttcctttatttctttcttcctgtattattttcttgtatagctyaggtctcactgctttgctgccattcttgtggagaataataggtaacagaggtgtgcacctggcctcatttattgtcacactggataggtaatagacgccg

SEQ ID NO: 42863 - DNA, 201 bp, Homo sapiens
aaaaaaaaaaaaaaagcctacagttgacaggcagataacagagggagcaaaggagtcttgtggaagacaatagggagtgttgaggacctgtcaaacaacasagtccccatctgtactttgggagggaaggacttcttaattccagctgcctgttgccatgggggaacatagacccagaactgccatcttttctaatttttt

SEQ ID NO: 42864 - DNA, 201 bp, Homo sapiens
accaccattctcccctactttgtctatgaattcgactactcttggtacctcatataagtggaatcacacagtgtgtgatgtgttcttttgtggctgacttmtttatgatactggattctcagcatcatgggagttaggactgtctgtcgcaccatcaaacaggcatagctggctggctagaccatgtcacagggatgttgg

SEQ ID NO: 42865 - DNA, 201 bp, Homo sapiens
gactgtctgtcgcaccatcaaacaggcatagctggctggctagaccatgtcacagggatgttggaactgggtggcactgactggcccagccaaggggtcaygcaggggactcctgattcattcctggggaaagtagttatgtcaggaagcacaggctatggctcacggctgtggctgtgcccacgtggtctgtgtgggctg

SEQ ID NO: 42866 - DNA, 201 bp, Homo sapiens
ggtctttgctcttccactgccaagaagtaaggttttggttgggcgcggtggctcacgcctgtaatcccagcactttgggaggccgaggtgggtggatcackaggtcaggagatcgagaccatcctggttaacaccgtaaaaccccgtctctactaaaaatacaaaaaaaaaaaaaattagcccggcgtggtggcgggtgcc

SEQ ID NO: 42867 - DNA, 201 bp, Homo sapiens
taatccgcccacctcggcctcacaaagtgctgggattacagacatgagccaccacacccgccctacatgggtattctaacccagtctagtgatagtccaayctcctgtactatgagtaattagcaaagaattaacagcagaagatcgctctcaccaaagcccatccagaaagtggctcgtattcaaggtgctaattagggt

SEQ ID NO: 42868 - DNA, 201 bp, Homo sapiens
aggagtttgaggctgtagtgagccctggtctcaccactacacttcatcctgggcaacagagtgagatgctgttttgtttttgtttttttttgtttgtttgkttggttttttttggaaaaagaaagaatcaccataaaaaagatgggtaactcggaaatttcaaatgcttgaatttcttgggttgggaagaatatcccaaaa

SEQ ID NO: 42869 - DNA, 201 bp, Homo sapiens
cagggacagcaaaagcacacacaatgatggccagagacactgctcagtgtactgtcttccaccgggacagcccactcaccaagggttaggtcctgtgctgmctgggtcccgggtctcctcggaggtcggtttgcatcacgtggatacactaatctacccaagttgacttggagaaccaatctgaaatcagatgggagctcc

SEQ ID NO: 42870 - DNA, 201 bp, Homo sapiens
tgccgcgttgggttaaccatggtagcattttaccatgagaagccatagcaagatgtgccaggtgcatgctgctggaacacctggctgaggctccaacagcrttttcctatgactgagggtagggtaggtagatgactcattacaatttataaaatggggggcttagcttgggtatcatcgtggttattccaagcagtcttc

SEQ ID NO: 42871 - DNA, 201 bp, Homo sapiens
atctgccagcaggctgtgctggggagtggtgagtagtacagggatgtgtctgaccccaggagaactgccccgatccctatcttgtctctgctcagttctgrtaactcttttatcttccctggagttatttttttcccttctttctttctctttttctgtgtgctcttctaagagtaaaacgcatgtccccccatgaagtca

SEQ ID NO: 42872 - DNA, 201 bp, Homo sapiens
gagttataaaaatgtttgtagtatagcacagaatgaaaaacacagcaaggtatgtacggtttaaagtgtaatcaattttgaggttgtatacaaggatatamatgataaatacaagtagtagcatttttagtaaaggctgttacaaaatactgtatttatggcctattccattctttttatagctcattaatgtagaaaaca

SEQ ID NO: 42873 - DNA, 201 bp, Homo sapiens
cggttctgatttattaaccatttacttggctttggagaaggcagcatttttagtagtactgttgagcctgcatgtagcttttccaggagggcagggtgccyggatatctgatcttacagttattactttgtgtcatatataattttgttttctccctgcaacaaataaatctttgggactccggaagaaaaaaaaatggga

SEQ ID NO: 42874 - DNA, 201 bp, Homo sapiens
aatgaaatatatgtagggtttggaaccatctgaggctttaggcatctactgggggtcttggagtatatcccctgtgcagaagcggaggctactgtacatamatttgcctgtaagtgagcgcgttcttggattttgttgaatggtgccactgattatgggtcagagcttgttgaaagggtattaatccattatttactaaaa

SEQ ID NO: 42875 - DNA, 201 bp, Homo sapiens
gcagtcacttaatgatattgaattgaacaccatttctcagaagttcctgtattaaattacaaccataagaacatacacaagcatgcagattgtaagtgtgwtgagaatggaaacattccataggacgcagagttattcctcaagcccctggactcgcagagaatcaggtgtatgaagcaagaggaagaagacaagaatcag

SEQ ID NO: 42876 - DNA, 201 bp, Homo sapiens
tttgctcaggaagaagagcaaatggatttttgttaagaagctggcagtctgtcacaggagctacttgaggatacacacagttttctccccattagcatctscagtctctggtataaacttgagtcttctctttggtccctgataaatatacatagaatgtatggatgtgagaaagttaaactgatgtctgtgtgtcttcat

SEQ ID NO: 42877 - DNA, 201 bp, Homo sapiens
aattttccaccttgccaaatttgaggtccccctcaacattaacggggaacccaatatcagttccttaaatgggagcaaagattgatgtcaatataaactakgacacacattcatattgcagaaagggtaagaaatccttacacagaacgagtacggtctctaacagtaaagtacagaacaggtggttctcattttagtata

SEQ ID NO: 42878 - DNA, 201 bp, Homo sapiens
tttattttactataaatatgggataattatagtttttactgcatagttttgttatgaggagtaaatgagtcactatttctgagacacttcgtgcctggcasagaacgagcactgtgtgtgtgttacagaaatatatgtgggtgggtgtgtttctgttttccgtaattccagctaggcaaagacatatttaacaaaagcctt

SEQ ID NO: 42879 - DNA, 201 bp, Homo sapiens
ggagaagacagtgtctgctgatgtgcttaacttttttttttttttggtcaggtgtgtaggtatgtgactgaaacccatagactttgcacatattgtcaaawgactttccagagggactcaggcactttatttaattaatgccaatgaagcccgttaatccgctcattactgcagtttaattttgatgctggtttttgatga

SEQ ID NO: 42880 - DNA, 201 bp, Homo sapiens
acaatgggactagaacactctgcagagtatgaaggttgtgattcagttgcccaagcagtaaggcctgactggtgtcacgatcccacaacccgcacaaaggygccattgttgcccagtgtgaagggagctgaggcatcaccaaagggggccaagcgtcccttctctgggttagaaatgttgttttccatttgctggtaaaca

SEQ ID NO: 42881 - DNA, 201 bp, Homo sapiens
ttttgagaatcacaggcgtttttgaggctcatggctataatcccagcacttggggaggccgaggcaggtggatcacctgaagtcaggacatcaagaccagyctggccagtgtggcaaaaccccacctctactaaaaatacaaaaaaaaattagctgaacctggtggttcacgcctgtaattgcagctactcaggaggctga

SEQ ID NO: 42882 - DNA, 201 bp, Homo sapiens
tttcctggcttgcagctgcaactatctgacctctgcgtctgtcctcccacggccttctccctgtgtgtttctggatctcttctcctttgttatcaggacastggtcacattggattaagggcctaccctattccagtctgactgcatcttaactgtttaactctgtattccaatctaattacatgtctatttccaagtaac

SEQ ID NO: 42883 - DNA, 201 bp, Homo sapiens
caataaactttattttcttcataagaattcagtctacgcaagggtattaggcagcttgtttgcaccttttaattgctggatgttttccagaaaggctgttwgcagtagttccagtgggttcatctgtgaatcaggaaagacaatgcagctttgtgttttggtttttatcagttaccttctgtttgtaaacatctgtttgga

SEQ ID NO: 42884 - DNA, 201 bp, Homo sapiens
agtggagcaaaacagatgtgaaacatttgtgtcttaaagtgttttggtcaagagaaactaaattggttagaaagtgtgcaattttgcaagctttataaaartataaaccaatgagtctggactctgttccctaaaggggatgaggaatgaaaatgaaggtttgcaaagacatcttgccagacccttacatattttaattta

SEQ ID NO: 42885 - DNA, 201 bp, Homo sapiens
ttgctggtattttcactcttccttcctaccctggatgctgatttgatgcttccagccttagcggttttcttgcttctaggactgaacagggaagagggaawagtcaaaagaatgacagaaggtcctcacgttgcagaacactgaccaatgttggcaactacaagacaatcaggcgtgattcttcatccaggatctgctttt

SEQ ID NO: 42886 - DNA, 201 bp, Homo sapiens
tccagcctgagtgacaagagcaacactccatctcaaaaaaaaaaaaaaaaaaaaaaggacagggaaaatgtccaggaaggatgtggcttagctgaagatcwgcttcagcttgatcccacgggaagctctggagggtgaattgtacagcagagttggtcctgactgagaccagggcctggctgacctatggcagtcagcgat

SEQ ID NO: 42887 - DNA, 201 bp, Homo sapiens
agcgagacttcttgtggaatgatgaatatgttcagggaggctgttgatggcaagaaaagaagggtgatgggttgggcttatattgtttagtggagcaaaasagatgtgaaacatttgtgtcttaaagtgttttggtcaagagaaactaaattggttagaaagtgtgcaattttgcaagctttataaaaatataaaccaatg

SEQ ID NO: 42888 - DNA, 201 bp, Homo sapiens
ctttattagtggcatgagaacagactaatacagtcagggatgctgcagaacatctccaaacacacaggactcccaccctctacttccaccccaccaacaargaatgattcagcccaaaatggcagtagtgaccttgttgagaaatgctgttcaagccatacgtcaccattggaaggttgccaaactgtgctttgcacacac

SEQ ID NO: 42889 - DNA, 201 bp, Homo sapiens
gaagtgcattccatggccctgtcccagccatagaaagaaatgcctttatttttaagcgagacttcttgtggaatgatgaatatgttcagggaggctgttgrtggcaagaaaagaagggtgatgggttgggcttatattgtttagtggagcaaaacagatgtgaaacatttgtgtcttaaagtgttttggtcaagagaaact

SEQ ID NO: 42890 - DNA, 201 bp, Homo sapiens
tctgagctgtgagtccttcctgtgcaccaggcatggatggcaaggcacgattgataatgttccctcttatctcgaaatgtccactctctctcccatgcacrgggagtcaagctgtgctcttcaaacacaaattccttctcccacttcctgggtagttatgctcttttcttccctgaggttgctaattgtgggcagtacagt

SEQ ID NO: 42891 - DNA, 201 bp, Homo sapiens
gaagacagggcaggagggtggtgtggcacaaaggcggctctgtctgacctgtcacgttaggactgagttcattcttgttcagattcagcatcttttgttayacccgaagtgcattccatggccctgtcccagccatagaaagaaatgcctttatttttaagcgagacttcttgtggaatgatgaatatgttcagggaggct

SEQ ID NO: 42892 - DNA, 201 bp, Homo sapiens
tgtgttactaaagttctcttagatactttacatttcctttcacggatttccaaaatttctttctttgagaatgtcaggaccagtaggaggttcagcacgcrttgccagagaaatcacagatgactaattggaatgcctcagaatcattctccttttgtttcacctaatttccacacttacgaagtcaaactctcagttaaa

SEQ ID NO: 42893 - DNA, 201 bp, Homo sapiens
gagcgctcggcaaatggtcttaaaagcatccgcgcttgcatggaaatgcatttccaatggtgacggggtttgttttattcatggactttttgaaaaaaaaatcactggtttattggaaaccatagagaagtataagtaattattatgctttttaaaatacaaccgaggttcctcatcatgatacgttaagggaaaggaaga

SEQ ID NO: 42894 - DNA, 201 bp, Homo sapiens
atactacatttcatcaggtagtgttagaaatttaggctgagccaaaaaagaaaagggaggaggtgggagggaggaagcaacgagtcccttgttcaggcggyattaacccccttaccctggctattggaacaatagcgcttctaaaagccgcacaaaatcctccaatattaagaacggagaaaaggagtgtggaaaaggtgt

SEQ ID NO: 42895 - DNA, 201 bp, Homo sapiens
attgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttatg

SEQ ID NO: 42896 - DNA, 201 bp, Homo sapiens
cagagcatttatctttgatgctgggaatgcgttcattttctttatcttgccattactgtacctctattgggaaatttactctctcttcatagataggatcmgattcagtacatatttataaaaccacacttacatttaaatacaggcctttcccatttcacagtgtttctagctcccctttccaatacatctctctctctc

SEQ ID NO: 42897 - DNA, 201 bp, Homo sapiens
ttccttcctcagaccccaaagtagctgggaccacaggtgcacaccaccacttccagctgattatttaaaaaaaattttgtagtgacagtgtcttgctgtgyttcccaggctgttcttgtactcctgggctcaactgatcttcccagcttggcctcccaaagtgctgggaatacaggtgtgagccactgtcccaggccagtt

SEQ ID NO: 42898 - DNA, 201 bp, Homo sapiens
ctccctctccccaggagaggtcccagcggaataaacatccccgccccttcaactctttgccattgttcaagccctgctagaaaccagatggcaaaaggaasttactgatgtgttcatattggtcaactttttcaggcacgaagaccagtacagaaggatggaaagtgcatttgggtagggaaatgggagattcctgcatag

SEQ ID NO: 42899 - DNA, 201 bp, Homo sapiens
aattattcttttacccagacacttacatattcctagccattccttttgcttaagtttgcagagatttgtgcttaaaactgaataaacaatctcagggtttktgtgtgtgtgtgtatgtgtgtgtgcgtgttatatgaagtcttgctagaatgcataaacaaacaaaaaaaatatcatactctcagatcctggatactgtgg

SEQ ID NO: 42900 - DNA, 201 bp, Homo sapiens
aattgctctccaaaaggtttgtagcaatttaaatgatcagaagcagcactgaagtccagtttcgtctaaccagtattgagtgctcattaaaaaaaaaaaaaatcattactaatatgataaacaaacaaatggtgtgttattgttgggttgaaagaagcaaatttggagaatccagagaaacacagcggaaattcaatttat

SEQ ID NO: 42901 - DNA, 201 bp, Homo sapiens
tgggaatacaggcacccaccaccacgcctggctaattgtttttgaatttttagtagaggcgagattttcccgtgttggccaggctggttttgaactcctgmcctccggtgatctgcctgtctccgcctcccaaagtgctgggattacaggcgtgagccaccgcgcctggcctgaattaatattttctaccccactttctta

SEQ ID NO: 42902 - DNA, 201 bp, Homo sapiens
agaagaaatatgggatgttttgcttcgggatggaggctggagcaggagtttctggagtctgccagtacccagtttgaatcccagctctgccttttatcagytgggtgttgggcaagttagctgacttttgtgagttttctcatcattaaaatgagaacactgttattggtctttcgggattgttttgagaaatgagatatc

SEQ ID NO: 42903 - DNA, 201 bp, Homo sapiens
tgcttttataaaaaaagtcacagaaacaattatattgtacacagtcctatataatctgctttcttttgtttatagaatactgtgaatgtctttttgttttktttttttttgtttgcgagacagggtctcactctgtcactcaggctggagtgcagtagtgcaatcttggctcactgcaacctccatctcctggatgccagc

SEQ ID NO: 42904 - DNA, 201 bp, Homo sapiens
tggaagggatatttaatttccattaaaacatgaatttcattctgcccttgccatgcttttcttggtcttagcccaacctgagctgctgatattaaggaatrataggataattccataattttcattttaccttttgctttttgttttccatagcagttatctagaggattcccattatgcttcttcattacccggtgccca

SEQ ID NO: 42905 - DNA, 201 bp, Homo sapiens
tctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaacttt

SEQ ID NO: 42906 - DNA, 201 bp, Homo sapiens
acagcttctggcgccgcaaacaccttgggtcctagagaaacctgcacacttgtgtctccacctttttacctcttgcgggcatgagtctggtctcagtaatmacattgtccagcccatcataaagggctcttgaacacattttcatcaactttaggttaagtctgtttgggtaaatgcgtcttggagggctgggtagaagat

SEQ ID NO: 42907 - DNA, 201 bp, Homo sapiens
ttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactt

SEQ ID NO: 42908 - DNA, 201 bp, Homo sapiens
tggagcacttgaaaactgctgttttgtgtcagtaggtaaacaacaaacattggtgactactgaattttcagcagatgtgattcctttgtttcacagaaaawctgtatcttttgttctaaatttttttcttctaatgggtataatcctctgttggagagtcctttgatagctaggagtgtgttttcttctttactttcccaa

SEQ ID NO: 42909 - DNA, 201 bp, Homo sapiens
gtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaac

SEQ ID NO: 42910 - DNA, 201 bp, Homo sapiens
tgaaaactgctgttttgtgtcagtaggtaaacaacaaacattggtgactactgaattttcagcagatgtgattcctttgtttcacagaaaaactgtatctkttgttctaaatttttttcttctaatgggtataatcctctgttggagagtcctttgatagctaggagtgtgttttcttctttactttcccaaagacaattt

SEQ ID NO: 42911 - DNA, 201 bp, Homo sapiens
ttctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgttttta

SEQ ID NO: 42912 - DNA, 201 bp, Homo sapiens
gaaaactgctgttttgtgtcagtaggtaaacaacaaacattggtgactactgaattttcagcagatgtgattcctttgtttcacagaaaaactgtatcttwtgttctaaatttttttcttctaatgggtataatcctctgttggagagtcctttgatagctaggagtgtgttttcttctttactttcccaaagacaatttt

SEQ ID NO: 42913 - DNA, 201 bp, Homo sapiens
attctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgttttt

SEQ ID NO: 42914 - DNA, 201 bp, Homo sapiens
tactgtggttacatttggaagtgtttacaaaggtgataagatgtttttatagtttggtgttcatttatcgaccatattaagaaccttcttctatgaaatgsttttagtaggaagtattttgaatgaagaaagcgtattttccacaatatatttggtagattatttttcaaaaccaaaggacttcaaaaatgtcttcctatt

SEQ ID NO: 42915 - DNA, 201 bp, Homo sapiens
ggccagggtcgggttaagatgctagcctcgtggggtgccatcctgacagattctactgtgtgcgtgtgtgtgtgtgtgtgtgtgtgtgtgtgtgtgtggtgatataatgtgttgcattggtgtctaaagccatgctcagtatatagttatatatttcattcattcatccgttcattcagttatctcacgtttctggagggc

SEQ ID NO: 42916 - DNA, 201 bp, Homo sapiens
ggaagtgtttacaaaggtgataagatgtttttatagtttggtgttcatttatcgaccatattaagaaccttcttctatgaaatggttttagtaggaagtaytttgaatgaagaaagcgtattttccacaatatatttggtagattatttttcaaaaccaaaggacttcaaaaatgtcttcctattagtggacaccagtatt

SEQ ID NO: 42917 - DNA, 201 bp, Homo sapiens
gatgctgggaatgcgttcattttctttatcttgccattactgtacctctattgggaaatttactctctcttcatagataggatccgattcagtacatattyataaaaccacacttacatttaaatacaggcctttcccatttcacagtgtttctagctcccctttccaatacatctctctctctctttctctctctctctc

SEQ ID NO: 42918 - DNA, 201 bp, Homo sapiens
agtgagctgagatggcaccactgcactccagcctgggcaatggagcaagactctatctaccccccaccctgcaaaaaaagaaaagaaaggaaaaaaaatcytggtgcttgtaggagaggcatttatttcttttaggactggacggggcttggagggtttccaggaaacagcctcaacctaaaaatagtagacacagttcat

SEQ ID NO: 42919 - DNA, 201 bp, Homo sapiens
accacaagcattatcttctttaatcatctcacaatcttatgaaggagatactaatattttgcttgcaaagatgagggaagtgagtttccgaagttgctaartgcgtaaaggaggtggtggtgtcagaatgttatcctgctcagatggttgcatgggacagtgtccagaggaaggcctctgattccttccccagcattaggc

SEQ ID NO: 42920 - DNA, 201 bp, Homo sapiens
gctacatacatttgaaaattaggatgatttgaaattgaaatgagggcttatgctgttcattggattaatttttctctcttataaataaaaaatatatacarataatacataaacattgtttttcactgtggcttgaattttctaacaatttttttcttcttctcaggaaatgttttcttcttatacctccaaaataaccac

SEQ ID NO: 42921 - DNA, 201 bp, Homo sapiens
aggttgggcacattttttaaaggtttgtgagacatattgccaaattgctctccaaaaggtttgtagcaatttaaatgatcagaagcagcactgaagtccaktttcgtctaaccagtattgagtgctcattaaaaaaaaaaaaaatcattactaatatgataaacaaacaaatggtgtgttattgttgggttgaaagaagca

SEQ ID NO: 42922 - DNA, 201 bp, Homo sapiens
ggctggactgtcacttggttgttctcggtttcaggacccacgtcttttgtctctgtaatgaatgtgttcagaggtctctgcacagagaagctggctgttargaaaactatttcttctttccgagacaggctgcaaaatgcttgttactattttgtgtattcctggcaggatttgtattcttagttttattactaatgataa

SEQ ID NO: 42923 - DNA, 201 bp, Homo sapiens
aaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaa

SEQ ID NO: 42924 - DNA, 201 bp, Homo sapiens
tttttatcattgtctttgcagtctattaggggctacacaatttaaacagagaatatatataaaatggtagaaagtacaagtaagtataccttatttttttwaaaaaaatgaatgtggtatttcacccacagcctcaagaatcactttccttaaaattgccagagtaggaaaacttacaattgaagaatttcaggtatttat

SEQ ID NO: 42925 - DNA, 201 bp, Homo sapiens
gggccagggtcgggttaagatgctagcctcgtggggtgccatcctgacagattctactgtgtgcgtgtgtgtgtgtgtgtgtgtgtgtgtgtgtgtgtggtgatataatgtgttgcattggtgtctaaagccatgctcagtatatagttatatatttcattcattcatccgttcattcagttatctcacgtttctggaggg

SEQ ID NO: 42926 - DNA, 201 bp, Homo sapiens
ctgtatcatgatatcggagtgttagctgttttgggagtacgtgtgctcaggacttgggctgagtggaaaaccagagtatggggttagaaatggaggcagarggactaccatgtcggggaggatgcacaatgaattggacgaaggttgcaactcagtgagcaccgtacctgtagtgtgtcttagtaatagcagatgcccaac

SEQ ID NO: 42927 - DNA, 201 bp, Homo sapiens
tgggccagggtcgggttaagatgctagcctcgtggggtgccatcctgacagattctactgtgtgcgtgtgtgtgtgtgtgtgtgtgtgtgtgtgtgtgtggtgatataatgtgttgcattggtgtctaaagccatgctcagtatatagttatatatttcattcattcatccgttcattcagttatctcacgtttctggagg

SEQ ID NO: 42928 - DNA, 201 bp, Homo sapiens
acagtggacctcacagctctcctgctaatggtgctgatggctaagctcagctcttacccttgaccactggaacaacttagacatgtcaccagctttctgascctgtctcattacgatgaaaattgtgatacaggttagtgtaaggaccgacaataatgcatataacatcaataatgatggatatagaatttctgcagttat

SEQ ID NO: 42929 - DNA, 201 bp, Homo sapiens
ccaaaaataagtcataagaacaacaaataataccaggaataaataatgtaaaatataaataattcctaaaatggtgataacagcttatgacaagtaatttyttttttttgagatggagtctcgctctgttgcccagggtagagtgcagtggtacagtctcggctcactgcaacctctgcaacccaggttcagtcgattctc

SEQ ID NO: 42930 - DNA, 201 bp, Homo sapiens
acatacttcttcctgccctggattaacattaccattggttttagtagtcttacgtcattatgtccaaagcttttaagtttacagtgcttgcttagtccagygaccaatggatgtaagtaagttggaaaagggcaaaggatttagaatcatgagggttgtattcaaactgcagcctctactcccttttagttacataatttt

SEQ ID NO: 42931 - DNA, 201 bp, Homo sapiens
tttatactcctctttgcacgttgcagaagatcaggaatttgcacattatagccacaaccatacccagaaccagattgtctaacactgaatctcgaatccamattcctggatttggatggactcaatctggacccagtatctacatttggtccagtcatctgtatccggcatcggggtcttgttgaaaaaccatggcttagc

SEQ ID NO: 42932 - DNA, 201 bp, Homo sapiens
tgctttcattgttgcttacatgtgttaaataattttgtctctgtataataacaacctctggcgatttttcctttctctctctctcttttttttttcttttstttagacggagtcttgctctgtcacccaggctggagtttagtggcatgatcttggctcactgcaccctccgccttctgggatcaagtgattctcctgcct

SEQ ID NO: 42933 - DNA, 201 bp, Homo sapiens
atgctgatgtaaccatttccattctgaactcagaaaatggagataaatctcttgcaaggcttttgattttagtttttagatacagaacctttaaaaaaaaagaaaaataaacgttttgccacagtgtagtatatacaacagatgtgagggaaggacattgttttaagtgggaaacgtcagctctctcaacttctacacatt

SEQ ID NO: 42934 - DNA, 201 bp, Homo sapiens
tgtcctttttaatttcctttttctagcaattctcaatgtttttttaaaatctcttctggaggagggtacccttcacaaagttatttgccaaaggtctgagraaaaaaaaagcctttcaccatggttagttcgagaagcacagcaatacagtacttctgctacgagtgtatacaggctgaggatgggtgctttgtggccctt

SEQ ID NO: 42935 - DNA, 201 bp, Homo sapiens
accactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagttgt

SEQ ID NO: 42936 - DNA, 201 bp, Homo sapiens
gtagcctcaacctcctgggctcaactgattctctcatcttagcctcctgagtggctgggaccgcaggttcatgctaccgtgcccagctaattgtttaattytttgtagagataggatctctccctttgtggcccaggctgatctcaaactcctgagctcaagcgatcctactcactcggcctcccaaagtgctgggattac

SEQ ID NO: 42937 - DNA, 201 bp, Homo sapiens
caccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagttg

SEQ ID NO: 42938 - DNA, 201 bp, Homo sapiens
tgttctttctgccatttgggatgtgctttctgataatggcactaggctgccttgttgcctcctgcatgtagaacacagaacttcgcagtctctgcagagtrtctaaatcctgctctgggccagccctttcagaaacacttcaggagatcaatagttatctgcttacctttctagctgagatgagattttatgcttgttact

SEQ ID NO: 42939 - DNA, 201 bp, Homo sapiens
tcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagtt

SEQ ID NO: 42940 - DNA, 201 bp, Homo sapiens
ttcttttcttttttcttttcttttcttttctacctctcgggattctgagagcatcctgtaatgttggaaagctttctgctaatccgggcattggagtgctytctgggttcactcctgacagttctttattgctttcccacctctgccaaggtcaaaaatggaacttgcttcttgttctcgtatcactcagactaagcagtt

SEQ ID NO: 42941 - DNA, 201 bp, Homo sapiens
gtttaattgacttccagttttgttttgttttgttttgttttgttttgttttgaaacagtctcactctgtcgcccaggctggagtgtagtggtgtgatctcygctcactgcagcctctgcctcctgggtttaaggaattctctgccttagcctcccgcgtagctgggattacaggtgcatgccaccatgcccagctgatttt

SEQ ID NO: 42942 - DNA, 201 bp, Homo sapiens
tactctcctgatagccactaaagggggaattggatattgtctatcaattggttggtctctgaactaaggctgtatctaattacaaggcattgtatcggttstgatttattaaccatttacttggctttggagaaggcagcatttttagtagtactgttgagcctgcatgtagcttttccaggagggcagggtgcctggata

SEQ ID NO: 42943 - DNA, 201 bp, Homo sapiens
ccatattttgcaaagtcaagttggagatggctctcgatatgcatgagtgtgttagactgcttttcttctattttttaaaaatgcacccaaatgtaaaagayacttttacctttttgatttgatgttgaaggtcatttgaaaaatactctgtctttattctttgaaatggatttactctcaagaaagttgcatgtcacttta

SEQ ID NO: 42944 - DNA, 201 bp, Homo sapiens
atgaagtggctactataattatcctgatttcccaggcagagaaactgaggcttagagagttgaagtaatcaactgggtgttaaaaagctggtaagtggcasagcacttattggcgctaagactgtttctcaggaccttgttgtacgagagtcaacgataagacgcagaacgtatgtttcatttttcttgggaaggatctat

SEQ ID NO: 42945 - DNA, 201 bp, Homo sapiens
caggccttcctcccttacctctctctacctctatctcttctatctacctgtctctactccctctccctacttttctctttttcccagcctccccccgatayactcaacatatatctccctctccctccacccacctgcctcccccacactccttctttccctctcctctgcagggagagcttggaaaccaagagtctatga

SEQ ID NO: 42946 - DNA, 201 bp, Homo sapiens
ggcacgtttttcaacctctctgtgcttaatcttctcctctttaaaggtgggctagtgatagttacctcacaaggtagctgtgagaatgaaataatgatacrtaaagcacttataacaggacctggcatgcagtgagtatcagtgggtatttgctgtggttatttagttatctactttacatgtacatgtaaagaactaggg

SEQ ID NO: 42947 - DNA, 201 bp, Homo sapiens
gagtgcagtgacatgatctcggctcactgcaacctacaccttctgggttcaagtgattctgatgtctcagcctccccagtagctgggattacaggcatgtrccaccacaccggctaattttatgcatttttagtagagacgcgtttcaccatgttagccaggctggtcttgaactcctgaattcaaatgatctgcccacct

SEQ ID NO: 42948 - DNA, 201 bp, Homo sapiens
tgaagatgctgaggttgagggaagaaataaatgttaatgcaaagtgcccagtttagtgcctgccaagagtaactggtgggtctgtgtcaccttctgacatkatcagtgtgattgtctccaacgcatccatggaagtgaaaccgttggaggaagctaatgccgtgagccagctgttggttatgtttttgttttgtttttctt

SEQ ID NO: 42949 - DNA, 201 bp, Homo sapiens
attagtgttgctgagataggagcttttggtagatggataaactgggatttgtaaatattttgcttagtttttttcccagagttttgcagaagagaataagktgttggtttgttataaggtggtcctttataaagtttagacctattttaataaggctgacttgggttgaagataactagagccatgactttcatcttgatg

SEQ ID NO: 42950 - DNA, 201 bp, Homo sapiens
taaatgttaatgcaaagtgcccagtttagtgcctgccaagagtaactggtgggtctgtgtcaccttctgacatgatcagtgtgattgtctccaacgcatcyatggaagtgaaaccgttggaggaagctaatgccgtgagccagctgttggttatgtttttgttttgtttttcttttttacttgctggatagtgggttctgt

SEQ ID NO: 42951 - DNA, 201 bp, Homo sapiens
gatgaggcctgggagtggcacaaatctttgaactccaggaggctaggaaacagagcataaccttgtgcccaggaagatgcggggcatagtacatctttgcytcacctgatgtattgtttgtttaaaatcactttggattctcatttaccttttccccctcaagatctttgtttttgactttggagataaccagaaataact

SEQ ID NO: 42952 - DNA, 201 bp, Homo sapiens
atgccgtgagccagctgttggttatgtttttgttttgtttttcttttttacttgctggatagtgggttctgtttattgagaaatatttacatccgtctaawtcaggtgcttgctagggttcttggcacacagagcatcccaccaataaactgtggttcccaacaaggcttgcaactgaatctgggcaacaatgaacatgac

SEQ ID NO: 42953 - DNA, 201 bp, Homo sapiens
gttttgtttgtaagaatcagttgaggacagatgggactatttgcatggattggtgtcatgtttgaagtcagttaccagagggtttctttcaacagagtatmccaaaaaaaaaaaaaaaaaaaaaaaaaaaaaagtaaattgcacagaccccagcttaggacctggacttaatcttcatgatgtttgtaaagtaatacttct

SEQ ID NO: 42954 - DNA, 201 bp, Homo sapiens
atatatatatatttatataaatatattttatatttaaaaatatttatattttatatatttttatatatttatgcaagtatatatctaaatatataaaatakatataaatatatacatatatgtgtatatatagattttgttttttgagacagggtcttgctctgtcactcaggctggagtgcagtggcgtgatcatggctc

SEQ ID NO: 42955 - DNA, 201 bp, Homo sapiens
ctcaccactgccctgcagcctgagctatagagccagaacttgtctcaaaaaaacccaataataataataataataataataataataataataataataataataaagaaagcgagagaggaggtagggaatgaatgccgaaagtggttccttgggtctgatgcccacgcttaaccgattcccagccaaacatttcacagt

SEQ ID NO: 42956 - DNA, 201 bp, Homo sapiens
caagaaatgcggcagctgcttctagccgctccatccttccttttcccagtgcgcactaaccctccagagccttccgcatctgctatgcagcattggccacrccagtgggatgcaagaatttatcccttctgttgatgcaattaaagctaatggatctcatatatatatatatatatatatatatatatatatatatatata

SEQ ID NO: 42957 - DNA, 201 bp, Homo sapiens
caacgctttgggaggctgaagcaggaggatcacttgagcctaggagttcgagacctgggcaacatggtgagacccccatctctacaaacaacaacaacaamaaaaaaaattagccaggcgtgggggtgcatgcctgtgctcccagccactcaggaggctgaggtgggaggatggctcgagcccaggaggccaaggctgcag

SEQ ID NO: 42958 - DNA, 201 bp, Homo sapiens
gttgctgtactagatgaataatgtccccccaaattcgtgtctatctggaacctcagaatgtgacctcatttggaaataaggcctttttaattaaaaaaaawtttttatttaaaaaacagagatagagtcttgccatcttgcccaggctagtctcaaactgttgggctgaagcagttctcctgctttgacctcctaaagtgc

SEQ ID NO: 42959 - DNA, 201 bp, Homo sapiens
aaagacttggaaccaacccaaatgtccaacagtggtagactggattaagaaaatgtggcctttgcctcttttaaaaagttctaagttgctagccagtcggracaaatacagaatgtgaggtccctttccagccaatggaaaccggacacagcagtagagtacacgtgtcaggttataaatgagcctgtctcctttgtccgg

SEQ ID NO: 42960 - DNA, 201 bp, Homo sapiens
cacagctggagtttaggaaggccaggcagcgtgtgttgaatgccagccactcttctacccagggtcatatccttggatgtttttctgtgcatctgtctttyccgaccctcccgtgattctggaaggaaacacctttccaagctccccagtgaccctggttcatcccggaaatatgcaggaaaagcattatgagcattgcag

SEQ ID NO: 42961 - DNA, 201 bp, Homo sapiens
tgtaatcccagccacttgggaggctgaggcagagaattgcttgaacctgggaggtggaggttgcagtgagctgagatcatcccaccgcacaccagcctggscgacagagtgagactctgtctcaaaaaaaaaaaaaaaaaaagttacttctgagttaaaatatgaagagtgagcagtacccagccatgcagaaggacatgg

SEQ ID NO: 42962 - DNA, 201 bp, Homo sapiens
ctcacatgtaggtcacctacgggagcaggggaggaaccatctgaggtgtttttttttttttttttagatttctcattgctgagaacagttccagctctgcygaccaaaggctgagtgtccttttattagtctgagcccctagagagaccaaagaggcaaccctcgagccaactgacagccagctgtggggttggaccctgt

SEQ ID NO: 42963 - DNA, 201 bp, Homo sapiens
ctcgtttttccttttttcttttcctttttttttttttttttttttttttttttttttgagatggagtctcactctgttgcccaggctggagtgcagtggcrcaatctcagctcactgcaacctctgcctcccgggttcaagtgattctcctgcctcagcctcccaagtagctgggactacaggtgcacaccaccatggctg

SEQ ID NO: 42964 - DNA, 201 bp, Homo sapiens
acagcttgcatgtgtagttaatttgttccaaatttccatcctgcattataaccctaatgtttgctaataacacacaaacccacattttattaagtaagtartttgagacatgatgatttttgtcatgtaaataggatcaggctgaccagtatagactgggcagaggaagattcataaccagggaattaatctctggatcca

SEQ ID NO: 42965 - DNA, 201 bp, Homo sapiens
ataagtaagtgggaagtccaggggtagacgtgagttcaggcatagctggatccaggatccgacagcttgcatgtgtagttaatttgttccaaatttccatmctgcattataaccctaatgtttgctaataacacacaaacccacattttattaagtaagtaatttgagacatgatgatttttgtcatgtaaataggatcag

SEQ ID NO: 42966 - DNA, 201 bp, Homo sapiens
acacaggctggagtgcaatggtgcaatctcagctcactgcaatgtctgcctcccagattcaagcaattttcctgcctcaggctcccaagtagctgggattrcaggcacccaccaccacacccaactaatttttgtgtttttagtagagacagggtttcaccatattggccagactgctcttgaattcctaacttcaggtga

SEQ ID NO: 42967 - DNA, 201 bp, Homo sapiens
ttgcctgatcgcctctccacccctgctacgtgtaatagaaaggtagggccatgttggagagggatccaacatttattatccccattttacagatgaagaasttaaggtggccaggcatggtggctcatgcctgtaatcctagcactttgggacactgaggtgggtggatcacttgaggtcaggagtttgagagcaatctgg

SEQ ID NO: 42968 - DNA, 201 bp, Homo sapiens
caagtgtgcaccaccatgcctggctaatgtttgtatttttagtagggacggggtttcgccatgttggccaggctggtgtcaaactcctgatctcaggtgtwccaagaacaaaaggccaaccccattagacggtggccaagttggtgctgtgaacagggatcctgcctctgcctcccaaagtgatgggattacaggcgtgag

SEQ ID NO: 42969 - DNA, 201 bp, Homo sapiens
aaaccctgtctctactgtaaactccgtctctactataaatacaaaaattagccaggcttggcgctgggtttctgtaatcccagctacttaggaggctgagrcaggagaatcacttgaacccgagaggcagaggttgcagtgagccgatatctcacctctgcactccagcgtgggcaacagagcgagactccgtctcaaaaa

SEQ ID NO: 42970 - DNA, 201 bp, Homo sapiens
ggtgaaaccctgtctctactgtaaactccgtctctactataaatacaaaaattagccaggcttggcgctgggtttctgtaatcccagctacttaggaggcygagacaggagaatcacttgaacccgagaggcagaggttgcagtgagccgatatctcacctctgcactccagcgtgggcaacagagcgagactccgtctca

SEQ ID NO: 42971 - DNA, 201 bp, Homo sapiens
ccaacatggtgaaaccctgtctctactgtaaactccgtctctactataaatacaaaaattagccaggcttggcgctgggtttctgtaatcccagctacttrggaggctgagacaggagaatcacttgaacccgagaggcagaggttgcagtgagccgatatctcacctctgcactccagcgtgggcaacagagcgagactc

SEQ ID NO: 42972 - DNA, 201 bp, Homo sapiens
ttatgtgaatttcatctcagcaaaaagaggctaacacataaggagacatattttgatacatgtggcatattaagctgctgttgttgttttttaaatattcmagctgcgtgcagtggctcacacctgtaatcccagcactttgggaggctgaggtgggtggatcacttgaggtcaggagttcgagatcagcctggccaacat

SEQ ID NO: 42973 - DNA, 201 bp, Homo sapiens
ttacaggcgtgagccattgcacccggctattgggtacaagtttcctttggggtggtgaaactgttttggaactagaggtgatagctctacaacactgtcartgtactaaatgacactaaattgtacactttgaaataatttatgttatgtgaatttcatctcagcaaaaagaggctaacacataaggagacatattttgat

SEQ ID NO: 42974 - DNA, 201 bp, Homo sapiens
gactataggtgcccgccaccatgcttggctaattttttgtgtttttagtagagacggggtttcatcgtgttacccaggatggtctcgatctcctgaccttktgatcagcctgccttggcctcccaaagtgctgggattacaggcgtgagccattgcacccggctattgggtacaagtttcctttggggtggtgaaactgtt

SEQ ID NO: 42975 - DNA, 201 bp, Homo sapiens
ccattctcctgcctcagccttcctagtagctgggactataggtgcccgccaccatgcttggctaattttttgtgtttttagtagagacggggtttcatcgygttacccaggatggtctcgatctcctgaccttttgatcagcctgccttggcctcccaaagtgctgggattacaggcgtgagccattgcacccggctattg

SEQ ID NO: 42976 - DNA, 201 bp, Homo sapiens
gccattctcctgcctcagccttcctagtagctgggactataggtgcccgccaccatgcttggctaattttttgtgtttttagtagagacggggtttcatcktgttacccaggatggtctcgatctcctgaccttttgatcagcctgccttggcctcccaaagtgctgggattacaggcgtgagccattgcacccggctatt

SEQ ID NO: 42977 - DNA, 201 bp, Homo sapiens
atttagcatatttccttttaattgcccaggtaaataatacccaccatcagagggcaccagtagtgtaatcaccttattttttaaaatgtattctgtgtttyatgattttttctgaataactgatctttacagtctgaattgcattctgttgggcttgacttatttttaaattaaaagagactaacacattaaacactaaga

SEQ ID NO: 42978 - DNA, 201 bp, Homo sapiens
actgaactcagtcgtttcacctggctggggaggcctcaaaattatggcagaaggcaaaggaggagcaaaggcacatcttacatggcagcagacaagaaagygtgtgcaggggaactgccctttataaaatcaccagatctcatgagatttattcactatcaagggaacagcacaggcagatcccatggctttgactcagtt

SEQ ID NO: 42979 - DNA, 201 bp, Homo sapiens
ctgctgatgcatgtgaaattggctttgtgttggggcctcttcttccaaagcaacagtaagcattttttttttttttgtgataatctctctctgtcacccaygctggagtgcagtggtgtgatctcagctcactgcaacctccgtcttctgggttcaagtgattctcctgcctgagcctcccgagtaactgggattacaggc

SEQ ID NO: 42980 - DNA, 201 bp, Homo sapiens
gggattataggcgtgagccactgcacctggccagtagtagacttttgatagggtttttttttctcaaggtgtaggtttggctaggaagtcatagaaaatgstctttttttttttttggagatggagtctcactttgtcacctaggctggagtgcagtggtgtgatctcagctcactgcaacctccatctcctgggttcaag

SEQ ID NO: 42981 - DNA, 201 bp, Homo sapiens
ctgggctacataaaattatatatatatatatatatatatatatatatatatataaaataatgcagaagttttatatatatataaagttttatatttatatmtataaagttatatatatatatatatatatatttatttattttcaagacatggtggcatgcaactgcagtgtcagctactccggaggccgaggcaggagag

SEQ ID NO: 42982 - DNA, 201 bp, Homo sapiens
tgtgagtttgactgctttaaattccacacaaaaagtgagatcatagagtatttgtctttctgcgcctggcttattttacgataaattgattgcttctcttyccattgtttatagatacccattctcgtaatgatggcactgtgtctgtcatagaaggcctaattctccctgttaacattgaacataaaaacctcatatggg

SEQ ID NO: 42983 - DNA, 201 bp, Homo sapiens
gcaacccgggctgtgttcccgagtgcatcaaacggggattgggacctgttttccttcccactcacatgtaggtcacctacgggagcaggggaggaaccatytgaggtgtttttttttttttttttagatttctcattgctgagaacagttccagctctgctgaccaaaggctgagtgtccttttattagtctgagccccta

SEQ ID NO: 42984 - DNA, 201 bp, Homo sapiens
aaatatgtgtatatatatatttgttagggtaaaacaaagtctataaaaactgttttcctttgttattgcccccaccaaatatttatatatatatacacacmtatgtatatatgtatgtatagagagtctattatatatattacatatacataatatatacataatatataatagactctataatatagactctaataatta

SEQ ID NO: 42985 - DNA, 201 bp, Homo sapiens
ttattttaagttcaggggtccatgtgcaggtttgttatataggtaaactggcgtgatgggggtttgttgtacagatgatttcatcacccaggtattaagcmtagtgcccattagttatttttcctgctcttctccctcctgccaccctccaccctttggtaggccccagtgtcttttgttcccctctttgtgtctatgtgc

SEQ ID NO: 42986 - DNA, 201 bp, Homo sapiens
tttggggggcaaaaacatatatataatgaatataattatataattcatataatatatgtaatagagcgtgtatattatttacatatgtatatatatatatwcacacacacacacacatttcaactttcttgaactcctgaaccagccttagattgcctagtaccagggttcttctttttttaaaaaatttatattttattt

SEQ ID NO: 42987 - DNA, 201 bp, Homo sapiens
atttggggggcaaaaacatatatataatgaatataattatataattcatataatatatgtaatagagcgtgtatattatttacatatgtatatatatatatacacacacacacacacatttcaactttcttgaactcctgaaccagccttagattgcctagtaccagggttcttctttttttaaaaaatttatattttatt

SEQ ID NO: 42988 - DNA, 201 bp, Homo sapiens
tatgtaatatataatatattctatgtaatatataatatattctatgtaatatatattaatatgtagggaatatgttacatattatgttgagagtgtatatrttatatatgggtttctatatattataataaacccatatataatatacataatagactatacacatatacagctaatatatatacacaatagtctagtata

SEQ ID NO: 42989 - DNA, 201 bp, Homo sapiens
atatataaatatgtgtatatatatatttgttagggtaaaacaaagtctataaaaactgttttcctttgtcattgcccccaccaaatatttatatatatgtrtatacacatatgtatatatgtatgtatagagagtctattatatatattacatatacataatatatacataatatataatagactctataatatagactct

SEQ ID NO: 42990 - DNA, 201 bp, Homo sapiens
cggggtttcaccgtgttacccaggatggtctcgatctcctgacctcatgatccacctgccttggcctcccaaagtgctgggattacaggcgtgagccaccrcgcccgactgctttattttcctttgtgttcctaatacctggcccagtgtctggcaaatggaaagttcccctggatgtagttgggtgacactatgagtgta

SEQ ID NO: 42991 - DNA, 201 bp, Homo sapiens
ttgctgaatactgagtaaataaagaaaagttaacacagtggagtccaggtacagtggctcatgcctgtaatcccagcactttgggaggtcaaggcaggagratcacgtgagcccagcagttcaagaccagccttggcaacatggtgagaccccatctctacaaaaaataaaataattagctgggcatggtggtacatgcct

SEQ ID NO: 42992 - DNA, 201 bp, Homo sapiens
caagtgattctcctgcctcaccctcccgagtagctgggataataggtgcctatcaccacgccgagctaatgtttttggatttttagtagagatgggttttmgccatgttgtgcaggctggtctcaaattcctggtcccaggcgatctgcctgtcttggcctcccaaaatgctgggattacaggcatgagtccccatgccca

SEQ ID NO: 42993 - DNA, 201 bp, Homo sapiens
gtgtatacatacatagaagtatatatataaataccagtactagtgtctgctaataggtggcgccactttttatctgtgtgtgttgggggtggaattagcaygtagaggttggcaaaggggacaggagactgtgggatgattagtatattcttatttggcctgggagggaaaaaaaatctttcatttccaacaatattcatt

SEQ ID NO: 42994 - DNA, 201 bp, Homo sapiens
ggaggaccttgtgttcctgctggagagtgagagtccctccctccccattccactcccaagagcagtgaagagtcaggaaggtgggcttgttttgttttgtdttgttttgttttgcttgttgagcaagggaatgcggttcccctgtgtcggacttgtttcagaaagacaatgtcactgaggctggggcagggagattagctg

SEQ ID NO: 42995 - DNA, 201 bp, Homo sapiens
gctgggcgtggtggcgggcgcctgtagtcccagctacttgggaggctgaggcaggagaatggcctgatcccgggaggcggagctttcagtgagccaagatygccctactgcactccagcctgagcgtgagactctgactcaaaaaaaaaaaaaaaaaaattagctgggcgtagtggcaggtgcctgtaatcacagctatcc

SEQ ID NO: 42996 - DNA, 201 bp, Homo sapiens
tgttaaaaaaaatttaattttgtttatgcatgtgtgcataaacaaagcaatagaaaatatttgatatttaagattgagcacttaacaaaatactttgtctytttttggtttgctgtcttaagcaatagccttaaattcttgtcccagggatacctgatagagctaatatagaacaatattttaacataatttgaagtattt

SEQ ID NO: 42997 - DNA, 201 bp, Homo sapiens
cttggtaatgtagattttggaggacttgaaaggttcctgctacctttggctggggatggagggaacatggaagatgggtctttgtttagaggaagctcttyatcctggtacgctggaagttggcatagtcttagcagttagtccagatgtgaatttcaggattattctgtgagtcttccaagtcctgtctcagcagtgaaa

SEQ ID NO: 42998 - DNA, 201 bp, Homo sapiens
gttgggaagagggacacatttttaacatagacaccaaaagagaggctggaagagttgaccacttagaaatgtcacgagtgtctgtgaatagtgttgggggmtgagaggcaagagaagaaaatagtcctaatgttgtacaagtagcaatggaaacaaacttgttaaaaaaaatttaattttgtttatgcatgtgtgcataaa

SEQ ID NO: 42999 - DNA, 201 bp, Homo sapiens
agaaatggggcttctaaaataagtggaactgggacctcttctctctcaggctgttacttgttgtggttccagcctattttctgagctgtggagcagggagrgatctcacaggaaacttggtaatgtagattttggaggacttgaaaggttcctgctacctttggctggggatggagggaacatggaagatgggtctttgtt

SEQ ID NO: 43000 - DNA, 201 bp, Homo sapiens
ttgatgcaaaaaatatgataacatttcaaaatttaaatcaagacaaattcaatattatagcaaaggttcaagtaatgaacatgaatttgtaatgatgcctsggggaggtgaaggttaaaaaaaaaaaaaaggccaccaaggacctcatgttaaagttgatgatgacggaagtgagcagtgatgatgagatttaaaaaacta

SEQ ID NO: 43001 - DNA, 201 bp, Homo sapiens
agaggcatggctcccctgttatgtatttgggacttactgcagatgcttcctctggttcagggtgttgaggcttcgtgctgttaatattggaaggtgggtcrtttgtactgggcatctgtcctgtatcttggagatgtttagtaacatccctgacctctagccattagataccatctctcccagtagggataataaaaacat

SEQ ID NO: 43002 - DNA, 201 bp, Homo sapiens
gtgtggcttttctgtcttgaggatagatagaagaggagtcagataaagttgcagaacagagatgacgtctttactgagacttgaatgatgtgtcggaggcmaacatgttgacacaaacgagagaattttaggttctctttgtagctgtggctgggctgggacaaggacgatggacaaagttatgggggtgctaaaaacctc

SEQ ID NO: 43003 - DNA, 201 bp, Homo sapiens
gatgtgtggcttttctgtcttgaggatagatagaagaggagtcagataaagttgcagaacagagatgacgtctttactgagacttgaatgatgtgtcggasgcaaacatgttgacacaaacgagagaattttaggttctctttgtagctgtggctgggctgggacaaggacgatggacaaagttatgggggtgctaaaaac

SEQ ID NO: 43004 - DNA, 201 bp, Homo sapiens
gaatttcacttttgttgcccaggctgcagtgcaatggcacgatctctgctgaccccaagctccgcttcccaggatcaagcgattctcctgcctcagcctcytgagtagctgggattacaggcatgcgccaccatacctggggaatttttttttgtatttttagcaaggttgttgatcaggctggtctcgaactctcaacgt

SEQ ID NO: 43005 - DNA, 201 bp, Homo sapiens
gctgttttttttcccctaggttgtgtttttgtgtttttgtttgtttgtttgtttctttgtttgtttttgagacagaatttcacttttgttgcccaggctgsagtgcaatggcacgatctctgctgaccccaagctccgcttcccaggatcaagcgattctcctgcctcagcctcttgagtagctgggattacaggcatgcg

SEQ ID NO: 43006 - DNA, 201 bp, Homo sapiens
aaacccaatacatttatacttatgtatattcgtgtgtgtgtgtgtgtgtgtattatatgcatgtgtgtgtatttgtctgaaataaaagttttacaaaatgwtacttttatctgagcagtgtcctgctgttttttttcccctaggttgtgtttttgtgtttttgtttgtttgtttgtttctttgtttgtttttgagacagaa

SEQ ID NO: 43007 - DNA, 201 bp, Homo sapiens
cagtgctttctgaagacagaggtgggacctggtgctggagacaatccattcctttcacaaagactgtaagccttacccaagcattaattttgctgcatagrcggcctgttctcccacaaagcactgagtaagaagaaaaggggcccggataaaccagcagggcctggcagacaacttctggctcccttgccatttaaggtc

SEQ ID NO: 43008 - DNA, 201 bp, Homo sapiens
caccccttccctcttatcagcttcttgctaccatgcagaaaagtgctgaaggtggcctgccctaaggcagtagcactagagcagggatggggaggacttgstggccagatgcatgtggacatgatggaaagggaagagaagaactgtcaagattttcactatcagtggtataagccccgtagtaatatgcctagtgttcca

SEQ ID NO: 43009 - DNA, 201 bp, Homo sapiens
acttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagaca

SEQ ID NO: 43010 - DNA, 201 bp, Homo sapiens
cacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagagac

SEQ ID NO: 43011 - DNA, 201 bp, Homo sapiens
tcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagaga

SEQ ID NO: 43012 - DNA, 201 bp, Homo sapiens
atcacttaaagtcaggaggcagaggttgcagtgagacaagattgtgccactgcactccagcctggatgacagcaagactccatctcaaaaaacaaacaaacaaaaaaaacattatattaagtgaaagaaaccagatgcaaaagatgacctaacatgtgaatctgtgtatacaaagtacctagaataggcacctccaaagag

SEQ ID NO: 43013 - DNA, 201 bp, Homo sapiens
gcatagggtttggggaggattaaataagataatgtaaatagagtttagcgtggtactgtgtatatagccagcactcactgctgttggcttattgaaaaaamaaaaataatacctacaataaccacaatatagcaacagcaatcatgttcaagtctgtatttggtttaaggagggggaatgtgacccgggggctctgtcatt

SEQ ID NO: 43014 - DNA, 201 bp, Homo sapiens
ttcggccctgatttcagagatgaaagaaccaaggcatagaaattgagtcactttctggagtgtacacaactagtaagtggattcgagttagttttgctctrttccaaggctacttactatgctatttttggtttcctacttttgttcaacttatatttatctgattatctgattctcttttacaagcacttagtgagcatc

SEQ ID NO: 43015 - DNA, 201 bp, Homo sapiens
gatggatgtcttctatctctgccctgtccagtataaaagccacaagccacatctggctgtgtggcacttggcatgcaactagtatgacatcttaatttttytttttgagatggagcctcgctctgtcacctaggctagagtgcagtggtgcaatctcgactcactgcaacctacacttcctggattcaagtaattctccta

SEQ ID NO: 43016 - DNA, 201 bp, Homo sapiens
tcttccagccccacaaacgtgcacctgcagccggagaccagggggccccgatcaggtggcagggcctttaattggagccacgtgtgtataatgagcagcgcacacacacaaaggcgagctaaaaatgtctccacccttctaaatatgggatgccttggccaggtattgagtcagctctgtgacgccagtgcaattatcccg

SEQ ID NO: 43017 - DNA, 201 bp, Homo sapiens
cactatctaagttttttctgttaaaacccaatacatttatacttatgtatattcgtgtgtgtgtgtgtgtgtgtattatatgcatgtgtgtgtatttgtckgaaataaaagttttacaaaatgatacttttatctgagcagtgtcctgctgttttttttcccctaggttgtgtttttgtgtttttgtttgtttgtttgttt

SEQ ID NO: 43018 - DNA, 201 bp, Homo sapiens
ctgggtttaaggaattctctgccttagcctcccgcgtagctgggattacaggtgcatgccaccatgcccagctgatttttgtattttcagttgagataagsgtttactgtcttggccaggctggtcttgaactcctgacttcgtgatccactcgcctcggcctcccaaagtgctgggattacaggcatgagccaccgcccc

SEQ ID NO: 43019 - DNA, 201 bp, Homo sapiens
gtcttccagccccacaaacgtgcacctgcagccggagaccagggggccccgatcaggtggcagggcctttaattggagccacgtgtgtataatgagcagcgcacacacacaaaggcgagctaaaaatgtctccacccttctaaatatgggatgccttggccaggtattgagtcagctctgtgacgccagtgcaattatccc

SEQ ID NO: 43020 - DNA, 201 bp, Homo sapiens
atgttctatgttgctctaaaacagcatctctcaaacttttttggaccactatctaagttttttctgttaaaacccaatacatttatacttatgtatattcktgtgtgtgtgtgtgtgtgtattatatgcatgtgtgtgtatttgtctgaaataaaagttttacaaaatgatacttttatctgagcagtgtcctgctgtttt

SEQ ID NO: 43021 - DNA, 201 bp, Homo sapiens
caaaccctgttttgtagtatttgctgattactgtggtgtaaatactcacaccttggctgatttcaagttgcagcttggaacttggagttagaaagagatgygtagtcccataccattttatgtatgtaaagtatttgcactatgccgactaatagacataaataacctcatgagcatagataatagtcacatctactaaga

SEQ ID NO: 43022 - DNA, 201 bp, Homo sapiens
tagcaggacaaattctgatggacagatcaagatgttctatgttgctctaaaacagcatctctcaaacttttttggaccactatctaagttttttctgttamaacccaatacatttatacttatgtatattcgtgtgtgtgtgtgtgtgtgtattatatgcatgtgtgtgtatttgtctgaaataaaagttttacaaaatga

SEQ ID NO: 43023 - DNA, 201 bp, Homo sapiens
aatttccttgtgaatgctgttaccatattcctggtgtctatgtgagggggtgtgtggtggtatgccggtaagtgttgaacaacctgctctgttggcgggarctaggggaaacaaaccctgttttgtagtatttgctgattactgtggtgtaaatactcacaccttggctgatttcaagttgcagcttggaacttggagtta

SEQ ID NO: 43024 - DNA, 201 bp, Homo sapiens
gtttcccaaactttcaatgttttggatgactttggaagccttgatttctgtaggctgtagcaggacaaattctgatggacagatcaagatgttctatgttkctctaaaacagcatctctcaaacttttttggaccactatctaagttttttctgttaaaacccaatacatttatacttatgtatattcgtgtgtgtgtgtg

SEQ ID NO: 43025 - DNA, 201 bp, Homo sapiens
cagatctggatttcaccacacctggtttttgttgtcattgagtttttgtgatggggtgatttcagtgagaaatatatgccattaatttgatgaaaaatcartatttatttattaactaatacccaagaaattccccagcaagcctcttccagtattctagagtttctcgtttcttgaggattggtctccgggcatactcct

SEQ ID NO: 43026 - DNA, 201 bp, Homo sapiens
attatttctaccaagtccaacttgtagattgggcagatctggatttcaccacacctggtttttgttgtcattgagtttttgtgatggggtgatttcagtgrgaaatatatgccattaatttgatgaaaaatcagtatttatttattaactaatacccaagaaattccccagcaagcctcttccagtattctagagtttctc

SEQ ID NO: 43027 - DNA, 201 bp, Homo sapiens
aaatttgccgggtgtagtggtgcacacctgtagtcccagctatttggaaggctggggcaggagaatcgcttgaacctgggaggcagatgttgcagtgagcygagatcaggccactgcactccaacctgggtgacagagccagagtctgtctcaaaaaacgaaaaacaaaaaaaaccaaaagactaaatgtataaaaggtac

SEQ ID NO: 43028 - DNA, 201 bp, Homo sapiens
tcaattatttctaccaagtccaacttgtagattgggcagatctggatttcaccacacctggtttttgttgtcattgagtttttgtgatggggtgatttcartgagaaatatatgccattaatttgatgaaaaatcagtatttatttattaactaatacccaagaaattccccagcaagcctcttccagtattctagagttt

SEQ ID NO: 43029 - DNA, 201 bp, Homo sapiens
atgccaagttttacagctttttgtatcatgagttttcttttgcatcaattatttctaccaagtccaacttgtagattgggcagatctggatttcaccacayctggtttttgttgtcattgagtttttgtgatggggtgatttcagtgagaaatatatgccattaatttgatgaaaaatcagtatttatttattaactaata

SEQ ID NO: 43030 - DNA, 201 bp, Homo sapiens
ggctaattattatgtttttaatagagactaggttttaccatgttggccaggctggtatcgaattcctgacctccatgtgatcggcctgccttggcctcccraagtgctgggattacaggcatgaaccactgtgcctagccttaataaatacgtatttatgtctttcgatctttttctgtttttctacattccgtttcccct

SEQ ID NO: 43031 - DNA, 201 bp, Homo sapiens
gttttccgggctgtttgtgtactacacagcctgtgtacctggcaaggcacgctctgctctgccctgccttctgatgagctgactaacaccttatagatgargttcccttagaaccaaagatgccccatgaaactccctaggatgaatgttggaagtccttccaactgggattcccagccggaaaggaaacagttcatctga

SEQ ID NO: 43032 - DNA, 201 bp, Homo sapiens
aaggacctaataaatacttttttctctctctctctttttttttttttttttttgagacggagtcttattctgttgcccaggctggagtgcagtggcggatsttggctcattgcaacctctgactcccaggttcaagggactctcttgcctcagcctcccgagtagctgggactgtaggcatgcactaccacacctggctaa

SEQ ID NO: 43033 - DNA, 201 bp, Homo sapiens
ctatgctgggcacaaggaatgttatggtggataaggggaaaatggtccctaccctctgtcagttttttatggaagaagaaagacggtctttaaagaaattyacataattaatcacaaaaagctaatactatgacaaagaatgtaagttactaatacagcttagaacagatgactctaaccttgtgtaggagctagagaagg

SEQ ID NO: 43034 - DNA, 201 bp, Homo sapiens
gtggtggctcctgcctataatcctagccctttgggaggccaaggtgggaacatcatttgagcccaggagttaaagaccagcctgggcacatagtgagacascagctttacaaaagagagagagagaaagaaagagagagagattatttctagaataagcaaaccaaacgtgaattaagttttcattctcattttagtgatt

SEQ ID NO: 43035 - DNA, 201 bp, Homo sapiens
tgggtatggttgtgcactcctgtggttccagctactcaggagactgcggtagggggatcacttcagcccagaagttcaaggctgcagtgagctgtgatcgytccactgcactctagcatgcgtgacagagtgagactatctcaaaaaagaaaaaatgagattatggccaggggtggtggctcctgcctataatcctagccc

SEQ ID NO: 43036 - DNA, 201 bp, Homo sapiens
gcactttgggaggccgaggtgggtggatcacgaggtcaggagatcgagaccatcctggttaacaccgtaaaaccccgtctctactaaaaatacaaaaaaawaaaaaattagcccggcgtggtggcgggtgcctgtagtcccagctactccggaggctgagacaggagaatgtcatgaacccgggaggcggagcttgcagtg

SEQ ID NO: 43037 - DNA, 201 bp, Homo sapiens
tggctgggcatggtggctcacacctctaattccagcactttgagaggataacttgagtccgggagtttgagaccagcctgggcaacagagccagaccatcyatctctacaaaaaatttaaaaattagctgggtatggttgtgcactcctgtggttccagctactcaggagactgcggtagggggatcacttcagcccagaa

SEQ ID NO: 43038 - DNA, 201 bp, Homo sapiens
cccaggagtctgtgtttgttctttaaacctctctattcagttgcccagctcttttcattccctgtcctttccccctctggctgggtctgcctttccaaccrctaccaccttccaccaccattttttttttgtttcctctgcaagcaacatctgaaaggcccagacccagcttgttggccttgggctctgataagatctgtc

SEQ ID NO: 43039 - DNA, 201 bp, Homo sapiens
atattaattattaataaaatccaactccttaataatacaatcatagttaccatttattgagagcactcttctgaacattttgcattctttatttaatcttmcctacaaccttattaagtagacattatcttcatcttattaagtagtcagttcctcatttgcagatgaggaaactggctgactgagttaaatgaatgccaa

SEQ ID NO: 43040 - DNA, 201 bp, Homo sapiens
actaatattctctctgactataattgtaaaacagtagatgtctttcaccaagcgctaacattatattaattattaataaaatccaactccttaataatacwatcatagttaccatttattgagagcactcttctgaacattttgcattctttatttaatcttacctacaaccttattaagtagacattatcttcatcttat

SEQ ID NO: 43041 - DNA, 201 bp, Homo sapiens
cctagccaagcagaaacccatgtttttgactttcaggatatttgtgaattaatttacttgcatatattggccaagatctagcataatctcttaatattcartgaataaaaaattgagttttgagagcaaatattttggtaggaaatagagaactgacactaatattctctctgactataattgtaaaacagtagatgtctt

SEQ ID NO: 43042 - DNA, 201 bp, Homo sapiens
agtacaagttggtaatgggtaacaggctaaaccatgtggcaccccttccctcttatcagcttcttgctaccatgcagaaaagtgctgaaggtggcctgccytaaggcagtagcactagagcagggatggggaggacttggtggccagatgcatgtggacatgatggaaagggaagagaagaactgtcaagattttcactat

SEQ ID NO: 43043 - DNA, 201 bp, Homo sapiens
gtggccctgaagagggtgggaatgtctcatccccctgtgggcttagaagaaaaccagaggtctgtgcacactatggatttttactacaatgatgccctttyacatacagcgagaaggattaagaggtactgtattgttggttgataaagtcaaacttgtgaacagagcaaaagggcattgcttggtcattgcagcttccac

SEQ ID NO: 43044 - DNA, 201 bp, Homo sapiens
tacttcttggagaaacctcccaaatttctatcgacactagacatctcaggatttgaaatgttaagctaacaaattgttcatcaggtgtatctccagccctycgtaaacactgccggatggatgaacctacgtaatgatctcctggtgccattttcctgactgtagatacttgggtaaggaggagactttgactctagatga

SEQ ID NO: 43045 - DNA, 201 bp, Homo sapiens
aaaggttctggttatgaactcacagaggaagtgacggctgaactttgtaaggacacaagtggtttaacaagtttcctggcccatatgagatctcggctccracgttacaggcagcagtgtggggcctcaccttaccttttcccacttccatccttctccacccccgttcagttcccaggctccccttgtgtgaactggctc

SEQ ID NO: 43046 - DNA, 201 bp, Homo sapiens
tcttccctgaggttgctaattgtgggcagtacagtgtagagtcactttgatttttctcatctccttcctggaatgtgccacagaagaaaacccacgaagtsttgagctaaacgaagcagagatgggagaagggacaaggtgggaggcggtagtggtgctgcatgggataaaaatggaaacacacacttttgccctctgtac

SEQ ID NO: 43047 - DNA, 201 bp, Homo sapiens
ctgtgcagcaattttaactttctatattcaaatatactctgaatgcacagtgaatttggcagaataccatttaagtcttgtattttccaaagctagtcaaygtccaactgccaatgttgcctgaacaggaaatatttatacctgaaagcgtccaggtgagagtcaggaaagccatgaaggtgcaactggcatactgatgtc

SEQ ID NO: 43048 - DNA, 201 bp, Homo sapiens
aaacttgatatggaaggtcttcacagattaaaacgaaggaaaaaaaaaaaaaaactagataaatctccctggacatgaacttttgtagaagtagttacaaygctagtgacctcatatactcatggtaacggcttccggcatccaatgaccttgccattgcggaggtcaatttcatgtgtgtgtgcacacatgggtgcgtat

SEQ ID NO: 43049 - DNA, 201 bp, Homo sapiens
ggacttacagttctgcacggctggggaggcctcagaatcatggcaggaggtgaaaggcacttcttacacggcagcggcaagagaaaatgaggaagaagcgmacgtgagaacccctggtaaacccatcagatcttgtgacacttattcactatcacgaggatagcgcaggaaagaccggcccacatgattgagttacctcgc

SEQ ID NO: 43050 - DNA, 201 bp, Homo sapiens
atttatgtagatacaaaaatagagtttgatattaaacaatactccaagacagccatttctgcagagttaaaaaatacgtaggttcagttccttaccaacaygtagacatgttgtgatgaaagaaggaaaggaaggaaggaaggaggaagggaagaaggagggagggagggaaagagagagagagaaaaggaagagaaagga

SEQ ID NO: 43051 - DNA, 201 bp, Homo sapiens
agggccctttgtcatttatgtagcaccagccctgaaatcggagactcataaaacctacaaatacacacacaaacacaaaccaggcaaacccacacaccacrgagaagaggcaaagtgtgcataaagataccctgttgttattcacccagtacaactctctaattcatgtataaacagtaagtgtaaaatgttccacaccct

SEQ ID NO: 43052 - DNA, 201 bp, Homo sapiens
tttaggtggaggatctggtcaaggctttgtgaatcaggggatgctccacacctttctgctctctgcaacagggccagggatctgagtcccttcttgtctayccagaaaccgtatacccagtgttctctttctctcacctccgaataggtgggccttcccaatttacctgtgagaaaactagtgtgccacctcaagcgattc

SEQ ID NO: 43053 - DNA, 201 bp, Homo sapiens
aagatggatcttgccttgtggatgtttttctaccgtgacagaagatagaaaggatgaaatagaaagagtgtgagtgaattctgcacccaccccccccccccagcttccccacctgtaaaatgatttgctcaaagtttgcaaagaatggaggcatattcaaagtgctcagcactgggccggacccatgggtatgaattcata

SEQ ID NO: 43054 - DNA, 201 bp, Homo sapiens
agagacttcaggtggatctggaggtccttccccaaccttctgcaaaccatgtcttcccagagagcttctaagccaaagcaaaggtgttgctctctgcctcytgttgctctgtaattcatctcagcaaccatctttcccatctctgggaagagaatgttgtcccccagaaaaagtccttatggatagatttagttattgctt

SEQ ID NO: 43055 - DNA, 201 bp, Homo sapiens
gctccctggaagatggatcttgccttgtggatgtttttctaccgtgacagaagatagaaaggatgaaatagaaagagtgtgagtgaattctgcacccaccmcccccccccagcttccccacctgtaaaatgatttgctcaaagtttgcaaagaatggaggcatattcaaagtgctcagcactgggccggacccatgggtat

SEQ ID NO: 43056 - DNA, 201 bp, Homo sapiens
atcaggccttgggagatgcaaacagtttgcccttggaccatgtcttctgctttcatccttatgctctcaacagatcatgccaaggtcctgtgttcaccgcsttcctgagtccccattcagaggctcaagaattgagacaaaagggcatcctgcaaatttgctgccctggaagctgtgctgggggagccagtagagacttca

SEQ ID NO: 43057 - DNA, 201 bp, Homo sapiens
ccaatccttgcactgaagcttttagcaggaaaggtgaacagaggcatctggatgcatcgcggccagtctgccccttgcccaattccctcccctctcctgcstacaggtcatccctgagaagtgtgcctgtggactgcgttctttggggtaggacatggaatgggaagatgaaaagaaagccttcctttttctgtcctcagc

SEQ ID NO: 43058 - DNA, 201 bp, Homo sapiens
tggagtgcagtggcgtgatcttggctcactgtagctgctgtctcccggattcaagcgattcccctgcctcagcttcccgagtagctgggattacacccacsaccatgcccggctagtttttgtatttttagtagagatggggtttcaccatgttggccaggctggtctcaaactcgtgacctcaagcaatccacccgcctt

SEQ ID NO: 43059 - DNA, 201 bp, Homo sapiens
aaatactcccttctggacactggaagggcaaatgaggtgcaagccttttttttttctttcttttcttcttcttcttcttctttttttttttttttttttgkttttcctcccagcctctctcctttcccattatgcacaatgcgctgagaaaggattcccagtccccctggtaaaaagtctgaaggatgccgaggagttcac

SEQ ID NO: 43060 - DNA, 201 bp, Homo sapiens
agaaatactcccttctggacactggaagggcaaatgaggtgcaagccttttttttttctttcttttcttcttcttcttcttctttttttttttttttttttgtttttcctcccagcctctctcctttcccattatgcacaatgcgctgagaaaggattcccagtccccctggtaaaaagtctgaaggatgccgaggagttc

SEQ ID NO: 43061 - DNA, 201 bp, Homo sapiens
attctcgccttctagcctgggcttgtcagcttggggtgtatgccgcacctcctctttgaagaggatcttcatttggaggggtgatctgactcccaaccctmcccaggtgaaagcaccgggattcatacctagggggctttgggatttggggctgactttgacccgtcattatttctgactgcaaaattcctgacaaatgtc

SEQ ID NO: 43062 - DNA, 201 bp, Homo sapiens
atggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccgggg

SEQ ID NO: 43063 - DNA, 201 bp, Homo sapiens
aatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccggg

SEQ ID NO: 43064 - DNA, 201 bp, Homo sapiens
taatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccgg

SEQ ID NO: 43065 - DNA, 201 bp, Homo sapiens
cagttcatcaaggacctaataaatacttttttctctctctctctttttttttttttttttttgagacggagtcttattctgttgcccaggctggagtgcartggcggatcttggctcattgcaacctctgactcccaggttcaagggactctcttgcctcagcctcccgagtagctgggactgtaggcatgcactaccaca

SEQ ID NO: 43066 - DNA, 201 bp, Homo sapiens
atcaaggctgggaggaggtctttccactggttttccgggctgtttgtgtactacacagcctgtgtacctggcaaggcacgctctgctctgccctgccttcygatgagctgactaacaccttatagatgaggttcccttagaaccaaagatgccccatgaaactccctaggatgaatgttggaagtccttccaactgggatt

SEQ ID NO: 43067 - DNA, 201 bp, Homo sapiens
gtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctcatgtctgtaattctagcactttgggaggccg

SEQ ID NO: 43068 - DNA, 201 bp, Homo sapiens
tatgcatgtgtgtgtacatgtaatcacagttcatcaaggacctaataaatacttttttctctctctctctttttttttttttttttttgagacggagtctyattctgttgcccaggctggagtgcagtggcggatcttggctcattgcaacctctgactcccaggttcaagggactctcttgcctcagcctcccgagtagc

SEQ ID NO: 43069 - DNA, 201 bp, Homo sapiens
ttgtctccatttctgtcccagttacatcaaggctgggaggaggtctttccactggttttccgggctgtttgtgtactacacagcctgtgtacctggcaagrcacgctctgctctgccctgccttctgatgagctgactaacaccttatagatgaggttcccttagaaccaaagatgccccatgaaactccctaggatgaat

SEQ ID NO: 43070 - DNA, 201 bp, Homo sapiens
agatttagattttttcaatttttttttactgtcatatgattcacatgctagttactgattgctatcatgcagtctgccagcagaccagatggcagatcttytaattagatatgtttgtgtgtgtatgcatgtgtgtgtacatgtaatcacagttcatcaaggacctaataaatacttttttctctctctctcttttttttt

SEQ ID NO: 43071 - DNA, 201 bp, Homo sapiens
gacatatttcttggattgtccgcactcataaaaagagattgcgtaacaccctttgaacaaatggatatttgagaaccatcctgtcttcagatttagatttkttcaatttttttttactgtcatatgattcacatgctagttactgattgctatcatgcagtctgccagcagaccagatggcagatcttttaattagatatg

SEQ ID NO: 43072 - DNA, 201 bp, Homo sapiens
gtgagtgcaataagtctgttttttgatcttagaacataacatttcttgttggctattgtgtgtgctatgtgtatgatttgtctctttgttaattctctatmaatataaaagagcaagtaatgaaattaccatggctgaattctgaatattaacccagagcagatttcctctaagaaagatcataagaagatgcttaaaaga

SEQ ID NO: 43073 - DNA, 201 bp, Homo sapiens
taaagccaaccatgttaaaaatgtataataaagtatctaatttagcaaaattcaaatttcccctatgaaatatcaagctctttttatgcttcttcacatgscaccttgtgtagaatttgaaccactttaaacattgcatccttgagttgcatatgatgggatctcttgaatcatttacattttgaaaaaagaaagtgaaat

SEQ ID NO: 43074 - DNA, 201 bp, Homo sapiens
ttcgcattacagattttaaatcctagctcctttttaagcttttaattccaacttgcatttcttattattctgtttacaaacctgacaaattttagcagtcrttttgaggagatctagaataatgtttcatctcatttttgaatttaggtacagaccttaaaaatattatgctacatttctaatattaatatcttgctttct

SEQ ID NO: 43075 - DNA, 201 bp, Homo sapiens
ctctcattacttgcccccaatccatgcaatgaaatactggcctgtgagtatgtggtcccttcagctcattttctgaagctgaccaaaggagcacagtaatkcataacgggggagtaaaattcctcaagacgagcaaaaaaggcagaaattaataaaactctatgtattagttatctatcactgcataacaagttacctcaa

SEQ ID NO: 43076 - DNA, 201 bp, Homo sapiens
atggcttaccttactttttagacataatttttgttttctgttaaagggtcagttatagataagtatgctcccttgcaatgaaatgaacccactttatcaaytttgaaggaatcaaaattaacttgaatacattgtctttttgcatatgtatgtagtgctttgtataaacatatgaatttgtaggagctgctcttaatgatt

SEQ ID NO: 43077 - DNA, 201 bp, Homo sapiens
tcttctttatattataagtttatgccactgcaacattttagaatcacctgggaagcttttgaaaactcccagcatcatgaagcatggtctcttgccttggrgtcagtgtctgtcaacgtggcttttgctaaagagccttcccctatgagaagtgaggcaggagaaggcggagtgaccacaagatgccctgatggtgccaag

SEQ ID NO: 43078 - DNA, 201 bp, Homo sapiens
ttatactgtgggctgcatcgcttaccaatatttcatctgtttcacttagctgctgttacttactcaataatgtgtggccaatctcacaagatactaattcwttttttcaaatgcagcatcgcttgaagctgtgataaaatatcacacctttggaaatcaaggctcttcttgtttatttatttaactcacattaattagcct

SEQ ID NO: 43079 - DNA, 201 bp, Homo sapiens
tgaacatcgagtatagtaccaagtgtatacttttttttttttttttttttttttgaggtggaatctccttctgtctcccaggctggaatgcagtggcattwtctcggctcactgcagcctccgcctcccaagttcaagccattctccagtctcagcctcctcagtggctgggattacaggcatgtgctactacccccggca

SEQ ID NO: 43080 - DNA, 201 bp, Homo sapiens
tctagtggatattttgttaaaaaaaaaaaatggggtctcattctgttgccccggctgcagtgcagtgacatgatcataactcatggtgacctcaaattcaygagcccaagcgatcttcccacctcagcctgagtagatgggactacaggcatgtgtcaccatgccaggctaatgtttaaaaatttttcttagaggtagagc

SEQ ID NO: 43081 - DNA, 201 bp, Homo sapiens
ctgagtttctgtggatttctataggctcctgcaaattttatctagtggatattttgttaaaaaaaaaaaatggggtctcattctgttgccccggctgcagwgcagtgacatgatcataactcatggtgacctcaaattcatgagcccaagcgatcttcccacctcagcctgagtagatgggactacaggcatgtgtcacca

SEQ ID NO: 43082 - DNA, 201 bp, Homo sapiens
aattttgtgttgcgtaatatttcaggaacttgcaaccctgataacttgtgcctgcctgtctgtaggcctttaatgatgttttattgaattttggttttccmctagactttgcagtgcatgacacatagtaattgctcaataaatatgtgttcaactgaactatggtggttaggttagtaattagatgcacagacaaaatca

SEQ ID NO: 43083 - DNA, 201 bp, Homo sapiens
cgagcatgctctgaactcctgaactgctcattctgttctctgagagaattgctcaagctgcagtttatcattatatgcctccaaagactttgtgtttcctrtgtttgacatcgagatagaatttttcataaccctttactagtaataaatttgattgttaagggaccgggttaatcttatttctaataccagcatctgatt

SEQ ID NO: 43084 - DNA, 201 bp, Homo sapiens
gaatgactccatggatgacctttccgtgcctttgtctgtagcctgccctcctctttaactgaacaccttccagacgagcatgctctgaactcctgaactgstcattctgttctctgagagaattgctcaagctgcagtttatcattatatgcctccaaagactttgtgtttcctgtgtttgacatcgagatagaatttttc

SEQ ID NO: 43085 - DNA, 201 bp, Homo sapiens
tcacgtttgtttaatattttaatttccccatgagtcttaaacctctgcgtggtgtgcaagttgaggcctggtgtatgcacttcggccacgggctttcccaytgtaatgaagatggaatgactccatggatgacctttccgtgcctttgtctgtagcctgccctcctctttaactgaacaccttccagacgagcatgctctg

SEQ ID NO: 43086 - DNA, 201 bp, Homo sapiens
catgcaccaccattcctggctaatttcttttgtatttttaatagagatgaggtcttgctatgttgcccatgctggtcttgaactcgtgggctcaagcagtmcacttgcctcagcctcccaaagtactgggattacaggtgtgagccaccacatctggcgaaactctgggtagtttctaattatttctgtatttctatttgt

SEQ ID NO: 43087 - DNA, 201 bp, Homo sapiens
ggttggagaatgttcatatcacattattttggatgtctggggttgcacctggaagctcagatagcaatatctaggcacggctgccagtgctctatacattsacgtttgtttaatattttaatttccccatgagtcttaaacctctgcgtggtgtgcaagttgaggcctggtgtatgcacttcggccacgggctttcccact

SEQ ID NO: 43088 - DNA, 201 bp, Homo sapiens
aagcggggcaaggggttggagaatgttcatatcacattattttggatgtctggggttgcacctggaagctcagatagcaatatctaggcacggctgccagygctctatacattcacgtttgtttaatattttaatttccccatgagtcttaaacctctgcgtggtgtgcaagttgaggcctggtgtatgcacttcggccac

SEQ ID NO: 43089 - DNA, 201 bp, Homo sapiens
gaaggggacatgctatgtcagagtggagggacatggggaggcaccaggactggtcaagaggcagagggagagggtcaaaccgtgggttctgtggggaggamtgaacgaggcagggtaagtagactagggtttgagtaagttcagcaggctctggggaagaggggctgtccctatttttctggtacctggccctgggtgatt

SEQ ID NO: 43090 - DNA, 201 bp, Homo sapiens
ctcacttagtcatttcactattaaaagagaaaaatagttagtttacaatttccaggaaatcagacaggtcaccaccacctcttcaacgactggaatttgcrcagtctcactactcataggcccatctgttactactaacagtgctaatgtgattgtctgtaggtctagcaattggaggttgttcgtttctttgagacaagg

SEQ ID NO: 43091 - DNA, 201 bp, Homo sapiens
gccagagtttttttttcccttgtcttataccagtggtgcctagcatggtgtcaggtttatagaggactaatacatataagaaggagaaagggagggaggargaattccagttgttttttttttaatctaggtacaagtctctctgttgatttctaaacatcgaatgaagatgaaggaaatacttaaagcacctaagcactc

SEQ ID NO: 43092 - DNA, 201 bp, Homo sapiens
agaatcttgagttgatacctccttgggtggcatggagcctatacctttgtagatcttgggaaacaacttctaaagtaatcatagttgtatgtaatcgtagktacaacaatagttattttaggcacataacccaaaggttttcttacaaggaatctatgaaccttaagagtgagggcttctgttaagagtaagggcttccct

SEQ ID NO: 43093 - DNA, 201 bp, Homo sapiens
ctcttttctgaagtgatggggatattcgatggcaattttgtgttttcttcacttggaaaaactaaaaagtttgcaacatttaaaaaaaatacaacccttaygctgatggatgtacactgtaaaacaaccacgtttggtaaactgttaatcactttcatagtgtatgtggatggagccagttaaaccagttttcatgtcttt

SEQ ID NO: 43094 - DNA, 201 bp, Homo sapiens
ctctcaaagatagacatggacatataaataattttttaaaatcctcttttgcaaaaaaaaaaaaaaaaagaggtgaatttagttgaaaggatatagccacwcttttctgaagtgatggggatattcgatggcaattttgtgttttcttcacttggaaaaactaaaaagtttgcaacatttaaaaaaaatacaacccttatg

SEQ ID NO: 43095 - DNA, 201 bp, Homo sapiens
tattaagagaatggatattttcatgtcagaaattataggaaggatacagttatgggatgaggagcaattcttttttttttttttttgaggtggagtctcaytctgtcaccaggctagagtgcagtggggcgatctcggctcactgcaaacctctgcctcccgggttcaagcaattctcctgcctcagactcccgagtagct

SEQ ID NO: 43096 - DNA, 201 bp, Homo sapiens
cccccttcacatacttatactgtgggctgcatcgcttaccaatatttcatctgtttcacttagctgctgttacttactcaataatgtgtggccaatctcamaagatactaattctttttttcaaatgcagcatcgcttgaagctgtgataaaatatcacacctttggaaatcaaggctcttcttgtttatttatttaactc

SEQ ID NO: 43097 - DNA, 201 bp, Homo sapiens
accatcatttattaagagaatggatattttcatgtcagaaattataggaaggatacagttatgggatgaggagcaattcttttttttttttttttgaggtsgagtctcactctgtcaccaggctagagtgcagtggggcgatctcggctcactgcaaacctctgcctcccgggttcaagcaattctcctgcctcagactcc

SEQ ID NO: 43098 - DNA, 201 bp, Homo sapiens
agaacagtttaacttgaaaggaaataaaaaaaggagactaacatgggcccacagacattgtatttcataaattttggatgaaaactgaacctaccatcatktattaagagaatggatattttcatgtcagaaattataggaaggatacagttatgggatgaggagcaattcttttttttttttttttgaggtggagtctca

SEQ ID NO: 43099 - DNA, 201 bp, Homo sapiens
gcacctcatcaatgtattttttctgccttgctttatagtgttttaaatccgcctcggcctttgttcctgaatgagcacccgagaaggggagaaagtgactmtctggccttagtatgtgtaacaaattatttaatgaacatttaaccaagatttgcaattcccctagttttatcttcccggtttccttttcttctgtgtgcc

SEQ ID NO: 43100 - DNA, 201 bp, Homo sapiens
gcaccactgcactccagcctgcgtgacagagcgagactccatctcaaaaaaaaaaaaaaaaaaaaaaggctgtgtgtggtgactcgtgtctattgtcccasctacttgggaggctgagacatgaaaatcacatgaacctgggaggtggaggttgcagtgagctgacatcgcatcactgcactccagcctgggtgacagagt

SEQ ID NO: 43101 - DNA, 201 bp, Homo sapiens
taatcccagcactttgggaggccgagccgggcgaatcacgaggtcaggagattgagaccatcctagctaacatggtgaaaccctgtctctaccaaaaatamaaaaaaattagccaggcgtggtggtggggcgcggtcgtgggtgcctgtagtcccagctactcaggaggctaaggcaggagaatggcgtgaacccgggagg

SEQ ID NO: 43102 - DNA, 201 bp, Homo sapiens
tcctgggaactgccctctactctctgcttctgtgagtttgactgctttaaattccacacaaaaagtgagatcatagagtatttgtctttctgcgcctggcwtattttacgataaattgattgcttctcttcccattgtttatagatacccattctcgtaatgatggcactgtgtctgtcatagaaggcctaattctccctg

SEQ ID NO: 43103 - DNA, 201 bp, Homo sapiens
aaggggtccctagacatgaagggcctcttcaacctaccttttgttggcttcaaggttatgccatattttgcaaagtcaagttggagatggctctcgatatkcatgagtgtgttagactgcttttcttctattttttaaaaatgcacccaaatgtaaaagacacttttacctttttgatttgatgttgaaggtcatttgaaa

SEQ ID NO: 43104 - DNA, 201 bp, Homo sapiens
tagatctccagaatgtattcattctgtctaactgaaacttaggatcctttgaccactatctccccatttatcaccccctcccacttccccactaccagccyctcctgggaactgccctctactctctgcttctgtgagtttgactgctttaaattccacacaaaaagtgagatcatagagtatttgtctttctgcgcctgg

SEQ ID NO: 43105 - DNA, 201 bp, Homo sapiens
gacaggcgtgagctgccttgcctagccaaataactccattatttaagaaaaattaaccagtatttattgaatacttactgggccctgtgctaagtgctttscatgtgatttctaatttcctgaccattctatgaagtggctactataattatcctgatttcccaggcagagaaactgaggcttagagagttgaagtaatca

SEQ ID NO: 43106 - DNA, 201 bp, Homo sapiens
caagctaattaacacatcggtcaacttacatagctatcattttttgtgtgtggcaagaacattgaaagtctagtctcagcaattttcaagtatataatacrttattattattactatcgttaactgtattcaccatgctgtacaatagatctccagaatgtattcattctgtctaactgaaacttaggatcctttgaccac

SEQ ID NO: 43107 - DNA, 201 bp, Homo sapiens
cccctaacaacctctacctggcaatcttcatttaactccaaactcaggacctcaatcctctgtttggcctgtgttccacgggacaggcatggggcacagakgtctgttatatataagggacaaatctctgggttggtcactcctggattccccagcccggaccacacattcaggtgcatctcccacacaggatcattctaa

SEQ ID NO: 43108 - DNA, 201 bp, Homo sapiens
aggaaaaaaaaaattatatgtattcgtggtgtgaaatgtgatgttttgatattcatatgcattgtgaaatgactaccacaatcaagctaattaacacatcsgtcaacttacatagctatcattttttgtgtgtggcaagaacattgaaagtctagtctcagcaattttcaagtatataatacgttattattattactatcg

SEQ ID NO: 43109 - DNA, 201 bp, Homo sapiens
tccaaggatgtacctgtgaataaggcaagttcctttttatcattgtctttgcagtctattaggggctacacaatttaaacagagaatatatataaaatggkagaaagtacaagtaagtataccttatttttttaaaaaaaatgaatgtggtatttcacccacagcctcaagaatcactttccttaaaattgccagagtagg

SEQ ID NO: 43110 - DNA, 201 bp, Homo sapiens
tgattgccagtccattctctagccttctgaagaagatagattgtaatctttaattaagctatcactcacaccaaaaaaaaaaaaaaaaaaaaaaaaaaagyggggcaaggggttggagaatgttcatatcacattattttggatgtctggggttgcacctggaagctcagatagcaatatctaggcacggctgccagtgct

SEQ ID NO: 43111 - DNA, 201 bp, Homo sapiens
ttttttttattattttttgagacagagtcttgctcttttggccaggctagagtgcagtggcgcgatcttggctcactgcaacctctgtcgattctccttcmtcggcctccgtagtagtcaggactacaggcatgcaccaccatagctggctaatttttgtatttttagttagacaccaggtttcaccatgttagccatgct

SEQ ID NO: 43112 - DNA, 201 bp, Homo sapiens
taatcattcagtaagtcttgactgcctgctatggaggttaagccctttactaagttccaaggatgtacctgtgaataaggcaagttcctttttatcattgkctttgcagtctattaggggctacacaatttaaacagagaatatatataaaatggtagaaagtacaagtaagtataccttatttttttaaaaaaaatgaat

SEQ ID NO: 43113 - DNA, 201 bp, Homo sapiens
accacccttacatatcccagtgtatatggtagccaaggacagtactgtttgagcctcccccattaagtgtcaacattgaatcaatgcaatcccatgcaaasaaagctgagcatgggattgtgccggtttagccagctaaagtgtggtctctgatgctgatcatgactatgaaaagggaaaatggaggagaatgatgacgaa

SEQ ID NO: 43114 - DNA, 201 bp, Homo sapiens
tcacaccaatgatatatattttccacacatttagattctccatgccactccttatctctttagtgcagaaaacggagaggaggttcagtattcttaagaamctcccatgattgctttgaggcaatggatttaacaggtatctttatcccttatttacgcactgactgtggtactgagtcatccctggtgtttctggatttt

SEQ ID NO: 43115 - DNA, 201 bp, Homo sapiens
ggagaattgtttgaagctgggaggcggaggttgcagtgagctgagatcgtgccactgccctccagtctgggtgacagagtgaaacccatcccccaaaaaartaaataaataaaaattaaaaaacctaacactggtacgagaagaaattatgctctaaatccttctttgagcagtggcttacagacctaaatttatcaaagg

SEQ ID NO: 43116 - DNA, 201 bp, Homo sapiens
ccctcctaaccatgattatgtaaacaatagctgctaggcaacttgttgtttgttttatgcaaggcagtgtgctaagcacttacatacatgtattctgtctktagtttgttataagagtcctgcacacttaaccatgattatccctactttgcaaattacaaggttgcagtgcagagagcctaagacactttctcaacttga

SEQ ID NO: 43117 - DNA, 201 bp, Homo sapiens
agcaggggaggcatgatctggaagataaagcagctaggagtatagactagggggctgatggaggggaacacctatcacaatatgtgttctcacaccaatgrtatatattttccacacatttagattctccatgccactccttatctctttagtgcagaaaacggagaggaggttcagtattcttaagaaactcccatgatt

SEQ ID NO: 43118 - DNA, 201 bp, Homo sapiens
aacagcacacgtcaaggaagcagttttggtctctcagattatatgaagctctccaatatgttctttcagaacagccagtgcctagaatactgcctgactcstagtagcactccttatgtgttgaatgagtaaatgaagagtccctggaatttcttcttcataacattgaacacaactgcagtttgaaaacataatttctgt

SEQ ID NO: 43119 - DNA, 201 bp, Homo sapiens
tgttcgtctcagcctcccaaagtgctgggatgacaggcatgagccaccgcacgcagcgtattgctttatattttaagactatacactgatatccccgagcmcccaagttcctgtccgctggtagaattcacaaagctggttttatgtctccttctcttcctcttccagtgttgtcttttccctgcattgagatagcattgc

SEQ ID NO: 43120 - DNA, 201 bp, Homo sapiens
agcatttgactgttgcatcctttgattgggccatgttcatgcagccagcctgggaaagcaattagtagttttaagcatgggaaatcatataaaagtaaacyaaaattgcatttgaattaattgatgaacatgtttgcttgaccatatcctgctgttaggcgtcttcaagttaacttaagtggttgataaaactttccaaaa

SEQ ID NO: 43121 - DNA, 201 bp, Homo sapiens
attttattttttttgagacagagtctctgtctccaggctggagtgcagtggcacaatctcagctcactgcaacctccacctcccgggttcaagcgattccmctgccctgatcagcttcctgagtagctgggactacaggtgcgcgctatcatgcctggctaattttttgtattttagtagagactgggttccaccatggtg

SEQ ID NO: 43122 - DNA, 201 bp, Homo sapiens
tttagacatttagattttttctgttttatctctctctctctatatgtatatctatatatatatttatctatatctatatagagatatatatatatatatawaataatgaatgaaatggactgtttgcaacctcagatgtatttctaggacttagagtgattagcttgaggcgatggtagtttctgtttttggagtctctgt

SEQ ID NO: 43123 - DNA, 201 bp, Homo sapiens
ttttttattttattttattttttttgagacagagtctctgtctccaggctggagtgcagtggcacaatctcagctcactgcaacctccacctcccgggttyaagcgattccactgccctgatcagcttcctgagtagctgggactacaggtgcgcgctatcatgcctggctaattttttgtattttagtagagactgggtt

SEQ ID NO: 43124 - DNA, 201 bp, Homo sapiens
cctctcaaagatagacatggacatataaataattttttaaaatcctcttttgcaaaaaaaaaaaaaaaaagaggtgaatttagttgaaaggatatagccaytcttttctgaagtgatggggatattcgatggcaattttgtgttttcttcacttggaaaaactaaaaagtttgcaacatttaaaaaaaatacaacccttat

SEQ ID NO: 43125 - DNA, 201 bp, Homo sapiens
aatgtcagagccctaaatggtatgaaaaataggcaacttgggtcatgccactacagatcgacacccactaaatccttttaatttagtctagtgcaacaagkatttgtgtaagtgtcctctgccctggacaccggtgaggtcaccgtgggaatggctgggcaggaacaaagccttttgtttccagctgagtttccttttctg

SEQ ID NO: 43126 - DNA, 201 bp, Homo sapiens
taccaagtcatttggtttacatcgggaatgccttttgtcgttatgtctagacccctggagaacagcccacggcaatgcacttgtggaaattcggactgtgrattacactgagtaacaatcctaataatacctgcacacaatcagttgcctgtccaaaaagcaataaagaacctctagattttgtggtcaccatattaatca

SEQ ID NO: 43127 - DNA, 201 bp, Homo sapiens
cactggtgtgtggggtcataccaagtcatttggtttacatcgggaatgccttttgtcgttatgtctagacccctggagaacagcccacggcaatgcacttstggaaattcggactgtggattacactgagtaacaatcctaataatacctgcacacaatcagttgcctgtccaaaaagcaataaagaacctctagattttg

SEQ ID NO: 43128 - DNA, 201 bp, Homo sapiens
gacggtggaaagagaggactgctcctagcgtgagagtgtcagggaagcttgctgggggaaatacaaggaaggaagagaatgcaggcagctcaaaagagccsggcaaggagacctgcagagcgagcggaggcctggtttctgtgaagcacagggcaggaaaatccaaactcacttgagtacacgctcagggtcatgggcttg

SEQ ID NO: 43129 - DNA, 201 bp, Homo sapiens
agggaagagcagggatagaagtgggctccgggtctaggagacggtggaaagagaggactgctcctagcgtgagagtgtcagggaagcttgctgggggaaayacaaggaaggaagagaatgcaggcagctcaaaagagccgggcaaggagacctgcagagcgagcggaggcctggtttctgtgaagcacagggcaggaaaat

SEQ ID NO: 43130 - DNA, 201 bp, Homo sapiens
ccctgaggagcgggattcgctgacccatgctggcagaacgggtgatggatgaggcagagaagggtacaggctggctggaccatgcgatggggaatgcaggyggaacaggcttcctcctgaatcaggagtggaagaggagtctggggtgaagccaaggggaagacagttaagctttaaaaaaccaactgcccagccgggcgc

SEQ ID NO: 43131 - DNA, 201 bp, Homo sapiens
atttgatcctggagttgctgtaatggcaagaaaaaccatggcctccagccccagtgttgaagttttgacgctaatgtgatgataattctcttttctttgastggggacttgcctttgtttatctttttttgttgttttagccatgaaatatcacatgtaaatagccgaggatatctgggctctgagtctttaaaaggcaac

SEQ ID NO: 43132 - DNA, 201 bp, Homo sapiens
aacgcagaatgcagaggccatgcctgcagatcaggggtgctagaggataggcaagaagtaaagtggccaccctatctcgtgttgagagcatgctagtctcygaacggcctgccagggtgcctgacagccagagccacctaatgggcctatttgatcctggagttgctgtaatggcaagaaaaaccatggcctccagcccca

SEQ ID NO: 43133 - DNA, 201 bp, Homo sapiens
agagggagaggacagtaaccaataccgctccttctacatgatcagtgttcaggttgaagacaaacagggctccaattatgttgtgatttagaaggcgacaragctgagacctcaccctctgcttatgggctgcatgcctttctcagtgaaataacgcagaatgcagaggccatgcctgcagatcaggggtgctagaggata

SEQ ID NO: 43134 - DNA, 201 bp, Homo sapiens
aaagcttttggattctgtgtggaagagttgacagagatttgcaggtgaaaaagaaaagaaaaaaaatacagatacgtgtatatatagagaaagacaaaaayttgtctgctagaaacctagggagagagatggtattgcccctgggacattggactttctgtttccagcatggtctgtcgtcttccataatggcatttaatt

SEQ ID NO: 43135 - DNA, 201 bp, Homo sapiens
ctagatgcttaagaaatgttaactactattgttattggcttgcagtagaaattaaagattatgaatgttcagcattcagaatatactagatactcaataascattattgctgtcattattaacattattttccccagctttactgaggtatgagtgacaaaaatttcatatatgcgcatgagtgtgtgtgtgtgtgtgtgt

SEQ ID NO: 43136 - DNA, 201 bp, Homo sapiens
aaaggatgattcctgctcacaccagccagctggagacattagagcattacttctcggtggcaagggagggactcttgttctttctggtggttcgttttcaycttcaggtcatgccctgtgtcacctgactcaggcaccattagcatctggggctgtacacgtctttgtactgcacactgtagggtatccaggattcctggc

SEQ ID NO: 43137 - DNA, 201 bp, Homo sapiens
tacgtaaaagataaggcaaggagacctgctgagagtcacacagcaagcccccaaggtcccccaggctcatggtcaaatgacatgtaagggacgtatccagyggtgtgggtatgtttggagggaatgaatgtaaggagagagaggtgaggcacaggagagacaggatgagctttagaggtagacagctctcgggtccagccc

SEQ ID NO: 43138 - DNA, 201 bp, Homo sapiens
ttattttgatgttgttagctttcaaagattaattccacagagatttttgggcatctttttgataatacacattatgcttgacttgggagtttcaggatgcrcaagagactccttttgactgcaaggactcagtaaaacaaagtatttcaaggtcatgctacaaaaagtcccaccaagagcatggtcaggaggtacagtgca

SEQ ID NO: 43139 - DNA, 201 bp, Homo sapiens
tccctctgaggtaggcaagggattatagtttagaatgtgtaaatacgtaaaagataaggcaaggagacctgctgagagtcacacagcaagcccccaaggtyccccaggctcatggtcaaatgacatgtaagggacgtatccagcggtgtgggtatgtttggagggaatgaatgtaaggagagagaggtgaggcacaggaga

SEQ ID NO: 43140 - DNA, 201 bp, Homo sapiens
gactaattactaaatttttaaaaatttttttagacactgagtctcaccgtcttgccctggctggtctcaaactcctgggctcatacaattcccctgcctcmgaatcccaaagtgctgggattataggcatgaggcaatgtgcccggcccacaatggttttcatatagctattgtgtattgcgttattgccttagtcacaga

SEQ ID NO: 43141 - DNA, 201 bp, Homo sapiens
gcacccagcctgtagtttcttatttaatgtctgtccccccttctcttgacagtggtgtttttgccttcacactactgtatccctggtccataccgtaaatkttctgtaaatgtttgtaaatgaatacatgaaagatgaccaggtgctgaatcagtgagagtccttaatgtacttcttatcatttatccctctgaggtaggc

SEQ ID NO: 43142 - DNA, 201 bp, Homo sapiens
agccactgcacccagcctgtagtttcttatttaatgtctgtccccccttctcttgacagtggtgtttttgccttcacactactgtatccctggtccatacmgtaaatgttctgtaaatgtttgtaaatgaatacatgaaagatgaccaggtgctgaatcagtgagagtccttaatgtacttcttatcatttatccctctga

SEQ ID NO: 43143 - DNA, 201 bp, Homo sapiens
acgggatttcaacatgttggccaagctcgtctcaaacctgcctcagcctcccaaagtgctgggattacagatgtgagccactgcacccagcctgtagtttsttatttaatgtctgtccccccttctcttgacagtggtgtttttgccttcacactactgtatccctggtccataccgtaaatgttctgtaaatgtttgtaa

SEQ ID NO: 43144 - DNA, 201 bp, Homo sapiens
ttaacttatatctggtcctttagacatttagattttttctgttttatctctctctctctatatgtatatctatatatatatttatctatatctatatagakatatatatatatatatataataatgaatgaaatggactgtttgcaacctcagatgtatttctaggacttagagtgattagcttgaggcgatggtagtttc

SEQ ID NO: 43145 - DNA, 201 bp, Homo sapiens
tgtgaaaactgtgaagacataacacatatctatgaaccttttctattaatcttcttggggctggagctttaaaataaaataaataacttttctgcagagasagaacctttccttacccaaagatttcgtaactttctcacatccttggttaaggctgagctgcctagctgtctgcatttctgataggttttgctttcatac

SEQ ID NO: 43146 - DNA, 201 bp, Homo sapiens
agacgggatttcaacatgttggccaagctcgtctcaaacctgcctcagcctcccaaagtgctgggattacagatgtgagccactgcacccagcctgtagtktcttatttaatgtctgtccccccttctcttgacagtggtgtttttgccttcacactactgtatccctggtccataccgtaaatgttctgtaaatgtttgt

SEQ ID NO: 43147 - DNA, 201 bp, Homo sapiens
tgttgtcatcgttttatgattaacttatatctggtcctttagacatttagattttttctgttttatctctctctctctatatgtatatctatatatatatwtatctatatctatatagagatatatatatatatatataataatgaatgaaatggactgtttgcaacctcagatgtatttctaggacttagagtgattagc

SEQ ID NO: 43148 - DNA, 201 bp, Homo sapiens
gaaggatatcctttcaatagaggtgaaaatcctgaaataaaaggtttcataaatggggaaaaaagtcattgattgaaagagtcatggcatagatgctgaasttttgatgggaactttgcaggatgttcgtttgtttatcattagccctgggagagtcatccctcgcctcccaccaccccttaatttaaagggatttaaaat

SEQ ID NO: 43149 - DNA, 201 bp, Homo sapiens
ctcccaggttcaagcgattctcctgtgtcagcctcctgagtagctgagattacaggtgtgcaccaccacgcacggctgatgtttgtatttttagtagagaygggatttcaacatgttggccaagctcgtctcaaacctgcctcagcctcccaaagtgctgggattacagatgtgagccactgcacccagcctgtagtttct

SEQ ID NO: 43150 - DNA, 201 bp, Homo sapiens
ctttctagctgtgtaactttaggcaaataatgtaacctccatctgcctttgttttttcctctgtaatagaaggaacaacaacgaacaacattttttttttkgcaagattaagtgagatcttccatttgacatgcctggctaattggcagtgcccaacagatagaaactattggtattgtaaggactgcttattgggtacat

SEQ ID NO: 43151 - DNA, 201 bp, Homo sapiens
gagacagagcattctgcttcagaactgtcctcctgagttgacttcccgtcagatcccactggttgggactgagtcatctgtttgtatcctagttataaagkagactagaaaagtgcataactggctttttgagcctctagagtggcaggcgaactctgattttgaggaaaaaggatagggtaatggtgttgacacaggcac

SEQ ID NO: 43152 - DNA, 201 bp, Homo sapiens
ggtacagtgaaaatatggtattataatctgatgggatcggcattgtgtacatagttcgttattgactgaaatgttggtatgaggtgtatgactatgttttytcatgacctctgctttttttgtctttaagtttttaatttttgttttacttttgtcttttaattttaattctattgcaaccaaatctatcagcctgtcttc

SEQ ID NO: 43153 - DNA, 201 bp, Homo sapiens
cacatttcaaatcttcagtagccagatgtggttattggctaccatattgggtagcaccgatatagaacatttctaccatagtagaatgctcttttggatasatctgctttaaagcattagtccccaaagtgtgaaggatgaaccacttgggttccgagaggaaacattataacttctgtttatccattaaactctttcatt

SEQ ID NO: 43154 - DNA, 201 bp, Homo sapiens
tggtatcgcaaatgcaacaaaaacaaataggtgggacttaattaaactaatcagcttttgcccagcaaaaggaacagtcagcagagtaaacagacaacccrcagagtgggagaaaatctatacaaatctatacgtctatacaaggactaatatccaggatctacatggaactcaaattagcaagaaaaaagctaacaatcc

SEQ ID NO: 43155 - DNA, 201 bp, Homo sapiens
tgataacacacgtatatattatctctttaaaaattaaaaaaaaaaaagccagccaaaaaaagaaaatggaagtgttcaagaaactgccttttttcatgtartagtatttctgtgtcactaaatccttcaacagcattatttttaatagctgcccaatgtcctaatggatgggtgagtcatgatttacttaaccaatcccct

SEQ ID NO: 43156 - DNA, 201 bp, Homo sapiens
ccattctcctgcctcagcctcccaagtagctgggactacaggcacccgccaccaagcccagctaattttttgtaattttagtagagatggggtttcaccaygttagccaggatggtctctatctcctgacctcgtgatccgcctgcctcggcctcccaaagtgctgggattacaggtgtgagccaccacgtccggcctgtt

SEQ ID NO: 43157 - DNA, 201 bp, Homo sapiens
ctcagaaagtaataaagccctgcagtaatcagagggctgaggccaggtccccagtgagcggctgaacacacagtgattcaaacccactccagacctgtgtwcttaatcattaccttcacctggagggacagacctggccttgggcaagccacccccactccctggctctgtgaccttggcagctgactggccctctccaag

SEQ ID NO: 43158 - DNA, 201 bp, Homo sapiens
ccaagtggaaggtggtgtaggcaaagagaaggatgcataggcacattggacggtggaaggcaggggctgctgaatgatgtggcaggaaacatgcaaagtgytcagcgtccctgggcggtgcagagtcttgggaagcaagaggatggagccatcctttcagtttccagcctgggtttcccaaaggagagggtgtttgagttc

SEQ ID NO: 43159 - DNA, 201 bp, Homo sapiens
cagttgtaacagtggtatgtgtatatctcaacatatctaaacatagaaatagtacagtaaaaatatgatattataatctttgggaccgccatcatatatgyagtctgtcattgactgaaagttgtcatgtagcccatgactgtcgtctcttttaggggaaaaaacaaaagcagaaagcaagcaagctggtatcctgcgtat

SEQ ID NO: 43160 - DNA, 201 bp, Homo sapiens
aaacatcctgtggaattcgcctcagatgcccctccatttgcactggtatatggaggatgtttgaaaaccaccagaacctattgtgtactttggaacaatgrcattttcctgcttgattgtgaagatggccgctggaaaagaagccaactcccagggggcacgaggggctaagctgtctcctgggaagtttgagggaggcca

SEQ ID NO: 43161 - DNA, 201 bp, Homo sapiens
ttcaggagcagcctgggctgagtttttaatgtggcagcagcctcggctggtttcagcatgcaggtgagaaggccgttcatctggaacttgggctacccaasagtgcaagtggggagatcagagcatggaaaatgtttttgtataaacttaggtggaccaaaatgatcatttcaacaacatttcggacttgattttttgtat

SEQ ID NO: 43162 - DNA, 201 bp, Homo sapiens
catgattcaattacctcccacctggtccctcctgcaacatgtgggaattcaagaagagatttgggtgggtacacagccaaaccatatcaaaaaccatttayaaaactctaagcagccttaaaggaaaccaccaagggaccaaggcctgatgaagcaagagtaggagggaacagatgcttggatagggcaggtgagtcacag

SEQ ID NO: 43163 - DNA, 201 bp, Homo sapiens
caggcaagaaagaacttgtgtagggaaactctcccttatgataccgtcagattccttgagacttatttgctattgtgagaacaccttgggaaagacctgcytccatgattcaattacctcccacctggtccctcctgcaacatgtgggaattcaagaagagatttgggtgggtacacagccaaaccatatcaaaaaccatt

SEQ ID NO: 43164 - DNA, 201 bp, Homo sapiens
ggcgacacagtgatggcagaaggtgaaaggcacatctcacatggcagcaggcaagaaagaacttgtgtagggaaactctcccttatgataccgtcagattycttgagacttatttgctattgtgagaacaccttgggaaagacctgcctccatgattcaattacctcccacctggtccctcctgcaacatgtgggaattca

SEQ ID NO: 43165 - DNA, 201 bp, Homo sapiens
gctggggaggcgacacagtgatggcagaaggtgaaaggcacatctcacatggcagcaggcaagaaagaacttgtgtagggaaactctcccttatgataccrtcagattccttgagacttatttgctattgtgagaacaccttgggaaagacctgcctccatgattcaattacctcccacctggtccctcctgcaacatgtg

SEQ ID NO: 43166 - DNA, 201 bp, Homo sapiens
ctgcgtactgtaggcagttgtaacagtggtatgtgtatatctcaacatatctaaacatagaaatagtacagtaaaaatatgatattataatctttgggacmgccatcatatatgtagtctgtcattgactgaaagttgtcatgtagcccatgactgtcgtctcttttaggggaaaaaacaaaagcagaaagcaagcaagct

SEQ ID NO: 43167 - DNA, 201 bp, Homo sapiens
ttggagccaaagccaaatagtgctctgtaaacattatgatttgtcagtaatcaatgtgatttgtataatttgtgagcaatcagatactttatccaaaagcrgattattgacctctgtgcccatcttgggagaaattgccacttggtctgtgtctacacagacccaagaggagaagggatttgacaatggtctgattaattg

SEQ ID NO: 43168 - DNA, 201 bp, Homo sapiens
gggctggatttgtcctgtggactgtagtttgctgacatccaggctagatccttaatatacaatgaagtagtaaaacacatgtaaaagtaaaaagcaggcgwaatagaataaaatacacatttgcacaccacagtatccaaaaaggttatgtactggggctaaagatttggcttggagtttcctggtagtcaaggcaaaaaa

SEQ ID NO: 43169 - DNA, 201 bp, Homo sapiens
gtggcagagggagaggacagtaaccaataccgctccttctacatgatcagtgttcaggttgaagacaaacagggctccaattatgttgtgatttagaaggygacagagctgagacctcaccctctgcttatgggctgcatgcctttctcagtgaaataacgcagaatgcagaggccatgcctgcagatcaggggtgctaga

SEQ ID NO: 43170 - DNA, 201 bp, Homo sapiens
agagtatgtgcgccttctttttggttaccctggaccagacattcctcagcactggcttgcattggcaggaggtggcagagggagaggacagtaaccaataycgctccttctacatgatcagtgttcaggttgaagacaaacagggctccaattatgttgtgatttagaaggcgacagagctgagacctcaccctctgctta

SEQ ID NO: 43171 - DNA, 201 bp, Homo sapiens
ttgaggttctttccaagtaaaggcgttattctttgtggtgtgctcctggaggtcactaacaaaacgtctccagcaggtgttgtgtggattcccccaaatcygtaggctcttatttcctagacatgaagagtatgtgcgccttctttttggttaccctggaccagacattcctcagcactggcttgcattggcaggaggtgg

SEQ ID NO: 43172 - DNA, 201 bp, Homo sapiens
aaacagccagctattctgatcatttgaaatctggaacattctttcctacggtggttgacttttcactgcctttgaggttctttccaagtaaaggcgttatyctttgtggtgtgctcctggaggtcactaacaaaacgtctccagcaggtgttgtgtggattcccccaaatccgtaggctcttatttcctagacatgaagag

SEQ ID NO: 43173 - DNA, 201 bp, Homo sapiens
ggagaccagactccaagttctggcctcacgttgcttggtatacatcactcagttctgttggcatggatgctcctcctataccccatcagccatcttgcagwatgggtttggtggatcacacagggattcagataagagggttcagatccttctatccatcaacccacccatccacatcactgaaaaagggactctcagatg

SEQ ID NO: 43174 - DNA, 201 bp, Homo sapiens
tggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtccc

SEQ ID NO: 43175 - DNA, 201 bp, Homo sapiens
ctatatgatcatatgattttcctttagctttttgatatggtggactatattgattttaaatattgaaccagccttgaagacctggaataaatcccacttgstcatggcatatatgtttttttatacattgttggatacagtttgctaacattttgtggatagctcaccaacttttattcagaaaacatccgtctcagttta

SEQ ID NO: 43176 - DNA, 201 bp, Homo sapiens
ttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacat

SEQ ID NO: 43177 - DNA, 201 bp, Homo sapiens
ctgttcaccgcattcacgccaatatctattattttttgcatttttggtaatggccattcttgcaggagtaagatggtatcgcaaatgcaacaaaaacaaayaggtgggacttaattaaactaatcagcttttgcccagcaaaaggaacagtcagcagagtaaacagacaacccgcagagtgggagaaaatctatacaaatc

SEQ ID NO: 43178 - DNA, 201 bp, Homo sapiens
tgtttattttcttgactctagagcattcttttatgcagttaaattactctaaaatgttttgcacctgcacgcattaatgtgtattgtttggtaagaacttycgagttggtgaaaaaatgtattgtattttagtatctatatttatatatacatattagtctatgggttttaattcacaaaaccaggtgttgtatctggtgc

SEQ ID NO: 43179 - DNA, 201 bp, Homo sapiens
gactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagt

SEQ ID NO: 43180 - DNA, 201 bp, Homo sapiens
agtgtcgttctaaaaaagatgcaatatacttcaaatagctgcttctaaaatatgttaaaggaaactaacatttgctgagtactttctaataatgaagtcayatcatacgtgcattacatgtttattttcttgactctagagcattcttttatgcagttaaattactctaaaatgttttgcacctgcacgcattaatgtgta

SEQ ID NO: 43181 - DNA, 201 bp, Homo sapiens
atggtagttctacttttagttcttcaagaactctccacactgttttccatagtggttgtactagtttacattcccaccagcagtgtagaagtgttccctgytcaccgcattcacgccaatatctattattttttgcatttttggtaatggccattcttgcaggagtaagatggtatcgcaaatgcaacaaaaacaaatagg

SEQ ID NO: 43182 - DNA, 201 bp, Homo sapiens
gcccttttacagttacacatttctaattgttgctgtaaatgcattatcactttgaaattaattaatttttccattttggctgcctgcaatataataatcaytaatgagaaactcacaggaatcaattctcagcacagcggcccctactggtaaagccatgtctctgcctccctcttcttcttcagatccagagaactggac

SEQ ID NO: 43183 - DNA, 201 bp, Homo sapiens
agtatgtctttcatataaggacttcttttcctctgggaagatacccattagtgggattgctggatcaaatggtagttctacttttagttcttcaagaactytccacactgttttccatagtggttgtactagtttacattcccaccagcagtgtagaagtgttccctgttcaccgcattcacgccaatatctattattttt

SEQ ID NO: 43184 - DNA, 201 bp, Homo sapiens
agcaccactggccaaagcgaggatagctgattgcactcctactttcctgctggtggaaacagcatgtatataggtacaactctggtgtggggaaaatgctraagatataaagtagaaatagcctttgtgtgatgtgagcagcagaacaaaaatcgagggtgccaaataatcgtatgaagtggtgaactgcctaagatggaa

SEQ ID NO: 43185 - DNA, 201 bp, Homo sapiens
cactagggggatggtgattagaaagcacctcatgatcccgtctacttcctgcagagaacagactagccccctatgcagcacacacctttgtgaggtccctyctccaacacagggattacaattcaacctgagacgtgggtggggacacagagccaaaccacactggaaggtaaaaaagttggcaaccagaggcttagagga

SEQ ID NO: 43186 - DNA, 201 bp, Homo sapiens
gtacacactgctgtttaccttggcgaggcctttcaccaagtccatggtaagagaacagcttctggcgccgcaaacaccttgggtcctagagaaacctgcamacttgtgtctccacctttttacctcttgcgggcatgagtctggtctcagtaataacattgtccagcccatcataaagggctcttgaacacattttcatca

SEQ ID NO: 43187 - DNA, 201 bp, Homo sapiens
ttcagggattaggacctggacatctttggttgggaaatgggcatcattttgtctaccacaacgtgagagcccattgccctgcatccacagtcataaaagtstgttcccttcctccctgattcttcctaacttctcctgcctgccttgcaggatatgtggagttatcagttcctagcaccactggccaaagcgaggatagct

SEQ ID NO: 43188 - DNA, 201 bp, Homo sapiens
cagattcccgtgtacaggcatgccaccacacctggctaatttttgtatttttagtagagatggcattttgccatgttggccaggctggtcttgaactcccracctcaggtgatccactcgtctaagactcccaaagtgctcggattacagatgtgagccactgcacccagcattccttagatttccaataaaaataaaaag

SEQ ID NO: 43189 - DNA, 201 bp, Homo sapiens
cctctccctatttatttttattttatttgtgagacagagctttgctttgttgcccagactggagtgcagtggcttgatcttggctcactgcaacttccgcytccagggttcaagcgattctcctgcctcagcctcctgagtacctgggaccacaggcacatgccaccatgccagctaatttttagtagagatggggtttca

SEQ ID NO: 43190 - DNA, 201 bp, Homo sapiens
cttcaagtcagttacttaatggaataatacatgtttcctgcttccattgtcttcctggacctgacactcactctttaaccataagcagaagacacatacamaaatgtcctatgttaagaatctttatttaagacaggtggctagcattatttgggtccagaagcttccctggaaagaaaggattcactgcaagatcgacag

SEQ ID NO: 43191 - DNA, 201 bp, Homo sapiens
tcctcccgcctcagcttcctaaagtgctgggattagaggcatgagccaccagacatgacctgtgtttatattgttaaatcaccattgtcaatcttgaaagkagactttgttttgatgtatgtaagattgagtttttactcatctctacatagtttcctcagattgcttttttttttttttgagaccgagtctagctctgtc

SEQ ID NO: 43192 - DNA, 201 bp, Homo sapiens
cagtgtttcctctttgttaatcctcatgatgattggtatggtttggctgtgtccccacccaaatctcattttgaactgtaatctccataatccctacgtgycaggtagggacctggtaggaggtgattggcccgtggtggcagtttccctcatgctgttctcgtgatagcacgtgagttctcgtgagatctgatagtttta

SEQ ID NO: 43193 - DNA, 201 bp, Homo sapiens
tttttttaatttttaaattttaaattcttacttttagatatgggggtctcactctgttgcccaggctagagttcagtggcacaatcatagctcactgcaaygttgacctcccaggctgaagcgatcctcctgcctcagccccccaagtagctgggaccacaggcatgtgccaaaatactcaactaattgtttattttttgt

SEQ ID NO: 43194 - DNA, 201 bp, Homo sapiens
ctagggtgttgataagaaacagcaggcatagttactgggtgattgagaagagtttaacaaaagactatattagtctgttttcatgctactgataaaggcayacccaatactaggtcatttacaaaagaaaaaggtttattggacttacagttccttgtggctggggaggcgacacagtgatggcagaaggtgaaaggcaca

SEQ ID NO: 43195 - DNA, 201 bp, Homo sapiens
gggtgggtgttacttctcaagaaggcgatggtagaaccgctggagacttcttatggctgtggcaggggactcacacgtcacaaggagtccagaggcatggstttgaagagctcttttcattcattcttccttttgttcacttgtacatcaaatacatgctgtgggcctactgtgtgctgagcactgatcttgtcaggttct

SEQ ID NO: 43196 - DNA, 201 bp, Homo sapiens
tagctagggtgttgataagaaacagcaggcatagttactgggtgattgagaagagtttaacaaaagactatattagtctgttttcatgctactgataaagrcatacccaatactaggtcatttacaaaagaaaaaggtttattggacttacagttccttgtggctggggaggcgacacagtgatggcagaaggtgaaaggc

SEQ ID NO: 43197 - DNA, 201 bp, Homo sapiens
gaggcaggtggattgcttgagctcagtcgtttgagaccatcctgcacaatacggtgaaacctcatctctactaaaatacaaaaatgtagccaggcgtggcrgcacatacctgtagtcacagctactcaggaggctgaggcaggagaattgcttgaacccgggaggtggaggttgcagtgaggtgagatcgcaccactgtac

SEQ ID NO: 43198 - DNA, 201 bp, Homo sapiens
ggattgatactagctagggtgttgataagaaacagcaggcatagttactgggtgattgagaagagtttaacaaaagactatattagtctgttttcatgctwctgataaaggcatacccaatactaggtcatttacaaaagaaaaaggtttattggacttacagttccttgtggctggggaggcgacacagtgatggcagaa

SEQ ID NO: 43199 - DNA, 201 bp, Homo sapiens
gtgcggtggcacactctgtaatcccagcactttgggaggccgaggcaggtggattgcttgagctcagtcgtttgagaccatcctgcacaatacggtgaaamctcatctctactaaaatacaaaaatgtagccaggcgtggcggcacatacctgtagtcacagctactcaggaggctgaggcaggagaattgcttgaacccg

SEQ ID NO: 43200 - DNA, 201 bp, Homo sapiens
ctttctgttataaaatcatgtttttattgaattacattttaatattggtatcactttaaaatgaaaatgagtacttgcaaaatgtatttttgaaggagttkggtggtggtggggggatgccattttggcaacagatgacttcggttcaagtcctctctctgtctcttacttgctttgtggctttagaccagccacccactc

SEQ ID NO: 43201 - DNA, 201 bp, Homo sapiens
gatctcaggagagccaactcaccacacagcatacgtgctaaaccatgcatgagaaatctgtccgcatgatctaatcaccttccaccaggccccacctccarcgttagggattacatttggacatgaaggctgggtgcggtggcacactctgtaatcccagcactttgggaggccgaggcaggtggattgcttgagctcagt

SEQ ID NO: 43202 - DNA, 201 bp, Homo sapiens
ttttttttctttttcccttatgcatttgggagtggaagagctgtcagattctgaatttagttagatttataatgctagagacattcagcagtctgcctttycctttctgttataaaatcatgtttttattgaattacattttaatattggtatcactttaaaatgaaaatgagtacttgcaaaatgtatttttgaaggagt

SEQ ID NO: 43203 - DNA, 201 bp, Homo sapiens
ggtatttgccaccacgcccagctaatttttgtatttttagtagagacagggtttcgccatgttggccaggctggtctcggactcctgacctcaggtcatcygcccgccttggcttcccaaaatgctggtattacaggcatgagcctctccatctggcctcagcagtgctcttctggctagcttgatcatatgccaatgttt

SEQ ID NO: 43204 - DNA, 201 bp, Homo sapiens
aagatacaatagatgtagcatctgctatatccggtaacaggataacagtgcattgctgggatgatgaggctgcagtgggctgtgattgtgccactgcattktcagcctgggtgacagaggaagaccctattacaaaaaaaaaaaaaaaaagggtctgttatcaaccatgcttttttattttattttattttattttcctgt

SEQ ID NO: 43205 - DNA, 201 bp, Homo sapiens
ctacaataactttttcagtctctttctccctttcccaccttcccaaaagggtgggaaatttttaaagtaaagtaataaacaaataagttttgggttgggcrggagattagttagagacaggatctgtaggtcagaagtggtatttgggggagtagggagttttttttttttttctttttcccttatgcatttgggagtgga

SEQ ID NO: 43206 - DNA, 201 bp, Homo sapiens
gcacaactgaactccagcctgggcgacagaggaagactctgtctcaaaataaacaaacaaataaataaataaaaattgtttaaacctgccaactacaatawctttttcagtctctttctccctttcccaccttcccaaaagggtgggaaatttttaaagtaaagtaataaacaaataagttttgggttgggcgggagatta

SEQ ID NO: 43207 - DNA, 201 bp, Homo sapiens
tttttgatttggtttggttctttggagttgtttgcatttcgtgagtcttggcatctttttggtagagaaccttgctaggttctcacaatgtagaaattaarcagaaaacagaggtctcaatttgccttttcagcgtgaatgcagactcttacattcagtgctgggagtctttcttgagggacagtgagagcgaggaagggt

SEQ ID NO: 43208 - DNA, 201 bp, Homo sapiens
atttccacccccattatttgcataacaaattacagattatccagaacaggtgggctgtacataaacaggctggtgggctggatttgtcctgtggactgtastttgctgacatccaggctagatccttaatatacaatgaagtagtaaaacacatgtaaaagtaaaaagcaggcgaaatagaataaaatacacatttgcaca

SEQ ID NO: 43209 - DNA, 201 bp, Homo sapiens
ctgaaaatgctgggattacacacatgaaccactgcgcccagccgctctactttattagatttaaaaagtttgctctcagctgggtgcagtggcttatgccwgtaatcccagcagtttgggaggccaaggcggggagggtcatgaggtcaagagatcaagaccatcctggccaacattgtgaaaccccatctctactaaaga

SEQ ID NO: 43210 - DNA, 201 bp, Homo sapiens
ttttgctctcctccttttgtcagttggcatgcgatatgcttctcaggcagtaatttagagactgtcaattcctgagagccgctggggaactgagcaatcgyctgcatttcgtcgctttagcccgagctgggtctttgagctggcagagaccaagatctttttctgggaagggatggtcctatttaaggaaggccctggatt

SEQ ID NO: 43211 - DNA, 201 bp, Homo sapiens
tagcaactcttcattgctgctttgcaaagaggatttgagattgtttatgtaggggcccgtgtataatacctcaagagaaaaagacacagatgaggctattrggattaagggaaaatcaagtaaatcgagaggtaaagcactgtgcagaaatattggccagaagctatgaacagttgccacagctgggctgaagagttacct

SEQ ID NO: 43212 - DNA, 201 bp, Homo sapiens
ttggatgtgcaatgtgaaatctcacaaattaaacatgttacataactgtattttgtttcctatctctgctgtaataaattttctcaatgttagtgacttakaaccacacaaaagttacactttacagttttggaggtcagtggtccaaaataggtctcagtgggctaaaatcgatgtgtcagcaggacaccatttctttct

SEQ ID NO: 43213 - DNA, 201 bp, Homo sapiens
tactaagaaacttttgaaaatgataatgggtgtgtactttttatcaactgctttttgtatgccaatctatatgatcatatgattttcctttagctttttgrtatggtggactatattgattttaaatattgaaccagccttgaagacctggaataaatcccacttggtcatggcatatatgtttttttatacattgttgga

SEQ ID NO: 43214 - DNA, 201 bp, Homo sapiens
gattcttctcaattcctaaattactaagaaacttttgaaaatgataatgggtgtgtactttttatcaactgctttttgtatgccaatctatatgatcatawgattttcctttagctttttgatatggtggactatattgattttaaatattgaaccagccttgaagacctggaataaatcccacttggtcatggcatatat

SEQ ID NO: 43215 - DNA, 201 bp, Homo sapiens
tttatttttgtttgtatttgttagtttttttgagatttcttgggattttctatctagcctgtcatgtcatatgcaaatagagaattttatttcttcctttrtaatatgtgtgccctttttttattgccttattgtagtggctagaacttcctgtgctatgttgaacaagagtagtgagaacatccttgccttgctcctgat

SEQ ID NO: 43216 - DNA, 201 bp, Homo sapiens
gttttttatttttgtttgtatttgttagtttttttgagatttcttgggattttctatctagcctgtcatgtcatatgcaaatagagaattttatttcttcytttataatatgtgtgccctttttttattgccttattgtagtggctagaacttcctgtgctatgttgaacaagagtagtgagaacatccttgccttgctcc

SEQ ID NO: 43217 - DNA, 201 bp, Homo sapiens
ttctttggagcgattgtaaatggcattgtgtttttaattccaacttctacatatatctagaaatatgattgagttttgtgtgttgatcttgatcctatgascttgctgattgcatttattataaagttccaggagttttttatttttgtttgtatttgttagtttttttgagatttcttgggattttctatctagcctgtc

SEQ ID NO: 43218 - DNA, 201 bp, Homo sapiens
tgaactcctggcctcaaagcgatcctcctgtctcagcctcccaaagtgtggagattacaggcatgagccactgcacacagccaaggtcagctttttcactycagcacaccaggattttcatcccagctctccaatcccccagctgtgtgggcctggtcaacctgtttagcctgtcaagacttcagtcccttcaactgatag

SEQ ID NO: 43219 - DNA, 201 bp, Homo sapiens
tacaaaaactgttaccgcctaacacattaaatgtatttaaattatttgttctattaaaatgtcagtgtatttcttgaattttaactgtgcctgaagatcartcattgtaacagctgcagggaaggctttatgacttacctgaacggtggtgtattctgtggctcggctaagtggattcttcgactttaatagattttacta

SEQ ID NO: 43220 - DNA, 201 bp, Homo sapiens
tattgaagtctctctttgtagccaatccttttttttttttttaatttttaaattttaaattcttacttttagatatgggggtctcactctgttgcccaggstagagttcagtggcacaatcatagctcactgcaacgttgacctcccaggctgaagcgatcctcctgcctcagccccccaagtagctgggaccacaggcat

SEQ ID NO: 43221 - DNA, 201 bp, Homo sapiens
agagggtggggagagagttcagtatgtcaggactgctacatttatgagtgtgggtctttattgaagtctctctttgtagccaatccttttttttttttttwatttttaaattttaaattcttacttttagatatgggggtctcactctgttgcccaggctagagttcagtggcacaatcatagctcactgcaacgttgacc

SEQ ID NO: 43222 - DNA, 201 bp, Homo sapiens
tcctgcttcctggccgtgtctagggcctctatgctgacttcctcctctgtggatcctgcagggttcacatctgcaggctgacaacatgaggcctcggggarctttgtaagggtagctgaggattctcccaaatcaagatttccaagtcatatagaccaaggcttcatacattcattcatttaacaaacataccaagtgcta

SEQ ID NO: 43223 - DNA, 201 bp, Homo sapiens
tgatatctttctgtttccaaaagcagcagccctttattcaagacacttttctgtttaatttaattatctttgaacttcctgttgaaggttttgaaaaatayatgttagagggtggggagagagttcagtatgtcaggactgctacatttatgagtgtgggtctttattgaagtctctctttgtagccaatccttttttttt

SEQ ID NO: 43224 - DNA, 201 bp, Homo sapiens
ctggcctcctgcttcctggccgtgtctagggcctctatgctgacttcctcctctgtggatcctgcagggttcacatctgcaggctgacaacatgaggcctsggggaactttgtaagggtagctgaggattctcccaaatcaagatttccaagtcatatagaccaaggcttcatacattcattcatttaacaaacataccaa

SEQ ID NO: 43225 - DNA, 201 bp, Homo sapiens
tttacatttttcttttaaacgtataagactattgatggtacctcaccaaggttataacccctttataatcattaatttttaatctagaaaagagtcttggrgacaacaagactcatctataatttcttggatgctcaaatgaaaatatacaggactcaagcattagctaaaataatccaggaaagccctgtcaaaggttag

SEQ ID NO: 43226 - DNA, 201 bp, Homo sapiens
agaggacatgctggcctcctgcttcctggccgtgtctagggcctctatgctgacttcctcctctgtggatcctgcagggttcacatctgcaggctgacaasatgaggcctcggggaactttgtaagggtagctgaggattctcccaaatcaagatttccaagtcatatagaccaaggcttcatacattcattcatttaaca

SEQ ID NO: 43227 - DNA, 201 bp, Homo sapiens
tagccccctgtacagcacacaactcggggaattttaggtctggtgatttactgctgttggagcctggccttcttcctgggagaaggctggaaaaacttcawgtcagttacttaatggaataatacatgtttcctgcttccattgtcttcctggacctgacactcactctttaaccataagcagaagacacatacaaaaatg

SEQ ID NO: 43228 - DNA, 201 bp, Homo sapiens
ggattcccattatgcttcttcattacccggtgcccagaatgaacttatagaagcagaatatgaggggtcctttgacaaacatgagactgtttagaaaattscttttgtttgctgtgatccattttgtaagggaagtcactataatgttgttatttaagagaaagagacaaacggaaagaaacaaacagctggtgtttaacg

SEQ ID NO: 43229 - DNA, 201 bp, Homo sapiens
actatgttggccaggctggtcttgaactcctgaccttgtgatctgccctcctcagcctcccaaagtgctgggattacaggtgtgagccactgtgcctggcyttttttttttttttttttttttttttgagacagaatctcactctgttgcccagtctagagtgcagtggcgtgattttggctcactgcaacctccctcccc

SEQ ID NO: 43230 - DNA, 201 bp, Homo sapiens
ggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatgg

SEQ ID NO: 43231 - DNA, 201 bp, Homo sapiens
cagagaacagactagccccctgtacagcacacaactcggggaattttaggtctggtgatttactgctgttggagcctggccttcttcctgggagaaggctsgaaaaacttcaagtcagttacttaatggaataatacatgtttcctgcttccattgtcttcctggacctgacactcactctttaaccataagcagaagaca

SEQ ID NO: 43232 - DNA, 201 bp, Homo sapiens
gggcattatcattccctttataggggacacagctgtggctcagaggggtttattcactttcctgagggccacacacataatgagaggcagacacaggtgasgaagtgagttttccctgtcacgccatcttatctgtcacatacctctctgacatgctaaaattgcactaaacaaaagaattctcttatgcacatatcatgc

SEQ ID NO: 43233 - DNA, 201 bp, Homo sapiens
cttccacccaaaaaatcaccatgatatccagctgtggaagagttcattatggagagcttcctggaagaagtagtccctgaactgggttgggctaaacaaayatgccaagaagggtttctggaagcagttgacaaaagatgagtagagagagggagggggtggtgctatatttattccatacctttcagatactctctaaat

SEQ ID NO: 43234 - DNA, 201 bp, Homo sapiens
gagcaagggggcaggtgcaaaacacttttcaacaaccagatctcaggagagccaactcaccacacagcatacgtgctaaaccatgcatgagaaatctgtcygcatgatctaatcaccttccaccaggccccacctccaacgttagggattacatttggacatgaaggctgggtgcggtggcacactctgtaatcccagcac

SEQ ID NO: 43235 - DNA, 201 bp, Homo sapiens
gggagctgtgcagaagctcttatctgcgcatcccatctcatggacaccatgctttccagcccgttccagcaagcacatgagaaagtccactctggcaagamggagaaaatgcttctgctgaaataccaggaaggtgtggaggctgggtgtcattgttccccctcctgatcatggcagcttcaggccagacaatgtcttgaa

SEQ ID NO: 43236 - DNA, 201 bp, Homo sapiens
cagaggggtggtctgcccctgtgcaggcaggaatgttcaggaagcaggctgcctctgtttctactctaaatatttaacattcacggatggcatggatcctsactaagcggagcagatgctggctctatattgcacatagctcctgaatatcagccctgcttggctatgcatgtgttttttgttagtttttgagacagagtc

SEQ ID NO: 43237 - DNA, 201 bp, Homo sapiens
agtgagccttttcaccaatcttggaaggccagtaatgtcagtgaacactaggaatggtgtcatggcctgggtcctgaagagtggatacttaatgtccatgraggcatgcatttttatctgccttgcatggcttctttcattctctccctgacttccacccaaaaaatcaccatgatatccagctgtggaagagttcattat

SEQ ID NO: 43238 - DNA, 201 bp, Homo sapiens
tgtatacataattttcatatccctgatagatattgccaaatatttaccagaagtgaatcaagtagtttttctaccaacattatctaagagggcttgtcttwttacatctttgtcagcactaagtattatctcccttacttttttttttttttggtaatctttgttactttgttaggattaaagtagcttctcattttaatt

SEQ ID NO: 43239 - DNA, 201 bp, Homo sapiens
attatcaaaacccaagtctttgtctcactcacggtccacaccccgcccagagtcgtatcacttgactgcatttgaccattcagttttcagaccaactccawtgttactagatatcctgacactgaagaagctaaaaccaaacaacaatgacaacaacaaacccaagtctgccttatggcacattcttcacgtcgtaacacc

SEQ ID NO: 43240 - DNA, 201 bp, Homo sapiens
accatcccggtaaagtgacgttttgatgaaaacagcatggatcttcctgcagagaacagactagccccctgtacagcacacaactcggggaattttaggtytggtgatttactgctgttggagcctggccttcttcctgggagaaggctggaaaaacttcaagtcagttacttaatggaataatacatgtttcctgcttcc

SEQ ID NO: 43241 - DNA, 201 bp, Homo sapiens
tttcaactcctgacctcaggtgatctgcctgcctcggcctcccaaagtgctgggattacaggtgtgagccacagcgcccggtggtcatatctctttcttgsgtttttgtgggggttggggtaataggtttattgagatataattcatataccacacagtttcatttttagtgtattgacaggtgtgcagtcatcgtcacaa

SEQ ID NO: 43242 - DNA, 201 bp, Homo sapiens
ggcacagtgagccttttcaccaatcttggaaggccagtaatgtcagtgaacactaggaatggtgtcatggcctgggtcctgaagagtggatacttaatgtmcatggaggcatgcatttttatctgccttgcatggcttctttcattctctccctgacttccacccaaaaaatcaccatgatatccagctgtggaagagttc

SEQ ID NO: 43243 - DNA, 201 bp, Homo sapiens
tgctgtttcctcatttttaaatagtgggctttgatgactattcttctacataaattattacatatctgtatcatagaatcttaaaaattatttgattcaartgtatacataattttcatatccctgatagatattgccaaatatttaccagaagtgaatcaagtagtttttctaccaacattatctaagagggcttgtctt

SEQ ID NO: 43244 - DNA, 201 bp, Homo sapiens
ggaggttgtggtgagccaagatcgcaccattgcactccagcctgggcaacaagagcgaaactctgtctcaaaaaaaaaaaaaaaaattatgtccttctagmttgtgaggattaagcaagaccatgcatttacattgtttaacactgtccctgagacatagtaaggcctcagtaactgttagctctcttattgctaccggac

SEQ ID NO: 43245 - DNA, 201 bp, Homo sapiens
agctgagatttaggctgcacctgagtaccaggcagggtcctaagtgacttcagactctatagacagtccctgacttataatggtttgacttagattttttsacctttgggatgctgagaaaaccatacacatccagtagaaaccgaactttacattttgagtttcgatttttttttttcacctgggctagtaatacgtggt

SEQ ID NO: 43246 - DNA, 201 bp, Homo sapiens
attaagttcaagtcatgtcagttattcaaattcaggaccagtggaacttgtccagtatcatcaagcagccagttattatcaaaacccaagtctttgtctcrctcacggtccacaccccgcccagagtcgtatcacttgactgcatttgaccattcagttttcagaccaactccattgttactagatatcctgacactgaag

SEQ ID NO: 43247 - DNA, 201 bp, Homo sapiens
aggatgctgtgctaatgtcttccttttttaattgagtaaatatattatacacagctgggtaggttgtttccttgctggccttactgctacaatttgaaaayggatacagttttctttaactcacataggatgaatgtggcatttattcctggtttcctgtggctctcctcctttagaaaacgtatttacatggacgttttt

SEQ ID NO: 43248 - DNA, 201 bp, Homo sapiens
tcatattggttacagtgatagcagctgagatttaggctgcacctgagtaccaggcagggtcctaagtgacttcagactctatagacagtccctgacttatratggtttgacttagattttttcacctttgggatgctgagaaaaccatacacatccagtagaaaccgaactttacattttgagtttcgatttttttttttc

SEQ ID NO: 43249 - DNA, 201 bp, Homo sapiens
ctgtacaggaagcatgatgctagcatctgcttggcttctggggaggcctcaggaaacttacaatcatggtggaaggcaaaggggaaggaaagcatctcacrtggtgcaaacaggagcaagagagggagcaagggggcaggtgcaaaacacttttcaacaaccagatctcaggagagccaactcaccacacagcatacgtgc

SEQ ID NO: 43250 - DNA, 201 bp, Homo sapiens
ggggaacccatagctccagccagtgtttgtatgtcaaggtattattatttatcacaatggatcagtaagcattgatgacaactggcaaggtattgcttcaratattttataacggagttgttaacattatttcctttagatggctctttcatcttttctgcattatgaactgatgccccaaaaggtggtatgaatgaaagt

SEQ ID NO: 43251 - DNA, 201 bp, Homo sapiens
cctgcaattctttgtacatatgaaatttaatatggtgagattggcatctagctgctgctagagatagtgctcataataatttttaacattgattgagtgtrgataataatccaggagctgtgctaaacgttttacaacacattatctcacttaatttcacaactccataaagtagttttcacttagttgagggatgaaaaa

SEQ ID NO: 43252 - DNA, 201 bp, Homo sapiens
tcattcttgcactgctataaagaaatacctgagactgggtaatttatttaaaagacacctttaattggctcacagttccacaggctgtacaggaagcatgmtgctagcatctgcttggcttctggggaggcctcaggaaacttacaatcatggtggaaggcaaaggggaaggaaagcatctcacatggtgcaaacaggagc

SEQ ID NO: 43253 - DNA, 201 bp, Homo sapiens
agtgattcttctcactgtattcttttttattaagattattttagcttcctaagacctgtgctttttcatataaattgtacaatatggttgtctatgtctaycagaagccttgctgcagttttaatggggtttaaatctataggtctaacattaaacctatagatcaattcgggagaattgacatctttactatgttgagtc

SEQ ID NO: 43254 - DNA, 201 bp, Homo sapiens
ctgcctcctgtccctatcattgatacctgcaattctttgtacatatgaaatttaatatggtgagattggcatctagctgctgctagagatagtgctcatartaatttttaacattgattgagtgtggataataatccaggagctgtgctaaacgttttacaacacattatctcacttaatttcacaactccataaagtagt

SEQ ID NO: 43255 - DNA, 201 bp, Homo sapiens
ttcattcttgcactgctataaagaaatacctgagactgggtaatttatttaaaagacacctttaattggctcacagttccacaggctgtacaggaagcatratgctagcatctgcttggcttctggggaggcctcaggaaacttacaatcatggtggaaggcaaaggggaaggaaagcatctcacatggtgcaaacaggag

SEQ ID NO: 43256 - DNA, 201 bp, Homo sapiens
cgttcctgcaaatatttcacagaggagtaagagccacattcttgctggctttccaattcattctcctctcttcgagtccacctcttaaaacttcttagtgmtcttgcaagaaactcatgtcttttgtcagggagaatggcatggcctttgtatgacacttccttctagccagactcggatttgggggcatcatatttggga

SEQ ID NO: 43257 - DNA, 201 bp, Homo sapiens
ttgtttttatttagggctcatctggtatgtgtattatgttcttggtagacagaagctgtctttagttcgtatgggttgagcatggagggaacttcatctcrtagtcactggataaggagccagtcctggctcttcctttaactgcccttgtgaccttgaacatgtcagttcatctcaccacgtagtcattttctcatccgt

SEQ ID NO: 43258 - DNA, 201 bp, Homo sapiens
ctggcaggggatgcccgtgacccctgaaaccctaaaaggagtgttacagtcagtgctcttttagttttgccatccacggacggcttaagtgttaacagttsagtggagggtcagcgtgacagccttttgcacccacatctgggttcttgtccagtgtccaggaggaatgaggtctcatgagcaaattttaaggatggcaaa

SEQ ID NO: 43259 - DNA, 201 bp, Homo sapiens
ggaatgtgggggtcatggaagactttgtggaagagttgcaagtagaattattactgttgaaaagagatggggagttaggtagacaaacagaaaaaatgccmccaaacaataagttaggatagaaaaactccacgtatccatatgtcagttggcccatctgttcgttcatacatcctttcattcttctatccatccaaccgt

SEQ ID NO: 43260 - DNA, 201 bp, Homo sapiens
cttctccatgccaggatccagagtaaaagcacagcttctctctaggactccaggggaaagagaaaagacaagttcttaaagtttcttccaggacgtgacasctgacatttcactggccaaacacagtgacctggtcactctggggcagggatgtgtaatctccccatagctggagaagtaaataataatgcacaataacat

SEQ ID NO: 43261 - DNA, 201 bp, Homo sapiens
tgaagcaggaaatttccctgacccctttgcaggcaggaagtggagtgcggatgctggaactagctggctgctttggtgccagtagaggtgaactgcactcwcttgaaccccctgcactccaccccttctgggaggaagcatgcaggtgagcaggtgcaggagccagggtaaatgcttttgggcactggcaggaatgaactc

SEQ ID NO: 43262 - DNA, 201 bp, Homo sapiens
cttcccccaagtgtgtttccctttgtaatgccagtgtcgtaacgccactatctatacttttcaacacaattccaagtgctacctctgcatggcagaaactrtcaaccgtggatggtttctttttagcttgtccttcccgttctacagcatggaggttaagagctctggctttggttccaatcgtgtcccctttcctccctg

SEQ ID NO: 43263 - DNA, 201 bp, Homo sapiens
gcagggagtaatgtgtatatgaatcatcagctatgcaacataatgctgatgctaagtactaacattgatggagtgttggcatgagctgggcagagtgctcyatcctctatgtgtgtattagttcattcttgcactgctataaagaaatacctgagactgggtaatttatttaaaagacacctttaattggctcacagttcc

SEQ ID NO: 43264 - DNA, 201 bp, Homo sapiens
gattgaagagaggaagggaacgttggaaccaatgctgatgagccattcataggctctggctcactatatatgtctaaaattcacatgcccctaaccctcarataatgaccattaataatctggcaggagaggaaagacctgcagctcttctagtccttatgctatctcattgtctcatggatttttaatatgtctttgcat

SEQ ID NO: 43265 - DNA, 201 bp, Homo sapiens
aatttatactcactggggtggtgagaaggttaagggcaatgatgtatacaagacattagcatttgctataaggaggatgtatctcagttgccatatttgtrtcactaaccatttgaagattttgtgttcaagatttggaagagaatcttcttcccaagccagcattttatattttgcattaaaaaaaaccacaaaagacaa

SEQ ID NO: 43266 - DNA, 201 bp, Homo sapiens
cgtgagtattatgttttattttgctgggagaacaatttgggaaaatttgagcagcaaaccataagtttcttggtgtctgtgtacttggagctctgaatcaytattgtcactgagggagtggacaggaagtgatgctgagataagtctagatgggataggtgggcaacatgcaggagaaacctcctgggaaaggtgagcaag

SEQ ID NO: 43267 - DNA, 201 bp, Homo sapiens
ttcctttcccaaacttttactagcttcttccatcctggacttgcaatctggctgaaaacctgctaaataagggaacaattttgacatggctcctgtactcyccacaaacctagttgattccagaccagtaatgtcttggggacagtgttgtcccatcttcctttctaggctgggctcagattactgacgtggaagagttgt

SEQ ID NO: 43268 - DNA, 201 bp, Homo sapiens
tgacctaaactcctggctacaagtgatcctcttgccttggcctcccaaagtgctgggattacaggtgtgagccaccatgcccagccttaaataaactcttyagtgtcaaaaaatctacgtgaggccaggtgtggtggcttacccctgtaatcacagcactttaggaggccaaggtgggtgggtcatctgaggtcaggagtt

SEQ ID NO: 43269 - DNA, 201 bp, Homo sapiens
attggtcctgctgtcctgggacccaggtgtgagtgcatagggaaaagggaggagaaatttaatcctgtaactatctccttatggaaaacaggaaaccacaratgaatcaaatgaatccgtttcccctctttctgatcctctgcaaaagtcatcaaaatcactctgttctcaccaggcaactggagtttcgtcagctgagtc

SEQ ID NO: 43270 - DNA, 201 bp, Homo sapiens
ccgaggcgggtggatcacctgaggtcaggagttcaagaccagcctggccaacatggtggaaccatgtttctactaaaaatacaaaaattagcctggcgtgrtggtgggcacctgtattcccagctactcgggatgctgaggtgggagaattgcttgagcctgggaggcagaggttgcagtgagctgagatcatgctactgc

SEQ ID NO: 43271 - DNA, 201 bp, Homo sapiens
gactctcagattctggcacatagtaaagattcagtaaatggtcgttgcagggaaagctaacttgtccaatgcagatctgtaaaatatactcataaatcttkttggagcaatatttcttctttgtcttacttcgggctaataacaaaaatatcatacaatgagtggcttaaatatttattcttacagttctagaggctggaa

SEQ ID NO: 43272 - DNA, 201 bp, Homo sapiens
cttaatctcccttttccatgggcccaacacctgaatctagggcaaacaggtgtcccccagattggatcctctgctctaggacacattcttgtcctagagcrggttgggcaagaggcttttctctcagtcaccagccccaaaccctgtggtcttgccagcccaggacgtgtcaagactgcagcctttgctgacctgtgacca

SEQ ID NO: 43273 - DNA, 201 bp, Homo sapiens
tataattttgatgaaagaagtttcccaacagtatttcggtgtgcatgctcacacaccagccctggtcgtcagtgaacagattcttccaggtcttcattgtrgcggaagaaagtgagatcagagatcccgaggaagggcttcagtttcaccagtagtggagctagggagtaggggggcagaagccgcaggaagtcagtgcag

SEQ ID NO: 43274 - DNA, 201 bp, Homo sapiens
tgcttctgacacccagtaagcagctctggcttttataattttgatgaaagaagtttcccaacagtatttcggtgtgcatgctcacacaccagccctggtcrtcagtgaacagattcttccaggtcttcattgtggcggaagaaagtgagatcagagatcccgaggaagggcttcagtttcaccagtagtggagctagggag

SEQ ID NO: 43275 - DNA, 201 bp, Homo sapiens
caaggtaatggacatgaggcaaaaatttaaggaaatgacaaaaacaagagtatttccattttcagttaagtgtatgtactgatgttctggaattcactatragaagttgcaaatggtgcatgaaatgaaaaattcctggtggtctccaggggacacagccggtgctgtgctccactctgggtaactgttttggattatttt

SEQ ID NO: 43276 - DNA, 201 bp, Homo sapiens
atgtgtctgaccccaggagaactgccccgatccctatcttgtctctgctcagttctggtaactcttttatcttccctggagttatttttttcccttctttstttctctttttctgtgtgctcttctaagagtaaaacgcatgtccccccatgaagtcactcaaagctcaggcgtgtgcaacagggacagcaaaagcacaca

SEQ ID NO: 43277 - DNA, 201 bp, Homo sapiens
gattggaacattgtattttatggttgcagagcacacgtatcatcctatctgcttctgacacccagtaagcagctctggcttttataattttgatgaaagargtttcccaacagtatttcggtgtgcatgctcacacaccagccctggtcgtcagtgaacagattcttccaggtcttcattgtggcggaagaaagtgagatc

SEQ ID NO: 43278 - DNA, 201 bp, Homo sapiens
aagcagggatcattctggagtgtacactgggcatttgattttaaagcaaatccaagagatcattaaatttgtatcaatgaatacactgttacccctcaatyaacactacaattcatatatcagaatagcactttgttacttgtttctgagatagggctggctctgtcacccagactggtgtgcagtggcacgatcacagct

SEQ ID NO: 43279 - DNA, 201 bp, Homo sapiens
gattacagacaagagccactgcgcagacggacatatgaatttttaatttgatatcattgtgatcaatttgaagatccacatatggctgagggctactctawtgagtggtgcagctccaaggcagagagatggctgtgattaaccaatgaatgagggaacaaatatccaggcagaatgaatagtctatggaaagggctggaa

SEQ ID NO: 43280 - DNA, 201 bp, Homo sapiens
tttgggaagttcccaaatctgtcagtatatattacaaaaactgttaccgcctaacacattaaatgtatttaaattatttgttctattaaaatgtcagtgtmtttcttgaattttaactgtgcctgaagatcaatcattgtaacagctgcagggaaggctttatgacttacctgaacggtggtgtattctgtggctcggcta

SEQ ID NO: 43281 - DNA, 201 bp, Homo sapiens
catctgggaagaggtaacattgatcttaattgttattagagagaattttcaatttcagttgtagcatgaaaaatcacagagtccatttatttctcctcttygagtcagtatatctcaaaacattttttcaacgttaatagaaatataagaagtgcctggatcagtttttgtttttgttttgtttctttttgagatagggtc

SEQ ID NO: 43282 - DNA, 201 bp, Homo sapiens
aacacatgacagtttcttgttcatatttggccagaaggaagcagtgtccattaggttgactctccagtgcttcttggtgttgtgataagcccgtctagcayggagggccagaaggaagcagtgtccattaggatgactctccattgcttcttggtgttgtgataagcccgtctagcacggagggccagaaggaagcagtgt

SEQ ID NO: 43283 - DNA, 201 bp, Homo sapiens
cgtggtcacttgcttgcacacacttgtttagatgtctctgccctgctgttaattagactgtgagcctccagagggtgagactgacatctcatttctctttkcagtcacagcagagatgcaggcccacagtagggactcaccagatgtggcagggtgagggaattgtccatagatgccttaaagatatgctatccacaggag

SEQ ID NO: 43284 - DNA, 201 bp, Homo sapiens
ttggaacaactgcctcactcctgtggccccactgtgccatagacaggttagagaacatgggccctggcatcagacctggcaggcagtcttgattaggcccsttattagggtgctctgggcaagtaagtttacctgtgccagggatgcacctttttaacccaacacttagaggggtcctccatgtacagccatgatcacaac

SEQ ID NO: 43285 - DNA, 201 bp, Homo sapiens
ccttgtgattgaaagcccaagccctgtgatccacagcaggggccacagccagaaataattccccgagaatactgcgtgtgccttcaaatggtccttgatcrtttttcttggatgccccactttccaaaggccagaaattgtttcagggagtcattccagttggggaaggttttatgttctaagagcaaggtgctgtactca

SEQ ID NO: 43286 - DNA, 201 bp, Homo sapiens
ggtaaaaataattctagatgaagatagacccgtttacattccaaggaagggaaatgttttacccaaactgtttccatggaccctgtgggttcttgttaatrctgttcaaccttgtgattgaaagcccaagccctgtgatccacagcaggggccacagccagaaataattccccgagaatactgcgtgtgccttcaaatggt

SEQ ID NO: 43287 - DNA, 201 bp, Homo sapiens
ggccctgatgtcacttcttaggctaatttctgtgaaattgtgattgggaggaaaaagtgaacaggaacttaaagccagcagaggaaagctacctgcccttsactggtggtcagtgcatggattccagagacagggtgggcaccagttcctcaccgggtcctttctagttgcatgacctggggcaggtgactttatgtggct

SEQ ID NO: 43288 - DNA, 201 bp, Homo sapiens
gtctcagtttcataatatgtgtaaaaattatcatgcccattcattatttaaagtgctgtggctttttagtgaataccaacattaacaaaccatgttaacaygatttaaaatatgtaatgaaatttgcaatgcatcagatgatggaactatcaaattagttcacgtggcgttggctgatcacccttatgaagagttacttgc

SEQ ID NO: 43289 - DNA, 201 bp, Homo sapiens
gccttcctgtctttgccacatcacgggattttctacagctcatattggttacagtgatagcagctgagatttaggctgcacctgagtaccaggcagggtcytaagtgacttcagactctatagacagtccctgacttataatggtttgacttagattttttcacctttgggatgctgagaaaaccatacacatccagtaga

SEQ ID NO: 43290 - DNA, 201 bp, Homo sapiens
aaatctgaatggcatgacctttattgatttgtaattcaacaacttcaacatcttaccaagaagaatgtgcagttattctagcaggagaaacaatgcaattrgagcctgcgagatgaaatcaaattgttttataatgagaaattagggaattcgaggcagacattagctgtgtaattgtggaaagggaagaactgtagttag

SEQ ID NO: 43291 - DNA, 201 bp, Homo sapiens
gttaaagaagtagagtaaaaatgtaaaatgtttcaaataaacacacactaaatatcttcttttatatcttataaacacccagcagtcctttagcacgggcrtcaaggtggcccagttggaaaatttcagtgacatgccatcagatttgttccatgtagaaggacgacactatcagttagatgcttattttgttggcaaatt

SEQ ID NO: 43292 - DNA, 201 bp, Homo sapiens
aaggcagaagcagcctccactgagaagcgtcagacaccacgtcagtcttgctttccattgctttgctccagtatccatttgaaattcagtgcaaacccatraattccactttgcctctggtagcagcctgcatggtgtgtatattgaacactagaaacacagtaaatccagcccatttattcacattaaccagcaaaggca

SEQ ID NO: 43293 - DNA, 201 bp, Homo sapiens
tgtgtgcccaggaaatggccaaatgttatcactcatccttccaagaaccacatgaaggttatattattatgtcgactttccagatgaggagactgaggctyagtggcttgtcataggtgtcaaagacaggagtccaatgtaaggacttctggcttcagcacaggggattttcctaccatcccatattgccaccccatctgc

SEQ ID NO: 43294 - DNA, 201 bp, Homo sapiens
tatgagcacggcatctaccgggctgttccacatcctccctgtgggactaggggccagggcaatgggaatcagtgcagaaataaagctcatgctgtttgctstgccatgagtaacgaagtcctctgtatctgatcctgggtctcctgttttctgctagcttcctcaaaacttggtagctaactcattaacttacaaggaaga

SEQ ID NO: 43295 - DNA, 201 bp, Homo sapiens
ggccgaggcaggtggatcggttgaggtcagagttcaagaccagcctggccaacatggtgaaaccctgtttctactaaaaatataaaaattacctaggcgtsgtagtgtgtgcatataatcccagctactctgtaggctgaggcaggaggcagaggttgcggtgagctgagatcgcactacttcattccagcctgggcaaca

SEQ ID NO: 43296 - DNA, 201 bp, Homo sapiens
cctcccaaagtgttgagatcacaggtgtgagccatggtgccaggcctctcctgtctttaactggggataatgtgtgcagaattccccctaaaggatctatsatgcgtaaggtggaccctcacagaaagcgtcaaagacacacgaatctcttagcaggaggccgccaggtggcacaaaatcaaaactgcatcattgagaatt

SEQ ID NO: 43297 - DNA, 201 bp, Homo sapiens
attctcagattcccagccaactggtttcacatgacaagtaaatgagcaacctggaagatgagtggcgtttccacacacagggaagcagatagttccattasgtgacagtgtgtgcacagtttatggaggatgaagcggaaaacctgagccacaaggcagtagaggttggacgagacactcattccgaaggcgggtgtgtat

SEQ ID NO: 43298 - DNA, 201 bp, Homo sapiens
ctttcccatgctattctcataatagtgaataagtctcatgagatctgatgggtgtatcaggagtttccgcttttgcttcttcctcattttctcttgccacygccatgtaagaagtgccttttgcctaccaccatgtttctgaggcctccccagccatgtggaactgtaagtccagttaaacctctttttcttcccagtctc

SEQ ID NO: 43299 - DNA, 201 bp, Homo sapiens
agctactcgggaggctgaggcaggagaatcgcttgaacctgggaggcggaggttgatgtaagccgagattgcgccactgtactccagcctgagtgagagasagactgtctcaaaaaaagagaaaagtaaagaaaagaaaagagtaagattaaaaacaagtaaagaaaataaatcctcccgctttttttgctccttcatggg

SEQ ID NO: 43300 - DNA, 201 bp, Homo sapiens
tgttgtgggagggacccagggggaggtaattgaatcatggggcccagcctttcccatgctattctcataatagtgaataagtctcatgagatctgatgggygtatcaggagtttccgcttttgcttcttcctcattttctcttgccactgccatgtaagaagtgccttttgcctaccaccatgtttctgaggcctccccag

SEQ ID NO: 43301 - DNA, 201 bp, Homo sapiens
agaaaacaaaaacaaataggacccatatccctggattgttgaggaaatacgtgaacatatgtggcacacattatagtgtctggcatacaataaatactttstaatgttactggtgtcttcttaccgttattgtctcactggtgaccgtttgaaatgttgaagctttattattacagataatggtggatatagtctcttcct

SEQ ID NO: 43302 - DNA, 201 bp, Homo sapiens
agctcaaagggagcacaattccctggagagctagggaaataatgaagtctaaggtctggcagatctggatctgaatcctggcaatgcatttcgggagttcrgtgtcaccctgagcatctttcaattccttgaacttcagtctcctcatctctgaaatggggttattatctacctgcagaggtgctgcagtattaactgagg

SEQ ID NO: 43303 - DNA, 201 bp, Homo sapiens
cctgactttctccctggtccaggtgcattttaagcatggaaggtgacacttgccattctcaatggacaaagggagtggggagtgtgggggtgtgctttggrgttagtctctgggttttcgaaacttagcattctcagattcccagccaactggtttcacatgacaagtaaatgagcaacctggaagatgagtggcgtttcc

SEQ ID NO: 43304 - DNA, 201 bp, Homo sapiens
tgctttagaaaacatctggctgggcatggtggttcacacctgtaatctccacactttgggaggctgaagtaggctgaagtgggaggatggttagagcctakgagttcgagaccagtctgggcaacaacgtgagatcctgtctctacaaaaaataaaaaaaattatctgggtatagtggtgtgcacctgaagtcccagctaa

SEQ ID NO: 43305 - DNA, 201 bp, Homo sapiens
tccccatttgttgtttttttgggacccagggtatcagtcatctgatcattgtgtgactttctcaaggacctttacttgagtcttgcacctctggtccacartgtccacataccagcttgatggtgacttgtgtcattctccatccccttgttaagagaaaatctactttatgagccctctttccaaccgcagtgttgagga

SEQ ID NO: 43306 - DNA, 201 bp, Homo sapiens
actgcattgactcctgttttctacacagtggtcttcagctacaccttaccaagcaccccttacccagcaaacgtggcttctcttccccaggcagagcagtycgttacttagactaggaaatggctccgagaagctcacccatcaccatttgctctactgcaaaacaggactcattagcaggagctcataaaatgaaactgg

SEQ ID NO: 43307 - DNA, 201 bp, Homo sapiens
tgttcaagactgccctgggcagcacagtgagaccccgtatctacaaaaaataaacaaacttagccaggtgcggaggcattcacctgtattcctagctactyaggaagctgagatgggaggattgcttgggccctggacgtcaaggctgcagtgggccatgatcgtgacactgtactgcagcctgggcgacagaatgagacc

SEQ ID NO: 43308 - DNA, 201 bp, Homo sapiens
gggggatctcagcagcacactacaatatccactacagtttcttgggcttgctctgaagccatgcctctctaacttcagggtatattcatgtaagtgaggtrcagggatgggggaaagggagaaggtaaagctacaaaggtaagccagcttgtctagaccgggagctagctccttgtgaaggaatggcaatgataatggtta

SEQ ID NO: 43309 - DNA, 201 bp, Homo sapiens
gccggatatagtgcacatggtgaacacataaataatgtttgttggccaggcgtggtggctcatgcctgtaaccccagcactctggaaggctgagtcagaasgattgcttgagctgaattgttcaagactgccctgggcagcacagtgagaccccgtatctacaaaaaataaacaaacttagccaggtgcggaggcattcac

SEQ ID NO: 43310 - DNA, 201 bp, Homo sapiens
ttgtctccatcgctgtctttactggtgtatgcccatgaggtatgtcaaagtctgtatgtctttgtaataatgctggatcatttgtccaccttcagagacarctgaagacagttttaagtgaaaccacacagagggcatataccattgggacaagaggtctgaagtctatttttgagaaagagaagagatcaagtagttaac

SEQ ID NO: 43311 - DNA, 201 bp, Homo sapiens
gttttactccttgtctcacattcctttctgctacttctctttggctcaccaaaaggagacagaagtttgtgtccatggctgtgaactgccaaagagttgcsaattctctacgatctttgacctctgtgatcccaggggcaaggccagcactttccattccattagacttcattctcttgtgggtgctttctgctggaatct

SEQ ID NO: 43312 - DNA, 201 bp, Homo sapiens
tcccttccaccatgattgtaagtttcctgagacctccacagccatgccaaattgtgagtcagttaaatctctttgctgtataaattacccaggcttgcatrtgtctttattagtggcatgagaacagactaatacagtcagggatgctgcagaacatctccaaacacacaggactcccaccctctacttccaccccaccaa

SEQ ID NO: 43313 - DNA, 201 bp, Homo sapiens
aaaattagccaatgtggtggtgggtgcctgtagtcccagctactcgggaggctgaggcaggacaatggcgtgaacccaggaggcggagattgcagtgagcygggattgtgccactgcactccagcctgggtgacagagcgagactctgtctcaaaaaaaaaaaaaaaaatagtagattgtttgcctcagttgggaaaaaat

SEQ ID NO: 43314 - DNA, 201 bp, Homo sapiens
cgttttactccttgtctcacattcctttctgctacttctctttggctcaccaaaaggagacagaagtttgtgtccatggctgtgaactgccaaagagttgycaattctctacgatctttgacctctgtgatcccaggggcaaggccagcactttccattccattagacttcattctcttgtgggtgctttctgctggaatc

SEQ ID NO: 43315 - DNA, 201 bp, Homo sapiens
agaaagtataattctttttcttctaactggagatataaaaatcatataagcatgatttatgatttgattggaacattgtattttatggttgcagagcacaygtatcatcctatctgcttctgacacccagtaagcagctctggcttttataattttgatgaaagaagtttcccaacagtatttcggtgtgcatgctcacac

SEQ ID NO: 43316 - DNA, 201 bp, Homo sapiens
atgccagatgcagtgcctcatgcctgtaatgtcagcactttgggaggctgaggcaggtggatcacttgtggtcaggagtttgagaccagcctggccaatayggcgaaaccctgtctctactcaaaatacaaaaagttagccgggcgtggtggcacgtgcctgtaatcccagctactgaggaggctgaggcaggagaattgc

SEQ ID NO: 43317 - DNA, 201 bp, Homo sapiens
tggtctcgaactcctgagctcaggcagtctgcccgcctctgcctcccaaagtgctgggatcacaggcgtgagccaccgcgcccagcccatgacttctcttyatgggagagaaaggccaccgagatagtaagtggacatcaggacatggattctattaaatctaacacctttatctttgcatttccatacattttgcttatt

SEQ ID NO: 43318 - DNA, 201 bp, Homo sapiens
gctttaaaaaaaaaaaaaaagggcaaggggaggtgtgagaagaaagtataattctttttcttctaactggagatataaaaatcatataagcatgatttatsatttgattggaacattgtattttatggttgcagagcacacgtatcatcctatctgcttctgacacccagtaagcagctctggcttttataattttgatga

SEQ ID NO: 43319 - DNA, 201 bp, Homo sapiens; identical to SEQ ID NO: 8542

SEQ ID NO: 43320 - DNA, 201 bp, Homo sapiens
cttgaactcttgacctcaagtgatccacccgcctcggcctccgaaagcgttgggattacaggtgtgagtcagagcacccggcctcaaagtgactttaacarcaacttaaaggcggtggctagctctgccccattcagtatggtagccactggccatgtgtggcagttgagtgcttgaaaggtagttagtccagattgaaat

SEQ ID NO: 43321 - DNA, 201 bp, Homo sapiens
cagggtttcaccgtgttgcccaggctggtctcgaactcctgagctcaggcagtctgcccgcctctgcctcccaaagtgctgggatcacaggcgtgagccascgcgcccagcccatgacttctcttcatgggagagaaaggccaccgagatagtaagtggacatcaggacatggattctattaaatctaacacctttatctt

SEQ ID NO: 43322 - DNA, 201 bp, Homo sapiens
aatcaagtttctttcagtcatgtatgatccattgggctttatataacttttagcctttgctttgcagggacagcaaagatgtgagcaaatttgtgcaaacytaatagggtgaaaaattgaggtatgaattagtaaagtcatttgtccttctggaaagagttatggattaacagattacatttgggtatattgtggttgtga

SEQ ID NO: 43323 - DNA, 201 bp, Homo sapiens
taaggagcagggggccccttccatccgtagagggcagaaaggtgcctatcatgtcttcagtgtcagtgccctggtatggagctagctggccttccacaggktctggagttaatgctggagagaagtaggggtggcagagcctaccctgtgttcctaggggggttcatctggagctagtccctgacccttaggtggaagatg

SEQ ID NO: 43324 - DNA, 201 bp, Homo sapiens
aacgcatcacaagtcacagggcttatctccattgttctgaacgatctgtagctaaacaaaaagataaaagctattaatattattaatagttgtagattacmgggaagagcgcatcctaaatcagccattagatttgttcctcatttctttgctttacaaattgtttttctgtatagtattggattttcaataaataaagta

SEQ ID NO: 43325 - DNA, 201 bp, Homo sapiens
ggaattccatgcaatctcctttgacactaaaagcttaagtcccatgatttgcctttgtggatggaaggccttggccttcttttatgatatatgtgttgggsggaggcatgtggtatgtggggcgggtaaaatacgagcctcatgcctgtctaagctggtgacttggcttggaaaagatgatcattcgtcaacgcatcacaa

SEQ ID NO: 43326 - DNA, 201 bp, Homo sapiens
tcaggcactttatatccctcatccaggaggatgcaaaaacctggtgtttttcttttttttttttttgcattttccagacgagccaagggatggctcagaarggtgaaggaactcacccgaattgcacagctggtgagctcagagtcaggctccttgcttggtccatctggcttccaaactccaagtctgtctgctccaccc

SEQ ID NO: 43327 - DNA, 201 bp, Homo sapiens
tgaagggacttggggctcagagaaatgaagtaactcagctaagtctgtacagtacttagccaggggatttagaaatccacccagggatggctccagttgcmtgtttcttttcatttgacacgggatggcctaatgggtccccaccaggggtggcttggaaaggagaaagcaactgcattcccactggaaggtgttctgtag

SEQ ID NO: 43328 - DNA, 201 bp, Homo sapiens
aagtcctcaagaagaaaaatttaaggagcaaatatgtgagccaggatctcatgctggactatctaagcaagcatgtaggaagagtttgtttcttcctgctrtggccatagaggtttggttgtcactatgaagaatgggcctgtgtttttttttaaaaatatgctgatctgggtgaggtcacattttgctattctcagtgga

SEQ ID NO: 43329 - DNA, 201 bp, Homo sapiens
gtcttaacttttcaaaaacaggacatgggtgatcaagcagcagtatatctctttactccttgtattagtccattttcacactgcttgataaaaacataccstagcctgggaagaaaaatcggtttaatggacttacagttccatattgctggggaagccttacaatcatggtggaaggcaaggaggagcaagtcacgtctt

SEQ ID NO: 43330 - DNA, 201 bp, Homo sapiens
gttaaagtcacactggaaggatatatattgaggctttatctctgccatggtgtcagcatcagtgaattaacacagggtgtcttaacttttcaaaaacaggrcatgggtgatcaagcagcagtatatctctttactccttgtattagtccattttcacactgcttgataaaaacataccctagcctgggaagaaaaatcggt

SEQ ID NO: 43331 - DNA, 201 bp, Homo sapiens
ctgcgggtgtgtgagccaagggggccctgtgacccttgaaatagaaaagggggaaatggctgcatgccaaccgaagagaccactgcattgttggccataartgaaactagtgagatgtgtgggatatcataaaaagaacattgacataatccttttttggatgaagttatatcacaaccagaacacacaatgaccagcagg

SEQ ID NO: 43332 - DNA, 201 bp, Homo sapiens
aggcacctgccaccacacctggctaattttttttgtattttagcagagacagggtttcaccgtgttgcccaggctggtctcgaactcctgagctcaggcartctgcccgcctctgcctcccaaagtgctgggatcacaggcgtgagccaccgcgcccagcccatgacttctcttcatgggagagaaaggccaccgagatag

SEQ ID NO: 43333 - DNA, 201 bp, Homo sapiens
gcctgcctcagcctctcacagtgctgggattacaggcgtgagccaccgtgcccggcctcatatccttttttatggaaaaaaaaaatcgggaattagcgtgyagctattaggcgtagattcctgcctaaggtctggatatgaattccaaagaccactggactttggaatattcgtaggtctctgaaaattcagacccacaga

SEQ ID NO: 43334 - DNA, 201 bp, Homo sapiens
tgtagttcccgcaaatctatttacggttttcacaaggaggtcacgaacatgcgttgttttcaatgctgggctagtttcagacttctggcttgttgtgggayggaggagaaagaagacagggcattttgatgtggcccagagaccaaatgaaacaaacgatcctctgattgctcagatgtcctctttgacttggaaagcacc

SEQ ID NO: 43335 - DNA, 201 bp, Homo sapiens
gagctgagtgattttagtaggtagtttaactccttaaaaacttccagtggtttcatattctacctagttttaggtgacagctggtatggggtggggaaggrgggggggataaagatattaatttggaagcatttgattgctccattattttatcatcttcccatggaaatgttttcataacgcgttgttttttaattatta

SEQ ID NO: 43336 - DNA, 201 bp, Homo sapiens
ggagctgagtgattttagtaggtagtttaactccttaaaaacttccagtggtttcatattctacctagttttaggtgacagctggtatggggtggggaagsggggggggataaagatattaatttggaagcatttgattgctccattattttatcatcttcccatggaaatgttttcataacgcgttgttttttaattatt

SEQ ID NO: 43337 - DNA, 201 bp, Homo sapiens
ttcaggttttcaatagagttgatatcgggtctatttattttgtgggagtgaagggatagggatagtactgacagcattatgtgattgcagcctcattgatwagcatcggaaataatgactttaacattattttcagatagggagcactcagtaccaaccattatattaggctcatgggctcaacattttgctgtgcttttc

SEQ ID NO: 43338 - DNA, 201 bp, Homo sapiens
cattcttcttaaaatacggagcgacataattaaccctctggggagactaatattagtttattagagacaatttctagttctgtttatttttaacactaaaygatttgttcagattggggaaaaaaattttttttttttttttggttgtggtggcgttggcttttacttggggttgacctttccttatcaaggacatacaag

SEQ ID NO: 43339 - DNA, 201 bp, Homo sapiens
aaggaggtagggtagagtgggagcagatggacctgatgtcatccatctccctacgttgtttgcaggaggaaaagggatgaggctgaggctgggaggcaggsgcggtggattgagagagaggagagggattgttatgagtaaccaatgttcctcatgcctgccaggccctcactagatctgtttaacagagagtgcagaaga

SEQ ID NO: 43340 - DNA, 201 bp, Homo sapiens
acaaaaagttaaatcatctgccctaggtcccagagctggaatttgaaccaaaggttctgtgcctcccaaatttgtattcttatctctgcatcacactaacwctgtcactcagtccttttctcactgctctggtctctatacttagagcttcgagacctgccactcagatgactccagaagaaaacacgctttggtgtcgtg

SEQ ID NO: 43341 - DNA, 201 bp, Homo sapiens
ctatgtgttaggaatccatgtgagttctctaagtctgggacaacgataggtgtgtctgagtcctgcattaccatggtttattctttcctttacccagtatstattggagttgggcttctgttgctttatttctcggggtctggcatatcccactccctgtcttgagatctcaggacctctgaggggcattgcatgtaaaga

SEQ ID NO: 43342 - DNA, 201 bp, Homo sapiens
atttaatacccattacctacggaggtggtttctactattgcacccactctacagatgagaaaatggaggcacaaaaagttaaatcatctgccctaggtccsagagctggaatttgaaccaaaggttctgtgcctcccaaatttgtattcttatctctgcatcacactaacactgtcactcagtccttttctcactgctctg

SEQ ID NO: 43343 - DNA, 201 bp, Homo sapiens
tgtgaagtcgtaaggccttcttgctctggtgacatctgttaggcttcgtctctatatcatcccccaactccttgacccttgatatttgctggtctacttcmcttcaggtccttcctcacctcacatctctgcgcaaggatttcatctggtatgtcactaaatattaccttcctgtgtttctcaaggtcaatttgatagact

SEQ ID NO: 43344 - DNA, 201 bp, Homo sapiens
gctgtgagtaaatcagtgtgttccttatacttaataacatactaagtggcaataataattattataacaaatgtatcaaataactatgtgtgaactctgcrtgtttcagcccatttaatacccattacctacggaggtggtttctactattgcacccactctacagatgagaaaatggaggcacaaaaagttaaatcatct

SEQ ID NO: 43345 - DNA, 201 bp, Homo sapiens
ctgaagaaactcaacctgttcatcatctctcatcttttcacttgttctctgtgtatgccattatattgtgttcctcattttcccaagatgatgattatggwaactcaaattttgcaccagaagctgtagttaccatttcattccattgcaccattcataccctgcagagaggatgtgaagtcgtaaggccttcttgctctg

SEQ ID NO: 43346 - DNA, 201 bp, Homo sapiens
aaaagcttaggctcaaagagattaaatgtcttatttctgcttttggaagatacacattttatttttttctgtgtctctgaattggcatccaaccataatcrttgtgctaatttactgtattcttactctccctctccagtgctgtgagtaaatcagtgtgttccttatacttaataacatactaagtggcaataataatta

SEQ ID NO: 43347 - DNA, 201 bp, Homo sapiens
ctaatacacgtggctccagatgtttaaaattagatttgataggttgtaggctgaagaaactcaacctgttcatcatctctcatcttttcacttgttctctstgtatgccattatattgtgttcctcattttcccaagatgatgattatggaaactcaaattttgcaccagaagctgtagttaccatttcattccattgcac

SEQ ID NO: 43348 - DNA, 201 bp, Homo sapiens
taaataagtcaaacaatatgaatatataagaagaaaacgctcgtaatttatgctctacctcttccctttgctaagtggcaattttggaccttctgtgaccrtgcaaacatgcagattatacatgcactataggagtggaatgtatgtgacttaatagcgtaatattttgtccattattttaaaacttgctttatttggtca

SEQ ID NO: 43349 - DNA, 201 bp, Homo sapiens
cgagtcattttcttttttcttttttttctttttcttttttattttttttttgagactgagtttcactctgtcaccaggctggagtgcagtggcacaatctygactcactgcaactttcacctcctgcgttcaagcaattcttctgcctcagcctcccgagtagccgggactacaggcacgcgtcaccatgcccagctaatt

SEQ ID NO: 43350 - DNA, 201 bp, Homo sapiens
tatgtattcttccagaaaaaggttatctatataccagcaaacacactcacattctgttctgtactttttttttttttaaacttagtactgcaggagatctsttattagtgcatatagatctacttcattgttttaactgctgtataatattccatcatgtgcttatgctataaccagtcttccctttggtggccatttagg

SEQ ID NO: 43351 - DNA, 201 bp, Homo sapiens
ttaattttttttttttaattatactttaagttttagggtacatgtgcacgttgtgcaggttagttacatatgtatacatgtgccatgctggtgcgctgcasccactaactcgtcatctagcattaggtatatctcccaatgctatccctcccccttccccccaccccaccacagtccccagagtgtgatattccccttcct

SEQ ID NO: 43352 - DNA, 201 bp, Homo sapiens
tgaaattcagtatatttgaaatgagcccttatcttgagctcactgagcttattattttgggttaaataaaaaagaaaacagagtcttactttttctgatcmttttattgtctttctgactaatgttaaaaagtagtaacctctagtaggtgggatttttagggatgtattgagaagagtacaaatgggaatacgtgcatct

SEQ ID NO: 43353 - DNA, 201 bp, Homo sapiens
ggacctttcatggaatccagggcttgagctttaatgctttacacttttgttttttcattccatacgcttttgctttagcttcctggcaaaattcagacaamcctagaagggataataacttacattcaacctctgcttgctctgtcctttctcacacgtgtttagagaaactggaggagcccgggaactgctttctcctct

SEQ ID NO: 43354 - DNA, 201 bp, Homo sapiens
attcatttaagataatgaagctcctgtccttgacccaatctccactctaccgtttgatgtccagtgtggactgcccctctgaaagcccttcactgcggctyagcctgtggtggaaggtgtccaaggtggctggaacacctcctgctgggggtgtcagtcttggctctcctgttttctgcctgtgcaatggtgggtaggtcc

SEQ ID NO: 43355 - DNA, 201 bp, Homo sapiens
acatcttgaatgcttctgtgtcattttcctttctttttttttttcaaagcacttaattatttaaaaacaaaaatacttctctgatcagagcatacctgccrtgctcaaagcacttgcttacttggaatgccataaattacatgaaggaattattcattgtatcacgaaacataccttccagtctcccgagtagtgtattag

SEQ ID NO: 43356 - DNA, 201 bp, Homo sapiens
caaattatgaaagtaaggtgggaaggcaatgaaggcaacaaagtatataaaacacacacacacacacacacacacacacacacacacacacacacacacayaagaaatgactacagacacctcaacacccttccaaaacacttgaatcattttcttcgggagttgaacaagtggctgaaaatgccaaaatccatcagccaa

SEQ ID NO: 43357 - DNA, 201 bp, Homo sapiens
aagtgctgggattacaggcatgagccaccatgcccggcccccttttttaaaaaacaaaaaaacaaaaaactcttttgtgttttagaaatggggtctcactmtgttcttcaggctagtcttgaactcatggcctccagtgatcctcccgcctcagcctcctgagtcactggaatttcaggcatgagccactgtgcctggcct

SEQ ID NO: 43358 - DNA, 201 bp, Homo sapiens
agaaaatctggtgtagtggcttagctagcataacttttgagaggtctctgtgtgatggtcttttttaatgtctttcgtgaagaattcttcttttttttttytgagacaatgagttgttctgtcactcaggctagagtgcagtggcgtgatcatggctcactgcagtcttaacctcccaggctcaagcgatcctcctgcctg

SEQ ID NO: 43359 - DNA, 201 bp, Homo sapiens
cgcctcctgggttcaaacaattctcctacgtcagcctcctgagtagctgggattatagtcacctaccaccatacccagctaatttttgtattttttagtaraaacagtgtttcaccaggttggccaggctgctctcgaactcctgacctcaggtgatctgcccaccttggcctcccaaagtgcagagcaggaatttcattg

SEQ ID NO: 43360 - DNA, 201 bp, Homo sapiens
ttatttatttatttatttatttatttatttatttgtttgtttgtttgtttgagatgagtcttgctcttttgcccaagctggagtgcagtggcatgatctcrgctcactgcagcctctgcctcccgtgtccaagtgattcttctacctcagcctcccgagtagctgggattacagttgtgcaccaccaggctctgctaattt

SEQ ID NO: 43361 - DNA, 201 bp, Homo sapiens
taaatggcagattatacaccggagttactgagaaatataaaaaaaaaaaaagcccacattttaaagggaatttggtatttttaacaaagcatcagggggcygggagcagtagctcacgcctgtaatgccagcactttgggaggccgaggcgggcggatcacaagatcgggagatcgagaccattctggctaacatggtgaa

SEQ ID NO: 43362 - DNA, 201 bp, Homo sapiens
atttccatgttctccgcacagtgcggagctactgcgggtgtgtgagccaagggggccctgtgacccttgaaatagaaaagggggaaatggctgcatgccarccgaagagaccactgcattgttggccataagtgaaactagtgagatgtgtgggatatcataaaaagaacattgacataatccttttttggatgaagttat

SEQ ID NO: 43363 - DNA, 201 bp, Homo sapiens
tttccctatgttgcccaggctggtctggaactcctgtgctcaagccatcctcccacctcagtctcacaaagtgctgggattacaggtacaagccaccatgycaggccattggtataccattgtttttcttaaacatttatttattttcttatatttacagcatatgtggtcatttaaaattattttatagcatataaaagt

SEQ ID NO: 43364 - DNA, 201 bp, Homo sapiens
agatgcagagtcttcatcttgttgggctgtgatcaagtacatatgctccccagcagttctttgagatttccatgttctccgcacagtgcggagctactgcrggtgtgtgagccaagggggccctgtgacccttgaaatagaaaagggggaaatggctgcatgccaaccgaagagaccactgcattgttggccataagtgaa

SEQ ID NO: 43365 - DNA, 201 bp, Homo sapiens
cacttagtgttccctagtcatgacatacttctgtgttatccttaaatactgaaacagggaccttattcttaacagtagaaaatcactgtgtatgatgatartgtatacctgtaataccagctactcaggaagctgaggcaggaggatcccttgagctcaggagttgagattagcatgggcaacaaagcaagaccttgtctc

SEQ ID NO: 43366 - DNA, 201 bp, Homo sapiens
gtcatatgctgtgtcaggcactttatatccctcatccaggaggatgcaaaaacctggtgtttttcttttttttttttttgcattttccagacgagccaagrgatggctcagaagggtgaaggaactcacccgaattgcacagctggtgagctcagagtcaggctccttgcttggtccatctggcttccaaactccaagtct

SEQ ID NO: 43367 - DNA, 201 bp, Homo sapiens
gccaagaacaaattaacccagggcaacaagaaacaatgactaattagaccctaatgaagtgctgcggtactggcgtccttccagatttgacttgtaatcgmcacaatgtattacagatgcagagtcttcatcttgttgggctgtgatcaagtacatatgctccccagcagttctttgagatttccatgttctccgcacagt

SEQ ID NO: 43368 - DNA, 201 bp, Homo sapiens
aatttctatataaagtgcttagcatagtgcctgccacttagacctcaaaatatattgttttcattggataattaaatataaaataacatacagcatgatgrttaatacaactaataaatagtgcattagtattataggcacaaaagacagtatgaagtacagcacagatcatgaggagggtagggtcagttctacgtaaaa

SEQ ID NO: 43369 - DNA, 201 bp, Homo sapiens
ctcctgtatctcagtaggcactgttcaagcatttgaacttcatcaagtatcaagacaagtctaagagaaggtggggagagaccatcagggcctaggattgsaaaacctccaacgcaaaatagagatgtagttttagcgtgctgcccaatattaaaagattgtataaatgaggggggcacacttcctgatatgttcgttatg

SEQ ID NO: 43370 - DNA, 201 bp, Homo sapiens
taaaatgttgcctcctgtatctcagtaggcactgttcaagcatttgaacttcatcaagtatcaagacaagtctaagagaaggtggggagagaccatcaggrcctaggattggaaaacctccaacgcaaaatagagatgtagttttagcgtgctgcccaatattaaaagattgtataaatgaggggggcacacttcctgata

SEQ ID NO: 43371 - DNA, 201 bp, Homo sapiens
accattgcttcaaatcccgacctctccagttctcctggtttcttgttaggcgggaacttgggcttctttatcagtgactggggtcagttcttgtactcaayttcctatctctgtgatctcttgtaagatgctgcattgtcaaatggagaaaacattgtctttgagttgttaggagccttgagtgagatggtatgcaaatgt

SEQ ID NO: 43372 - DNA, 201 bp, Homo sapiens
cacacacacacttttaagcatttttgatttatatatccctctgcatattttgtgccttgtgatgtgtttaacgaatgacagtgtctttagtgcattgctayttggggtttctacactggaagtgtaatccgaggccttggaattggtcaaacaaaactcacttggcaacatttacttagagagcactctgcgagcactctg

SEQ ID NO: 43373 - DNA, 201 bp, Homo sapiens
ttagcaaatcacgccttattcctaggcagacttcttgggtacactttccaccctccccagcagtaatgcctgaccaactaatggaatcctaactaatgcartatgtgacgcctggcagctccagtccgaaccaagggaaaacctgcaaacatgcaatccttcatgcttttgtttttgtttttccttcagcctagctaaaat

SEQ ID NO: 43374 - DNA, 201 bp, Homo sapiens
tccaaaagtgtagcattaaactcagagatgtaaaacaacgtgtctaaatgccaggtaagcaatgcttacttgacttggaccagggtggtgaatgaacatamaaaccgattacaacatttttccatttttatgtttcctctgaaaccagccatgagaggtactcttagcaaatcacgccttattcctaggcagacttcttgg

SEQ ID NO: 43375 - DNA, 201 bp, Homo sapiens
aacccactttatttggactaaggtttctcaatgtgtgttcagttctggctcatgcttggcacttacatttgagccatattcagtagtcccagccttacttrttcttttacaaaaagggtcagcagactttctgaaaagggacagatagtaaatattttaggctttgtggaccatagggcctgtgtcaaaagtactaaatgt

SEQ ID NO: 43376 - DNA, 201 bp, Homo sapiens
ctttattagtcaggggtttgagaatgtttcttcctttaactcatttattaagaaaaataaaacgtggtgaacgcccatgattgcaactaggagactgttaygcttatggttgttaagattagaaagaaggaagctttaaccctatctctgatttcttacttttctctgtctatgtagaagttgatgttgatacgtgtctac

SEQ ID NO: 43377 - DNA, 201 bp, Homo sapiens
ttgcttttattaggtgggcataattgcattcatgggatcacctacaaagtcctttcgaatataaaattgaaatggcttcacactcagtgcacaagtccttmtgaggcactgttttccccttcgctgcctccggttccccttttgctgtgaagttcacattgaagtgtgaaaagagagacgtggcaactgacacatgctgga

SEQ ID NO: 43378 - DNA, 201 bp, Homo sapiens
atcagatttcttttggcccgtgttatacagtataccttttctattcttttactttttttatgcttatgtttaaataaggtataaaacataatgtacattcktttttaaggacagtatatgtatatttatgttttcttcagtctgacaaactttttcttttaattgccatctttaggccatttatatttaatgtaatgacag

SEQ ID NO: 43379 - DNA, 201 bp, Homo sapiens
ctttaggagtgtgtttttgccctccctcggaatctggtgatctcactaccaatggcaaagacaaactgtgaggtgtttttttgtttgtgtgcacgcgcacrtatgtgtgtgtgtaaaaaggccatggaaatataaaattgtaacctaaatgccttcacggccagttatggtggctcacgcctgtaattccagcactctggg

SEQ ID NO: 43380 - DNA, 201 bp, Homo sapiens
tggcaactttttttgtagtgtttttctaggaatttgtcttttttacctgtattgtaaattcattggtataaagttgttcaccatatcttaagatcttcttwgggttcataggatctgtagtccttttctttatttttcatttttaaaaacaactttattgaggtatgattgacgtacaaaaagcctcacgtatttgatgta

SEQ ID NO: 43381 - DNA, 201 bp, Homo sapiens
tcaatgagtttcataccctaaattatgccagattaagaaaatgaaatctgactgtaaattacttctctaggagcaaatgattgcttgattctattgtagamaataaaaattttttacttaaaccacacaaattaaaaaatggaactcactttcacagtcaagagttacttctatttttttttacagtaaatgcgctcttta

SEQ ID NO: 43382 - DNA, 201 bp, Homo sapiens
gaaagatattcctgatcattgctttgacctggaaatttcaaagggacccacagtccaccattccgtccaagatcttctgggtgtgtgaagtcccgggctcmcaaatgcagttgtgtttggtcactgtgttgcttgcatatggctgttggcatctcattagcctgattgatggggcagatcagtcagcaagactttgttcgg

SEQ ID NO: 43383 - DNA, 201 bp, Homo sapiens
acagcgggcttgatgggcccagaaatcaagatggaaaaaaacaaccctctatgttgatggccatgcacagtggctcagcagaactggctctgttgaccagkcttgggtgctctcctgcagggcattgcaatctttaggacaccttcattacccctcctaaaaggagattttataatgagcgccaaccagctcaaacaagtt

SEQ ID NO: 43384 - DNA, 201 bp, Homo sapiens
aatgctgctttatggtatttgtgatatatcatgtgaatatacttgagggtcatgagaagttcatatgtgtgtgtgtagtgtgggccccagactttcgccayactgctggctaaagtggccatgtttttgtacgtctctgcagagcttacaagttattcaacagccagatttctattctgatatgcccttttagttttcaaa

SEQ ID NO: 43385 - DNA, 201 bp, Homo sapiens
ccaaaggtctgagaaaaaaaaaagcctttcaccatggttagttcgagaagcacagcaatacagtacttctgctacgagtgtatacaggctgaggatgggtsctttgtggcccttttcttttaccggctgactagaatgttgacgttaaagcagttagagtccgagcaggcaactccgaccccaagttggagctgtgtgttg

SEQ ID NO: 43386 - DNA, 201 bp, Homo sapiens
gcctaaatccacaggctcccgctgcctacagaggagtcccacagttttcgcttgcttcatggagcttcatctctgttgtattcatgtgatttatttacacrgagttgctccccaatccttgatctttttttttttttttttttttgccaagcaccctgcctttttgcttgtctgtttcgtctttatctctccttccagtaa

SEQ ID NO: 43387 - DNA, 201 bp, Homo sapiens
gggcttttccaggccttaatttctctgacacaggaggatggaattacattatttccaccacaaagattgtgttttaaatccttcttagtttgcagcttttyttcccttttgcctcctctttagttcattccaatgataaatcctccctcctttgtcacagagccactgtgtactttcatagaccatcctatttttcaacga

SEQ ID NO: 43388 - DNA, 201 bp, Homo sapiens
aagtttgcccagatagtaagttctactagacatgtcaattttttctgaggtctaatcttgatttttttttcctgcacaatatggaattcagtgtttttatktaatcattcagtaagtcttgactgcctgctatggaggttaagccctttactaagttccaaggatgtacctgtgaataaggcaagttcctttttatcattg

SEQ ID NO: 43389 - DNA, 201 bp, Homo sapiens
ttgtatcatctgaattatttccatatccataatgtgcaaggatatccttccatgttattagaaatacagatacaccatcattatcagtggccaaatcattmaaatcgctgtttgcttcttctcgggctcttattcaagctcacgatgctattctcatagtgattgcgaatctcactgcataaaggtgattttgaaaacatc

SEQ ID NO: 43390 - DNA, 201 bp, Homo sapiens
tacctctgtgggagctttgtcagtatttgaggggacagggttcccaccttcatgttttttgtgcctgaggattctgtgggcgactgtccccacctgtccarcctaccagtgagtctcatggtgtgcggctgcctgctccgatgctctccaccaccatgcccaagccatttctccctttgtgttccctgtctgggtaaacaa

SEQ ID NO: 43391 - DNA, 201 bp, Homo sapiens
cctctgcagggtgtctgtgggcatggtttgcaaataaacagtgagaagtataagctaaacatagactttaggcatatacataataggcaggcgtgatcgcrttcacccattcagtttgccatataaaagcttttcctcggtgccactttatggcccagaaacaaggctacaaaaactttaatactgctttttattttatag

SEQ ID NO: 43392 - DNA, 201 bp, Homo sapiens
cactcccgcccgggtgacagagcgagactccgcctcagaaaaaaaaaaaaaaaaaaaaaaaggaaccagatggccctgcccttgagcaggctgtggtctgkcctggtggagagacagagaatcagttaattccagggtcatgtattaggtagtaagatagtggttcacaccaaaaacatagaaaatgatcacttagcctga

SEQ ID NO: 43393 - DNA, 201 bp, Homo sapiens
ccccaactcctttgggcgtcttaataaaaatgataattaaaaccataatttacagtaaatggggacactgcccaagtacatccacaatatggagaaaattwaaaaacttaaaccagaaggaaccttcctggcatcggggaaagaagctgcctttttcttagctcctacctctgtgggagctttgtcagtatttgaggggac

SEQ ID NO: 43394 - DNA, 201 bp, Homo sapiens
gcacgatctggcttacgatgatttctaacatctcaccatctttacttctgtatataaatatatgataagtatacctttatatatgtgacatgtatctttayatatgatatgtatggttacatatctactcactcacacatccacacacacacacacacacacacacacacacacacacttttttggaaccattgaaaagtt

SEQ ID NO: 43395 - DNA, 201 bp, Homo sapiens
gagaagacagtggattgtttctctgggtggtcaaggaaggcttccaggcagaggaggtttggccatgggtaccaaggggtagagatgggaaccttccaggkacatggacccgatgctgccagcagaggggaaaccatggccctaagggcagagcacactggggcgggggtgggggttcagtgacagtctggtggcctgtgt

SEQ ID NO: 43396 - DNA, 201 bp, Homo sapiens
tcaggctctcaggccctatccacagatgacctcacaacatgactgttggcttcttcaagactgaaggaggctcccccatgctctgagtcactctcttcagygagggcccagccccttttaagggcctagcgattagatcagtcccacttaggattgaatcccttttgattaatgcaaaaccaactgcgttcaggcctccat

SEQ ID NO: 43397 - DNA, 201 bp, Homo sapiens
taagacctgtgctttttcatataaattgtacaatatggttgtctatgtctaccagaagccttgctgcagttttaatggggtttaaatctataggtctaacrttaaacctatagatcaattcgggagaattgacatctttactatgttgagtcttccagtttgtggacatggtatgtaattctatttatttagtataaaccc

SEQ ID NO: 43398 - DNA, 201 bp, Homo sapiens
tgagatcttgttttttaaaacaaaaaaaagtttaagaaattgtcatataggctgggcgtggtggctcacacacataatcttagcactttgggaagttgagkcaggagggccacttgaggccaggagtttgaaaccagactgggcaacacagtgagaccccacctctacaaaatattttaaaattagccaggcgtggtggtg

SEQ ID NO: 43399 - DNA, 201 bp, Homo sapiens
ctctcctcacccactctgtttcttttcttttgagcacttaccactttctgaatatgtatacaattgtttcctcgattactgtctgcctcttcttccctagrgcgtcagcccatgagcttatccagcctacagaggagatgctgcagcttggcagagcatggattgctcaacataccagagtttagtcctacctctgtctcc

SEQ ID NO: 43400 - DNA, 201 bp, Homo sapiens
aggaacaagagagagagaaagtgcatggcaaagacccatcattgatgagtgactggatgtgaggaatggagcaggggagatgctgatgatttggttacccscttctccatcccccaccacccactgatgttattatccagtaaggaccaggagagaagaagagatttaagaagaagacaatggctgtggtttgatgaagat

SEQ ID NO: 43401 - DNA, 201 bp, Homo sapiens
aggataaaatcctatgcagtttacagaaatgtaaactaagtgcttcgttaaatgaatcctagatcccgtgccttctgactgggtgagacctcccagcaggsgttgccagagaacttacacaggagcgtttctgctggaatcagctcgatgcctcttgaggacagagactcccagaggaaggagcgggcagccatccttgct

SEQ ID NO: 43402 - DNA, 201 bp, Homo sapiens
gctttaaggagaaatattttgttgggacacagaagttagactgcaagaaggagaagattggattcagggcaggaaatcagtacaacttgcagtagtccacrtgacagttacgcaaaggcctggtctgatagaggaacaagagagagagaaagtgcatggcaaagacccatcattgatgagtgactggatgtgaggaatgga

SEQ ID NO: 43403 - DNA, 201 bp, Homo sapiens
ccagccttttgctattgcaaattgtgccgcaacgtgtaaccttgcaccgacatcgcttcccacgtgcatgcatgtatttgcaggattgagtcttagaaatmgcagcatcggctgagagagtatgcactccggtcgttttcatagatattgccaaattgccctctacggaggttgttctgatttacattcccactaagcaac

SEQ ID NO: 43404 - DNA, 201 bp, Homo sapiens
ttgctatagataccaaactccacaatcagtaattagagcgtgccccctgccccagaactggtcaaacggtgcagagcgctcggcaaatggtcttaaaagcrtccgcgcttgcatggaaatgcatttccaatggtgacggggtttgttttattcatggactttttgaaaaaaaaatcactggtttattggaaaccatagaga

SEQ ID NO: 43405 - DNA, 201 bp, Homo sapiens
tctaggctcattcatacaccagttcattcatcctcataacagttctgtgcctgagtagattcttgtccttatgtaaggattaaggacgttgagacccagargggtctcatctaacaggcagtagtagagccagcagtcaaaatagtttgaccccaaggctccaggctttttccctatttctttctcacccacagccaattg

SEQ ID NO: 43406 - DNA, 201 bp, Homo sapiens
gcatcttacctataaaaataatgcagatacattcgtaactccccaggttttcgggagtggaaatgagggcagctggggagtgaatctgtcgtttgttgagrctctttttcctgcttgccagacactgatctaggctcattcatacaccagttcattcatcctcataacagttctgtgcctgagtagattcttgtccttatg

SEQ ID NO: 43407 - DNA, 201 bp, Homo sapiens
tgactcactgtgttgatgttatgttttctaacattgactttcctttaaaccatagggttcgaaaccgccaagtcttttgccctccatggtgcacatgtgaycttggcctgcaggaacatggcaagggcgagtgaagcagtgtcacgcattttagaagaatgggtaagcgcttgactgttgttgttttttttaattgtcaaa

SEQ ID NO: 43408 - DNA, 201 bp, Homo sapiens
ggacccttgccggggcctcgccatccacatggtcattgcctcaaaatttgggattccagttgcccttttccttcttctctcttgaacaatgtgaacgcaakgtgaggatgggccttctccgccttcaaaagttgctgccttccaaggggaaaaggtctggtcttgtaatttctggtctgtgcgtgctgtataaggaagaag

SEQ ID NO: 43409 - DNA, 201 bp, Homo sapiens
ttcagtggagtgtgtaaagtttattgctcttggaatcatgtctttatttttaaagtcatcttcactttgtttgtcttatgaatgaaagcatgagcaagtcmattattattcacgcatttgtttgtagttcattgtcagtgtcatctgctttattagtcaggggtttgagaatgtttcttcctttaactcatttattaagaa

SEQ ID NO: 43410 - DNA, 201 bp, Homo sapiens
ttgaggctgaggcaggagaatcactggaactgggaggcggaggttgcagtgagctgagatcgtgccattgcactctggcctggacaacgagcaaaactccmcctcaaaaaaaaaaaaagagagagagagaataaggtcagagggggaaaagagagaaagtgaaagcaacagtaaggaagagaattggaaaaaaaaaaaaaa

SEQ ID NO: 43411 - DNA, 201 bp, Homo sapiens
taaagatcaggccttgggagatgcaaacagtttgcccttggaccatgtcttctgctttcatccttatgctctcaacagatcatgccaaggtcctgtgttcmccgccttcctgagtccccattcagaggctcaagaattgagacaaaagggcatcctgcaaatttgctgccctggaagctgtgctgggggagccagtagaga

SEQ ID NO: 43412 - DNA, 201 bp, Homo sapiens
actggtgttcctctagtaggcaacattgatggtaaacatagaaagtcatggaaggcctcagttacctctagccctgaagacacagggatacccttggggcrgagaccttagggacaggacaataaagatcaggccttgggagatgcaaacagtttgcccttggaccatgtcttctgctttcatccttatgctctcaacaga

SEQ ID NO: 43413 - DNA, 201 bp, Homo sapiens
gccacgtgaggccgagaacatccaaatgaacactggtctgtttgttcaagatgggagctgtcagttgtgagagctcctatgggaagagtgttttgatgtayagacatccctggtccacagagccaccaagcaaggcagactatttcgtgagaaagaaggaagatagactccatgcaacacagtgggtgtggcaccaagcgg

SEQ ID NO: 43414 - DNA, 201 bp, Homo sapiens
ctctgaaaattacgaaagaaatagtgcatggattccagccccagtaggcttctgggcttggtgtttctttaatttcatgtaaatttctctaagtaaatatkccttaaaagtgaataaaattttatttcgctttaacaagagaatataaaagttaaaaaggtcactgtagtaatagactaatctcaattaccagggcagcct

SEQ ID NO: 43415 - DNA, 201 bp, Homo sapiens
acctgctatcctccccagctttgcacacctgattgctttttgtaagtcagatctcagattaattgtcgcctttacagacagatttttcttaactctccagwctaaagaagccacctcctccagttctcagcactgtgcttctcactctcgtttattttgttgtttattcatttgcttgtcatctgtattttcccactagaa

SEQ ID NO: 43416 - DNA, 201 bp, Homo sapiens
tgaaaagacagtttgtgagagttgtgatgattgtgatctgtgtcctttacagtttgcaagggaaggggacatgctatgtcagagtggagggacatggggasgcaccaggactggtcaagaggcagagggagagggtcaaaccgtgggttctgtggggaggactgaacgaggcagggtaagtagactagggtttgagtaagt

SEQ ID NO: 43417 - DNA, 201 bp, Homo sapiens
cctaacaggctgataatccatggatcgcattttgaatagaaaggattatgcaaaaagccagagtttttttttcccttgtcttataccagtggtgcctagcrtggtgtcaggtttatagaggactaatacatataagaaggagaaagggagggaggaggaattccagttgttttttttttaatctaggtacaagtctctctg

SEQ ID NO: 43418 - DNA, 201 bp, Homo sapiens
gggaaaactaggttagtgccagataaggtccattactctttaaaagtggccactcatccctaataataaataaaccaaacattgggatattaaaacaattygttctcagcatcagaaaagaggtcgtgtgtgtgtttgtgtttttttaatatcccatccagcccccagccccagtaaccctaagattgaacaaaaccctac

SEQ ID NO: 43419 - DNA, 201 bp, Homo sapiens
aaccacacagcccagtggccgtggcctgggcagggaaaccgcaactgcctgcaggaagagtgcagtttatttagataacattttcacttaacatcctgccrttaatgacctccacctggcaacctttatttaatccaaaactcagggactggattttccatacggcctgtgaggccagggggctcagttgttcctcataga

SEQ ID NO: 43420 - DNA, 201 bp, Homo sapiens
acaacataaccacacagcccagtggccgtggcctgggcagggaaaccgcaactgcctgcaggaagagtgcagtttatttagataacattttcacttaacaycctgccgttaatgacctccacctggcaacctttatttaatccaaaactcagggactggattttccatacggcctgtgaggccagggggctcagttgttcc

SEQ ID NO: 43421 - DNA, 201 bp, Homo sapiens
ggagaatccagagaaacacagcggaaattcaatttatgggctacattaacccagcattttggattggagggtttctaaagaggtttcgttatattaatggrtgacaagtggatacttaagaaaaagtgtattttggagaaagttgcaataatacctactagagattgtgtcctccctcaaaatcggagtgccatccgcgct

SEQ ID NO: 43422 - DNA, 201 bp, Homo sapiens
tgcccatggcaaccacaattaacccatgcctgccttccagtctttttaccacgtgttgtgttgtgtggtgtttgtcccacatagagatcattgccatacgsccatttggcacattgcttatttttccctgtctttatacatttcatcatgttgttctaaatgcttcttaactgcaattcttagtggttgtgatagtccaca

SEQ ID NO: 43423 - DNA, 201 bp, Homo sapiens
accacttttgctctctgctggcatagatggctgtgctttggttcattttcttgctcatcttcatgatctagcaagttcttgttgagtgccagcccagtgcyaggtgctgaagaacaatggtgaacggcacagtcatggtaccagaactcggtctggtggaacagagagattaagcaatcagaaaaacatatgtgtgtgtaa

SEQ ID NO: 43424 - DNA, 201 bp, Homo sapiens
ccatgagtaacgaagtcctctgtatctgatcctgggtctcctgttttctgctagcttcctcaaaacttggtagctaactcattaacttacaaggaagaggktgaacgtgtagacccttcacagtttgaaaaatcacctgatcaataactgagattatgaaaaggtaggaatgaaccaattatggcccaaaggctaactcca

SEQ ID NO: 43425 - DNA, 201 bp, Homo sapiens
aattctacattcctaagaagctcctaacaggctgataatccatggatcgcattttgaatagaaaggattatgcaaaaagccagagtttttttttcccttgycttataccagtggtgcctagcatggtgtcaggtttatagaggactaatacatataagaaggagaaagggagggaggaggaattccagttgtttttttttt

SEQ ID NO: 43426 - DNA, 201 bp, Homo sapiens
aaaatattttagactttgaagtctaagagacaaaattgaggttattatgtaggtattcatatagcatttaaaatgtaatcattttaaaatgtagaaatcasttttagatcgtagaccataaaaaaacagcaggaaaaactacatggttggctggatttggccaagttgacatagagagccaatccctcatctccagcaggg

SEQ ID NO: 43427 - DNA, 201 bp, Homo sapiens
tttgggctgttattaggtagactctcctgggacattctacacagctcctgcctccttctgtatgtaatatatatattatatatatataaaatatatattakgtatagataatttatatataaatatgtgtatatatatatttgttagggtaaaacaaagtctataaaaactgttttcctttgtcattgcccccaccaaata

SEQ ID NO: 43428 - DNA, 201 bp, Homo sapiens
aagagatggaaaccattctggccaacatggtgaaaccccatctctcctaaaaatacaaaaattagctgggcatggtggcgtgtgcctgtagttccagctastcgggaggccgaggcaggagaatcacttgaaccagggaggaagaggttgcagtgagctgagatcacgccattgcactccagcctggcgacagagggagac

SEQ ID NO: 43429 - DNA, 201 bp, Homo sapiens
tcaagagatggaaaccattctggccaacatggtgaaaccccatctctcctaaaaatacaaaaattagctgggcatggtggcgtgtgcctgtagttccagcyactcgggaggccgaggcaggagaatcacttgaaccagggaggaagaggttgcagtgagctgagatcacgccattgcactccagcctggcgacagagggag

SEQ ID NO: 43430 - DNA, 201 bp, Homo sapiens
ttttgcttaagaaggcaagccgggaatggtggctcacgcctgtaatcccagcactttgggaggccgaggcaggcagatcatgaagtcaagagatggaaacyattctggccaacatggtgaaaccccatctctcctaaaaatacaaaaattagctgggcatggtggcgtgtgcctgtagttccagctactcgggaggccgag

SEQ ID NO: 43431 - DNA, 201 bp, Homo sapiens
ggcaagcttttgcttaagaaggcaagccgggaatggtggctcacgcctgtaatcccagcactttgggaggccgaggcaggcagatcatgaagtcaagagawggaaaccattctggccaacatggtgaaaccccatctctcctaaaaatacaaaaattagctgggcatggtggcgtgtgcctgtagttccagctactcggga

SEQ ID NO: 43432 - DNA, 201 bp, Homo sapiens
tggcaagcttttgcttaagaaggcaagccgggaatggtggctcacgcctgtaatcccagcactttgggaggccgaggcaggcagatcatgaagtcaagagrtggaaaccattctggccaacatggtgaaaccccatctctcctaaaaatacaaaaattagctgggcatggtggcgtgtgcctgtagttccagctactcggg

SEQ ID NO: 43433 - DNA, 201 bp, Homo sapiens
tagattcttctagattctacagcaggcactggcaagcttttgcttaagaaggcaagccgggaatggtggctcacgcctgtaatcccagcactttgggaggmcgaggcaggcagatcatgaagtcaagagatggaaaccattctggccaacatggtgaaaccccatctctcctaaaaatacaaaaattagctgggcatggtg

SEQ ID NO: 43434 - DNA, 201 bp, Homo sapiens
tctagattcttctagattctacagcaggcactggcaagcttttgcttaagaaggcaagccgggaatggtggctcacgcctgtaatcccagcactttgggasgccgaggcaggcagatcatgaagtcaagagatggaaaccattctggccaacatggtgaaaccccatctctcctaaaaatacaaaaattagctgggcatgg

SEQ ID NO: 43435 - DNA, 201 bp, Homo sapiens
acttagggttctagattcttctagattctacagcaggcactggcaagcttttgcttaagaaggcaagccgggaatggtggctcacgcctgtaatcccagcwctttgggaggccgaggcaggcagatcatgaagtcaagagatggaaaccattctggccaacatggtgaaaccccatctctcctaaaaatacaaaaattagc

SEQ ID NO: 43436 - DNA, 201 bp, Homo sapiens
gaaagagagggaactgaacgggatgctttttattttgggctgttattaggtagactctcctgggacattctacacagctcctgcctccttctgtatgtaayatatatattatatatatataaaatatatattatgtatagataatttatatataaatatgtgtatatatatatttgttagggtaaaacaaagtctataaaa

SEQ ID NO: 43437 - DNA, 201 bp, Homo sapiens
taaatagtggatgtattttttctagtttttttgttttgcttaataggctctctctctgtctctttctttctatatatatatataatatatagaaagatatrtaatctatatatagatatctatataatatatataatctatatatgatatatatatcttattatatattatatatatagatagatatctatatacagatat

SEQ ID NO: 43438 - DNA, 201 bp, Homo sapiens
ctgacaagtattttcagtggaattagggtcatgatgtcatgcttatttcaaaagatagcttcatctgtgccttcacccagacttagggttctagattcttmtagattctacagcaggcactggcaagcttttgcttaagaaggcaagccgggaatggtggctcacgcctgtaatcccagcactttgggaggccgaggcagg

SEQ ID NO: 43439 - DNA, 201 bp, Homo sapiens
atgcgtgctcttttagggacatctcttcaaataagaacaggttgtaacctacactcaaaagagatgctcttggcaaggtatggcccctaaggtttgaaagsgttttccaggcctgctgtcaggccaggctggactgtccacaatttcttgtcctgcctcccgtgatgctagccatggatgcaccccagaagcatttagaat

SEQ ID NO: 43440 - DNA, 201 bp, Homo sapiens
gggtcatgggcttgctatatttttcattcaaccgccaagaaatcttgagaggcagctttatcatctccatgtgaggaggaggagattcaggcccagcgtartggcttgcgaaaagattccagcactaaagtttgaccccagtcctacctgacttcctttctccagctgtgagactcccctgtacaatttttctggagggtc

SEQ ID NO: 43441 - DNA, 201 bp, Homo sapiens
gccttggaacttgcttgcatccctcccccacgcgaggcgaggccctgaggagcgggattcgctgacccatgctggcagaacgggtgatggatgaggcagasaagggtacaggctggctggaccatgcgatggggaatgcaggtggaacaggcttcctcctgaatcaggagtggaagaggagtctggggtgaagccaagggg

SEQ ID NO: 43442 - DNA, 201 bp, Homo sapiens
aggcaacagaaaggtctctgttacgaagggggaactagttttcattgtcactgtattaagcagaagttgggaatcatagaagaccttgatgttaccatatyccttgttaaatttcctctaatactattgagaagtttatcctctactttttcctgtagagtaaaagatatcgattttgtttctgtcggcactgccttggaa

SEQ ID NO: 43443 - DNA, 201 bp, Homo sapiens
agtctttaaaaggcaacagaaaggtctctgttacgaagggggaactagttttcattgtcactgtattaagcagaagttgggaatcatagaagaccttgatsttaccatatcccttgttaaatttcctctaatactattgagaagtttatcctctactttttcctgtagagtaaaagatatcgattttgtttctgtcggcac

SEQ ID NO: 43444 - DNA, 201 bp, Homo sapiens
aattctatttatttagtataaacccactggagtgtgtacctaagcatttcattttctttggagcgattgtaaatggcattgtgtttttaattccaacttcyacatatatctagaaatatgattgagttttgtgtgttgatcttgatcctatgagcttgctgattgcatttattataaagttccaggagttttttatttttg

SEQ ID NO: 43445 - DNA, 201 bp, Homo sapiens
tattttagcttcctaagacctgtgctttttcatataaattgtacaatatggttgtctatgtctaccagaagccttgctgcagttttaatggggtttaaatstataggtctaacattaaacctatagatcaattcgggagaattgacatctttactatgttgagtcttccagtttgtggacatggtatgtaattctatttat

SEQ ID NO: 43446 - DNA, 201 bp, Homo sapiens
tgggtatctttctggcttctttattccactgatctatgtgtctgtctctctgacaattatacgctgtcttcattactatagctatgtagtaagcctcatgycaggtagagtgattcttctcactgtattcttttttattaagattattttagcttcctaagacctgtgctttttcatataaattgtacaatatggttgtct

SEQ ID NO: 43447 - DNA, 201 bp, Homo sapiens
gcctaggaacatctcattgttttagcaccatttgctgaaaatgatcttcctccagagaatttttttacctttattcaaaatgaattgagcatgtttgtgtrggtatctttctggcttctttattccactgatctatgtgtctgtctctctgacaattatacgctgtcttcattactatagctatgtagtaagcctcatgtc

SEQ ID NO: 43448 - DNA, 201 bp, Homo sapiens
ctttgtagttcttgggtaggtgtgtgactgtggcctatgaggccaagttgcaaggtctttggatgaactttgtggcatctggcaatgtccccagtgcaacytatgtaaaatatagcagtttcctgcacacgcttaagggaagaaaccgttgtggggaagcgtgctctgttattcttgccaatgtagccaacatatacatgg

SEQ ID NO: 43449 - DNA, 201 bp, Homo sapiens
atgcggaagccttcgcccccttcttgagggtgtttagggattagatgagtgtcccatctgggtttcccatccctgcagagcccacgtgtggggtgctgagrggtacgtggtgggtgactccctggggagcactgtttggtactgatcactgtcccatcctggcactgcagtcctgggacagtctacacagctcctgcctcc

SEQ ID NO: 43450 - DNA, 201 bp, Homo sapiens
ccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagg

SEQ ID NO: 43451 - DNA, 201 bp, Homo sapiens
tacaagggccggatgcggtggctcacacctgtaatcccagcactttgggaggcctaggcgggtggatcacttgaggcctggagtttgagaccagcctggcyaacatggtgaaaccctgtctctactaaaaatacaaaaattagccaggtgcggtggcgcaaacctgtaatcccagctacttgggaggctgaggcaggagaa

SEQ ID NO: 43452 - DNA, 201 bp, Homo sapiens
tgtagcttcctttatacacaactacatcaagacagtgaacagtgcatcaccacaaaattcccttgcgttgccttgcaaaccacacccaccttccttctgcscctgcctcatccctgacccctggcaaccactaaactgttctccacttttaaaatgttgttttttcaaaattattatataagcagaatagcatagtatgta

SEQ ID NO: 43453 - DNA, 201 bp, Homo sapiens
cgaatggttttccaatcttcaaaccaacctatatcacaaaagcattctgaaaactgggaagagatcacttcacagtttcctgaaccactagaaaaaaaaaatgttcataaatttatagccgctgacattgaagttggagaaaagagcatatctagtacctatgctatgtggagaacactctccatgtctttgaaaaataag

SEQ ID NO: 43454 - DNA, 201 bp, Homo sapiens
tgtgtctacatatgtagttttatacagtgtcatcaaatgtgtagcttcctttatacacaactacatcaagacagtgaacagtgcatcaccacaaaattccsttgcgttgccttgcaaaccacacccaccttccttctgcgcctgcctcatccctgacccctggcaaccactaaactgttctccacttttaaaatgttgttt

SEQ ID NO: 43455 - DNA, 201 bp, Homo sapiens
gaatctatggatcttattcagatttctcattttacctgtactcaagtgtgtatatgtgtgtctgtgtctacatatgtagttttatacagtgtcatcaaatrtgtagcttcctttatacacaactacatcaagacagtgaacagtgcatcaccacaaaattcccttgcgttgccttgcaaaccacacccaccttccttctgc

SEQ ID NO: 43456 - DNA, 201 bp, Homo sapiens
ttttaattgaagactcacatgtagttgtaagaaataatatacaatgattcctcatattcttagctcagtttcccccagtgatagcttttgcaaaacaattstgcaatatcacagtgttgacacttacagaatctatggatcttattcagatttctcattttacctgtactcaagtgtgtatatgtgtgtctgtgtctacat

SEQ ID NO: 43457 - DNA, 201 bp, Homo sapiens
tcctcccatctcaacctcccaaagtgttgagattacagttatgagccaccgcatccagcccacaagtattattccaaactgtaaaatcgtgaaatgttttscattagaatcagaaactagacaagaatattcatgatagctgtcaattgtcacattattttagaagttttaacaaatacagtaagacaaaaaaagtcttaa

SEQ ID NO: 43458 - DNA, 201 bp, Homo sapiens
gcccaggctggtctcgatctcctaggctcaagcagtcctcccatctcaacctcccaaagtgttgagattacagttatgagccaccgcatccagcccacaartattattccaaactgtaaaatcgtgaaatgttttgcattagaatcagaaactagacaagaatattcatgatagctgtcaattgtcacattattttagaag

SEQ ID NO: 43459 - DNA, 201 bp, Homo sapiens
tggtctcactatgttgcccaggctggtctcgatctcctaggctcaagcagtcctcccatctcaacctcccaaagtgttgagattacagttatgagccaccrcatccagcccacaagtattattccaaactgtaaaatcgtgaaatgttttgcattagaatcagaaactagacaagaatattcatgatagctgtcaattgtc

SEQ ID NO: 43460 - DNA, 201 bp, Homo sapiens
gggttttaccatgttgcctaggctggtctcgatctcctgggctctagcaatcctcccacctcggcctcccaaagtgttgggattacaggcgtgagctaccrtgcccggccttacgtttcagcatctttcaatccatctaatacgcagtgccagggaaggtttgtgaaaacatttgaatcacagagtcacaaacagtgagaa

SEQ ID NO: 43461 - DNA, 201 bp, Homo sapiens
gaactggctgcaccagcaggagccaatgattacccatctcccatgtttagtgacatcatgttgatagcttgatttcagccatagtgagaatattttcaccmcggaaattggcacatgctacacatcagggctccctcctccccaccaaagctgatcattaaacattttctagaacatacctggaaggcatctgggaagagg

SEQ ID NO: 43462 - DNA, 201 bp, Homo sapiens
agccaacaaaattcaataggcacatgccatgtacatgcctgtgttatgccgggaacttcttaacatttccagaatatgtgtaatcatatttgttacatgcwatatgaaattatgtgtaaactgtccaacctgcaggaggcagtagatcaatcaattacatgtgattaatcctccccctatcttacagagaataggagagaa

SEQ ID NO: 43463 - DNA, 201 bp, Homo sapiens
tgtcacttcttctttttttttttttttaagacggagtcttgctcttttgccaggctggagtgcagtggtgcaatctcggctcactgcaacatttgactccytggttcaagcgattctcctgcctccgcctcccaagtagctgggattacaggcatgcaccatcacacccagctaatttttgtatttttagtagagacggga

SEQ ID NO: 43464 - DNA, 201 bp, Homo sapiens
tgctgagagtttgaatagtatgtgaagtctgtagagacaaaattgttgttttccccagttgtaaagtgtgcaatattatccttgcaaaattgtctgtttawtttttttgcccttttgggggacaaaatgtctttatgttaaattgttttattattgttatctttatggagttaagggcacataaaatattcttacagagag

SEQ ID NO: 43465 - DNA, 201 bp, Homo sapiens
gctctttttttctctctcactctgagtatttagaggcttttattgctatttttctaaaaggcaacattagtaatcaactttgccaaaaatttcatatgaayggtgggcttttctttctcatttgctttcgcttagtattttccattattcatttggcttcttgaaccctccctatctgtaccccacacttactcttattca

SEQ ID NO: 43466 - DNA, 201 bp, Homo sapiens
tataaatgcagacacatacagacacccacacccacacatacagacacacacagaaacatatacacatttaggtcgcgatttcttcacaaggacattcttayagacatgtcatgaagggacttggggctcagagaaatgaagtaactcagctaagtctgtacagtacttagccaggggatttagaaatccacccagggatgg

SEQ ID NO: 43467 - DNA, 201 bp, Homo sapiens
gaaaagattactgacgatcaacatgctgaactgacatttcacagatatgcagatttattcatctctgttcaaggtatgccttttccaatcataatagccaygtagaggacattaaacaaatattttattgtggtaaaaacacttaacatgagacctacccttttaacaaatttttaaatatataatttattattattgttg

SEQ ID NO: 43468 - DNA, 201 bp, Homo sapiens
gtatcagtaattttaaaagccagcaagtgttctaccagctgaagaagttttcctaatggtggctggtcaaacgtattacttaactaggcgtatagaattgrggggaaatgcaggatgtaatgaaatgacattggtcaatcctcagtaaatgtttttttcaaaggcttggcacaaaaaatgtgcaaaatcttggaggtagat

SEQ ID NO: 43469 - DNA, 201 bp, Homo sapiens
atgagatttgggtggggacacagagtcaaaccgtatcactctcccacccaacacttgcagaaacacacacacacacacacacacacacacacacacacacmccccttcctacgtcctacatccctgtacttggaaagcaatcatatttaaatcattgctgctggaactttagttgactttataagttacattttacataaa

SEQ ID NO: 43470 - DNA, 201 bp, Homo sapiens
ttttcattaattaatgggtgtatttattggaataaccgtgtaaggttgccatttttatttccatctgtgtgttacagatgagatgtgtaatagaaagggartttgcccaagctcacagtcacaggctggtggagttgggatttcaaacccagagtgtctgattcctgaacctgtgctcttgtctcttccttcagtaccaca

SEQ ID NO: 43471 - DNA, 201 bp, Homo sapiens
cctggagtgaagtgtaagcgtcgctgttcactggctgagtcatctttggtaggtccctttaccactttgccactttaagtctccgtttcctcatctgtaamatagaggtaataaaaacagctaatatttacagagagcttactccttgttagcagttttcattaattaatgggtgtatttattggaataaccgtgtaaggt

SEQ ID NO: 43472 - DNA, 201 bp, Homo sapiens
tgtccaagaagcatggtgccaatgtatttctgatgagggcgtcaggcagcttctactcatggtggaaagtgaaggggagccagcatgttcagagaacatayagggagaaagggagcaagagaggggaggggaggtgccagagcctttaaaagaaccaactctctgggaacaaatagagggagaacattaatctagccatga

SEQ ID NO: 43473 - DNA, 201 bp, Homo sapiens
taaaaataggcaatgaaactgaaaggcaatcaaagtctattgtcacaaggaatgggaggaacggggacgtgatctaacatttgctgagatcctgctgtatmccgggaacagaacatatatggtttcatttcatcctcccattatcaccgtgaggcctcttccgcttatctattgctgagtaacaaggtgtacccctcaatt

SEQ ID NO: 43474 - DNA, 201 bp, Homo sapiens
tgggcatttatttccaaagaatgatttcactcaactgaggaattctaatgttttaacagcatcctacttatttctaaagtgttggggtgaatttgccaagktttgaaaagtgcatttgtaagccagtaggattcaatctgaagtcagggataacagagccgggggcggaggctaggtctccttacatattttgttcacaat

SEQ ID NO: 43475 - DNA, 201 bp, Homo sapiens
tcctcgtggtgatgttaagatgaaacaggaaggtgaggggcttaacacatttccgtgttcccataagctttcaggagatcttggtagttttcatctcggtsttcattaccatcatcactgcttcagactcctgtccatgtggggccctgtggtcttgcgatcacctccataaatgttcctttgttcccgcctaacacaata

SEQ ID NO: 43476 - DNA, 201 bp, Homo sapiens
tgatggggaaagaggatgtgagctgaggcttggaaccaagcagagcttgggctttggggtgctgggaggacagaatgctggaaacagaggtaagaagggtragcacctagtcaacatgagtgatttagctttgggagctgatcaagtgatatgatttggctctgtgtcccaactcaaatgtcatctcgaattgtaatcccc

SEQ ID NO: 43477 - DNA, 201 bp, Homo sapiens
tcctccagaggactgagatcctccagatgctgttcatttgccttattcgttatgaccatagaagtttgtggggtggcactctttattctgtcctcgccccrcaagcaaagcacacaccacaagctataaggagatgagctcagtaggcctgtcctttactttattttccctattagaatcccaccatagacgccctctctg

SEQ ID NO: 43478 - DNA, 201 bp, Homo sapiens
gccctggagtttcacagaagaaggggctttcttccagcttggggatggaggtgagctgtcattctggatgatgtgatggggaaagaggatgtgagctgagscttggaaccaagcagagcttgggctttggggtgctgggaggacagaatgctggaaacagaggtaagaagggtaagcacctagtcaacatgagtgatttag

SEQ ID NO: 43479 - DNA, 201 bp, Homo sapiens
atgatttcatgggcccagccctgggtccctgtgctgtgtgtagcctagggacttggtgccctgtgtcccagccactccagtcatggctgaaaggggccaakgtatagctcaggctgtggcttcagagggtggaagccccaagccttggcagcctccatgtggtgttgagtgtgtgggggcacagaagtcaagaattggggt

SEQ ID NO: 43480 - DNA, 201 bp, Homo sapiens
ccaatggtgacggggtttgttttattcatggactttttgaaaaaaaaatcactggtttattggaaaccatagagaagtataagtaattattatgctttttwaaatacaaccgaggttcctcatcatgatacgttaagggaaaggaagacagggcaggagggtggtgtggcacaaaggcggctctgtctgacctgtcacgtt

SEQ ID NO: 43481 - DNA, 201 bp, Homo sapiens
ttttttaaaaggcaagatgttggcctggcgtggtggctcacgcctgtaatcccagcactttggcaggccaaggcgggtggatcacctaaggtcaggagttygagaccagcctgaccaacttggcaaaacccagtgtctactaaaaatacaaaaattagctgggcatggtgtcacatgcatgtagtcccagctactcaggag

SEQ ID NO: 43482 - DNA, 201 bp, Homo sapiens
tcaggcccataaaatactgcacatcttggcatcttacctataaaaataatgcagatacattcgtaactccccaggttttcgggagtggaaatgagggcagytggggagtgaatctgtcgtttgttgaggctctttttcctgcttgccagacactgatctaggctcattcatacaccagttcattcatcctcataacagttc

SEQ ID NO: 43483 - DNA, 201 bp, Homo sapiens
ccctcatcatcaacccctccccagctaccctgcaaaagagtcacagatcattgggataactagaaccacagagatccccctagacttgtcagccagggaamctgacactcttagaccttcttctgagtgctttgtccttgtccggagagctcggggaggagcaaggttgtactgggatttttttccgatcacagaaagtaa

SEQ ID NO: 43484 - DNA, 201 bp, Homo sapiens
ccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacc

SEQ ID NO: 43485 - DNA, 201 bp, Homo sapiens
aaagcacacacaatgatggccagagacactgctcagtgtactgtcttccaccgggacagcccactcaccaagggttaggtcctgtgctgactgggtcccgkgtctcctcggaggtcggtttgcatcacgtggatacactaatctacccaagttgacttggagaaccaatctgaaatcagatgggagctcccggaagcaaag

SEQ ID NO: 43486 - DNA, 201 bp, Homo sapiens
tttcataggcaatatgtctgataattgcagagagatactgagttaacttgtagcaatgagtttctgtgacaaagggaaatcagtttgtttgcagtaagccraggataacggcgccgaaactttactatttgggggtggggggaggttggggaagggaggccctgaaattgctttttataattaaaaagggaatctcagatg

SEQ ID NO: 43487 - DNA, 201 bp, Homo sapiens
ggtaacttgttttcactccctcagaacctcagtttcctttcctatacaacgcaagccataaggttaacccctcctcgtggtgatgttaagatgaaacaggraggtgaggggcttaacacatttccgtgttcccataagctttcaggagatcttggtagttttcatctcggtcttcattaccatcatcactgcttcagactc

SEQ ID NO: 43488 - DNA, 201 bp, Homo sapiens
ttgcaccactgcactccagactgggagacacagcaagaccttgtctcaaaaaaaaaaaaaaagccagattctccacctaccagtggtggggccccttgggyaacttgttttcactccctcagaacctcagtttcctttcctatacaacgcaagccataaggttaacccctcctcgtggtgatgttaagatgaaacaggaag

SEQ ID NO: 43489 - DNA, 201 bp, Homo sapiens
tctcctttacggccaggtctccttcgtcctccctgctcagaatttcagtctttttttttttttttccctatacagacacaggaagtatatattttcctctygaatatcacttgggtcttatcttgttttatgctacatgcatgtggcttcccccgttacaaaaagaattcacattattagagaacatttggaaaacataca

SEQ ID NO: 43490 - DNA, 201 bp, Homo sapiens
agtgttgtgataaacatctctgtgcataaagcagtttctatagttcccattatgtctttaggatagattcccagaaatggaattactaggtcaaaggttgsgcacattttttaaaggtttgtgagacatattgccaaattgctctccaaaaggtttgtagcaatttaaatgatcagaagcagcactgaagtccagtttcgt

SEQ ID NO: 43491 - DNA, 201 bp, Homo sapiens
tttatccatttctatgttgttggtcatttatatggttttaaatacttttggtgtcataaggagtgttgtgataaacatctctgtgcataaagcagtttctrtagttcccattatgtctttaggatagattcccagaaatggaattactaggtcaaaggttgggcacattttttaaaggtttgtgagacatattgccaaatt

SEQ ID NO: 43492 - DNA, 201 bp, Homo sapiens
tatcttaaaaatatttaaaaagaaggaagaaaatcactcataattctgctgcccatggcaaccacaattaacccatgcctgccttccagtctttttaccaygtgttgtgttgtgtggtgtttgtcccacatagagatcattgccatacgcccatttggcacattgcttatttttccctgtctttatacatttcatcatgtt

SEQ ID NO: 43493 - DNA, 201 bp, Homo sapiens
acagatcaccaaaactgatataataataatttaaaagcttgaaatattgtaagaattatcaaaatgtgatacagagacatgaagtgagcaggtaccattgsaaaaatggtgccgatagtcttccttaatgcaaagttgccagaaaccttcgatttgtaaaaaacacagtatttgcaaagtgcaataaaaggaaatgcaata

SEQ ID NO: 43494 - DNA, 201 bp, Homo sapiens
tttagcataattcttaaggaccctaggattttgggaatggtaaatgagcttggcttcaacttgaagtcaccagcagggaagagagtcagcctgtgcttcgmagctttgaagccaggcattgccttctcctccctagctctcaaagtcctagacagcatcttcttccaacagaaagctgttttgtctacattgaaaatctgt

SEQ ID NO: 43495 - DNA, 201 bp, Homo sapiens
cgacagtgggcataaattattcagtaaatcatgccataaatagacgtggtctcatccagggtttgttattccatttatagagcacagggagagtaggtttrgcataattcttaaggaccctaggattttgggaatggtaaatgagcttggcttcaacttgaagtcaccagcagggaagagagtcagcctgtgcttcgcagc

SEQ ID NO: 43496 - DNA, 201 bp, Homo sapiens
cctcccacagtgccacaattacaggtgtgagccaccacactggaccaagcagaatatttttaaaggaatacaaattttttcccaacagtaggtctcgacastgggcataaattattcagtaaatcatgccataaatagacgtggtctcatccagggtttgttattccatttatagagcacagggagagtaggtttagcata

SEQ ID NO: 43497 - DNA, 201 bp, Homo sapiens
ccaaatcagcctcccacagtgccacaattacaggtgtgagccaccacactggaccaagcagaatatttttaaaggaatacaaattttttcccaacagtagrtctcgacagtgggcataaattattcagtaaatcatgccataaatagacgtggtctcatccagggtttgttattccatttatagagcacagggagagtagg

SEQ ID NO: 43498 - DNA, 201 bp, Homo sapiens
gatacctcagagatattgcagatcccgttccagaccaccacaataaagcaaatatctcaataaggcaagtcacatgaattttggagtttcccagtgcatayaaaagttgcttacacgatataatagactcttaagtgtacaatagcattgtaagaaaacaatgtacataccttaattttaaaatatttcattactaaaaaa

SEQ ID NO: 43499 - DNA, 201 bp, Homo sapiens
gagtatatgcatggagaatattttctgagctggtgatgagctgcagggggcctctcccagcccccgcactggttgcacttttaaataagagaaaaaaacartgataggactgacctgcgtgtagaagtttcaagttacaagaaaaacacttcacaggatccaaatccttaaagtcctgaaggaaacagagagcatatacac

SEQ ID NO: 43500 - DNA, 201 bp, Homo sapiens
accaagtatgaattctcatatgttcttaaagtatctgctgatttcttcaaacatctctaacaacatgtctgatgaatacgaagcctccctttatttatttwttttctttttgctttctttttttgggggcagggggcacagtttttctttctgtctcagtctctcaaactgtaggaggaccaacttcagggttttattttg

SEQ ID NO: 43501 - DNA, 201 bp, Homo sapiens
aaaataaaagaacctgaagccgccaagagaggctcactgaccatctctgggggaggaagggtgaagagtagcaaatttaccgtcatcagcaggtgtgtaawtgttccatttacattgaatggcacatgtcataaagtacataccgctgcacatcccaccctctgtttctgtttcaactgcagagcctatttttctttccct

SEQ ID NO: 43502 - DNA, 201 bp, Homo sapiens
aaaaataaaagaacctgaagccgccaagagaggctcactgaccatctctgggggaggaagggtgaagagtagcaaatttaccgtcatcagcaggtgtgtaratgttccatttacattgaatggcacatgtcataaagtacataccgctgcacatcccaccctctgtttctgtttcaactgcagagcctatttttctttccc

SEQ ID NO: 43503 - DNA, 201 bp, Homo sapiens
ttttaagatacagaaagtgggccttaaaggtgctactgacttgctgatatgctttggctgtgtccccacccaaatcttaacttgaatcgtatctcccagarttcccacgtgttgtgggagggacccagggagaggtaattgaatcatgggggctggtgtttcccatgttattcttatgaaagtgaataagtttcataagat

SEQ ID NO: 43504 - DNA, 201 bp, Homo sapiens
ggggatttcaccatgttctccaggctggtttcaaactcctgagtccaggtgatccacccatcttggcctcccagagtgctgggattacaggtgtgagccaytatgcccaataccccctatgtagacttttaaagaaatacaggaaacagccaagactggtgtcattcagatttagcttgggagagtctagtgggtgttagg

SEQ ID NO: 43505 - DNA, 201 bp, Homo sapiens
accacaagtatgcaccaacatgcctggttaatttttgtggttttttttttttttttttttttcctgctgagatggggatttcaccatgttctccaggctgktttcaaactcctgagtccaggtgatccacccatcttggcctcccagagtgctgggattacaggtgtgagccactatgcccaataccccctatgtagactt

SEQ ID NO: 43506 - DNA, 201 bp, Homo sapiens
ttagcagctttttctacaaatctcttggcgggtggggggatatttcactcttctatgaatcaaataatatatggctttttcctattggaaaaaattagtcktgtgaactttattcttcaagaaaaagtagtttttatctgccttggaaatgtcaaaaggattcacgagtttcacaagtgatgatctgggttgattgctagg

SEQ ID NO: 43507 - DNA, 201 bp, Homo sapiens
ctacaaaaatattagtcaggcatagtggcgtatgcctgtagtcctagttactcgggaggctgaagcaggaggatcacctgagcccagggaggtcaaggctrcagtgagctgtgattaggtccctgcactccagcttgggtgacagagtgagaccctgtctccaaaaaaaaaaaaaaaaaaaacaaaagaccatttttaaga

SEQ ID NO: 43508 - DNA, 201 bp, Homo sapiens
tgctgtttaggaaagaaaaatgatatcgctcagaaaatcatttaaaaacttcctggtgaatgcacccagctcgccaatgcatgccagccacagggcctcayagcacatttcaggagcaagacaattcagaccccactcttccccctgaaaaacctccttccagaaccctcttttgcagtgagcagagataagcctctccaa

SEQ ID NO: 43509 - DNA, 201 bp, Homo sapiens
ataagacatttccagtgtctagtccaaattagtatttctctaattctcgagtgtctgatctgcctggctagaatgattaaaacaaaaaaatagcaaatcaktttgacagtccacttcattaagtggaggacagtgttttgattgctatttaatctgtttttccttctgtctgttcttggctatatggaattcactttgcct

SEQ ID NO: 43510 - DNA, 201 bp, Homo sapiens
tgaaaggactggcaagtgcctctgtgctgatattgtacctgggctcagtggtctggctaaaggagaggtgctggggccaggtgacaggcgagtctctatayggcaggcccaaaaaatggaggtgcaggcttcatctatactttgatgtgtatgcttccttctttaaacttgtgataatcagagttatagctgctttaaact

SEQ ID NO: 43511 - DNA, 201 bp, Homo sapiens
gcagccatcttgctttgtaagccttctctagctttatgatgctcccagtatataagacatttccagtgtctagtccaaattagtatttctctaattctcgmgtgtctgatctgcctggctagaatgattaaaacaaaaaaatagcaaatcagtttgacagtccacttcattaagtggaggacagtgttttgattgctattt

SEQ ID NO: 43512 - DNA, 201 bp, Homo sapiens
ccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccaga

SEQ ID NO: 43513 - DNA, 201 bp, Homo sapiens
gagcactgagtgtaactccaggtcgggtatattatgtccctctgtgttctctagctagttatctatccatccatctcttgccttgtccacagaagttacakgtaggctgccgggcgcagtggctcacgcctgtaatcacagcactttgggaggccaaggcgggcggatcacgaggtcagaagttggagaccatcctggcta

SEQ ID NO: 43514 - DNA, 201 bp, Homo sapiens
agtttgtcttggctctgatcacccctttttgtgacttagctggctgggaagtagcaaaagtatcttccaagctcagcttctctctgcttgcattctttccmaatacgtgattccaaagcccatgcccaatccttgcactgaagcttttagcaggaaaggtgaacagaggcatctggatgcatcgcggccagtctgcccctt

SEQ ID NO: 43515 - DNA, 201 bp, Homo sapiens
agagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgt

SEQ ID NO: 43516 - DNA, 201 bp, Homo sapiens
tacagtggctcatgtctgtaattctagcactttgggaggccggggcgagcaaattgcttgaactcaggagttcgaggctagcctgggcaacacggcaaagscctcatctctacaaaaaatacaaaaattagctgggcttggtgacagacgcttgtagtctcagctactcgggaggctgaagtgggaggatctttagagccc

SEQ ID NO: 43517 - DNA, 201 bp, Homo sapiens
gttgacctggaatgacctagaccagcagtcacaagctcctgcccatggacaaaatacagccggtacctctttggctatggcctgcaggctcagaatagttyttacattttcaatcatctgcaaaaaagaataaagaggagaatattatttcttgaaggaggaaaatgatatggaattctgatttcagtgtcataaagtttt

SEQ ID NO: 43518 - DNA, 201 bp, Homo sapiens
tcaaagtcctgggctcaagcgattctcccgcctcagcttccctaagtgttgggattacagacttgagccactgcatctagccacaactgagttcattattstgagctttctttgggatgttatttaactctcagtttcttcttctataagatggaaataataacaactaaaggctaggatttggggaaggtatggtaaatt

SEQ ID NO: 43519 - DNA, 201 bp, Homo sapiens
aaaatgaggaagaagcgaacgtgagaacccctggtaaacccatcagatcttgtgacacttattcactatcacgaggatagcgcaggaaagaccggcccacrtgattgagttacctcgccctgggtccctcccacaacatgtgggaattctgggagatataattcaagttgagatttgggtggagacacacccaaagcatat

SEQ ID NO: 43520 - DNA, 201 bp, Homo sapiens
tctccccacaatcaggggatcttatgactgaatttcttacaaatagcaaaggaataagtaggcttaggtgagaggggaaaggggctaaattgaggggagcrgtggagcaacagattagtggtagcagatttatttttatttatctttttttgttgttgttgttaagacagaatcttactctgtcacccaggctggagtgca

SEQ ID NO: 43521 - DNA, 201 bp, Homo sapiens
actctgtctcacaataaataaataaataaataaataaataaataaataagagttggatcacagcaaaggtgagctttaacgagttcagtctagctctctcwcaaaaaaaaagttaaaatgacaaattttgtgttacatacattgtactacaataaaaaccatttttttgaaaagaatagtacaaaaatgatacttccctct

SEQ ID NO: 43522 - DNA, 201 bp, Homo sapiens
caccagaacccgtctgcgccagtgtccctgcagcgccctctactggcgaagctggacatggcgtccgctggcaaaggggaaactcttctttcctcccaagscgagcaatgctaaatgtgcctggtactgagacgtcatctgtggacggttggcaccgatgctaatcagtgctatgggaaaataggcagagcgaggagcgta

SEQ ID NO: 43523 - DNA, 201 bp, Homo sapiens
cagatggagggaaagagaggcgggggattccaggtacagtggctcatgtctgtaattctagcactttgggaggccggggcgagcaaattgcttgaactcasgagttcgaggctagcctgggcaacacggcaaagccctcatctctacaaaaaatacaaaaattagctgggcttggtgacagacgcttgtagtctcagctac

SEQ ID NO: 43524 - DNA, 201 bp, Homo sapiens
atagagtgagactctgtctcaaacaaaaaaaaaatttaactctaaagaatccaagaatacagatttgggagcagccagtaccaatgggggatggggcagtwcacccaggaaagagcaaatctggggtccccacgggccaggactgggatctggactgggccatggcccattggatggcagaaaggttctcactgaagcccc

SEQ ID NO: 43525 - DNA, 201 bp, Homo sapiens
gagaggaagcaaagtgagacagaggtggtgtgtgagcgtgtgtttgtgtgtgtgtgtgtgtgtgtgtgtgtgtgtgtgtgtgattgagagagagagagacrgatggagggaaagagaggcgggggattccaggtacagtggctcatgtctgtaattctagcactttgggaggccggggcgagcaaattgcttgaactcagg

SEQ ID NO: 43526 - DNA, 201 bp, Homo sapiens
cgggaggcagaggttgcagtgagccaagatcacgctattgcactccagcccaggcaacaagagcaaaactctgtctcaaaaaaattaaaaaaaaaaaaaaagaaagaaaattaatttctcagaggtagtaataggggtggctgtcaccatccttggccaaggagagggagcagatactggagacagttgaaggtgccagga

SEQ ID NO: 43527 - DNA, 201 bp, Homo sapiens
acttagctagcaaatggtggagtcgaattcaaaccctgcctctcctcacccactctgtttcttttcttttgagcacttaccactttctgaatatgtatacmattgtttcctcgattactgtctgcctcttcttccctagagcgtcagcccatgagcttatccagcctacagaggagatgctgcagcttggcagagcatgga

SEQ ID NO: 43528 - DNA, 201 bp, Homo sapiens
tgggtggtttgggcatttgtcaaagcagggtcagcagaaagctgacgtagttgggtctaaagtacaacaggactgagcatggtggctcacacctgtaattytagtgcattgggaggccaaggcaggaggattgcttgaggccaggtgttcaagaccagccttggcaatatagcaagacattgcctgtacaaaaaatttaaa

SEQ ID NO: 43529 - DNA, 201 bp, Homo sapiens
tgtggttttgctttttaaaatggggttatgagtggttttgttttgaactccagtgaaggaggcctgatgacgttcatcaaggtcaacactaggccagaaaracttggcttgcaatatcactgcccattctgttcaccagcaggcaccatttttagaagcttatgtaaaaaaaaaaaaaaaaaaaaaaaaaaaatctaaaat

SEQ ID NO: 43530 - DNA, 201 bp, Homo sapiens
ccatgtggcacatacccctgtacatgtttgccaagactgctatatggtagagcttggaattcttaggagctttatcaggtaattgcaagtcccccacctcyaagaaagcactctctaggtcaagaatcagcaaatgttttctatagaggcccgtaaaattaatattttatactttgtgggtcatatagtctctgtttcaat

SEQ ID NO: 43531 - DNA, 201 bp, Homo sapiens
tttctccctctggccaatgctccttcccctgtagatcatacccattcccaagatttcagtcatcaaatccattccaatatgactcctgtatccatatgtcyagttccaagtatctgtccatggtgttggtcccaggttattcgcacctcatatgtctttggcacagcactcttgacagctcataaagtcacgctgttaccc

SEQ ID NO: 43532 - DNA, 201 bp, Homo sapiens
aaggacatcgttttgatatgatgaaccatgggtggtttgggcatttgtcaaagcagggtcagcagaaagctgacgtagttgggtctaaagtacaacaggamtgagcatggtggctcacacctgtaattctagtgcattgggaggccaaggcaggaggattgcttgaggccaggtgttcaagaccagccttggcaatatagc

SEQ ID NO: 43533 - DNA, 201 bp, Homo sapiens
gtcggtagatttgtttatgattttaatggctgcatagtattctatcatatggatatattctaaatgtaataattcctcaatggtatatttagtttactttwtatttgctgctttagtttgtcacaaacactgtggatagccttgtatatatttattttgttgtatagttcttattggtacagtatgatttttcacaagtat

SEQ ID NO: 43534 - DNA, 201 bp, Homo sapiens
gtctaatttatgtaaaataaattgcatccatttaaatatacaattcaatgagttttgacagatgcacatgcccatgaaaccaacacgaaaataaaaaaaawagaacatttacgtcacctcaaaaagatttcaaatgccacttctgtggtgtatgactctgagtccagacagcctcagctccaggaaaaccctggtctgttt

SEQ ID NO: 43535 - DNA, 201 bp, Homo sapiens
tttgatattttttaaaggaaaaatttgaggcattgacacatgccttttgcttacttgcttggattggtttgatcaactttgttgcggtctaatttatgtawaataaattgcatccatttaaatatacaattcaatgagttttgacagatgcacatgcccatgaaaccaacacgaaaataaaaaaaatagaacatttacgtc

SEQ ID NO: 43536 - DNA, 201 bp, Homo sapiens
aaaaaagtaaaataaagcatgggaagtcccttatacagtttgtgatatgggtacacactcagtgaaatggccattaatactgctgttcttaactctgaaarcagagtgggccatttgaatgctcactttgatattttttaaaggaaaaatttgaggcattgacacatgccttttgcttacttgcttggattggtttgatca

SEQ ID NO: 43537 - DNA, 201 bp, Homo sapiens
ttaacagcaagatcttcagagctgcagctcacctgtgccacgatggtctcctaggagccctttcctgctgtagtcccgccccgaggggtttcacttcccaytgcctcttggtagccgtgggcactttggtgctctgatgatgtaacatggagattgtccttgtctccatcgctgtctttactggtgtatgcccatgaggta

SEQ ID NO: 43538 - DNA, 201 bp, Homo sapiens
cgtcgcaaagtgctgggattacaggggtgagccaccacgtctggcctgacatcagtcttttcctgccttcagacttgaactgaagcatcagcatttcttgkgttttgatcttgctggagttggactgaaactacacatcagttctcctggctctccaccttgcctatagcggatcttgagactttttcttattttatctat

SEQ ID NO: 43539 - DNA, 201 bp, Homo sapiens
accagtccctagcctgtggagaaggggcaatctcttatctgaaggcctaggaggtgcagggatgtttatatgggctgctagcgcttagtttcctgccacarggagacagtaagaaaggtgacgtcaatctgagatgagagagagagcaaaacagttcttttgaccaccttgaccccgaccttgaaataaggtggaactaat

SEQ ID NO: 43540 - DNA, 201 bp, Homo sapiens
ggcttgctttaaatgttatcagtgtgaattgagatggtgtcagcattatttttttaaagaccaaaacaacaatagtaacaaacacacacaagccactgttrgattttacaaaactttaaaaagtaattatcttaaagatatctaagatagtgatctggttacatagattatcagagatacttttttttttgattatcagag

SEQ ID NO: 43541 - DNA, 201 bp, Homo sapiens
tccacaatgtccacataccagcttgatggtgacttgtgtcattctccatccccttgttaagagaaaatctactttatgagccctctttccaaccgcagtgwtgaggactagaccaggcaagatgatgccgctggaccactggatccagctggaccgctagaccacagagcccctggagcctcccaaggccaagcccgccag

SEQ ID NO: 43542 - DNA, 201 bp, Homo sapiens
cactttggctttacaaaactgcttattttcaaatttttaaatggggacaaaaacgaatatgctatattatatacttttatttatataatttttttttcagyaactttttctcttttgaaaatgcaagagcctgaaaaacattgtgaatatacttgtaacattgcaaagctatttcaccagagtaaagatattttggttgtt

SEQ ID NO: 43543 - DNA, 201 bp, Homo sapiens
aaggaagagaccaatttaaaacattctaatgagcatcatctcataatttggtaatctcatgtaaaatgcttataataggggtgtgtgtatgttatatatayttttaaaataaatttgtaatcatgtatacagtagtccccccttatccgtggtgtttcagtttttttttttttgagtcagagtattactctgttgcccagg

SEQ ID NO: 43544 - DNA, 201 bp, Homo sapiens
gtttggtggaattaacatagatttcccacatggggaaggttttgggtgaggatttagaacaaggcaggttcttgatcctcggaagagattcttatctgagrggggatttgagaatggcattgcagagtgggaggcgctgctgtgtggaaaaatgaactggaataattattagaacagttctcagaatttacaggatatttg

SEQ ID NO: 43545 - DNA, 201 bp, Homo sapiens
tctattgtttctcattacccatcgaccactgtgaagagatctctctgtgtaaaggcagtgcctaagctatcaccattaattatggaagtaatataaatgasacactctccacagtatgttctaaatgaaatattaacaaggccagcgtcttggaacctgagaaatggtctgttccagtgagctctgtatggaaatccacac

SEQ ID NO: 43546 - DNA, 201 bp, Homo sapiens
aggatatttgatcataggagtaactttcctcaggagtgatggatggaatgcctgtacttggaatatttttaaattaatctattttcattacattgaaagtrtgacacacagagaacactaaaattggatgaggcactacctggaattatataaagaatgacaaagatgcggttatccatttattttctaggcaagttagtt

SEQ ID NO: 43547 - DNA, 201 bp, Homo sapiens
gaggctgcagtgggctgtgattgtgccactgcattttcagcctgggtgacagaggaagaccctattacaaaaaaaaaaaaaaaaagggtctgttatcaacsatgcttttttattttattttattttattttcctgtttctgagttagagtctcttttgctcaggctggagtacagtggcgtgatcttggttcactgcagca

SEQ ID NO: 43548 - DNA, 201 bp, Homo sapiens
agtgcttatagtttttgaggaatcagtgagaaatgtcatctgaatgtctcttctcaatctttctgaaagataacttgcctataaacataaaattaaaagcytgctgtctgcttagttcaggtattgggtcagcgtcttgtgactatggacaagaggtgtttgactctaggactcagctacctcatctgttaaatgggcaaa

SEQ ID NO: 43549 - DNA, 201 bp, Homo sapiens
gatcacatgaggtcaggaattcgagaccagtctggccaacatggcaaaactccgtctctactaaaaattcaaaaattaggcttggtggcacgtgcctgtartcccaagctactcaggaggctgaggcaggagaatcacttgaacccagtaggcggaggttgcagtgagccgagatcgcaccactgcactccagcctaggtg

SEQ ID NO: 43550 - DNA, 201 bp, Homo sapiens
tagaacccactaacgctctatgtaactgtcttacgtgttccatttcttgtttctagactgtctccctccagtagaatgtgcgttctgctatacagcagtgytgtgtgacgcgatagcaggtcctttttaaacatctgttgaaggagaaaatgaaggcacacgtggccttgctgacatctgagtttgcaacttcttttatgc

SEQ ID NO: 43551 - DNA, 201 bp, Homo sapiens
gtccacatagaaaaacctgtttctctattttgttttcaaaattatatcatctttataataactgttagtacctagaaaaatgcatacattttattccttascaaaaccagttaccctatagtcaaaaggcattcagaagtattagcagaaatgtagtcagtagccaggcatagtggctcacacctgtaatcccagcacttg

SEQ ID NO: 43552 - DNA, 201 bp, Homo sapiens
gttttcgagactgagtcttgctctgtcgcccaggatggagtacagcagtgcaatctcggctcactgcagcctccaactcccggctccagtgattctcctgyctcagtctcccaagtagctgggattacagggatgcgccaccatgcccagctaattttttgtatttttagtagagacggggtttcaccatgttggccaggc

SEQ ID NO: 43553 - DNA, 201 bp, Homo sapiens
agtcctaggcttggttacaaagggcaatgaagggtcttttctgtccttaagcactcacaggtagcttaacagtaatgccttggattccttccttcaagagygacagcaggaagcccagcttctctggtagcagagcaggggtcctcaaagcagaccgtgaggtcagaggagcactggagtcaggagtttccatctccaccc

SEQ ID NO: 43554 - DNA, 201 bp, Homo sapiens
ttgtcttctcctctgagcgggaactgggcaattggaggttctttcccctcccgtgctggtgggagaattgtttagtaggtcataaagtggaatctccattycagtctgatccggtcaattctggtaggacttcatccaagcacaaagaaacctttgttttcattcaagacttccctaaaaggtggctgggtgcggtgcctc

SEQ ID NO: 43555 - DNA, 201 bp, Homo sapiens
gccctccggggggtggggtatcaagggagagtatgggctttgaaactgctcatcccgtctacaaccttggagggcatggtgtttcactcccccacctctcyccacaacttcaccctgctccaatgaggatgaaaatgtctttcttatagatgggacaggagccttagtaatatggtgcgagcaatggttcacataggggac

SEQ ID NO: 43556 - DNA, 201 bp, Homo sapiens
aaggctacagtgagctgtgatcctgtctctacacctcagtctgggtggcagagcaagaccctgtctcaaaaaaaaaaaaaaaaaaaaaaaagtaaaataawgcatgggaagtcccttatacagtttgtgatatgggtacacactcagtgaaatggccattaatactgctgttcttaactctgaaagcagagtgggccattt

SEQ ID NO: 43557 - DNA, 201 bp, Homo sapiens
tggtttactactccttagacggtggcccagagaccctttaaatgaaattcattttactagcaccctttttcatcatgagaaatatattctgtttttcttaraaaatgggttatgttaggtctggtcaaggtaaataagtgttgagagtcgatgttgtgtgcatagttaatttcaattctttgaagaagctcccccatgata

SEQ ID NO: 43558 - DNA, 201 bp, Homo sapiens
ctacctatctatgatcacatagacatttggaagcaaagagaaatgcttttcatgtgggaaaaaccaataccaacttcagtgatattatttctccgcccccygcaccgggctcttgggaatatctcttagccctcaattgtcacattcattcagcagatgttagcacgtgcaggcaccattctaggtgttggggatacatcc

SEQ ID NO: 43559 - DNA, 201 bp, Homo sapiens
gtattcttccagaaaaaggttatctatataccagcaaacacactcacattctgttctgtactttttttttttttaaacttagtactgcaggagatctgttrttagtgcatatagatctacttcattgttttaactgctgtataatattccatcatgtgcttatgctataaccagtcttccctttggtggccatttaggttg

SEQ ID NO: 43560 - DNA, 201 bp, Homo sapiens
tttaaacttcatggtgagcagaacactgtactccagactgtgaggccccacctgtgcagcctgctggcttctcataccagcttccttctcaccttaacccmacgtattgttgcaacggcaaaaaagagaattgcacagaggaacaccacctatcagagttcacactgagtttgcagattcatccttttgcttccagccatc

SEQ ID NO: 43561 - DNA, 201 bp, Homo sapiens
taggacccatatccctggattgttgaggaaatacgtgaacatatgtggcacacattatagtgtctggcatacaataaatactttgtaatgttactggtgtyttcttaccgttattgtctcactggtgaccgtttgaaatgttgaagctttattattacagataatggtggatatagtctcttccttgtttattttttgaca

SEQ ID NO: 43562 - DNA, 201 bp, Homo sapiens
ggatggtcttgatctcctgacctcatgatccacccgcctcggcctcccaaagtgctgggattacaggcgtgagctaccatgcctggccctgatgtcacttyttaggctaatttctgtgaaattgtgattgggaggaaaaagtgaacaggaacttaaagccagcagaggaaagctacctgcccttcactggtggtcagtgca

SEQ ID NO: 43563 - DNA, 201 bp, Homo sapiens
atactttgtaatgttactggtgtcttcttaccgttattgtctcactggtgaccgtttgaaatgttgaagctttattattacagataatggtggatatagtstcttccttgtttattttttgacagaatctttttttaaaaaagtttttatttgtttggtgagaatttacttgttacaggtctagtgctgttatagttgaat

SEQ ID NO: 43564 - DNA, 201 bp, Homo sapiens
agataaacattatgtattcttccagaaaaaggttatctatataccagcaaacacactcacattctgttctgtactttttttttttttaaacttagtactgyaggagatctgttattagtgcatatagatctacttcattgttttaactgctgtataatattccatcatgtgcttatgctataaccagtcttccctttggtg

SEQ ID NO: 43565 - DNA, 201 bp, Homo sapiens
tcctctgccctgtcctcaggcttagccttagtgggcctggtttttgcccccctccagttttagcttcccatctaaaatacaagggaaaagacagcaaggasaggacacttcctcctagtgtcttgtaaagctgcaagggagtcgcggctgagtcgaggatccacattcctggatgagtccttttgttaccagcggagggtg

SEQ ID NO: 43566 - DNA, 201 bp, Homo sapiens
ttacaggtctagtgctgttatagttgaatgttttgaattatgtaacttaagtgaaacataaagctatgacttgaattttgtggttagaaattttctcagtygattgacaaggatggcgtattggccaccttttgccgcagtaacaaacaatcccagactctcaaggcttgcaaaaataaatgtgtgtttgtttgctcataa

SEQ ID NO: 43567 - DNA, 201 bp, Homo sapiens
gctcctgttgtacactgtcccttcaataaaagttgctaacaccaccaccttgcccttgaattctttcctgggcaaagccaagaaccctgttggcctaagcygcagttctggggttcgcctgccctgcatcaccagcacagtggaaggccacaagctcacagcattttcatccgtaaacaaagcttggcaatatctctgatg

SEQ ID NO: 43568 - DNA, 201 bp, Homo sapiens
gtaacaaacaatcccagactctcaaggcttgcaaaaataaatgtgtgtttgtttgctcataacacatgtggctgagggttggccgtggctccacagtcacrggtgggctttcctgggctcagcttctcacagcgtctccttgcagggcccaggctgtaggagatgtcatcagggcctgcagagggcaaaacctcacagagg

SEQ ID NO: 43569 - DNA, 201 bp, Homo sapiens
aacccatcacccaaattagtaaacatagtactcaataggtagtttttcaatccttttctccttccctccctagtccccccttttgaagtccccagagtctrttgttcctgtcttcatgcccatgtgtacgcagtgttgagcttcgacttgtaagtaagaacatgcggtatttggttttctgtttctgcatttattcgctca

SEQ ID NO: 43570 - DNA, 201 bp, Homo sapiens
tcagtttagtcgggactacacaaatgagtcaataactgtagtggagtgatgcgatctcaactgccaggaatcccccggctctcctctcttcctgtgcctcytcaggtaattagctatcctttctttcttttattttccttccttccttccttccttccttccttccttccttccttccttccttccttccttcctccctcc

SEQ ID NO: 43571 - DNA, 201 bp, Homo sapiens
tttgagccaggctgtggatcaagatgaaagaaaaattaaattgtatattgaagagctcttaattgagccatgctgtatttaacagggaagcatcggcttcwggcagtcgataccactgaggatttttaatgccctgcatcatgagactgtcagtttgctttggagaatgcaaacaggctaatgacaaagccctgcaaactt

SEQ ID NO: 43572 - DNA, 201 bp, Homo sapiens
cacgtggccttgctgacatctgagtttgcaacttcttttatgccttctgctaactgggaccccagtgggcttccctgctacaccctctgaggttccccagwcctgccaagctgttccatccccagttccttggtgcctgctggtacttcaccctggagagcccagcccttccacttgttcagatctcagtctctcatctgg

SEQ ID NO: 43573 - DNA, 201 bp, Homo sapiens
ctaactgggaccccagtgggcttccctgctacaccctctgaggttccccagacctgccaagctgttccatccccagttccttggtgcctgctggtacttcmccctggagagcccagcccttccacttgttcagatctcagtctctcatctgggagggacagcttgagcactatgacctgtgtgaagcttttcccagtgctg

SEQ ID NO: 43574 - DNA, 201 bp, Homo sapiens
ttggcgtgagctgagatcgcaccactgcactccggcctgggtgacagagcaagactctgcctcaaaaaaaaaaaaaaaaaaagaaaaaaaaaagattgaamatgtggaatatgagacaaatgaaaaagattgaattccgttccaactgggcttttgaatttattttcgcacttcctattttttgagcccgggagtgcaaga

SEQ ID NO: 43575 - DNA, 201 bp, Homo sapiens
ctgtactctttaaccaaggctccttttgcaaagagaaatctgagctgctttttaaagaaggccgtttttaaataaaaatgcaaataagctactttgtaacyacattaattacccacctagcctcttattaccatgtttgtattgtttgcaaatactatttacagtcgtgtggaaattaacattactggtcctgaggaaaga

SEQ ID NO: 43576 - DNA, 201 bp, Homo sapiens
gacatccatttgggcattgtatatgttttgataggattacataaataatgaaattgtatgcaaagcatcagaatgcaaaaggtgttttctccaaggtgtayacactgcctgggccttgtactctggccctcaattttcttaaacagctgcatcttttgggggctctgttaagacatgctactgtctttagtattttgcccc

SEQ ID NO: 43577 - DNA, 201 bp, Homo sapiens
gaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctg

SEQ ID NO: 43578 - DNA, 201 bp, Homo sapiens
acgaaacataccttccagtctcccgagtagtgtattaggctaagtatggtcttttaaattattactttaaaaataaaagataatggaattatagcattaartacattttgcaaatgatcttctagtaggattattgaaagacagtaaaggcaagtataaatcagaagcaaaatcattgtcctctaattcattaatggttaa

SEQ ID NO: 43579 - DNA, 201 bp, Homo sapiens
gctgggagtacaagtgtgcaccaccatgcctggctaatgtttgtatttttagtagggacggggtttcgccatgttggccaggctggtgtcaaactcctgayctcaggtgttccaagaacaaaaggccaaccccattagacggtggccaagttggtgctgtgaacagggatcctgcctctgcctcccaaagtgatgggatta

SEQ ID NO: 43580 - DNA, 201 bp, Homo sapiens
ggaatgccatttgacagttacaggctcccgtgaggcggtgcaggctcctccgagccagggatggagctggggattgagtgacacaagactctttgggtatstctcaaacaatataaatcaccagcaaaatctcactcctacaaggagaacctgcagggagctccgtgggaggcactgctgtttactctcctcattccccac

SEQ ID NO: 43581 - DNA, 201 bp, Homo sapiens
agcaggacacactgcaaatactaggaatccttaagtacagtggaaccccagagcactctacctgctttctttctcacctccttaaaaactttttttgcccwcacctcatcatttattcagcagtcacaacagtgccaagaacttggctagagattggaaataaagcttatgccttctctcatatctcctgtaccttatttc

SEQ ID NO: 43582 - DNA, 201 bp, Homo sapiens
agcttcttaaaggagctgcctcagactgtctcaagatcttagaaggccatgcctacattgccaccagcatcccttggctttttgcttggcttaagaatctrtcttttccgttcctccttccagcatactcagcacagtccacctctgtggtctctctgtggttttctttctgttttcctgctctctccatttctcattcac

SEQ ID NO: 43583 - DNA, 201 bp, Homo sapiens
tgaaataccttggatttaggaattggagatttccttgggtcaggtttcaccctcttcaagtagcgtctcaaacagtatacccactacagctttctccccastctgtcaaccatgccatggggcctactttttgccctgactcccaccagataatgcccatcagatggcacctcttttggctgaaaaatcgaaaactcatca

SEQ ID NO: 43584 - DNA, 201 bp, Homo sapiens
gagtctaggactcagcagctgtcaccttcccaaagtcacactgctgatgagtgacagagaccacatttaaatctgtgtgtttacaaggtctacaactgcaycctgctacctcccagaagctgaggcaggatgggcaggttgccacaccctcccaacctcctgcaaccttagttgttagtgaaaggttattaaataggcctc

SEQ ID NO: 43585 - DNA, 201 bp, Homo sapiens
cagctctgagagcaaggccaaatcaccagattgatgcctttggctgtgtatctaaaggacgtgccattgcagctaagtggacctgaatgtacagtaagacytagtggtcaccagaatgcatgccaccccggtgcttctgcatgcaaagggtgcgggccatgtgccagtcacagtggaaaaggcatgcttcgtgtcagcaca

SEQ ID NO: 43586 - DNA, 201 bp, Homo sapiens
acatgatggcaaccaggctccaatatctgccagttcccctgtacagattcctctttagcattctctcggcttccctcctcaacaattaattcagatgagcmgttgggagagtgcaggatccagttcaaaaggatctgtccccccgtgaaccccaggacagggtgagaggccacctgcacactttttttttgtcagctcaca

SEQ ID NO: 43587 - DNA, 201 bp, Homo sapiens
ttggccagactgctcttgaattcctaacttcaggtgacccacctgcctcagcctcccaaagtgctgggattacaagcatgagccactgtgcccagcctagraataacttttaaatcagaaaaatacattttttaaaaagatgtaaagcatacatagaggataacttacaaatctgcatttcatgaccacatatatctattg

SEQ ID NO: 43588 - DNA, 201 bp, Homo sapiens
gagatgtagctttgaatggccacatgagtgtttttttaaatgaaaaaaaaatctatgtataacttgtttcctgtgagggtgccaggaaactttacaatgarcttcgtgaattaaacctctaccagatgaatagaggtggtggcatggtagcagaaattaggattaaaaaaatggtttttgatttatgaaaaatttttctgc

SEQ ID NO: 43589 - DNA, 201 bp, Homo sapiens
ggctcttgatgctggctacaccctcagtaagagatactgtcctagggtcatttttttcaacccacactagttacgtggactgtcttagtcagtccaggctrctataacagaataccgttgactgggtggcttgatttttttttttttctcccagttctggaggctggaagtcagatatcagggcaccagcatggttggttt

SEQ ID NO: 43590 - DNA, 201 bp, Homo sapiens
aaatggatttagaaatggtacagtcagaggttaggggtcgggtcaaagcgatccccccagagacctgtggaaagtgtggttctgtctacaagctgcgaccrtggtctttactgcttctgcaaatacttgacaaaaagggccacactcttagctggacttttcctccctttcctgaaacaatgcccttcccattgtcaaggc

SEQ ID NO: 43591 - DNA, 201 bp, Homo sapiens
attgcattgcaaataatagcagttagtgggagttgagagccagctctgcaccagactcgtatcagccacttgacctccattattccttattccttggtacytctgcgccatctgtgatatcagatccttttttctgcaaggaaactgaggctcggcgatactaagaaactcagccagggtccgtcagctgtcaagtggcat

SEQ ID NO: 43592 - DNA, 201 bp, Homo sapiens
cccatataccacagtttctaatacgatattataccaagctttaatatgagcacacctcctggatgatgctgtaaattagttgcctcccaccacaccacatsaagtataatggatataatatgatttttcagaattcagctaattacctactgagctttacattttgtaacttttttgactgtccatcaaaatgtctttggg

SEQ ID NO: 43593 - DNA, 201 bp, Homo sapiens
gtagtttaactaaaaagtggccactgtctcctggtagcggttggtaagccatccagtctctgcaggcatctacgctccaggtctccagtctgaggagtctsgctcctggggcaggtgcctctgggggtctctgccaggcttgtctggtcatgcagctacttccagactgattcctagatcttgcatttttacataggacat

SEQ ID NO: 43594 - DNA, 201 bp, Homo sapiens
aactaaaaagtggccactgtctcctggtagcggttggtaagccatccagtctctgcaggcatctacgctccaggtctccagtctgaggagtctcgctcctrgggcaggtgcctctgggggtctctgccaggcttgtctggtcatgcagctacttccagactgattcctagatcttgcatttttacataggacatccccagc

SEQ ID NO: 43595 - DNA, 201 bp, Homo sapiens
ccctagttgtatcaccttcctcccattatgtttgtaacttcagattttgtatatttcgcatatgtcaatatgtaaacattttatatatatatatatgcatkcacacacatgcatacatatatgtaatggtatatatacatgtaagtttccatttttgctcaaattgctctggacagttctttgctctgggagttctttact

SEQ ID NO: 43596 - DNA, 201 bp, Homo sapiens
gttgcagtgagcccagatcgcaccactgcactccagcctgggtgacagagcgagactccatctcaaacaaacaaacaaacaaacaaacaaactaagaacarcaacgaaaaaactcccatgtattatctatggattgactgtaaaatatgagaagcaataaatatgttcatcactagggccatctagaaatttctaacccaa

SEQ ID NO: 43597 - DNA, 201 bp, Homo sapiens
gagaagcaataaatatgttcatcactagggccatctagaaatttctaacccaagggtcaactaatctttccctgtgttgtatttcctgctctgcggatccrgcatcatgacctttgtactacccaggaaagccagtgttctcatgggctcttctcttttttatgctctaccagatgctagcactgtggcatgccattcgct

SEQ ID NO: 43598 - DNA, 201 bp, Homo sapiens
taactgggtgtggctgtgtcctaataaaactttatttacaaagaacaggaagtggcttggatttggtatctggcctggcagctgtggtttactactccttrgacggtggcccagagaccctttaaatgaaattcattttactagcaccctttttcatcatgagaaatatattctgtttttcttagaaaatgggttatgtta

SEQ ID NO: 43599 - DNA, 201 bp, Homo sapiens
tgtctgtttatagaaagtgtcaccaagttctgtcttgggcccgtccactcggttatatgtgctggaccctgggtggaagcactttgcacgtgtgcattcaygatgggctgtgctggaggggaaaacaggcatcactcccaaattctattcatgcaattaaaaattcctttcatttttatttgtgagagggtatgggtgcac

SEQ ID NO: 43600 - DNA, 201 bp, Homo sapiens
ttacaaagaacaggaagtggcttggatttggtatctggcctggcagctgtggtttactactccttagacggtggcccagagaccctttaaatgaaattcaktttactagcaccctttttcatcatgagaaatatattctgtttttcttagaaaatgggttatgttaggtctggtcaaggtaaataagtgttgagagtcgat

SEQ ID NO: 43601 - DNA, 201 bp, Homo sapiens
ttggattatttatttatttatttatttatttatttatttatttattgtttgagacagtctcactttgtcaccaagtctggagtgcagtggtgtgaccttgrctcactgcaacctctgcctcccaggttcaagtgattctcttgcctcagccccctgagtagctgggactacaggcacgtgccaccatgcctggctaatttt

SEQ ID NO: 43602 - DNA, 201 bp, Homo sapiens
cccctttcctttcccaaacttttactagcttcttccatcctggacttgcaatctggctgaaaacctgctaaataagggaacaattttgacatggctcctgkactccccacaaacctagttgattccagaccagtaatgtcttggggacagtgttgtcccatcttcctttctaggctgggctcagattactgacgtggaaga

SEQ ID NO: 43603 - DNA, 201 bp, Homo sapiens
gcagtctgattgtgcgacagaaaagaaaaacccattttctggggagaaattcaagctggctgcagaaatttgtgtaagtggcaaggaacctaatgttaatstcgaagaccatgaggaaaatgtctccaggccatgtcagagactttcacagcagcccctcctatcagaggcctgaagtcccaggaggaaaaaatgatttca

SEQ ID NO: 43604 - DNA, 201 bp, Homo sapiens
aagcagagcatcaaggtttggaaaatttgcagtctgattgtgcgacagaaaagaaaaacccattttctggggagaaattcaagctggctgcagaaatttgkgtaagtggcaaggaacctaatgttaatctcgaagaccatgaggaaaatgtctccaggccatgtcagagactttcacagcagcccctcctatcagaggcct

SEQ ID NO: 43605 - DNA, 201 bp, Homo sapiens
gtgaggacacatcacttgcacctcagtgtgagtttgaaagtgttttctctggagaataattctgaagaaataggccctccagatatcagtagtgacagggstatcagtaatgttgattactaagttcttgccacaggtagaagccatgctactgcacaagtttcatacttgaagagtggacatctgacacagtgttggtgg

SEQ ID NO: 43606 - DNA, 201 bp, Homo sapiens
agtcttcaggcccacagtgtaggcattcaacaaacgctcttcagggagaaggaaagttaccatcaaaatccgtcgttgaaagtattgaagttccagctggyggtctgatacagcttagatgttgtccctgcccaaagctcatgtcaaaaggtaatctgcagcgttggaggtggggcatggtgggaggtgattgggtcatgg

SEQ ID NO: 43607 - DNA, 201 bp, Homo sapiens
aagaggtgacttgggtgctgttaaaggcattcagttttataaaagaagcagagcatcaaggtttggaaaatttgcagtctgattgtgcgacagaaaagaaraacccattttctggggagaaattcaagctggctgcagaaatttgtgtaagtggcaaggaacctaatgttaatctcgaagaccatgaggaaaatgtctcca

SEQ ID NO: 43608 - DNA, 201 bp, Homo sapiens
ttattttaattttttaattgaattcagctttacagtatcttttgtagggggtaattttagcttctttctccgttgaaaacttcaagtaaggaaacacttayattgctagtgagtggccagctggagttgtaggtctaattctttttttttttttaagacggagttgtgctcttgtcacctaggctggagtgcaatggcatg

SEQ ID NO: 43609 - DNA, 201 bp, Homo sapiens
attcagaggttgtttttatagcagcaacacagtaagttgggaagagggacacatttttaacatagacaccaaaagagaggctggaagagttgaccacttaraaatgtcacgagtgtctgtgaatagtgttgggggctgagaggcaagagaagaaaatagtcctaatgttgtacaagtagcaatggaaacaaacttgttaaa

SEQ ID NO: 43610 - DNA, 201 bp, Homo sapiens
cccacagtgtaggcattcaacaaacgctcttcagggagaaggaaagttaccatcaaaatccgtcgttgaaagtattgaagttccagctggcggtctgatayagcttagatgttgtccctgcccaaagctcatgtcaaaaggtaatctgcagcgttggaggtggggcatggtgggaggtgattgggtcatgggggtggattt

SEQ ID NO: 43611 - DNA, 201 bp, Homo sapiens
ggtctaattctttttttttttttaagacggagttgtgctcttgtcacctaggctggagtgcaatggcatgatttctgctcactgcaacctccacctcctgkgttcaagcagttctgcctcagcctcctgagtagctgggattacaggtgcctgccaccatacccagctaacttttgaatttttagtagagatggggtttca

SEQ ID NO: 43612 - DNA, 201 bp, Homo sapiens
aatctgcagcgttggaggtggggcatggtgggaggtgattgggtcatgggggtggatttctcatgaatggtttaccaccatcctcttggtactgtcctcamgatagtgagtgagttgttgggggagctggtcatttaaaaatgtgtggcacagccccccaccctgtctcttgctcctgccctggccacatgacgtgcctgc

SEQ ID NO: 43613 - DNA, 201 bp, Homo sapiens
tctgtttttcttagaaaatgggttatgttaggtctggtcaaggtaaataagtgttgagagtcgatgttgtgtgcatagttaatttcaattctttgaagaarctcccccatgatatttcacggctgagagaagaggaaagagtttaagtggaacagtgtgctttgctgagctttggaaatattaccatatagggaagcaggt

SEQ ID NO: 43614 - DNA, 201 bp, Homo sapiens
atataatgatgataataattgctaatatttatcagctatttatcatgtgtcatgtacagctaagcacttacataccatcccattttatccttataatgackctaagagtgggttaaaaaatggcagaagaatggcagtgtttaatggttcagcctggtgcaatgattaaccacattttacagactaagaaattaagaacct

SEQ ID NO: 43615 - DNA, 201 bp, Homo sapiens
acatatgtattcattcattcattcatttattctttcattcagtcaataaatatttattgagtagtaagcacatgcaaggcattgagggtggggagggaaaragacacaaattgtccttaccctcatggattcaccatctatttaaaggccacaaatacttgtgtgagaagcaagtcttaatagtctgaagtattttcttag

SEQ ID NO: 43616 - DNA, 201 bp, Homo sapiens
ttcagtcaataaatatttattgagtagtaagcacatgcaaggcattgagggtggggagggaaaaagacacaaattgtccttaccctcatggattcaccatstatttaaaggccacaaatacttgtgtgagaagcaagtcttaatagtctgaagtattttcttagattcccttgagccgcaatgctgaaaagcttatggtgg

SEQ ID NO: 43617 - DNA, 201 bp, Homo sapiens
ggagggaaaaagacacaaattgtccttaccctcatggattcaccatctatttaaaggccacaaatacttgtgtgagaagcaagtcttaatagtctgaagtrttttcttagattcccttgagccgcaatgctgaaaagcttatggtggttttgctaatgaatttgacaaggccagaaatagaccagatgaagattgatccat

SEQ ID NO: 43618 - DNA, 201 bp, Homo sapiens
caatggcatgatttctgctcactgcaacctccacctcctgggttcaagcagttctgcctcagcctcctgagtagctgggattacaggtgcctgccaccatrcccagctaacttttgaatttttagtagagatggggtttcaccacgttggctaggctggtgtcgaactcctgacctgaggtgatccacctaccttggcctc

SEQ ID NO: 43619 - DNA, 201 bp, Homo sapiens
ataaaaatttggtatcaattgtttggctaaattatgcacagtgggccatcctaacctgccattaacataacgtatgctaaagaatgtgttgtgtttttttsttttctctgataattatactctaaagcatcaattgcttatttgagtaaattaaactttgagttgttcttatttcttcaaactttcaaattgtcttgcctg

SEQ ID NO: 43620 - DNA, 201 bp, Homo sapiens
atgggcatgtgctgtgtgccattctctccccttatcagtgggttcccagctgcctggtgtacaggagggttaagtagatacctgttgagtgattgtgaatrttttcattcacgggggcagatttgtgtcctactaacaccagacatgtcctgttttcagattacttctttttcaacatctgagtacctataacatctaaag

SEQ ID NO: 43621 - DNA, 201 bp, Homo sapiens
actagcttcttccatcctggacttgcaatctggctgaaaacctgctaaataagggaacaattttgacatggctcctgtactccccacaaacctagttgatyccagaccagtaatgtcttggggacagtgttgtcccatcttcctttctaggctgggctcagattactgacgtggaagagttgttggtcctggtgcaacatg

SEQ ID NO: 43622 - DNA, 201 bp, Homo sapiens
tggcatctagtgggcaaaggccagggatagtgctaaggatcctgcagtgcaaaggagcatgcccaccacaaaatatcagcagtgccgaggttgggaagctytgtgccattgtgcaaagattcaaggtggctatgtcacaggactggtacatgtccttttttttttttttttttttttgagacggagtcttgctctgtcgcc

SEQ ID NO: 43623 - DNA, 201 bp, Homo sapiens
atagaagtttatgacggaaaaggcaaaattctctgtgtctttatggggagatattcgatatgttttttcttggcagaaataaaacatattcaataatatamttaggcaaacttgttttacttgacaagaagaccgtatctccgtctgcaagatgaaggcaagatcaagagatgtcagttaacattcttgcgaccacaggta

SEQ ID NO: 43624 - DNA, 201 bp, Homo sapiens
gatttgaaatatgtgccctgaagttttgctatgttgaaaaaaatgatgagccgggcacagtggctcacgcctgtaatcccagcactttggaaggccaaggmgggtggatcacctgaggtcaggagtttgagaccagcctgaccaacatgttgaaaccgtttctctactgaaaatacaaaaattagccaggaatggtggtac

SEQ ID NO: 43625 - DNA, 201 bp, Homo sapiens
ggaaaaggcaaaattctctgtgtctttatggggagatattcgatatgttttttcttggcagaaataaaacatattcaataatataattaggcaaacttgtkttacttgacaagaagaccgtatctccgtctgcaagatgaaggcaagatcaagagatgtcagttaacattcttgcgaccacaggtagggaggagaactggg

SEQ ID NO: 43626 - DNA, 201 bp, Homo sapiens
atgatcttgccactatacatcagtctgggtgacagagcgagactctgtctcaaaaaaccaaaacaaaggtcaattttttttccacattcatctataaaacrataaaggaaacatcctagacacttgaatcagagcccttttaattatgacttcaaaaaacagggctcgtgccacccaagatttcctccatatacaaaaaaa

SEQ ID NO: 43627 - DNA, 201 bp, Homo sapiens
aaggcaaaattctctgtgtctttatggggagatattcgatatgttttttcttggcagaaataaaacatattcaataatataattaggcaaacttgttttasttgacaagaagaccgtatctccgtctgcaagatgaaggcaagatcaagagatgtcagttaacattcttgcgaccacaggtagggaggagaactggggagg

SEQ ID NO: 43628 - DNA, 201 bp, Homo sapiens
aggttgtgtctgagattcagaggttgtttttatagcagcaacacagtaagttgggaagagggacacatttttaacatagacaccaaaagagaggctggaaragttgaccacttagaaatgtcacgagtgtctgtgaatagtgttgggggctgagaggcaagagaagaaaatagtcctaatgttgtacaagtagcaatggaa

SEQ ID NO: 43629 - DNA, 201 bp, Homo sapiens
gttcaagaaggtcttgggcaagcgcgtgctagttattttcctcactggtgtggtcgtgacagatgaatcacattttactctcctccctttctcatagtatrattacataaaggagaccttccctggaaagagccctgtgcatggcttttgagagtgggcctgggctaacagtgagtgtggaagcttgctgccttgaattct

SEQ ID NO: 43630 - DNA, 201 bp, Homo sapiens
ttttgcatccctagacatcatcctttttgagagagaaaattccgagtgtcagttttcctttatcggaacctccttttatttgaactaaccacaatgggtcrtaatttataggcccagtcagcgcatcattgctcagatagagtcatttacctacaagtatccatcagttaggtgggggctgctagattttttaagtggaaa

SEQ ID NO: 43631 - DNA, 201 bp, Homo sapiens
gggctaacagtgagtgtggaagcttgctgccttgaattctttccaattctggagagttgatgggtaacaagtgtgtatctatagtctgcttggacatggcrgtgtggccactgacacgttgtcagccatcccctcaactccagggacaggaatggtgagaaggtggtgagggcacagtctgcccggagacgggacagtttg

SEQ ID NO: 43632 - DNA, 201 bp, Homo sapiens
tgcctctctttccttagtcctgtgtgcttccccttgatttcaccaggacaattttataccaatcccttgtattttagaagagcctgatacatttgcaaggwctctctttatattcctgaattttgcatccctagacatcatcctttttgagagagaaaattccgagtgtcagttttcctttatcggaacctccttttattt

SEQ ID NO: 43633 - DNA, 201 bp, Homo sapiens
tcagaaatgcatgtcagagctacacaattctatccaaggcattaactgttgtcaagtctgttttttatgaatatgtttcaatataagaaattgtcttaggyccaaagtgaaacgtcttcctccttgactcatagcaagctcatgcaggtatttgaacattgttctgtataatatgtgcacctttgagaaatcccatgattc

SEQ ID NO: 43634 - DNA, 201 bp, Homo sapiens
atgcagtgttttccctgcaaaggagaagaaatatatttcttgcctctctttccttagtcctgtgtgcttccccttgatttcaccaggacaattttataccmatcccttgtattttagaagagcctgatacatttgcaaggtctctctttatattcctgaattttgcatccctagacatcatcctttttgagagagaaaatt

SEQ ID NO: 43635 - DNA, 201 bp, Homo sapiens
atgagggccaggacctcatggtcataaaagtaacattagacctattcctagtaatttgatctaggttggcctgatttttgttgtggtggcagtggtggctrtggttgtcaatttaatggaatgtatttggaaagagcaagcttcttcccaatgcagtgttttccctgcaaaggagaagaaatatatttcttgcctctcttt

SEQ ID NO: 43636 - DNA, 201 bp, Homo sapiens
gccacttgcagaccttggcagttgctgttgctcctgctgctgctgctgctgctgcattgtcaagactacattgatgtcttggaaatatagaaaaaagaggmtgctggactgtgtgcttagaatcagtgtgctaactctgttaccaacaccgtagagaagtggttccagaaggaagagttcagggtgagaatgaataacgga

SEQ ID NO: 43637 - DNA, 201 bp, Homo sapiens
ctgttgctcctgctgctgctgctgctgctgcattgtcaagactacattgatgtcttggaaatatagaaaaaagaggctgctggactgtgtgcttagaatcwgtgtgctaactctgttaccaacaccgtagagaagtggttccagaaggaagagttcagggtgagaatgaataacggagtggctttgcagtgggaacctggc

SEQ ID NO: 43638 - DNA, 201 bp, Homo sapiens
cttgtctacattttgaggctcttctattatggaagagggctagagaggccatcagaatttggtttcactagcctttgatccttcctgtttaaggagctcarcatttagcttcacttccctgtcattcatcagaattcattctcagattggaattgtccagtcttagagtgatttttgtccccagtgacacttcccttatat

SEQ ID NO: 43639 - DNA, 201 bp, Homo sapiens
tggaggaggattcaagccccttgcaacggactgaagtgcccaagctctaaatccctgccacccacagcctctgttggccccaggttgtgtctgagattcaraggttgtttttatagcagcaacacagtaagttgggaagagggacacatttttaacatagacaccaaaagagaggctggaagagttgaccacttagaaatg

SEQ ID NO: 43640 - DNA, 201 bp, Homo sapiens
agggggtggaggaggattcaagccccttgcaacggactgaagtgcccaagctctaaatccctgccacccacagcctctgttggccccaggttgtgtctgarattcagaggttgtttttatagcagcaacacagtaagttgggaagagggacacatttttaacatagacaccaaaagagaggctggaagagttgaccactta

SEQ ID NO: 43641 - DNA, 201 bp, Homo sapiens
gcagtcccaaagcccggggcatggatccagagaggagggtgaagaatgggcccctgacccaagactgcacttgtatttgagttgcataagaagctgctgakgaattttaagaacaggagtgacatgacttccgttacaattgaaaaaatcaatctggcgaaatgaatggggctacataggttgggggaaggaggtaagaga

SEQ ID NO: 43642 - DNA, 201 bp, Homo sapiens
ttgttaaacttcttgcactgagctttaccaggtgagctgacagttatcctctgcattcatcaatataagccccataaaaggcaaagtggttgaggagaaaygagaaattacagcccagattagcagccttgagtgctccttgtgaacacaagacactgacccaaatcacacgtcacggctcttcgcccattaacgcttata

SEQ ID NO: 43643 - DNA, 201 bp, Homo sapiens
catcaatataagccccataaaaggcaaagtggttgaggagaaacgagaaattacagcccagattagcagccttgagtgctccttgtgaacacaagacactsacccaaatcacacgtcacggctcttcgcccattaacgcttatagcaggattattcccaaggaagctgtagccattatatttgctgccatcacaacagtaa

SEQ ID NO: 43644 - DNA, 201 bp, Homo sapiens
cacggctcttcgcccattaacgcttatagcaggattattcccaaggaagctgtagccattatatttgctgccatcacaacagtaaaataaacaggtgtgaytgcagccctactcctcgggttgtttcatgctgatcagttgttaatatatgtgtgacttgaagttggagcctgttgggagaaaaagttgtctttagaggag

SEQ ID NO: 43645 - DNA, 201 bp, Homo sapiens
attttactcacccagaaggaagccgggtccctctttgcccctttgggtgtttgtgaaaagcaagttgtaaacactgaattctataaactgttggagacagrttctggagagacactcaggcttagctctagaaagaaacgggtaagacagaggaggttcagggcaactgtgttgccttccttgactggtgcatgggaattc

SEQ ID NO: 43646 - DNA, 201 bp, Homo sapiens
aggagtaaagtgttgccttgctgtgggaaggggaaactttttcttgggaagtggactcaccaataatttttgcatcatgcgcaggagaccctactaaaacstaagtgtgcaatgctttaaatcagtaagtttgtttttcattaacataaaatccaaaacaggtgctgtgatcagcaagccgctgtcctccaagtggtaatt

SEQ ID NO: 43647 - DNA, 201 bp, Homo sapiens
tgctggcgagtgtaccctttctgcagaaagtaaaaatggccttgctgaggaaattaaattcctgttcgagtgctatttctttatggcactgaggagcaagyatttctaacaatcatattgcttaagaagtggatggcaagaagataattactaatatgtctgcaattgatctgaaattgacacagttgatctcactgattc

SEQ ID NO: 43648 - DNA, 201 bp, Homo sapiens
tgaatggaccctgagtatcttagaatcttctgaaataatatgcagcattatattccatttgtacctgggaagagggtacttgtctttcatcagagagtcaycaatggaccactggtccctgctgatttagtgtcacagctcaaaaccatcagtagtcctcgtgatctttcggcattgtggctccctttgtgagaagggcct

SEQ ID NO: 43649 - DNA, 201 bp, Homo sapiens
gtgaatctcccaaccataagctgtattcaggcaggcacgaagtctcttatttactcagtgtttctggagcccagcatagtgcctcgcacacagcaagtgcycagtgggtatctgttgaaccggcaaaacaaacaaatgaataaattaatgggtggtcactgtactagttttctattgcttcataaacaaactatcacaggc

SEQ ID NO: 43650 - DNA, 201 bp, Homo sapiens
cactgtactagttttctattgcttcataaacaaactatcacaggcatagtgagttggaatgatggctctcaaaaaactatgtccacatcctataaatgctrttgtacaatatatggtcttttgtgattggcctcctccacttagcgtcgtgtttttgaggttcagccacagttgtagcatgtccatctctctttgtgtggc

SEQ ID NO: 43651 - DNA, 201 bp, Homo sapiens
gcatgttaacatcctggtagctctatttatttgctaccatggtacataatcatgggagctctatttatttgaacatcttcttttgttattatttggtgtayttgggaaaggcatgtgggagcagcaagcaggtgagcatcctgtttggaatgcagggccgggaactgccctgcccagtccagcctcattccagaggctagc

SEQ ID NO: 43652 - DNA, 201 bp, Homo sapiens
agctctctgcttctttggcagtctagtgctgtcacagaaggaaagctcactccatggaaaaggggggattgatttcttctctgagggcagaggctgatcartctaggctggtaggaatagatgtaacctcagaggaaacaatttgcattggcgaaagcaagtcaatggccatccccaaattcaaaaggacagggaagtgta

SEQ ID NO: 43653 - DNA, 201 bp, Homo sapiens
gagtgacaagccctggagacctgagggcttctggggcccccagggcggtttcaggaggctgtctccagacctgtccggggtgtgagcatgtcacgctgtgrcccgcgcctcccctgtacagctgcctctgctcttctaagcactgaaatgagaggtgtaacctgtgttccagagtctgcgcctcccagccactggggcagg

SEQ ID NO: 43654 - DNA, 201 bp, Homo sapiens
agctaattcctacctgtgcgatcactagccaagtactgaacctctctgaacttcaattatctcatctgtaaaaggtggttggtttgtaattgttcctaccycttagggcttttgtgagagtttagatgataaaccaccaagcaacagtggctggcattctgtgcacaatcgaagtctgctgctgtcagctctgtggtcgct

SEQ ID NO: 43655 - DNA, 201 bp, Homo sapiens
aggtggttggtttgtaattgttcctacctcttagggcttttgtgagagtttagatgataaaccaccaagcaacagtggctggcattctgtgcacaatcgawgtctgctgctgtcagctctgtggtcgctgtctgcactcccacccctgtcatcctccaagtctgatctcctcccgaagtctcttcctggacctcagccctc

SEQ ID NO: 43656 - DNA, 201 bp, Homo sapiens
gtgagatctgatagttttataaatggaagtttcccctggccttcattctctttcctgctgctttgcgaagaaggtgcttgcttctgctttgccttctgccrtgattgtaagtttcctgaggcctccctagccatgcggaactgtgagtcaataaacctctttcctttatacattacccagtctcgggtagtatcttcatag

SEQ ID NO: 43657 - DNA, 201 bp, Homo sapiens
tgagatattgggactgttcttattcccatttcacagatgagccactaactggctcctggcaggacagtgaataaggggcacaacagagacacaaacacatsgctaaccaatggtctcatccgtcagccacactgcctgtctcagcatgggccctgtgtggaccattccatctcaatttgtttctgattcttgtcaattaaa

SEQ ID NO: 43658 - DNA, 201 bp, Homo sapiens
cttgggctaaaatgtagttgttggcatttctttctggaggctctgggggaaggtcgttccttggccttttcccatgacgtagaggctgacacattcctctkctatggcctcttcatttttcaaagccagcaagattgcatctctctgtctttcttttgtggtcacattttaccaggactcttctcctgcttttttttttct

SEQ ID NO: 43659 - DNA, 201 bp, Homo sapiens
gcagcctgtaactcccagactgaagcgatcctcctgcctcagcctcccgagtagcttgtactgcagatgtgtgtcaccatacctggctgatttatacttayatttatgtatgtgcatgtgtgtttatatatatatatttgtagaaatgggattttgccatgtttcccaggctgggctcaaactcctgggtttaagcagtcc

SEQ ID NO: 43660 - DNA, 201 bp, Homo sapiens
caaagtagggaaagcacgactttggggccagggccctttctggttcagaatgtccctggccagtgtgcgccgtgcagtgtggaagcacgcttcggtgcgcrtgtaagtttacgtgctatctgtagggacagtgatttttattcattagagtttttgagtctaattgtttttaaactgccacttttgtttgttaaagataca

SEQ ID NO: 43661 - DNA, 201 bp, Homo sapiens
ctctgcgtggtgtgcaagttgaggcctggtgtatgcacttcggccacgggctttcccactgtaatgaagatggaatgactccatggatgacctttccgtgsctttgtctgtagcctgccctcctctttaactgaacaccttccagacgagcatgctctgaactcctgaactgctcattctgttctctgagagaattgctca

SEQ ID NO: 43662 - DNA, 201 bp, Homo sapiens
gggaggtaatcaggggtgtgctgggagggccagaacgatccacccacgtgttggtgccacccggcaatggaaaagcctctggcctcggccttctccggaasgttgtccgcggtgccagtgagagctgcttttcaccttacagcagccccggcctatctctcaggaggcctgctgataatcagtaaatgaaattcacctttc

SEQ ID NO: 43663 - DNA, 201 bp, Homo sapiens
tcttggactcattttcctcggtggtgaagtggggataatttattgacagtggaccgtgaggttctgcgcacaaaattcgttgcatagcacctgatacacasaaagctttcaggcaaggttagtttcgggtatttccagccttagtcttggctgtgggagccataatggagttgttcagaagtttacagctagtgtttataa

SEQ ID NO: 43664 - DNA, 201 bp, Homo sapiens
ttagatgctcttagttaaagaccatgcaaaaaggatgaaatcttttgatcatgttcttcacaatattagaggtaaaacatgaactcaacgcttttaggaaraaacaactggattgcgttttctattttattgacagaaactagatggggaggccagggtgtgttttattattgcacacatacgtaattacaaagtctttgc

SEQ ID NO: 43665 - DNA, 201 bp, Homo sapiens
ttacatttatcaaatgttgtcctgcccagtactttatattcattgttgcttccggacctagctgacaacatggtctatatgaaaaacaacacaaaacaacrcataagagagtcaaagggacttctttggggagaatataaaaacaagccaaggcgaaagtggctgtaaaaatgcgttgtgttcccaagtggaggctccttc

SEQ ID NO: 43666 - DNA, 201 bp, Homo sapiens
aagctgtaccttaagtttatagttatgcaaatgaaaaccattaatcctggagcctctgacttgcaaggtgtgcttcagaaatttgcagcttctatttaggyaggaagagtttgccagcccgaaaactccagtaagcaaacagctttatagtaccccagccatagaaagtgagagctttcgaagaatctgtggttagaacta

SEQ ID NO: 43667 - DNA, 201 bp, Homo sapiens
ttgatgatagcattaaaacaaatgcctcaaatcatttttggaaggagacaggatatgaattgacaaattaataaaataaattatacttcaaagatgctaarttatctcttctatgtaagtaggaggctctcttttcagatgtggaatttgtaggagcttgaatattctcaagagagggtatgggcaacatttgataaaaga

SEQ ID NO: 43668 - DNA, 201 bp, Homo sapiens
aatgaaaagaatcaggagtctattgaggagacagaacatgagtgatttctgtgtgctgactatatttaaagacaagattagcagtaatatataaacgtaartaagaatttttttccccagccaagaaccatagattggacttcacattcaaaatgtaaattgtgcctaggaaacatcaatgcttattttaagcaactgacc

SEQ ID NO: 43669 - DNA, 201 bp, Homo sapiens
caggacacttgctgttttctgttattttggtttatattgcttaattagccagcctttctaattaacattacattttgctgagttcacattgtgataaagawgaatatcaattcttttctactcatctcattgagagatagagttgaattcatcttcccttgtatctaggctgcacttattcgtttgcttgaccaatggaat

SEQ ID NO: 43670 - DNA, 201 bp, Homo sapiens
tacccaagacagagaagaaaaacgaaagagagcctgagcattcctttgactccctccacccccggaaggtatattcagagtctccaagactgcctccgccyactcacatgtttatggcccggtgagaccgcatcctccctttctctatctgtcccttttctggatgcagggacacagaatcccctaagtgggaagagcttt

SEQ ID NO: 43671 - DNA, 201 bp, Homo sapiens
cttctctttatggatttccctttggaagcagggataagaagagggaaggtctcccagatgtaaatttctcataaatatttgagctccatttcagtaattcyttcattctctgatctgttgcctaatcttctatttagcaagtactttccatgaaatagaaggctttaattgatagaattactaatttgaatagcttagcac

SEQ ID NO: 43672 - DNA, 201 bp, Homo sapiens
gaagagactggagaaagccaatctgtttctccctgaaaatcatcttacttttttaacgcttcgtacctagatttggcctgggcagcccagggagactgttmgagcactggatacctagactctgctgggctctagagaagtgctgggctacagcgcccagtgccctacctcttggggccagccagcctcaccaaaaaatca

SEQ ID NO: 43673 - DNA, 201 bp, Homo sapiens
atagtgagttggaatgatggctctcaaaaaactatgtccacatcctataaatgctattgtacaatatatggtcttttgtgattggcctcctccacttagcrtcgtgtttttgaggttcagccacagttgtagcatgtccatctctctttgtgtggctgaatatcattgcattgtatggatataccaaatatttttctcctt

SEQ ID NO: 43674 - DNA, 201 bp, Homo sapiens
agggtagtgtgaagtggcgttatagttctccttttaatggttgagacaagaattgcctggacctcttttaggatacatcaccagtcttccaatggcaaacktatgtttattccagctgattctccccagcatgggggcatgaattgcagtggaaatcagtggactagaatttggatgcaattgcccccaaattatcgaaga

SEQ ID NO: 43675 - DNA, 201 bp, Homo sapiens
ggtccaccaggccctctgagtggggctcaggacactctgagatggaagagactggagaaagccaatctgtttctccctgaaaatcatcttacttttttaaygcttcgtacctagatttggcctgggcagcccagggagactgttcgagcactggatacctagactctgctgggctctagagaagtgctgggctacagcgcc

SEQ ID NO: 43676 - DNA, 201 bp, Homo sapiens
ttggatgcaattgcccccaaattatcgaagagaaaagaagaccactgtaattcaccggccatagcatttttaccaactgtttttgctaagcattagtttcktgtgataggttcaattctcaggctccttctcattagagtctttctgtaaagaccattattatttctgttatatttcctgtggctgagctgagccgcactt

SEQ ID NO: 43677 - DNA, 201 bp, Homo sapiens
ccaggcagcccccactcttcagaacttcaaatctaaagatcttttaaatacacagaacttacttttgaaagctgtggcccatcccaaatgaattctaatcstcagcctctagaatgcctggagtgagaaaacagaatattgttcttttctgtttatattatttcatactgagttaacacacttgccaagactccgaggcag

SEQ ID NO: 43678 - DNA, 201 bp, Homo sapiens
tcttacttaagcatcacagtctagactagaattcccaagtcaaccgtttgttttacgggactcttcttatttgaataggcaggtggccctgtgttcttggsttttttgtcctttcaaggagctaggtctaagaagtgatagtatttaatctcgcactccgaagcgcacccagatttaaaagttgggagtggcccatacaca

SEQ ID NO: 43679 - DNA, 201 bp, Homo sapiens
aacctcagtttcctttgccacaaaatagcaatacaaatttataattccttagattgctgtgagaatgaattgaggcaaggtaggtaaagtgcaaggaattktgtgtggccggccaggtgcagtgtggctcaagcctgtaatcccagcactttgggaggctgaggtgggtggatcacctgaggtcaggagttcgacaccagc

SEQ ID NO: 43680 - DNA, 201 bp, Homo sapiens
aaaagaagaccactgtaattcaccggccatagcatttttaccaactgtttttgctaagcattagtttcttgtgataggttcaattctcaggctccttctcrttagagtctttctgtaaagaccattattatttctgttatatttcctgtggctgagctgagccgcacttggagatttgatccattttaactctctcattgc

SEQ ID NO: 43681 - DNA, 201 bp, Homo sapiens
gaacacagccgtgtttggcccagcggttatagtttgccaacccctgcttagagtctagctttattcagagcttaaatatgtcatcgaggtcccctctttayttattcccttagttttgatgatcttttatgggttatattcttcaaagggaaaattctctccgaatggggctgccactggcagacgagcactgtcccatct

SEQ ID NO: 43682 - DNA, 201 bp, Homo sapiens
gaggcaggagaatcacttgaactcggaaggcagagtttgcagtgagccagattgcaccaccgcactccagcctgggcgatgagtgaaactccgtctcaaaraataaacaagaattgtgtctggcctttgtgatagttactcaacaaatcatatctgtgattgttttggttttaacaataatggtttttaaaaaccgtaggt

SEQ ID NO: 43683 - DNA, 201 bp, Homo sapiens
aagaagaccactgtaattcaccggccatagcatttttaccaactgtttttgctaagcattagtttcttgtgataggttcaattctcaggctccttctcatyagagtctttctgtaaagaccattattatttctgttatatttcctgtggctgagctgagccgcacttggagatttgatccattttaactctctcattgcct

SEQ ID NO: 43684 - DNA, 201 bp, Homo sapiens
caggcatggctgcgagaaactttatttatggatactggaatttgaatttcatatacattttcatgtgtcacaaaatattattctttcccccccgcccccarccatttaaaaatgtgaagcatttttagcctgtgtgctgtataagaacacagccgtgtttggcccagcggttatagtttgccaacccctgcttagagtcta

SEQ ID NO: 43685 - DNA, 201 bp, Homo sapiens
cagcctgggcgatgagtgaaactccgtctcaaagaataaacaagaattgtgtctggcctttgtgatagttactcaacaaatcatatctgtgattgttttgrttttaacaataatggtttttaaaaaccgtaggtgatcacatactacgcagaaagggaagcagttacagcattcacagcatccgtgagtcatagactcact

SEQ ID NO: 43686 - DNA, 201 bp, Homo sapiens
catttttaccaactgtttttgctaagcattagtttcttgtgataggttcaattctcaggctccttctcattagagtctttctgtaaagaccattattattkctgttatatttcctgtggctgagctgagccgcacttggagatttgatccattttaactctctcattgccttcagagagttggtgattttggggggggcac

SEQ ID NO: 43687 - DNA, 201 bp, Homo sapiens
tactcaacaaatcatatctgtgattgttttggttttaacaataatggtttttaaaaaccgtaggtgatcacatactacgcagaaagggaagcagttacagyattcacagcatccgtgagtcatagactcactgcattgctccaaggtgcagattctagttggaaatgttaagttttttagagcaatgaaaaaattgatctc

SEQ ID NO: 43688 - DNA, 201 bp, Homo sapiens
cccgcagtttcatgaatgcctcgctgtgccaccaggattttcttggagggagccacggtcagatttcaagtggtcatttcactctttctccctctgggggmctgagacatgattaacttgcaataattgtgactccctcattaaaggagagctgtagcaagggaagaaatcattgagactgatcaagacatcccgtgctat

SEQ ID NO: 43689 - DNA, 201 bp, Homo sapiens
cactgcaactacaacatcccaggttcaagagagtctcccacctcagcctcacgagtagctgggatttcaggtgcctgccaccatgcctggctaattaagtsagtttcttaaagtcctacaactggtgagctgtgagctgtaaattgcggaactaatttttatactgccaatctgaggccttttctgacctcatcgctgcca

SEQ ID NO: 43690 - DNA, 201 bp, Homo sapiens
cctcacgagtagctgggatttcaggtgcctgccaccatgcctggctaattaagtgagtttcttaaagtcctacaactggtgagctgtgagctgtaaattgyggaactaatttttatactgccaatctgaggccttttctgacctcatcgctgccactgtaaaatgaattctagccccagaccatgacatgcctactagctt

SEQ ID NO: 43691 - DNA, 201 bp, Homo sapiens
tgaaactctatagacagcaaacagaatgatggttgcctggggctgggagtgagtggaggggattacctggaaagggtggggcaattttggggggtcaagaraatgttctaggacaagactgtggtgatggctgcacaactggataaatatactaactatcatcaaactgtatatttacaatggttaaatcatatggtatgt

SEQ ID NO: 43692 - DNA, 201 bp, Homo sapiens
ttacagtcgtgtgccaccacgcctggttagtttttgtatttttagtagagatgggtttcactgtgttggctaaggtggtctcaaactcatgacctcaagtkatccgcccgcttcagcctcccaaagtgctgggattacaggcgtcagccactgtgcccggccggatagaaataatttttataaactccttggatgctacct

SEQ ID NO: 43693 - DNA, 201 bp, Homo sapiens
taatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgccttag

SEQ ID NO: 43694 - DNA, 201 bp, Homo sapiens
ataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgcctta

SEQ ID NO: 43695 - DNA, 201 bp, Homo sapiens
atgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattccc

SEQ ID NO: 43696 - DNA, 201 bp, Homo sapiens
aggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgatt

SEQ ID NO: 43697 - DNA, 201 bp, Homo sapiens
aaaaaaaaaaatcactggatttgaagttggcctatgttagattactccaaggaagttagttaatatgttaatatgaatctagatgaacattgagtgttttrctcttcttgttaatttgcgccatctactaatctctggacaatggagaaaaagtcgtaggttatgagttttttatttatggacattaagcaatatctttaa

SEQ ID NO: 43698 - DNA, 201 bp, Homo sapiens
tctggacaatggagaaaaagtcgtaggttatgagttttttatttatggacattaagcaatatctttaaaatgtaaaatgaagccgacaaaatgcacagccrgataacaacaacaaatctaatctaaagtgacaggaagagactctcccagacatttttctctttaatgtaacatgactttaaattgatgcaaccccacagt

SEQ ID NO: 43699 - DNA, 201 bp, Homo sapiens
aattgtgatgttcagcagtttataccttgggagctggaagcgtttctccatggtgaatttgtaatattaattggccatgtcagttcatgacaaatgtagtracatctatttcaagtatttcagttttatggtgctgaagaagtgacacgcgctccagataagtaatctcacaaaagatcttcccgctcgctgtggagcgcc

SEQ ID NO: 43700 - DNA, 201 bp, Homo sapiens
aacagcagcacaacaaaatagccatttacatgtcaagactatattcatagaatccatatgtctaaggtggggaagttgtcattattcctgttttatagatraggaaacagaggcccagatggagtaagtgactgctgaagtacacatgatttgtcagtagaaaggaagagaccaaaggtggcatcaactttatctttcctt

SEQ ID NO: 43701 - DNA, 201 bp, Homo sapiens
taagtttttaatttttgttttacttttgtcttttaattttaattctattgcaaccaaatctatcagcctgtcttctatgatctctgcttttaattgttacsctttaaaaatccttctccatggtaacattatattgactcatatgtcttactggttgaacgtgcctatgtttgactttgaaatcattaaattcattgagga

SEQ ID NO: 43702 - DNA, 201 bp, Homo sapiens
atgaaatattaggttaacatggaaaaaacatggcatcccatgttttagtattttttccttatttccaagcagcacctctctttgaattatattctgttctstgtttttataatttgactcccttctattctacatctaaatagtgcattgtctgttttcactcaggactttaaaaatagttctagtactaattgtattttt

SEQ ID NO: 43703 - DNA, 201 bp, Homo sapiens
cactggataggtaatagacgccggcatggctatgctgtggttcctgctgatgggcacactattacaggtgcatgataagtgtgtcgtacgcaggaagtacrtttcccccagccttccctacctgctgagggctgctcccagcctaaggatttcatccagatagattcatagcgcttccagtaaatgcaccccttgcctttc

SEQ ID NO: 43704 - DNA, 201 bp, Homo sapiens
cctgctgatgggcacactattacaggtgcatgataagtgtgtcgtacgcaggaagtacgtttcccccagccttccctacctgctgagggctgctcccagcstaaggatttcatccagatagattcatagcgcttccagtaaatgcaccccttgcctttcaaagttgaaaaagaaattactttggacacaaagaggtgtttc

SEQ ID NO: 43705 - DNA, 201 bp, Homo sapiens
tcatgtgttacctgagactctccgcccataggatgtagttcctttccattggaacacatggggaccgagggaataaagaatgttttcatctctgaaaatayctctcattcttccaatcaatgctgctcttttcttgcatactgtatactgggaagcatttgtttcgatttgtggttaaatgtatgtgtccactggacttca

SEQ ID NO: 43706 - DNA, 201 bp, Homo sapiens
cgatttgtggttaaatgtatgtgtccactggacttcagtatccaccctttgaaggaccgcaggagaagttgttcaggtagaaacatacaagggccggatgyggtggctcacacctgtaatcccagcactttgggaggcctaggcgggtggatcacttgaggcctggagtttgagaccagcctggccaacatggtgaaaccc

SEQ ID NO: 43707 - DNA, 201 bp, Homo sapiens
cattagttcatggattttgtgtctattatgaataatgctgccatgagcatctgtgttgtccacaagtttcagcatggacttctgttttcattccaatatcstttgatgacatgtcttggcagtgatgtctatgacactgggcaagtgtcttaaaatgttgtgcatcagaaaaaagtcatcattgccaaggccagcagatct

SEQ ID NO: 43708 - DNA, 201 bp, Homo sapiens
ccattcattagttcatggattttgtgtctattatgaataatgctgccatgagcatctgtgttgtccacaagtttcagcatggacttctgttttcattccartatcgtttgatgacatgtcttggcagtgatgtctatgacactgggcaagtgtcttaaaatgttgtgcatcagaaaaaagtcatcattgccaaggccagca

SEQ ID NO: 43709 - DNA, 201 bp, Homo sapiens
gctttgcagggcctatctgcccttagccctccaatatccttttcattttctttaatagttttattgatatataatgtgcctaccatataattcatctgctyaaggtgtacaattcaatggcttttagtgtattcagagtttgcatccaccatcacaatcagttttagaacattttcattaacccaagaaaatgacccctta

SEQ ID NO: 43710 - DNA, 201 bp, Homo sapiens
aatctaaaaaatttctgtacagaaaggaagcaatgaacagagtgaagcagcatcctacagaaagagagagaatatttgcaaaccacacatgtgataagggrttaatattcaaaatgtacacacagcgtaaatgcaagaaaagaatctgatgtaaaaatggcccttccaacatctagcattattgtgtgttgaataaatact

SEQ ID NO: 43711 - DNA, 201 bp, Homo sapiens
catttactcacctgttgtatcatctgaattatttccatatccataatgtgcaaggatatccttccatgttattagaaatacagatacaccatcattatcastggccaaatcattcaaatcgctgtttgcttcttctcgggctcttattcaagctcacgatgctattctcatagtgattgcgaatctcactgcataaaggtg

SEQ ID NO: 43712 - DNA, 201 bp, Homo sapiens
tgattccagaagtttataataattggaaagtgtattagtcgattctcacactgctataaagacattcctgagactgggcaatttataaagaaggaaggttyagttggctcgtggttctgcagactgtataggcttctgcctctcgggaggcctcaggaaacttacagttatggcagaaggtgaaggggaagcaggtaatgt

SEQ ID NO: 43713 - DNA, 201 bp, Homo sapiens
cgacaggcttacccagttcatttaggcgtggctcgattaatgcacacaaagctttgggaacatatcagtcacatcaagctaggtccacctgtgtgagtaastaacgtgtttatttatgattttctttaacagcacagaagagcaattgcatttggtcattctagtatcaactgagttctttataaaatatctttggggtgt

SEQ ID NO: 43714 - DNA, 201 bp, Homo sapiens
caggtggctagcattatttgggtccagaagcttccctggaaagaaaggattcactgcaagatcgacaggcttacccagttcatttaggcgtggctcgattwatgcacacaaagctttgggaacatatcagtcacatcaagctaggtccacctgtgtgagtaagtaacgtgtttatttatgattttctttaacagcacagaa

SEQ ID NO: 43715 - DNA, 201 bp, Homo sapiens
taagacaggtggctagcattatttgggtccagaagcttccctggaaagaaaggattcactgcaagatcgacaggcttacccagttcatttaggcgtggctygattaatgcacacaaagctttgggaacatatcagtcacatcaagctaggtccacctgtgtgagtaagtaacgtgtttatttatgattttctttaacagca

SEQ ID NO: 43716 - DNA, 201 bp, Homo sapiens
tagaaagattttcacccattctgtataattagacaaattctgttactatctgtccaacagtttagcaagagtcactctgagattgaagagaggaagggaaygttggaaccaatgctgatgagccattcataggctctggctcactatatatgtctaaaattcacatgcccctaaccctcaaataatgaccattaataatct

SEQ ID NO: 43717 - DNA, 201 bp, Homo sapiens
aaaacagcatggatcttcctgcagagaacagactagccccctgtacagcacacaactcggggaattttaggtctggtgatttactgctgttggagcctggmcttcttcctgggagaaggctggaaaaacttcaagtcagttacttaatggaataatacatgtttcctgcttccattgtcttcctggacctgacactcactc

SEQ ID NO: 43718 - DNA, 201 bp, Homo sapiens
catcgcccactctgatttagatgagcaagagctgctgagttgtagatttctagtttctaaacaacaataagtcttgcccccagatagcctcttagcagagycaaaagccagcagagagaagactcagcatttgctttggagtaagtttgtgtgtgtatgtttatctcccttttactcatgggctcttttttcccaaataac

SEQ ID NO: 43719 - DNA, 201 bp, Homo sapiens
gactgaatttatgatgaaactttcttcgtatattggctttgagaaattctgttttggtgcttatgtgctctggataattctcaatgactttcaaagttatrattcagggagtaattggttctgagagaatatgcataatcacatcaaggtgtgtttgttttccaccatttgtagccttttgacaaatttctgggggcctca

SEQ ID NO: 43720 - DNA, 201 bp, Homo sapiens
actacaaatcattgatcaaagtattggtctgtcacctgtccatgtgtaaggccaggcctaagtgctctgacagggcatgactcaatcctcaaacaggaagsgggaaattgctttccatctcctaaccctaagatcctggatggcaggtaatctgcttcctcaagattctgttgatacacattcaggactctggtttctgtt

SEQ ID NO: 43721 - DNA, 201 bp, Homo sapiens
gatgaatgtagtgagagaaggaaggaagagagagagggaagaaggggaaaaagagggatggaaaggaggaaggaaggaaaggagggaggaggcaagtatawtagtcatgatatagggaattgaaaagacattcacgttttgtggtgaatgaaaataacttgacctttatgaagctggcctaatccctggaaggaaaaaatt

SEQ ID NO: 43722 - DNA, 201 bp, Homo sapiens
caaagtattggtctgtcacctgtccatgtgtaaggccaggcctaagtgctctgacagggcatgactcaatcctcaaacaggaagggggaaattgctttccrtctcctaaccctaagatcctggatggcaggtaatctgcttcctcaagattctgttgatacacattcaggactctggtttctgttttgcttgatgacaatg

SEQ ID NO: 43723 - DNA, 201 bp, Homo sapiens
gagaaggaaggaagagagagagggaagaaggggaaaaagagggatggaaaggaggaaggaaggaaaggagggaggaggcaagtatattagtcatgatatakggaattgaaaagacattcacgttttgtggtgaatgaaaataacttgacctttatgaagctggcctaatccctggaaggaaaaaatttccttggatatgtg

SEQ ID NO: 43724 - DNA, 201 bp, Homo sapiens
atacacattcaggactctggtttctgttttgcttgatgacaatgacccagtttctttgactaaataaatgtatagacacacattacttcttttcattctargaatcataagtttttcaaactttagaatcacaaggtccattaaaggacatctcccctgaccttcccattttgtagatgggaagactaaggtccaagcttg

SEQ ID NO: 43725 - DNA, 201 bp, Homo sapiens
gggaagaaggggaaaaagagggatggaaaggaggaaggaaggaaaggagggaggaggcaagtatattagtcatgatatagggaattgaaaagacattcacrttttgtggtgaatgaaaataacttgacctttatgaagctggcctaatccctggaaggaaaaaatttccttggatatgtgatttatataatcaatcaacta

SEQ ID NO: 43726 - DNA, 201 bp, Homo sapiens
tattttagtagagacgggttttcaccgtgttgcccagggttgtctcgaactcctgagcttaggcagtctgcccacctcagcttcccaaagtgctaggattrtaggcatgagccaccatgcccggcctaatctaatcaattcctttaaatctgaaactgtccgcctgattctggtttaccacaaccaccagagtcttaagtg

SEQ ID NO: 43727 - DNA, 201 bp, Homo sapiens
gtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcg

SEQ ID NO: 43728 - DNA, 201 bp, Homo sapiens
aggcagtctgcccacctcagcttcccaaagtgctaggattataggcatgagccaccatgcccggcctaatctaatcaattcctttaaatctgaaactgtcygcctgattctggtttaccacaaccaccagagtcttaagtgtcccaatagccagggtctcatagactctgcttatggttaattcttctggggaaattaatt

SEQ ID NO: 43729 - DNA, 201 bp, Homo sapiens
tgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagc

SEQ ID NO: 43730 - DNA, 201 bp, Homo sapiens
gtgacaagatctccaaggagccagttcacgcttggatgactctggagctgtggtgacaatctaaatcctaaattgaggcttactaggaaatgcactaggtracaggctctagagaaatggctattaccaggttgctcaggctggagtgcagtagtgcaatctcagctcactgcaacctctgccttctgggttcaagcaatt

SEQ ID NO: 43731 - DNA, 201 bp, Homo sapiens
ctctagtctagggcacaaaatttctgtcaacccttctaaccagtgtttgaagtacgtaagacgttcatttccacttctaatgaggaattagaggaacggawttataaaggaattctggttataattgcatgtacttttagagacgatgtctaacagtgcaacccatagaaccaggctgcctggattcaaatcccagctctg

SEQ ID NO: 43732 - DNA, 201 bp, Homo sapiens
ttttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttca

SEQ ID NO: 43733 - DNA, 201 bp, Homo sapiens
gattttgtgaggatgatgatataatttccattacattacagcatataaatataaatatatatatatatatatatatatatatatatatatatatatatatwtatattttattatttttttttgagacggagtcttgctctgtcaccaggctggagtgcagtggtgcaatctcggctcactgtaacctccgccgcccgggtt

SEQ ID NO: 43734 - DNA, 201 bp, Homo sapiens
tgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggt

SEQ ID NO: 43735 - DNA, 201 bp, Homo sapiens
ttgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccggg

SEQ ID NO: 43736 - DNA, 201 bp, Homo sapiens
attgattttgtgaggatgatgatataatttccattacattacagcatataaatataaatatatatatatatatatatatatatatatatatatatatatawatatatattttattatttttttttgagacggagtcttgctctgtcaccaggctggagtgcagtggtgcaatctcggctcactgtaacctccgccgcccgg

SEQ ID NO: 43737 - DNA, 201 bp, Homo sapiens
accaattttaagaaatcctttataggactatttgtgaaattgattttgtgaggatgatgatataatttccattacattacagcatataaatataaatatawatatatatatatatatatatatatatatatatatatatatatatattttattatttttttttgagacggagtcttgctctgtcaccaggctggagtgcag

SEQ ID NO: 43738 - DNA, 201 bp, Homo sapiens
tccactctgggtaactgttttggattattttctctattccaactgaaataaaaaaaaattaattaaatgtggctaggttatcttgacagcagaatccattsccagttaattattattttaatacttgatggtgtctgtcaaattgtcgacatgtgacggtcctttcaaatttaaaggaatagctgatggtcactggccacc

SEQ ID NO: 43739 - DNA, 201 bp, Homo sapiens
attattgttggtgttaaataatgattatgtaaagcactagactagacattcgtcggcaaagtttttctgcaaagaatcagatagtaaatatttttgctctyatcagccagacagtctctgcggcaaccattcaagcattgttgaatacattgttgagtgttacatgagactattgtaatataaaagtagcctgggacaaca

SEQ ID NO: 43740 - DNA, 201 bp, Homo sapiens
tgcggtggcgcaaacctgtaatcccagctacttgggaggctgaggcaggagaatcgcttgaactcgggaggcggaggttgcagtgagtcgagtcgtgtcartgcactccagcctgggtgacagagcgaaactctgtctcaaaaaacaaacaaaaagaaacataccgggagatctggttctattgaaccccagtgcagccat

SEQ ID NO: 43741 - DNA, 201 bp, Homo sapiens
cagtggtgtgatctcagctcactgcagccttgacctcctgggttcaagagatcctcccacctcagcctcctgagcagctgggaccacaggtgcttgccacyatgcccaactaacttttgtattttttgtagagacagggtttcaccacattgcccaggcaggtctcaaactcccgggctcaagcgatcctcccaccttggc

SEQ ID NO: 43742 - DNA, 201 bp, Homo sapiens
atcatattctcttcactgaaacatttcagatgacttaaaaattcaccttgtagaacttttaaaattgaaactttctggtgaacatcattagttgacagatrtgtcattgaagtttcatccttcttcatttcagagtctgctggaagacccttcatttaccactctctccttcctggaggtgtggaaatactctacctgggt

SEQ ID NO: 43743 - DNA, 201 bp, Homo sapiens
catattctcttcactgaaacatttcagatgacttaaaaattcaccttgtagaacttttaaaattgaaactttctggtgaacatcattagttgacagatatrtcattgaagtttcatccttcttcatttcagagtctgctggaagacccttcatttaccactctctccttcctggaggtgtggaaatactctacctgggtga

SEQ ID NO: 43744 - DNA, 201 bp, Homo sapiens
ttcaccttgtagaacttttaaaattgaaactttctggtgaacatcattagttgacagatatgtcattgaagtttcatccttcttcatttcagagtctgctrgaagacccttcatttaccactctctccttcctggaggtgtggaaatactctacctgggtgaggctctcgtggctttttgtgccaagtgtccgtaaacttc

SEQ ID NO: 43745 - DNA, 201 bp, Homo sapiens
tctgtagcttcttccagcatgtgatcatacatctacctaacctctcccattggttgaatttaatatactagtgaattttccattgcaaagatgaggttacraatcatagtgttcatactcagaaggactttataaatattttgcctttttgaagtatatacaagaaatgaaaaaaaaaacaggaataaataaaaagaataa

SEQ ID NO: 43746 - DNA, 201 bp, Homo sapiens
cccaggctggagtgcagtggcatgaccatggctcactgcagcctcgacctctggggctcaagcgatccttctgcaacagcctccctagtagctgggactayaggtgcatgccaccacacccagctaatttttatattttttgtagagatggggttttaccatgttgcctaggctggtctcgatctcctgggctctagcaat

SEQ ID NO: 43747 - DNA, 201 bp, Homo sapiens
tcgacctctggggctcaagcgatccttctgcaacagcctccctagtagctgggactacaggtgcatgccaccacacccagctaatttttatattttttgtrgagatggggttttaccatgttgcctaggctggtctcgatctcctgggctctagcaatcctcccacctcggcctcccaaagtgttgggattacaggcgtga

SEQ ID NO: 43748 - DNA, 201 bp, Homo sapiens
cccggccttacgtttcagcatctttcaatccatctaatacgcagtgccagggaaggtttgtgaaaacatttgaatcacagagtcacaaacagtgagaatakctgcagttatgtttgtgatgctctaatgaacttacaaaaggccaggcctagtatttcagctgtgtccatgatgtctctgatggaaatggacaggtaacat

SEQ ID NO: 43749 - DNA, 201 bp, Homo sapiens
cagtgtgctggagtcaaacatattcagcatccaatccacattggactgtttgcatgtaacgtacagaacactcattcatctacatctaggaccataacagygagcaggagacagtccctgaccctggggactaagcccaggacctgccactaggagatattcatggaatcactgtttctcctccttttcaaagaagactga

SEQ ID NO: 43750 - DNA, 201 bp, Homo sapiens
acacagggaagcagatagttccattaggtgacagtgtgtgcacagtttatggaggatgaagcggaaaacctgagccacaaggcagtagaggttggacgagrcactcattccgaaggcgggtgtgtatgtgcaaactgtataatttttttcttcttttctatctgctagcaaagtgggtaagttgacccatgacatggtcca

SEQ ID NO: 43751 - DNA, 201 bp, Homo sapiens
taaatgagcaacctggaagatgagtggcgtttccacacacagggaagcagatagttccattaggtgacagtgtgtgcacagtttatggaggatgaagcggraaacctgagccacaaggcagtagaggttggacgagacactcattccgaaggcgggtgtgtatgtgcaaactgtataatttttttcttcttttctatctgc

SEQ ID NO: 43752 - DNA, 201 bp, Homo sapiens
ttggatatgtgatttatataatcaatcaactagtccttattttggtagagctaaacttctgtctttgggtttactcaccgtatctgtgtgcatcctggcartgtttacgatatacttctactaaaatattattttattctatactaacaaagggatttgttgtgtgtgtaaaattcaaatttcaatgaagattgtgtattt

SEQ ID NO: 43753 - DNA, 201 bp, Homo sapiens
agtaaatgagcaacctggaagatgagtggcgtttccacacacagggaagcagatagttccattaggtgacagtgtgtgcacagtttatggaggatgaagcrgaaaacctgagccacaaggcagtagaggttggacgagacactcattccgaaggcgggtgtgtatgtgcaaactgtataatttttttcttcttttctatct

SEQ ID NO: 43754 - DNA, 201 bp, Homo sapiens
tgggtttactcaccgtatctgtgtgcatcctggcaatgtttacgatatacttctactaaaatattattttattctatactaacaaagggatttgttgtgtrtgtaaaattcaaatttcaatgaagattgtgtatttttatttgctaactctggaaaatgtgtttacagaagaaccagagaaggacttactcctctccgtac

SEQ ID NO: 43755 - DNA, 201 bp, Homo sapiens
tcaagattctgcagcccagggtgctgcttgttgatggacatcttcacctgactttctccctggtccaggtgcattttaagcatggaaggtgacacttgccrttctcaatggacaaagggagtggggagtgtgggggtgtgctttggggttagtctctgggttttcgaaacttagcattctcagattcccagccaactggtt

SEQ ID NO: 43756 - DNA, 201 bp, Homo sapiens
tactcctctccgtacactttggacatgtcaaaatctagaaatagagatcagtaaaggtaacacatagcaccttaaatctgatttaaaaggaaaacaatgaytattatacagatttatggcttcttgtcaataatactctgatttctggagattgttatcagtcataagctttataggaaatatctccttttgaaaatgaca

SEQ ID NO: 43757 - DNA, 201 bp, Homo sapiens
taccaagtaactttagatgcaaatatggtagtactgtgaagattatggtttttgaatgaagtcactttgtggcatgatggtatagaataagatattttcayagtgaaaatggagataagacatgtcccattccctagaatagactgtcactgctctcgttgcctccaaggaggaaactgttataggaatgattgacatgga

SEQ ID NO: 43758 - DNA, 201 bp, Homo sapiens
tccgtacactttggacatgtcaaaatctagaaatagagatcagtaaaggtaacacatagcaccttaaatctgatttaaaaggaaaacaatgactattatasagatttatggcttcttgtcaataatactctgatttctggagattgttatcagtcataagctttataggaaatatctccttttgaaaatgacattttaaat

SEQ ID NO: 43759 - DNA, 201 bp, Homo sapiens
acggtttaaaattcccttaaatgatgtttttaaatgtaaataactgagctcatttgatctggttcttccttaagccaatgttagcatgaatggccatattyaccaccccggggttccttttcagactccggaaagaaaaagcgatgataatgacgtatttccctcccttccacaaaacagggccaggtgtaacacactaag

SEQ ID NO: 43760 - DNA, 201 bp, Homo sapiens
ggaaaacaatgactattatacagatttatggcttcttgtcaataatactctgatttctggagattgttatcagtcataagctttataggaaatatctcctwttgaaaatgacattttaaattaatgtgaaattgtgttttaatttaattcacagggagtcataaacaggtgggagaattatggaacaataattgtgtttgc

SEQ ID NO: 43761 - DNA, 201 bp, Homo sapiens
gaggacgtcttcttttataacagctctaggtcttgcctgttaagcacgctgtaaaatgactgttacacgtttatggattgaaatggttctgctgaaatttkaagtgttaacattgttcaaattttcattactaacacctctcacattgttagaaaacagttttatgtttgacattttgatcatactaacctgggacatttt

SEQ ID NO: 43762 - DNA, 201 bp, Homo sapiens
ggtctcccaccctctcttatttttataaacaggctccatggtactatatacactgcagatggacagctgccaacctgctctttttgtgctgaggaactctrgatatttcaactagtttacatgactttcttacctacgctaccttataatccttttataaattttgctttacgttttaacaacggaaaacacttaaggttt

SEQ ID NO: 43763 - DNA, 201 bp, Homo sapiens
acaatgactattatacagatttatggcttcttgtcaataatactctgatttctggagattgttatcagtcataagctttataggaaatatctccttttgamaatgacattttaaattaatgtgaaattgtgttttaatttaattcacagggagtcataaacaggtgggagaattatggaacaataattgtgtttgcaagaa

SEQ ID NO: 43764 - DNA, 201 bp, Homo sapiens
atggacaaccaggctgggccatgggttgtgttttttttcctctcattttatagaaatgttaccaggcatattttccctgtttccctaagaagagcttcctstcagtgctagccagccacagggccaagtgacacctagaggtgatcctttggttatttgctaaacagatctaagacaaaccgatatctgtaacctgggatt

SEQ ID NO: 43765 - DNA, 201 bp, Homo sapiens
catggtactatatacactgcagatggacagctgccaacctgctctttttgtgctgaggaactctggatatttcaactagtttacatgactttcttacctaygctaccttataatccttttataaattttgctttacgttttaacaacggaaaacacttaaggtttttttcctttctttttttttttaattcttccgccagc

SEQ ID NO: 43766 - DNA, 201 bp, Homo sapiens
ttataggaaatatctccttttgaaaatgacattttaaattaatgtgaaattgtgttttaatttaattcacagggagtcataaacaggtgggagaattatgkaacaataattgtgtttgcaagaaatggatttcatcctaaaactccatgaatatgctattacagtttgttgtcatcctgaaatgctctgtttaaccataaa

SEQ ID NO: 43767 - DNA, 201 bp, Homo sapiens
tcccatttcaggctgattaaaaggcaaaatcttcacagtaggacaccaaaccctctgtatgccctgcctgcctccccccctctgacccgcctgcctccccvctgtgagctttttccacctactggcctcttgttcttcttcagctgttcctcagacatgccaggtgtgttcctgtctcagacgctttgcctttgctgctcc

SEQ ID NO: 43768 - DNA, 201 bp, Homo sapiens
tgtacaaagctgataaataactgaaaccaaattagctcaaactggttatatttctgggtacaaaccaggtgtatagttaatccattgttgtttctgtgtcraccaccattgtcctcacctatacttgggcagtgggggtggggaggagaacataaaaacccaccaagcctcatttttcttgctaatttatttccttgaact

SEQ ID NO: 43769 - DNA, 201 bp, Homo sapiens
aaaaaaacaaacttgaaaagcatagcaggctgccaggacatgtctgagtaccgcgcagatagtggggaatagtctatggattctgcttacaccatggacarccaggctgggccatgggttgtgttttttttcctctcattttatagaaatgttaccaggcatattttccctgtttccctaagaagagcttcctctcagtgc

SEQ ID NO: 43770 - DNA, 201 bp, Homo sapiens
tcttcttcagctgttcctcagacatgccaggtgtgttcctgtctcagacgctttgcctttgctgctccttctgcctggagtattcttccacgtagcaccaygagctgttcttctccaaaaggctttgctcaactgacactttctcagtgaagctgtttctcaccactcactataaaatggcagcctgcctctctgagcctt

SEQ ID NO: 43771 - DNA, 201 bp, Homo sapiens
gcagtgtttccaaaaatagttttggaaattgcaaaaatactacaatgctgttgtgccggccacactgtgagtgctgactgtcatgcattttatagcccatstccctctccagtgaggcttttggccactggccgttaattggtaaggttcttgaaaactgaagtgatggtatcagcatggatgcccgtgctttctgatgcc

SEQ ID NO: 43772 - DNA, 201 bp, Homo sapiens
cataggtagttttatatacattttatagctaagcccagcagcccaaaaagctaaatgacttcagcgcccacagatactcctggatgagaggggattggaawccaggtctgttcaattgcaaatcccctcttgtgccttttacaggtcagatgattttgtttttataggctctagcaggtcccttctctttgcgtcaccaga

SEQ ID NO: 43773 - DNA, 201 bp, Homo sapiens
tggccatggtgctcacagtctctcaatcctttatgttgagggagaaatgataaccagatctcattttgtgtgccaacccgaaagcctgacttgactgcctmaaatgttaggaaggactctaaagccctatctggattccaaatttatggttggtgcagactggatttttacaatttgtgcttagtagtatcttattatatt

SEQ ID NO: 43774 - DNA, 201 bp, Homo sapiens
tttataggctctagcaggtcccttctctttgcgtcaccagagaggaagatcccctaagacaaagcattccctgtagtttttagcataactagtactggctsagtaagtatccactggggttcggaatacaactgccctgcctcttgagcagccatgcctgcttccgaggtggtgctgcatgctattcaggaggacagacca

SEQ ID NO: 43775 - DNA, 201 bp, Homo sapiens
ttccattttctttgacatgactatgtctgttcctcttgattttaggcatctttttcagatgagttgccataaaagcagcctgctctggataagtgaggtayagcaggacacactgcaaatactaggaatccttaagtacagtggaaccccagagcactctacctgctttctttctcacctccttaaaaactttttttgccc

SEQ ID NO: 43776 - DNA, 201 bp, Homo sapiens
ttttagcataactagtactggctcagtaagtatccactggggttcggaatacaactgccctgcctcttgagcagccatgcctgcttccgaggtggtgctgmatgctattcaggaggacagaccatggatgggaatcctgagccacaactccttagcctcatgacgttgggcagatgactgagcttgtctgagttacaataa

SEQ ID NO: 43777 - DNA, 201 bp, Homo sapiens
ttttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaa

SEQ ID NO: 43778 - DNA, 201 bp, Homo sapiens
cggaatacaactgccctgcctcttgagcagccatgcctgcttccgaggtggtgctgcatgctattcaggaggacagaccatggatgggaatcctgagccasaactccttagcctcatgacgttgggcagatgactgagcttgtctgagttacaataaataaaaataccatgctgaatgatggcctagcatgacattgggaa

SEQ ID NO: 43779 - DNA, 201 bp, Homo sapiens
tgtcaccggtataatttaaagaaattatacttaagctttgtctcacttagaagataatatagaacagtggtgtttttttaattaaaaaaaaagttaaaatracggttttgtatccttgctttacttcttaaacatatgggaggaaaaaaaatctttaacaagtttatttattttcattttctgctaaattactttcagaac

SEQ ID NO: 43780 - DNA, 201 bp, Homo sapiens
tgctattcaggaggacagaccatggatgggaatcctgagccacaactccttagcctcatgacgttgggcagatgactgagcttgtctgagttacaataaayaaaaataccatgctgaatgatggcctagcatgacattgggaagtacagactttgcaggcaggcccctgggttcaattcctgcccctgtcattgagtaaag

SEQ ID NO: 43781 - DNA, 201 bp, Homo sapiens
tgaactttctgtcaccggtataatttaaagaaattatacttaagctttgtctcacttagaagataatatagaacagtggtgtttttttaattaaaaaaaargttaaaataacggttttgtatccttgctttacttcttaaacatatgggaggaaaaaaaatctttaacaagtttatttattttcattttctgctaaattac

SEQ ID NO: 43782 - DNA, 201 bp, Homo sapiens
gattgtctagttctaggaaaacaagctcagggctcccaccgattgtacattatggtgagttggataactatttcattatatattacaacgtaataataatagaaataaagtgcacaataaatgtcatgtgcttgaatcgtcccaaagccacccccactcctttgagtctatggaaaaattgtcttccagaaaaccacttgc

SEQ ID NO: 43783 - DNA, 201 bp, Homo sapiens
ggattgtctagttctaggaaaacaagctcagggctcccaccgattgtacattatggtgagttggataactatttcattatatattacaacgtaataataatagaaataaagtgcacaataaatgtcatgtgcttgaatcgtcccaaagccacccccactcctttgagtctatggaaaaattgtcttccagaaaaccacttg

SEQ ID NO: 43784 - DNA, 201 bp, Homo sapiens
gggattgtctagttctaggaaaacaagctcagggctcccaccgattgtacattatggtgagttggataactatttcattatatattacaacgtaataataatagaaataaagtgcacaataaatgtcatgtgcttgaatcgtcccaaagccacccccactcctttgagtctatggaaaaattgtcttccagaaaaccactt

SEQ ID NO: 43785 - DNA, 201 bp, Homo sapiens
aggtcctccccctgtcagatcagcaacagcattagtctcataggaccgtgatccctattgtgagccacacatgcaagggatctaggctgcatgctccttasgaaaatctaatgcctgatgatctgtcactgcctcccatcaccttcaagatgggattgtctagttctaggaaaacaagctcagggctcccaccgattgtac

SEQ ID NO: 43786 - DNA, 201 bp, Homo sapiens
cccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagaga

SEQ ID NO: 43787 - DNA, 201 bp, Homo sapiens
acccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagag

SEQ ID NO: 43788 - DNA, 201 bp, Homo sapiens
attctccatgccactccttatctctttagtgcagaaaacggagaggaggttcagtattcttaagaaactcccatgattgctttgaggcaatggatttaacrggtatctttatcccttatttacgcactgactgtggtactgagtcatccctggtgtttctggattttattggcaatgccaagagagcaggaagactgggac

SEQ ID NO: 43789 - DNA, 201 bp, Homo sapiens
aatgagggcattggaaatccgctctcaggtggccatcgaaaatagtcagcctgagtgttgctacctgttttccataattgtgtagctttgcctttccttarttaatctgttcaataaactcctctgcagaatccaaatgcttaaattcagtttctttttgtctttatggtgtttttcattgttaacgtggcatcggagtag

SEQ ID NO: 43790 - DNA, 201 bp, Homo sapiens
taattgtgtagctttgcctttccttagttaatctgttcaataaactcctctgcagaatccaaatgcttaaattcagtttctttttgtctttatggtgtttwtcattgttaacgtggcatcggagtagctcgacttttgcatcatgataaattcataacccaagagaaggcagaaaacataattattatcaattgcctctct

SEQ ID NO: 43791 - DNA, 201 bp, Homo sapiens
ttgtctttatggtgtttttcattgttaacgtggcatcggagtagctcgacttttgcatcatgataaattcataacccaagagaaggcagaaaacataattrttatcaattgcctctctcctggaattgccattggctgagtggaacaaaatacgaacttaaggagtagctgattcagagaaatccagggtaggaacgggtc

SEQ ID NO: 43792 - DNA, 201 bp, Homo sapiens
tctttatggtgtttttcattgttaacgtggcatcggagtagctcgacttttgcatcatgataaattcataacccaagagaaggcagaaaacataattattrtcaattgcctctctcctggaattgccattggctgagtggaacaaaatacgaacttaaggagtagctgattcagagaaatccagggtaggaacgggtccca

SEQ ID NO: 43793 - DNA, 201 bp, Homo sapiens
gcccttttgaagatcaaatgggatctgtaaaaactctttgaaaaatgtagactgcttcttatgtgattcttactggtctattatttatcaagaaattaaamaggaatgaatatctgtagctgtttttctttttctttcttttcttttcttttctttttttttaagatggagtctcgctctgtcaccgggctggagtgcagt

SEQ ID NO: 43794 - DNA, 201 bp, Homo sapiens
ttcttttcttttcttttctttttttttaagatggagtctcgctctgtcaccgggctggagtgcagtggtgctatttcggctaactgcaatctctgcctccygggttcaagcaattctcctgcctcagcctcccaagttgctgggactacaggcgtgcgccaccatgcccagctaatttgtaattgtttgtttctaaaagga

SEQ ID NO: 43795 - DNA, 201 bp, Homo sapiens
tctgtcaccgggctggagtgcagtggtgctatttcggctaactgcaatctctgcctcccgggttcaagcaattctcctgcctcagcctcccaagttgctgrgactacaggcgtgcgccaccatgcccagctaatttgtaattgtttgtttctaaaaggatattcagtgcttccactgtcttttagaagtctgtagaaggaa

SEQ ID NO: 43796 - DNA, 201 bp, Homo sapiens
cctcccgggttcatgccattcttctgcctcagcctcccgagtagctgggactacaggcgcctgccactacacctggctaatttttttgtagttttagtagrgatggggtttcaccgtgttagccaggatggtctagatctcctgacctggtgatccgcctgtcttggcctcccaaagtgctaggattacaggcgtgagcca

SEQ ID NO: 43797 - DNA, 201 bp, Homo sapiens
gaagaacatacttcatacaaagctatgaagcatattggaagattttaggtgccctgtcttcctggatataaaatgactccaaactcagtgatactgatcascctggcttcttttccacctttctcacttcattgtctttttgtgtgtttctgacatctgttgacaaatgggcaatcttggggatggggggttccactggta

SEQ ID NO: 43798 - DNA, 201 bp, Homo sapiens
aggaaaaaggggactgaaattagtgctgataaaagcttgaattagacattatagcactgaaacttctttttcttccttacttagaatttggaagaacatayttcatacaaagctatgaagcatattggaagattttaggtgccctgtcttcctggatataaaatgactccaaactcagtgatactgatcaccctggcttct

SEQ ID NO: 43799 - DNA, 201 bp, Homo sapiens
cagagctgctgcctcatttcttacgttgcccccacccgtgcagcaattcttcctgggaggcctcattgttcatattcataaagggccccattcagtctccyttttggagaaatggccactgcaactctctgttctgacctggggggaaatgttagaccctcaataaggagaatcagagaaagaagaaataaaacatattac

SEQ ID NO: 43800 - DNA, 201 bp, Homo sapiens
tgctcacagtctctcaatcctttatgttgagggagaaatgataaccagatctcattttgtgtgccaacccgaaagcctgacttgactgcctaaaatgttargaaggactctaaagccctatctggattccaaatttatggttggtgcagactggatttttacaatttgtgcttagtagtatcttattatattagcccggca

SEQ ID NO: 43801 - DNA, 201 bp, Homo sapiens
gttactgtcagttgttgtaaactcgtcctgccgcctggactagttacgcttcccttgattagctctgagaaacgaggcagcgggcactggggcagccacayagacaacatctaaatttttgttgctttcctgggtcttgccctgtccttactgtttcccttgggcacgctgttcaccccttaggacatactacagtaacct

SEQ ID NO: 43802 - DNA, 201 bp, Homo sapiens
gccagggaaccaaggcctttcaaagttgaggacacttcccggtgccgtgcggtgtaaatcacagtgcaaactatgcgattatcccctgcagaggaatcgastgtgactttatgggattcttcaccaagcacttaggaataatctgatataaaacagcaggggtggagagtaatgacaacttcaaattagtttaatgaatgt

SEQ ID NO: 43803 - DNA, 201 bp, Homo sapiens
atgccttacctcttcagtgtctgcaaatgacagccgccgtgctgagcgctcactgaagtggaaccgggagatcagaggtccgtctccaagtcgcccttagyggaggcaggagcagatgaactgccaagtaggagtaatagagtcataattggtgattagaactggaaaggtgcaataacatcttaatacaaactggcgtat

SEQ ID NO: 43804 - DNA, 201 bp, Homo sapiens
tgtccaatgacctgctgtgtccttgcttttgaagaactaaagagtagacttgaccactttttaaacatgacattcgatccacgtggcatagcaaggatggratccacaagatggagtgatctttacgccatcctcctgaccataaatactaaatgaatactctatttcagttgagtttttagtttgctctgttacgtgagg

SEQ ID NO: 43805 - DNA, 201 bp, Homo sapiens
ctcctggttttcagcctgaggaggaaggtggctttatttaactccttcagccccggaacatcacagggcccttctttgtgcattctgggttctaacagccmcttgaacagtgcttgagagtatttccattataaatgtcgaatcggcattgaaggaacatctgttttaagtcaacttagactcaatccaggaaaaaaaata

SEQ ID NO: 43806 - DNA, 201 bp, Homo sapiens
tttacttccgtcacaaaactacttgaagttgtcccaggctagttggtcctattaattacaacctagagggattctattagtaaactaatggattacagtayctaaatggaagccagcagatgactttggaaggactgatccgcaagggccttctgtgtgaagattaaatgaagcttcctttagccttctcaggtggccaca

SEQ ID NO: 43807 - DNA, 201 bp, Homo sapiens
atttcagtagaaggagtgggataggaaatgttcacattgcttgcagtatgtgaaatagacctcgaggtattttggataaaaaagcaacattcgtgttttakatatggttacccagcccaagccgcctctgctctttatagccgtgtttttgaagtgttcttattttttgttccgaaatcggaatatttcctggcgtgcgta

SEQ ID NO: 43808 - DNA, 201 bp, Homo sapiens
ggaattagcatgtagaggttggcaaaggggacaggagactgtgggatgattagtatattcttatttggcctgggagggaaaaaaaatctttcatttccaasaatattcattctctgtgtcacctcagcatttaatttacttccgtcacaaaactacttgaagttgtcccaggctagttggtcctattaattacaacctaga

SEQ ID NO: 43809 - DNA, 201 bp, Homo sapiens
ttgaggttgcagtgagctatcattgtgtcactacacttcaccctggatctggaaggaagggaggaaaggaggaagggagggaaggaggaatttactagaarcaaattaacttctgtaatcctaagtacttgttaaggcagaaaaacgcagataagaaaatcgaagttgagggcaaggagctcatctttcacggtcatagac

SEQ ID NO: 43810 - DNA, 201 bp, Homo sapiens
gtgttttagatatggttacccagcccaagccgcctctgctctttatagccgtgtttttgaagtgttcttattttttgttccgaaatcggaatatttcctgscgtgcgtatcttggccccatcacatcacaacaggctgaatgctgtccacaggttgccagtctggatatggaatattagtcaaaacgatataaactaactt

SEQ ID NO: 43811 - DNA, 201 bp, Homo sapiens
gcatttcaggttggtctttcccgcaagaaggtaaactcatctgcagctgtattcgctgtgcctatggtagtgcctggcaaatgcacagaagtgggtattastgaggactttgtggttcgaatggaatgagtgtgctgctgacagtgttgcgagtcatctgcaaatgaaaagtccttccttctcttcccttctggaaccttc

SEQ ID NO: 43812 - DNA, 201 bp, Homo sapiens
catttttaacatagacaccaaaagagaggctggaagagttgaccacttagaaatgtcacgagtgtctgtgaatagtgttgggggctgagaggcaagagaaraaaatagtcctaatgttgtacaagtagcaatggaaacaaacttgttaaaaaaaatttaattttgtttatgcatgtgtgcataaacaaagcaatagaaaat

SEQ ID NO: 43813 - DNA, 201 bp, Homo sapiens
gatgaccaagaatttatagtcaaaagtagataaagtaaaagagtgaaaacagagacatgatacgagttgatgataccgtatgcaacttgtcaaacacttamatttgtgaataagaaaactggggtctatttggtggtttatttcagagatgttggatcaaatcagacatcagaaaagacaccagtaccaaacgaagatatc

SEQ ID NO: 43814 - DNA, 201 bp, Homo sapiens
acgtgtaggaagctcaagacagagacgtggctggtcacggtggctcatgcctgtaatctcaacgctttgggaggctgaagcaggaggatcacttgagcctrggagttcgagacctgggcaacatggtgagacccccatctctacaaacaacaacaacaaaaaaaaaaattagccaggcgtgggggtgcatgcctgtgctcc

SEQ ID NO: 43815 - DNA, 201 bp, Homo sapiens
ctatgaaatatcaagctctttttatgcttcttcacatggcaccttgtgtagaatttgaaccactttaaacattgcatccttgagttgcatatgatgggatmtcttgaatcatttacattttgaaaaaagaaagtgaaatattctttaagaagccaaagtaatccacgagaatgtatggtgtttgttcagctggatatctta

SEQ ID NO: 43816 - DNA, 201 bp, Homo sapiens
aaaactcctgggctcaagcgattcacgtgcctcagcctcccaaagtgctagggttacaggcatgagccactgtgcctggccctggtaaaattttgtctacrtagttactgctgcccaggcaaaatctgaaaaatgttagtctaatttagttaagtttttcttgcagaccagaacttctaggaaactaatatacaggttttc

SEQ ID NO: 43817 - DNA, 201 bp, Homo sapiens
gagaaggcagcatttttagtagtactgttgagcctgcatgtagcttttccaggagggcagggtgcctggatatctgatcttacagttattactttgtgtcrtatataattttgttttctccctgcaacaaataaatctttgggactccggaagaaaaaaaaatgggaaagaaaaaaaaaatttgtggttacagtataataa

SEQ ID NO: 43818 - DNA, 201 bp, Homo sapiens
aacttctaggaaactaatatacaggttttctccaaaatatattttcaaggaaaatcagagaataaaagtttccaatgcatttagactagaaaattaaataytcaacaaacaatttcggagggccaactatttgccaggatccttgctggaatagtctctaacctcaaggcaattgctgtctagctttaagatcaagagtaa

SEQ ID NO: 43819 - DNA, 201 bp, Homo sapiens
gtgtcacatatttaaggatgttcaaggcaaccaattagtattcaagcatttagaattattttgaaacatcttctgtgaaaaacaatttatttcctattccwaaataaatgcagaatattcctaatatagtttgatagttcctcctcaagacttatcattcaaagattgggcaaattgacttgaaagagaaaagttaagcta

SEQ ID NO: 43820 - DNA, 201 bp, Homo sapiens
gaagtacttttcccaacaatcggttccgctgtcctgctgtgaccagtaacaggggaaaaaaataaaactcccctaaaggtaaatgattcacctcatgaacraagggaagaataagagacctaagtttatatacacagattccaattgtaaaatcaaacctattttgttttctaaataaacaatatttgaaaatacaacatt

SEQ ID NO: 43821 - DNA, 201 bp, Homo sapiens
cacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacaga

SEQ ID NO: 43822 - DNA, 201 bp, Homo sapiens
tccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttct

SEQ ID NO: 43823 - DNA, 201 bp, Homo sapiens
aaaaaaatcagccccttaaaatgctgactagtaacatcagtttttggaaggatactatttttgtttccattctgtctttatagtttgaacttttccttttsatagtctgtaaatattcatcatctcagagccttttgaattgcaatggcttttagtcaaaactgagcgcaatgtgccatttgaataataagaacctcatta

SEQ ID NO: 43824 - DNA, 201 bp, Homo sapiens
aaaacttagcagttgtaagttacttacagagaagactgggctagttggctgtgctatcatttttgttgaaatactgctttggggtcgccatctgggaatgytcttcctgttttatgggggaaatacatacatgcgtttttataatatgtagcctgcatatcccttggggtttccactgggggcttggctgagcagagcaat

SEQ ID NO: 43825 - DNA, 201 bp, Homo sapiens
aagttaacaaccagaagatcacgagctaaaccaataaagtgaattatggtcagttgcagattcactgccagacctgggaggaaatctcaccttggcagatsgagtctcttgtcctcgcctaacaatcagcagttcacctctcgaaaaggggttccgtttgcaatctgtcagccactaccttcttatttagagcatgtccca

SEQ ID NO: 43826 - DNA, 201 bp, Homo sapiens
gctggatgatgggtatagggtgttctctgtaccagtttggccatgttttgtgaatctataattagtttcaaataaaagttaacaaccagaagatcacgagstaaaccaataaagtgaattatggtcagttgcagattcactgccagacctgggaggaaatctcaccttggcagatcgagtctcttgtcctcgcctaacaat

SEQ ID NO: 43827 - DNA, 201 bp, Homo sapiens
agtgtgagcaagtcataattctgggttattctaattaatggagatttgggggttgttccttactgaagcacatcctgattgatgcagaggatcttgtgagycatgctaaggaattcagcccacgtcttactgaccactctgacgtactaaagggttggttttgccaatgaagagagcaggctctgactgaacgaggcctga

SEQ ID NO: 43828 - DNA, 201 bp, Homo sapiens
ggaagaatgaggatttggggaaggaaaattttgagagccattttacagcatttcaagattcagtgatctcagaacctcttttggttaaacaagcatgggargatggatgattggatggatggatgaatggataggtaggtgggaagataaatggatagacatataggtaggaaggaatgagggatatatggaaggctagca

SEQ ID NO: 43829 - DNA, 201 bp, Homo sapiens
gggtgagagacatcagcataatgcaattaaggcccattggattagaatttgcaggatgccattagcaataagctctgagtgtagattattgccgtgcttamattttctccttcagcggtaacacttctcttgtaaattctaactgggtaaaataaatatgatataaaacagacacaaataagaatatatagatgatgttaa

SEQ ID NO: 43830 - DNA, 201 bp, Homo sapiens
ttcatttctgcttgcacactggacaatgctttttttcaggaacacatctctttcttgtaatatctttgtaaaagcagcgtggagcagccagcacacaatgmcattttagctcttccctagagcttcagactcaataggtactagatctaccttatgagttatggcagagcacaattttaccaaaagtctttcagtgtaaag

SEQ ID NO: 43831 - DNA, 201 bp, Homo sapiens
ttgtcctgcctcagccttctgagtagctgggattacaggcgcccgccaccacacccagctaatttttgtatttttagtatatacggggtttcaccatgttrgccaggctggtctcgaactcttgacctcaggtgatctgccctccttggcctcccaaagtgctgggattataggcgtgagccactgcacctggccagtagt

SEQ ID NO: 43832 - DNA, 201 bp, Homo sapiens
gatccgcctgtcttggcctcccaaagtgctaggattacaggcgtgagccaccgtgcctggcctgatgattcagtttttaccccaagatgcagtatgcctcmgtctcactaaaatatgccaatatgttcttcttcttgaggatcagggctgatttcttctactgggaaaatgtatcccctgtgtttggccccagaggcatca

SEQ ID NO: 43833 - DNA, 201 bp, Homo sapiens
ctgcttattttgatttcagcacctttctgtaggacgccaatagcttatgtttgcacatcttaccccgatgcactctctaaaccgatcatcacagaagataytttgtagtgatgaagaaagcttaaatgtctcatttgtcagattggtttaggtagaaaataaggatttccaccccctcatcgtggttcccttttagatttt

SEQ ID NO: 43834 - DNA, 201 bp, Homo sapiens
ggtggggaggagttcatattcttttttttttttgagtctggattttagaataaattcactgtgtacatagctattccatctttaaaaacctttgtgaatgytaatatacagcctttataaatttgaggtataatgttcaaaatgctctaatccctaaattttccagtctaggttattatacttttatgactattcattttg

SEQ ID NO: 43835 - DNA, 201 bp, Homo sapiens
tttttttctaactgagggattaaggatataaacccaacttcaaatttctttctgggtggtcttgaaaacttaacagtaggtcctgtaaagaggtgggggaraggaaaaagaaatcctttactctcatctgctggttttaaaatgagaaaaatacacacacacacgtaatgatgttcgtgatgttaatggagggaaatatca

SEQ ID NO: 43836 - DNA, 201 bp, Homo sapiens
tgggagatagtttgagatttgaggcctctgaagaataggtgtttttgtgatgattttggcttttcagtttgacagttggctttgcttttttgacagacacmttaagagcttcaagggtcatttcatggtttgtcctttccatgtcagggacacctttcacgtggccattttaagcacaggaattgccttcaagtagtttac

SEQ ID NO: 43837 - DNA, 201 bp, Homo sapiens
tagtaaccatgaacctgtatatcaaaaagcgtgactagagtttcatagttaaacatgtgctgaaatccacagtggacaccagagagggtcatggaatctgrgaatggatgacttgtcccatgatgataatatctgtgttcctacggctgggcccggtggctcacacctgtaatcccagcactttgggaggccgagatggga

SEQ ID NO: 43838 - DNA, 201 bp, Homo sapiens
gcccggtggctcacacctgtaatcccagcactttgggaggccgagatgggaggatcacgaggtcaggagttgaagaccaccttgatcaatatggtgaaacsctatctctactaaaaatacaaaagttagccggtgtggtggtgcatgcctgtaatcccagctactcaggaggctgaggcaggagaatcacttgaacccagg

SEQ ID NO: 43839 - DNA, 201 bp, Homo sapiens
ccagcactttgggaggccgagatgggaggatcacgaggtcaggagttgaagaccaccttgatcaatatggtgaaaccctatctctactaaaaatacaaaarttagccggtgtggtggtgcatgcctgtaatcccagctactcaggaggctgaggcaggagaatcacttgaacccaggaggcggaggttgcagtgagccgag

SEQ ID NO: 43840 - DNA, 201 bp, Homo sapiens
ttttttgaaagagactgtttaaaacacgtaattttgctaagttatggctcatatcgtatttgttattttggttttgaaaaattgagtaggaagcaattgcrttcttaaatgacttgaacatcaaaggcaagtagtgtcttgttttaggagcagccaggctcctatccctctgatccagccaagtgctttcacttggtccca

SEQ ID NO: 43841 - DNA, 201 bp, Homo sapiens
ccctggttgacctggaatgacctagaccagcagtcacaagctcctgcccatggacaaaatacagccggtacctctttggctatggcctgcaggctcagaayagttcttacattttcaatcatctgcaaaaaagaataaagaggagaatattatttcttgaaggaggaaaatgatatggaattctgatttcagtgtcataaa

SEQ ID NO: 43842 - DNA, 201 bp, Homo sapiens
taggtttgagattgattttgaatactaaagtatagttttcatgttataaagccaaccatgttaaaaatgtataataaagtatctaatttagcaaaattcaratttcccctatgaaatatcaagctctttttatgcttcttcacatggcaccttgtgtagaatttgaaccactttaaacattgcatccttgagttgcatatg

SEQ ID NO: 43843 - DNA, 201 bp, Homo sapiens
tcatctgtgaaatgcagacctttctggacgtaccacctcgtggggtgaagggaaagaaatgatacaggtgtacatcagggtataagctgtcctagagtctrgattctttttatccagaagccattctttcagcctgtgcctttttgtaaataccataccccatctatttccacaaaggatttggggcattagcgagtaaag

SEQ ID NO: 43844 - DNA, 201 bp, Homo sapiens
cagtacttctgctacgagtgtatacaggctgaggatgggtgctttgtggcccttttcttttaccggctgactagaatgttgacgttaaagcagttagagtycgagcaggcaactccgaccccaagttggagctgtgtgttgaagatagaagagcaaatatgtagaaggaacctggatttctatttttttaaaaaatataat

SEQ ID NO: 43845 - DNA, 201 bp, Homo sapiens
aacctgcactaaaacttgttgctgcatctcacctaatcgtgtagtgagccaggtgagctcatctgtgaaatgcagacctttctggacgtaccacctcgtgkggtgaagggaaagaaatgatacaggtgtacatcagggtataagctgtcctagagtctggattctttttatccagaagccattctttcagcctgtgccttt

SEQ ID NO: 43846 - DNA, 201 bp, Homo sapiens
ccggctgactagaatgttgacgttaaagcagttagagtccgagcaggcaactccgaccccaagttggagctgtgtgttgaagatagaagagcaaatatgtrgaaggaacctggatttctatttttttaaaaaatataataaatcatccagccccaaatgtcaggaacctgggtttctaatgatggttggctgtcaccccca

SEQ ID NO: 43847 - DNA, 201 bp, Homo sapiens
gtgtaaggtaatgttttcctagcaaaaacaaagagggctgaaacctggtgctcagaatcgtttggaaacggaactcctctccctcttctttttacaccaarataaagaaatactttgcaaatcagctgagcacatgttcccagctccgtgccgggctctgtggtcatgggtttccttctttatgtcttactcatctaatgt

SEQ ID NO: 43848 - DNA, 201 bp, Homo sapiens
gcagttagagtccgagcaggcaactccgaccccaagttggagctgtgtgttgaagatagaagagcaaatatgtagaaggaacctggatttctatttttttwaaaaatataataaatcatccagccccaaatgtcaggaacctgggtttctaatgatggttggctgtcacccccatttcccacactttaaatgagagaagta

SEQ ID NO: 43849 - DNA, 201 bp, Homo sapiens
tgtgagaagaagtgagaattgaaatgaaaggcatctagtcttccccggtccccatccacttgacccaccatacctcaagccacttctggctccatgctctktctttccttagggttttgaaacatgttcttcagcctagaatactcctcctccactcttaatttctacccatcctgcaaaactcagtctgaacagcacacg

SEQ ID NO: 43850 - DNA, 201 bp, Homo sapiens
tccctttataagctaggaatactaagaacctaagagtctccatgaggattagatgaggtaatgtttgtaaagaatctgagatatagtaagttgatcagcawatgttatttatcctcttcttccctctacaaagataactaagctgagatagcctaactcccccagctcagaaaatagcaagttatttgcaaaatcaaatgc

SEQ ID NO: 43851 - DNA, 201 bp, Homo sapiens
agttacataattttgaaatcatttgacatttctgaggttaattttctacatcagtttagctgctttaggccgcaagttattaacacccacttaaaggtggytgaaataatagaggttttgcttcccatgtatccagagttgctgaggcagcaagggttgtgtttggctactatatgagtagctcctttgtgataatcttta

SEQ ID NO: 43852 - DNA, 201 bp, Homo sapiens
ttctgaactcagaaaatggagataaatctcttgcaaggcttttgattttagtttttagatacagaacctttaaaaaaaaagaaaaataaacgttttgccamagtgtagtatatacaacagatgtgagggaaggacattgttttaagtgggaaacgtcagctctctcaacttctacacattcgactattccctactcctcag

SEQ ID NO: 43853 - DNA, 201 bp, Homo sapiens
tagttacataattttgaaatcatttgacatttctgaggttaattttctacatcagtttagctgctttaggccgcaagttattaacacccacttaaaggtgkctgaaataatagaggttttgcttcccatgtatccagagttgctgaggcagcaagggttgtgtttggctactatatgagtagctcctttgtgataatcttt

SEQ ID NO: 43854 - DNA, 201 bp, Homo sapiens
tttacagtgcttgcttagtccagtgaccaatggatgtaagtaagttggaaaagggcaaaggatttagaatcatgagggttgtattcaaactgcagcctctrctcccttttagttacataattttgaaatcatttgacatttctgaggttaattttctacatcagtttagctgctttaggccgcaagttattaacacccact

SEQ ID NO: 43855 - DNA, 201 bp, Homo sapiens
tgatttttcaagtaaggtaatggaagcaagagaggtttacatacatggtgtacatatacctcggcagcctgtttccttcccttataactatctcaaaaaamcatattaagttatttttcagaattatgttttttcctgttgcttttgactgtaaagggcagacttaaatttagttaacatctgctctaacgttggatcatg

SEQ ID NO: 43856 - DNA, 201 bp, Homo sapiens
ccattggttttagtagtcttacgtcattatgtccaaagcttttaagtttacagtgcttgcttagtccagtgaccaatggatgtaagtaagttggaaaaggrcaaaggatttagaatcatgagggttgtattcaaactgcagcctctactcccttttagttacataattttgaaatcatttgacatttctgaggttaatttt

SEQ ID NO: 43857 - DNA, 201 bp, Homo sapiens
atctcaaaaaaacatattaagttatttttcagaattatgttttttcctgttgcttttgactgtaaagggcagacttaaatttagttaacatctgctctaaygttggatcatgtgtggagtccccagttttcaacattaaaaataaagtatttgttgaagtggggtttttttcttcttacagtatatgtagaaccattttct

SEQ ID NO: 43858 - DNA, 201 bp, Homo sapiens
cttttccttcatgagaattttctgaagctattgtgaatctatggaagactcaaggtagtatctttttcacagcattcaaaaaaatgctgctggctccttgrcttgtccggtgcatcctccgtgccagcccccgctgtcctagaaccatctaagctaactctccgatgagctctggcctctggacctcagcctatccaggcc

SEQ ID NO: 43859 - DNA, 201 bp, Homo sapiens
attgactttttcaactctgtaatgtcctaactttcatttctgcttgcacactggacaatgctttttttcaggaacacatctctttcttgtaatatctttgyaaaagcagcgtggagcagccagcacacaatgccattttagctcttccctagagcttcagactcaataggtactagatctaccttatgagttatggcagag

SEQ ID NO: 43860 - DNA, 201 bp, Homo sapiens
tgatggaaaaacaagcacagagaggctaaggaatatgctgaagcttgcacagctagtaaatggcagaacattcagactggaattcagacttatacactcayattcataccacacagcctctcgaagggacgtgccccttgaacgcaagagaggtacattgggtggccatggtgctcacagtctctcaatcctttatgttga

SEQ ID NO: 43861 - DNA, 201 bp, Homo sapiens
agatttgtgaggggcgggggtccccctacaaagcaagtgttactgtccacagagcaaatgtcaatattttaatgtactagtaagggaaaattctattaagrcataattgtttggctttgtcagtttgtcaacttgaaaatagagtcagcagcatctaaagagttgttttactacctctggagctgagaggtgaacatagtc

SEQ ID NO: 43862 - DNA, 201 bp, Homo sapiens
cctccatggtcccatctgaactggatctagagaagggttactctccttagggaaattagcagctgtcagcccacttcctgctggtgcatggttgaggctcygtttttttgtttttagcagttataggcttttaaggtcagattaatctttatttaatttcttaataatcttataggattcagatgtatttgtttcccatta

SEQ ID NO: 43863 - DNA, 201 bp, Homo sapiens
ctgcactcccgcccgggtgacagagcgagactccgcctcagaaaaaaaaaaaaaaaaaaaaaaaggaaccagatggccctgcccttgagcaggctgtggtstggcctggtggagagacagagaatcagttaattccagggtcatgtattaggtagtaagatagtggttcacaccaaaaacatagaaaatgatcacttagcc

SEQ ID NO: 43864 - DNA, 201 bp, Homo sapiens
atccaggtctgaaatctgctctctggagggaagtgccctgtccattatcctccatggtcccatctgaactggatctagagaagggttactctccttagggraattagcagctgtcagcccacttcctgctggtgcatggttgaggctccgtttttttgtttttagcagttataggcttttaaggtcagattaatctttatt

SEQ ID NO: 43865 - DNA, 201 bp, Homo sapiens
gtctgtgtgcgactgtcagctgctctctactgctcctcatagacttcctgtctgcctttttctgcatttctcagtctccccatctccccttcttatctaayccccttccttcctctctcaactcttccttcctctatcctttttctttcccttttttttttaactattcttctttagagtttgttttctcattgaacttgt

SEQ ID NO: 43866 - DNA, 201 bp, Homo sapiens
atgtagtaaggcctcttttcaatgtggtaaaagctctgggccaccccataaggctgcaagcgctagaagctcttcccatagagaacatctatatcctcaamccaaggagaaaaaggaagctgctgttcataaatattgaagaggcagggagagcttgcactgaggccagggtgtattaacatgcatgccatcgtgaagtgg

SEQ ID NO: 43867 - DNA, 201 bp, Homo sapiens
actcagttttcaaactggcttaatccaaagcctggggggtggatgtaggagagaagttgaaattagctggggttttttttttgtatcacaaaagttacattttttttttttttttttttttttaagacgtagtcttgctctgttgcccaggctggagtgcagtggtgtgatttcggctcacagcaagctctgcctcccagg

SEQ ID NO: 43868 - DNA, 201 bp, Homo sapiens
gactcagttttcaaactggcttaatccaaagcctggggggtggatgtaggagagaagttgaaattagctggggttttttttttgtatcacaaaagttacattttttttttttttttttttttttaagacgtagtcttgctctgttgcccaggctggagtgcagtggtgtgatttcggctcacagcaagctctgcctcccag

SEQ ID NO: 43869 - DNA, 201 bp, Homo sapiens
ccttgtatctactgctgtcgtttagattaggaacagattgccagatgtggaagaaatagcctcattagtaacttttctgtaagcaatctccttatttcttkttttttgttcttttgttttttgtgtgtgcttctgcgtgcacctcctctatggctccccccaccaaatttctgtgtcttcatttgcaactctcttttctcc

SEQ ID NO: 43870 - DNA, 201 bp, Homo sapiens
taaaaatacaaaaattatctgggtgtggtggcacatgcctgtaatcccagctactcaggaagctgaggactgagaatcgcttgaacctgggaagtggagtwtgcagtgagccgagatagttctactgcactccagcctgagcaacagagcaagactccgtgtcaaaaaataaataatatatgtgtgtgtgtgtgtatgtac

SEQ ID NO: 43871 - DNA, 201 bp, Homo sapiens
ctttgggaggctgaggtgggcagatcacttgaggtcaggagtttgagaccagcctggccaacatggtgaaaccctgtctctactaaaaatacaaaaattakctgggtgtggtggcacatgcctgtaatcccagctactcaggaagctgaggactgagaatcgcttgaacctgggaagtggagtatgcagtgagccgagata

SEQ ID NO: 43872 - DNA, 201 bp, Homo sapiens
acccaaagagatctgaaaagcaaaaacaaatttattgtatatttatagcaaatttatttggtggtgaaatttgacttcagctttagcgtccctgtttctcstttctagtgtgaatgttcattttgttttgtttgtttttttgaggcaaggtctcacttcatcacccaggctggagtgcagtagtgtgttcacagctcagag

SEQ ID NO: 43873 - DNA, 201 bp, Homo sapiens
gtaatatgcagtatatgtgctaaattactttttttgttgttgttgagatggagtttcgctcttgttgcccaggctggagtgcagtggtgtgatcttggctygccgtgatctctacctcccaggttcaagcgattctcctgccgcagcctcccgagtagctgggattacagacatgtgccaccacacccggctaattttgta

SEQ ID NO: 43874 - DNA, 201 bp, Homo sapiens
tatataagacagtgccctttagaagatccctgtctcattgagaagcgttgagtaaatgggtctctctggtcattctctccagaacatgaagccaaagggcygagagggagagactccaagaatgaattagtgtccagcaaggtatcgcttgtctcaggatgacaacttgcaatttggggatctctcaacgtcctgacctcc

SEQ ID NO: 43875 - DNA, 201 bp, Homo sapiens
tctctgccttcctttctctccctccttggtctgcttcctcctgttgctatcagagcctgcctgcctcatccttgttccagccttgatggtgatgatgattrtggttgctgttgctatttgtttttttggtttgtttgtttgttttgagagggagttttactcttgtcacccaggctggagtgcagtggcgccatctcggct

SEQ ID NO: 43876 - DNA, 201 bp, Homo sapiens
ccatgcctggctaattctttgtagttttagtagagatggggtttcagcatgttgtccaggctggtcttgaactcctcagctcaaatgatctgcccacctcrgcttcccaaagtgttgggattacaggcgtgaaccaccacgcccctcacgcgcagccactgttgctattgatgattattatgacatcattgctcagattca

SEQ ID NO: 43877 - DNA, 201 bp, Homo sapiens
atgtgaccttttgtgtctagctccgttcacttagcatgctgtttccaaggcttgtctaagttgtggcatgtgtcagtactttattcttttttatggctgcrtagtattccactgcatggatataccacatcttgtttatctgttcatccattgatggacatttgggttgtttccgccttctaggtataatgacttgtgttg

SEQ ID NO: 43878 - DNA, 201 bp, Homo sapiens
gcccctctgaaagcccttcactgcggctcagcctgtggtggaaggtgtccaaggtggctggaacacctcctgctgggggtgtcagtcttggctctcctgtkttctgcctgtgcaatggtgggtaggtcccttgatacctcgtaacctcagcatccctgtgggtgataaggagatgataatagtctcttcccgatgggggtt

SEQ ID NO: 43879 - DNA, 201 bp, Homo sapiens
accatggtggaaggcaaggaggagcaaagtcatatcttacatggttggcagcaggcaaagagtgagcttgtgcagggaaactcccccttataaaaccatcmgatctcgtgagacttgttcactatcacgagtaaagcacaggaaagacttgccctcatgattcagttacgttccaccggggccctcccacaacacatggga

SEQ ID NO: 43880 - DNA, 201 bp, Homo sapiens
gtcattctagtatcaactgagttctttataaaatatctttggggtgtttaaggagaattattctttttacaagttctgattaatgacaccgcaaaaatgaraataatgagctaatatgtatctagtaattgctatgcacttatatgtatagaagcgtataatccacagcactccttctgaatacgttacgtaaatggaacc

SEQ ID NO: 43881 - DNA, 201 bp, Homo sapiens
aatctttagtgagtacctgtcacaggttgagcagtcttctagggcctctggttaccagcaatgaaaaaagccccatttggtaaaatacagtagttggattmattatctctgtgattaacttgcataaaaaagagacagttttcattgatgtgacctttagcaacaactcctaaaatattttttttccttcattcctgcttt

SEQ ID NO: 43882 - DNA, 201 bp, Homo sapiens
gtaaattgatgggtgggccacaaaaatcatgtcacaagatcttgttgatgtgcatgcattcattcattcaacaaatattattgagcatctaacataagccrggtgctttgctagggacagaatgctgtacaaggtccctgtcctcatggggaccgtatgttgggaagacagatgataggcatggaaatgaagagacaaacc

SEQ ID NO: 43883 - DNA, 201 bp, Homo sapiens
taaataaaatattaatttttcatagtgtttaatatgtgccagtatatataaattcaaggtaaggtagacagctgtaaactggatcccctgctgtacccagsaaatgctgagagccctgcttcccctcttgtattcaaatggctctataagagaggaagtagtacagctatcagtaacaatgccatccggtaattaccgaat

SEQ ID NO: 43884 - DNA, 201 bp, Homo sapiens
ggatagggtaatggtgttgacacaggcactgttgaatacgtatgtacatattttaatagttttctcattaatcaaatggaaatgctatcgattttataggrtcgttgtgagaagaagtgagaattgaaatgaaaggcatctagtcttccccggtccccatccacttgacccaccatacctcaagccacttctggctccatg

SEQ ID NO: 43885 - DNA, 201 bp, Homo sapiens
ttaaaaaatggcttacgtttatggaacttctgcgacgatcgggttacgtttcctgtgcccgtgtaaagccagtcatcgtgctgagttttaacggatgtgcrgctaccctgctaatggatgggccggcaatgctggtcctgttgcaaagttataaattataactagaaaaagcacaagatgtcattcttctaaccttcgtga

SEQ ID NO: 43886 - DNA, 201 bp, Homo sapiens
gcccattgaattttgatgatagcattaaaacaaatgcctcaaatcatttttggaaggagacaggatatgaattgacaaattaataaaataaattatacttsaaagatgctaaattatctcttctatgtaagtaggaggctctcttttcagatgtggaatttgtaggagcttgaatattctcaagagagggtatgggcaaca

SEQ ID NO: 43887 - DNA, 201 bp, Homo sapiens
ttaaggaatattgttgcagatcagtaattttacaattggatgttcttgtgcaactttattaaatgtgatctgtcttttaaatgttgcccttttacagttayacatttctaattgttgctgtaaatgcattatcactttgaaattaattaatttttccattttggctgcctgcaatataataatcactaatgagaaactcac

SEQ ID NO: 43888 - DNA, 201 bp, Homo sapiens
attaggttgatacagaagttattgaggtttttgccattgaaagtaatacgtcacttcatgcagaggtggaattggcgctctgagcttgcttgtcaaattcrcaggcattcacttttctttcataaacatttaggactctgtatttaggagaggaatcactgtgaatgtagacctcgggttggtcattttcctagtaagata

SEQ ID NO: 43889 - DNA, 201 bp, Homo sapiens
gacccagtcacagtgattctatctgtacctaccacagctaggtaggcggtatgggaagaccacaaacttgagagtcagacggatcgaacttcgtctttagycccccacttaggtgttatgtgactgtggtcgggttattggtaacatcttcttgctcagcttcctgacctgcagaatgggaataagaatacctagcacata

SEQ ID NO: 43890 - DNA, 201 bp, Homo sapiens
gaaatggaggcagagggactaccatgtcggggaggatgcacaatgaattggacgaaggttgcaactcagtgagcaccgtacctgtagtgtgtcttagtaayagcagatgcccaacctccatgcctaactcctttgcctaccccaccagtgtgcagcagcctctgccgcaccctactgcagtctctcctatttccctggcag

SEQ ID NO: 43891 - DNA, 201 bp, Homo sapiens
gtgttatgtgactgtggtcgggttattggtaacatcttcttgctcagcttcctgacctgcagaatgggaataagaatacctagcacatagggttataatgragatgaaactgcttaacgcatgtgaataacaacaatggctaacatgtatcagacgcttgtcttagtgtttattgttttatgcgtattgtcctgtttcatc

SEQ ID NO: 43892 - DNA, 201 bp, Homo sapiens
agctggtgtttaacgactccgtcagacccaattataaagcatcaactagttacgttgatttgtgtacatccatgccatgggtatacttaaaaacattagaytttgccagaactcatcttggctttgtttacatttttcttttaaacgtataagactattgatggtacctcaccaaggttataacccctttataatcattaa

SEQ ID NO: 43893 - DNA, 201 bp, Homo sapiens
aagatcctcaagctgttccttccaccccctgggatgctgattaagttaagatttcagattttatttattctacgggtatttgttgaatatttatttcttamgataccacgcactgctttaggcactgggaatatagcaggatatacaaaacagaaaaatcatggccctcatggattattggttgtgagtaataggaacctt

SEQ ID NO: 43894 - DNA, 201 bp, Homo sapiens
ggagaaagcacccccatgattcacttatctccacctggctctgcccttgacacatgggggttattacaattcagtgtgagatttgggtggggacacagccraaccgtatcagtcaccctccaaaaatcacacaaaatctgaaagtgcttttattcattctacatgtaaatagttgttgcactacccacctggaaattcagt

SEQ ID NO: 43895 - DNA, 201 bp, Homo sapiens
tcctcaagctgttccttccaccccctgggatgctgattaagttaagatttcagattttatttattctacgggtatttgttgaatatttatttcttacgatrccacgcactgctttaggcactgggaatatagcaggatatacaaaacagaaaaatcatggccctcatggattattggttgtgagtaataggaacctttcaa

SEQ ID NO: 43896 - DNA, 201 bp, Homo sapiens
cactgggaatatagcaggatatacaaaacagaaaaatcatggccctcatggattattggttgtgagtaataggaacctttcaatctaacttaggaaaaaasgttagggagccaaggaggaagagtgggtgtgatgatgcatcaggataccagagaatcccgtggaatcccacagtgacacagccaagccttgggaggggtg

SEQ ID NO: 43897 - DNA, 201 bp, Homo sapiens
tgagacttattcactaccatgagaacagtatgggagaaagcacccccatgattcacttatctccacctggctctgcccttgacacatgggggttattacarttcagtgtgagatttgggtggggacacagccgaaccgtatcagtcaccctccaaaaatcacacaaaatctgaaagtgcttttattcattctacatgtaaa

SEQ ID NO: 43898 - DNA, 201 bp, Homo sapiens
cccacagtgacacagccaagccttgggaggggtgacactagcgatagagacagaaacccacacaggagtccttttctctgtctctcatctctgcttttctytgtacatctggttcaattattctcttgccacgaatcagctatttgtattcctctgtgcacgtcgcagaagatcaggaatttgcacattatagtcacaacc

SEQ ID NO: 43899 - DNA, 201 bp, Homo sapiens
gacatcaggcaacagagtatgtgcaggggaattctcatttataaaaccatcagatttcgtgagacttattcactaccatgagaacagtatgggagaaagcrcccccatgattcacttatctccacctggctctgcccttgacacatgggggttattacaattcagtgtgagatttgggtggggacacagccgaaccgtatc

SEQ ID NO: 43900 - DNA, 201 bp, Homo sapiens
tgcacattatagtcacaaccatacctagaaccaaattgcctaacactgaatcccaaatccaaattcctgggagatagaattcaattcttctcttgccacamatcagctgtttatactcctctttgcacgttgcagaagatcaggaatttgcacattatagccacaaccatacccagaaccagattgtctaacactgaatct

SEQ ID NO: 43901 - DNA, 201 bp, Homo sapiens
ggtaatttataaaggaaacaggtttaatgggctcacagttacacatggctggggaggcctcacaatcatggcggaagatgaaggaagggcaaagggatgtsttacatgacatcaggcaacagagtatgtgcaggggaattctcatttataaaaccatcagatttcgtgagacttattcactaccatgagaacagtatggga

SEQ ID NO: 43902 - DNA, 201 bp, Homo sapiens
aaggtttggcttaactgcaaaggggtggttgatatcagattcatacgccagaaccagaagaccactcgtgagaaattctgtaagcacaggagtgtggtttrtgtcaaaatcaatctgatggagtgaagccattccttgccaagcgaaaatacagcatcatcaactacatccttgagcctagaacctcttcactcagcacca

SEQ ID NO: 43903 - DNA, 201 bp, Homo sapiens
atacccgagaccgggtaatttataaaggaaacaggtttaatgggctcacagttacacatggctggggaggcctcacaatcatggcggaagatgaaggaagrgcaaagggatgtcttacatgacatcaggcaacagagtatgtgcaggggaattctcatttataaaaccatcagatttcgtgagacttattcactaccatga

SEQ ID NO: 43904 - DNA, 201 bp, Homo sapiens
atatgtcgccttgggaaacagaggcagaggagaacaggaaagagtcagatggactttgatttgagacccgtttctgcttcttcccagggtgtgacctcagyggagttccagagcatccatctcctttgtaagacacagataataccaactgcatggatttgttatgagagttacatcaggggagggtcatgaggtcacctt

SEQ ID NO: 43905 - DNA, 201 bp, Homo sapiens
ccgtttctgcttcttcccagggtgtgacctcagcggagttccagagcatccatctcctttgtaagacacagataataccaactgcatggatttgttatgasagttacatcaggggagggtcatgaggtcaccttcccatggccaggagaagcaggtactcaggaatggctacttctctggccactttatagacctatggag

SEQ ID NO: 43906 - DNA, 201 bp, Homo sapiens
tctcatatcgaaggataacctcttgtatttacaaaaaaaagaagaaaaagtgctgtcatcagtaaattcattcatgtatgttatacacttacatacaaaaygtatctatttgattaaattagaactctgctaatgaattactttccttgattgcacagtaataaagtcaatgttgtaaatataataattatagccaagtgc

SEQ ID NO: 43907 - DNA, 201 bp, Homo sapiens
taatcaacaattctcatatcgaaggataacctcttgtatttacaaaaaaaagaagaaaaagtgctgtcatcagtaaattcattcatgtatgttatacactyacatacaaaatgtatctatttgattaaattagaactctgctaatgaattactttccttgattgcacagtaataaagtcaatgttgtaaatataataatta

SEQ ID NO: 43908 - DNA, 201 bp, Homo sapiens
gtaaaagcatcatgcaccaggtaaaatgtttaataacacagagaaatctaattgtcaagtatcttctcaacacacattaatcaacaattctcatatcgaargataacctcttgtatttacaaaaaaaagaagaaaaagtgctgtcatcagtaaattcattcatgtatgttatacacttacatacaaaatgtatctatttga

SEQ ID NO: 43909 - DNA, 201 bp, Homo sapiens
atgaaaggaccagaatggcagttctgagctagaatgtgatgagtaagtaccaccatagttagcggctagggaagggaggttgttctacagagaaacatgcycatcatttcttctgttacctggtattcactctggcaatttctttttggactcattctaaaatcaggattaaggatatccactgagaagcttgcatttatt

SEQ ID NO: 43910 - DNA, 201 bp, Homo sapiens
gttctctggatggtggtgtcatgccaacatgggagccactagcacaaagaacatgctaggttctgttgagacctgactttgggaatagcataggtacttayctttctcagcaccacacaaacacactccagaatgcaaaggaacctgcactgtgccatcttgcttctccctgcatagccacttctctttccagtggtgttt

SEQ ID NO: 43911 - DNA, 201 bp, Homo sapiens
ggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtataccttt

SEQ ID NO: 43912 - DNA, 201 bp, Homo sapiens
tggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctt

SEQ ID NO: 43913 - DNA, 201 bp, Homo sapiens
ctggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacct

SEQ ID NO: 43914 - DNA, 201 bp, Homo sapiens
tctggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacc

SEQ ID NO: 43915 - DNA, 201 bp, Homo sapiens
tttccactgactaatcaggctgataaaacaacctgaaaatggctttcccatggagtttatatatttcgtcagagacctaaaatggtataaatgttcaatartagccagtgaatataaaactaaataatccatatgagacaaaacaggtagaagaaaaaaacattcctcctcagatatgcaccttttaattgaataaagcaa

SEQ ID NO: 43916 - DNA, 201 bp, Homo sapiens
tttttttcctaaaaaaaaaaaaaaaaaaaaaagaagaatcgcttgaacccgggaggtggagcagtgagccaaggtcatgccactgcactccagcttgggcracagagcgagactctgtctcaaaataaataaataaaaatgcatatatgtatatttgtgtgaatcatatacacatatataaaatatatgtatcatatacat

SEQ ID NO: 43917 - DNA, 201 bp, Homo sapiens
aagctaaatggtattttcgtttttctcaagctcttccaataaatatgaccaccaagatttttttttcctaaaaaaaaaaaaaaaaaaaaaagaagaatcgmttgaacccgggaggtggagcagtgagccaaggtcatgccactgcactccagcttgggcaacagagcgagactctgtctcaaaataaataaataaaaatgc

SEQ ID NO: 43918 - DNA, 201 bp, Homo sapiens
gagcttgcagtgagccaggatcgcgccactgcactcccgcccgggtgacagagcgagactccgcctcagaaaaaaaaaaaaaaaaaaaaaaaggaaccagrtggccctgcccttgagcaggctgtggtctggcctggtggagagacagagaatcagttaattccagggtcatgtattaggtagtaagatagtggttcacac

SEQ ID NO: 43919 - DNA, 201 bp, Homo sapiens
ctttttttttttttttttttttttttttttgatacaatgaggggaaatgtttcttccacaaaagcctggccgtttgtctttaaaaattttcatcttttggstactgagttgtaatagtaaatacagatgtagctgtgtcacattaaaagcacaaccaaattgtagtacaatgttcaggacacttttatgtcactttaaaat

SEQ ID NO: 43920 - DNA, 201 bp, Homo sapiens
aacttggctgggtgcggtggctcacacctgtaatcttagcattttgagaggccgaggcgggtggatcacttgaggtcaggaattcaagaccagcctggccrccatggtgaagccccgtctctactaaaaatacaaaaaattagccagctgtggtggcacatgcctgtaatcccagctactcgggaggctgggacaggagaa

SEQ ID NO: 43921 - DNA, 201 bp, Homo sapiens
aggggacccttggtatcctgttcatctggcaaatctcagcaccaatagaaacaccaagaacatggattcatcaaaggaaaaatgttgaagtttccattttkatgcttcctggtaatccttcagcccttgatggaaatttccagacctaaaccagtgaattaagagtatggggaagaggagccctcatacagttctgttaaa

SEQ ID NO: 43922 - DNA, 201 bp, Homo sapiens
attggtaaatgaagtcagcttagtgatatgagaattatgaaacataaatccctttgtaaaaatataaaataatcttacaatcatcatcgtcatcctcatcrtcgtgttccttcacaccagcggtatttatggtatttatcaactaactgctgtgtactatgctctattgaaaatgttagcaatatagtaatgaacaaaaca

SEQ ID NO: 43923 - DNA, 201 bp, Homo sapiens
aaggtcacttgaacccaggaggtagaggttgcagtaagctgatatcatgtcaccgcactccaacctgggtgacaaggctagaccctatctcaaaaataaasaaacccttgctattttagcttccgatgaggatatttatccttctagcatttgaatgcagccaaagtccttactgggcaaatttttgagctctcaccccac

SEQ ID NO: 43924 - DNA, 201 bp, Homo sapiens
cgagacaatgtctcaaaaaaaaagaaagagttctgaatgatgataggtgttggaatccacgttggtgtgtctcatgtcattttttcgggcagtttcttgamagacccattttgtgtgtgtgtgtgtgtgtgcgcgcgtgcgcacacgcatgagcctgtacgtgtccccctccccccccacacatatgcacataagatagca

SEQ ID NO: 43925 - DNA, 201 bp, Homo sapiens
tataattgtcattgaagtcaaaactgatggcgtaatatttaaaacaatggctggatccccaatctaagaagaatacattttgttgatcatattaagtactsttacagtgaatgcatggacccatacaattgtggaataattaagaaaaaaggacttaagggcttaaaaatgtctttttaacaatttaacaagttagccaga

SEQ ID NO: 43926 - DNA, 201 bp, Homo sapiens
agcacctttgtgtgacacctcttctgtaataccttattatgttgaaataaagttagcaaataacataacttacatgcacaaatatattttcaattcgatakgatagctttactgtaatgaaagaaaaaataactgaaacaaaatggcgtgtgtttcaacatgtaaatgcttgggccaggctacaggaaagatggggatgta

SEQ ID NO: 43927 - DNA, 201 bp, Homo sapiens
tttctggaagcagttgacaaaagatgagtagagagagggagggggtggtgctatatttattccatacctttcagatactctctaaatccttgtccctgttktctatgccatgtaggtagagttttcaagtcatgtcccataccttggatcattggattctcaactcagtagcacctttgtgtgacacctcttctgtaatac

SEQ ID NO: 43928 - DNA, 201 bp, Homo sapiens
tcctgaagagtggatacttaatgtccatggaggcatgcatttttatctgccttgcatggcttctttcattctctccctgacttccacccaaaaaatcaccrtgatatccagctgtggaagagttcattatggagagcttcctggaagaagtagtccctgaactgggttgggctaaacaaatatgccaagaagggtttctgg

SEQ ID NO: 43929 - DNA, 201 bp, Homo sapiens
agatgtgcataataagttcaggaggggctcggttttgggaggccggggatactagaagataaccctaaaatgtggaaatctacatcagagagtggtgtgartggttcccaaaatgcctacctggcactcctaccaaagacacagcagagaacttggggcctcttgtttcagccattttcatcttcactgtaaatctagaca

SEQ ID NO: 43930 - DNA, 201 bp, Homo sapiens
ttttcaccaatcttggaaggccagtaatgtcagtgaacactaggaatggtgtcatggcctgggtcctgaagagtggatacttaatgtccatggaggcatgyatttttatctgccttgcatggcttctttcattctctccctgacttccacccaaaaaatcaccatgatatccagctgtggaagagttcattatggagagct

SEQ ID NO: 43931 - DNA, 201 bp, Homo sapiens
caggctctaatgcacgataagacagttaggttcgaaggaaaacaaagacaattgcacggcacagagggaatatactgctacggtaaaccgatcactaacayccggccctgaatttgcttcaaagttttcactaaggcacaaagggagccgtgtggagctccggagttcccatctgaggtcttgtctaactccttggcaact

SEQ ID NO: 43932 - DNA, 201 bp, Homo sapiens
gtctactttccaagaattcacagtctagttttggaatcaggtgatcaattgacttacagtctggtatggtgatgacagaggagcaatgtacagatagaacmgaaggatggcacagtgagccttttcaccaatcttggaaggccagtaatgtcagtgaacactaggaatggtgtcatggcctgggtcctgaagagtggatac

SEQ ID NO: 43933 - DNA, 201 bp, Homo sapiens
tgatgcacccgcatcggcctcccaaagtgctgggattacaggcatgagccaccgcacctggaggacaagtaatttctaagtattatttcttttaatcctcrcagtgactccttgttagggtttgctgcattttatacaaagaagaaaggagtctgtggaagtgacataaagtaggacatgtattcatttactgattcaacc

SEQ ID NO: 43934 - DNA, 201 bp, Homo sapiens
cccaaagtgctgggattacaggcatgagccaccgcacctggaggacaagtaatttctaagtattatttcttttaatcctcacagtgactccttgttagggwttgctgcattttatacaaagaagaaaggagtctgtggaagtgacataaagtaggacatgtattcatttactgattcaacctttcatttgtacatatatgt

SEQ ID NO: 43935 - DNA, 201 bp, Homo sapiens
agaaaccaaaagccctaaacatgaggaaattccacatgtaaacattaatggaaaacatagaagagttgaacctagtggtaaattttacctttagagcaatrcttgaaacaagggaaactgtcaaattctcatcatgggatttgtgttcctttgttttttttattaaggacttggtccttggattggaattccaaacccatg

SEQ ID NO: 43936 - DNA, 201 bp, Homo sapiens
gattagggatcaagaagaaatgactttctcctcttagacatttaattcacttagtgttccctagtcatgacatacttctgtgttatccttaaatactgaarcagggaccttattcttaacagtagaaaatcactgtgtatgatgatagtgtatacctgtaataccagctactcaggaagctgaggcaggaggatcccttga

SEQ ID NO: 43937 - DNA, 201 bp, Homo sapiens
aattctattaagacataattgtttggctttgtcagtttgtcaacttgaaaatagagtcagcagcatctaaagagttgttttactacctctggagctgagasgtgaacatagtcgtttttcaggaagccgtttctggctcagacagataagaagctggcccacccttgccacttcctggaggactgtcagtgctagctaatg

SEQ ID NO: 43938 - DNA, 201 bp, Homo sapiens
agacatgtgggtggactcagcttggctcacttaatttttccaggtcttttttgttcgcctgtgattgtgggggactgtttagaaggactttctagagcaasgaagattgtttttacgactatacttcaagctcctcattgattttgcttagagatggaataataattgatgaaatctgaatggcatgacctttattgattt

SEQ ID NO: 43939 - DNA, 201 bp, Homo sapiens
gctggacaagaagtcctgagcactggggagttgacttcatattggaggcagagaagaattacctgccgatggctgttggcccatggcaacaccctagatcsttgcatttgtggtcctgctgaaagaggagacttaagttatagagttattggtacttgcaacactttctctggaatttggccatttctctgctcttttagt

SEQ ID NO: 43940 - DNA, 201 bp, Homo sapiens
tttattacttctaagttccattgcaaaaatatgctgcctgctctgtcagccaccctatatgcctatttagtcccagttttccagcttctatttttttccamataatccctaaccatgataatacaaatataatagaaataattatgtttgtttaaaatatacacagaaccaaatagtcatagagtagtatttcaggtgggg

SEQ ID NO: 43941 - DNA, 201 bp, Homo sapiens
acaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaataa

SEQ ID NO: 43942 - DNA, 201 bp, Homo sapiens
cacaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaata

SEQ ID NO: 43943 - DNA, 201 bp, Homo sapiens
tcacaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaat

SEQ ID NO: 43944 - DNA, 201 bp, Homo sapiens
caacaaaacagaatattccagtgttctttctccggggagatggcattttcctggttgcccctccactgagagttggctgaaacaaagaatttgtcctgtayggaaaacaggagactttgtacagtggcctctctaaaggtgcaagatattcaaaagagaaacccgcatacatttggatattaagaaataattctggggatt

SEQ ID NO: 43945 - DNA, 201 bp, Homo sapiens
tgaatcaacaaaacagaatattccagtgttctttctccggggagatggcattttcctggttgcccctccactgagagttggctgaaacaaagaatttgtcmtgtatggaaaacaggagactttgtacagtggcctctctaaaggtgcaagatattcaaaagagaaacccgcatacatttggatattaagaaataattctgg

SEQ ID NO: 43946 - DNA, 201 bp, Homo sapiens
gaggttcctgtctgccagtcactctatagtaactattaggaaacccctttttttctctgaagtcattgctcctgtgtgtgtgtgtctgtatataaaaaaaagtatgtatacatatacgtatatgtatgtgtatagataaaaatgcatgtatggtgctgggcgcagtggctcacgcctgtaatcccagcactttgggaggct

SEQ ID NO: 43947 - DNA, 201 bp, Homo sapiens
gagaggatagtataatgaggttcctgtctgccagtcactctatagtaactattaggaaacccctttttttctctgaagtcattgctcctgtgtgtgtgtgkctgtatataaaaaaaagtatgtatacatatacgtatatgtatgtgtatagataaaaatgcatgtatggtgctgggcgcagtggctcacgcctgtaatccc

SEQ ID NO: 43948 - DNA, 201 bp, Homo sapiens
acttagaaccacacaaaagttacactttacagttttggaggtcagtggtccaaaataggtctcagtgggctaaaatcgatgtgtcagcaggacaccatttytttctgtaggttctagaagagaacccacttccttgctgtttccagcttccagggactgcccaaatcctttggctcatggccccttcctctatcttcaaag

SEQ ID NO: 43949 - DNA, 201 bp, Homo sapiens
ggtatcacagaagccaagacaggaaagtgagccagaagtgagggaggagcaggatcctctgcaacagggcagtctagtcttagcagagaggaggttgctgratttattgattgagaagccactcctcgccaggcagttttgagaggttctggatggtgatagaatggaattcattcagctgatgatgagaagtagatttgg

SEQ ID NO: 43950 - DNA, 201 bp, Homo sapiens
gtgcataatgcttccaggtacacttgtctacacatttttgtgtggatataggttttccttttttggggtatgctcctaagagtgcaatttctggatcacgkggaactccttgtttaaccttttgaggagccaccagattgttctccacagcagccacacccatctacattctaaccagcagtgtaggaaggttccgatttc

SEQ ID NO: 43951 - DNA, 201 bp, Homo sapiens
ccactttttaaacatgacattcgatccacgtggcatagcaaggatgggatccacaagatggagtgatctttacgccatcctcctgaccataaatactaaaygaatactctatttcagttgagtttttagtttgctctgttacgtgaggacacatcacttgcacctcagtgtgagtttgaaagtgttttctctggagaataa

SEQ ID NO: 43952 - DNA, 201 bp, Homo sapiens
tgacagggagatggagggaggcaaaaagaaaaagggagaaggaaagagaggaaagaggggaagggaggaaggaaagaagagagagaaggaggaagagaggraaggaggcacagaggtagagaggcagggagataatggagatcctggccaaaagttaatgctccgtttctagtagtccacagaaagcaccttgaccaagtg

SEQ ID NO: 43953 - DNA, 201 bp, Homo sapiens
gctatgtcagaagcaagtcaggatttgaaggcagatctgtctgcttttgcccctctgtaaatccagagctgctgcctcatttcttacgttgcccccacccrtgcagcaattcttcctgggaggcctcattgttcatattcataaagggccccattcagtctcctttttggagaaatggccactgcaactctctgttctgac

SEQ ID NO: 43954 - DNA, 201 bp, Homo sapiens
tgccttttgctatggggttgcatccacggaagagtttgaaagcccaaccatatggacatcatattattcatttttatttgccatccagagcttgccagcarccttttagatctctttccttggaaggttcagcaagatgcttgtaaatgtatgttgctttgttgcagacaatgtatatttaaaaagcaattatttgcccat

SEQ ID NO: 43955 - DNA, 201 bp, Homo sapiens
caattgtggaagcaatgaattgaaggactagggtcaccagtggagtcccataaataggttgtttatgatccctgtgaaacaagaagaccctcttaatttcmtgcttcttaaactggggtatgagtggccccaggtttccctgttgggggtactgataccagagttcatttgaagtcattggaaaccaaggcatattttctt

SEQ ID NO: 43956 - DNA, 201 bp, Homo sapiens
aaatgaatggcatatgcgtatgtttcaagagctccagcagcctacccaggatggcttgatgttgtctcttagcaccgtatcaatacctgggggttttcaartattgcaggtggccgaagcctttgtgttgaggtttctgtagtgtttatccatttgtgaaaccaggcctcaatctatatgtccaacgccattcgtagaccc

SEQ ID NO: 43957 - DNA, 201 bp, Homo sapiens
ctctctattgcatattaacccaccatattgagagaatagaaacttttgccttcattatatcacctttacaccccaggacaggtgccctcctcagcggagasaactgtccccctccatcctgcaggagttttgcagccatccttccagccactgcttctctaccggggcaaattttcccccaagggataattgataatgtct

SEQ ID NO: 43958 - DNA, 201 bp, Homo sapiens
ccaggtctgactattaaccagattttggaacctttagggcttattatttagtaatccctgaagctctcaagtaggcgtttttaaattcatgcattagaacrgattaaaaattagctagaaacgcatgttaaatggcccactccctttcttttgctaattgtgctagaaatgaaaaagaaaatgcaagtgaggtcagatcta

SEQ ID NO: 43959 - DNA, 201 bp, Homo sapiens
cccctcctgcacaactgtggcgttctctttttctgactagctgattctgctgctgctggatttattcattcttctccctcacaattttggctcgcacatgmttcctttttagctcatgaccgtgcaattcaactcaacctcatggcatctttttatcagctgtccctgctgcaacaggcttagagttggtttcccaattcc

SEQ ID NO: 43960 - DNA, 201 bp, Homo sapiens
aagagataatgttggcaagctgaggaaaggaggcagttttgggtaactgtctcttgcgatcccctcctgcacaactgtggcgttctctttttctgactagstgattctgctgctgctggatttattcattcttctccctcacaattttggctcgcacatgcttcctttttagctcatgaccgtgcaattcaactcaacctc

SEQ ID NO: 43961 - DNA, 201 bp, Homo sapiens
ctatctctacaaaaattagctgggcatggtgtcacgtgcctgtagtcctagctactcgggaggctgaggtgggaggatcgcttgagccccgggaggtagasgcatgatcatgccacttcactgcggcctgagctacagggactctgtctcaaaggaaagaaaacaaacaaacaaaaagccatgtagagctgggctatccaa

SEQ ID NO: 43962 - DNA, 201 bp, Homo sapiens
aattagccaggtgtggtggcatgcatctgcagtcctggctactcagaaggctgaggtgggaggattgcgtgagcccaggagttcaagaccagcctgaacgmcgtaaaaagacctatctctacaaaaattagctgggcatggtgtcacgtgcctgtagtcctagctactcgggaggctgaggtgggaggatcgcttgagccc

SEQ ID NO: 43963 - DNA, 201 bp, Homo sapiens
aaacaaacaaacaaaacaaaacaaaaaaggtttaagaaatgttctagtaccttgaaaccaaaataggtatcagatacttggctgttttgttttttcttctwagccattttgacctgtgagattttatgtgatgaaaacataagaatgtggtattacaccctgtgatttgaattttccatactccattccattctatatgtc

SEQ ID NO: 43964 - DNA, 201 bp, Homo sapiens
ggagacgactgaggctcacagaggttaagccacctacccaggctggcaccgcacactttgttcagagtgggcctggcatacggcatcagttcagcctggcmctagacccttttcctcccacaaccatattgcccccagtggagagacaggaaagcagggaagggggcaattgccaagcctgtttctagaatctcaaggatg

SEQ ID NO: 43965 - DNA, 201 bp, Homo sapiens
catatactgatgcggtgtttattttattttagttttttgagacagggtctctgtcgctcaggctggattgagtgcagtgaatcttggctcactgtagcttytgcctcttgagctcaggcaatcctcctgcctcagccccaccagtagctgggactagaggcacatgccactacacccagttaattactacattttctgtag

SEQ ID NO: 43966 - DNA, 201 bp, Homo sapiens
gaaaaagatcatagagccaaagagctcgatacatatactgatgcggtgtttattttattttagttttttgagacagggtctctgtcgctcaggctggattragtgcagtgaatcttggctcactgtagcttctgcctcttgagctcaggcaatcctcctgcctcagccccaccagtagctgggactagaggcacatgccac

SEQ ID NO: 43967 - DNA, 201 bp, Homo sapiens
ttccaagaagggagtggcactatagctgaagaggatgaccctctatcacagcctttgctaaaaccactgaaaactgtcttatttttcattttgcccggaartgcgacacataagtgcattcctctagggaaggatttttttttttttttttttttttgagacaggagtctcactctgttgtccaagctggagtgcagtggc

SEQ ID NO: 43968 - DNA, 201 bp, Homo sapiens
gtaatgtcacttatatccaggaaagagtggcaaagaaccatcccagcagatagcttgagggtgggaagggggataggttgttgataatatggaataggagraaaaagatcatagagccaaagagctcgatacatatactgatgcggtgtttattttattttagttttttgagacagggtctctgtcgctcaggctggattg

SEQ ID NO: 43969 - DNA, 201 bp, Homo sapiens
gaggccctacctccaaacaccatcttattgggtgttctagtttaacatatgcatttggaagagagaggaacatattcagtccatagcatgaaccaaccacrtgcacagaggtgtgccccaatttactgtcagtgcagccttcacaggcaggaaacccaccaggtccaaggaaggggcactcagctgttacctcctgtcata

SEQ ID NO: 43970 - DNA, 201 bp, Homo sapiens
ctaattatctccttcccccgccccctccattctctttccatcctttaaatgtcagtgtcccccacaattctgttgttgaccctttctccctctggccaatrctccttcccctgtagatcatacccattcccaagatttcagtcatcaaatccattccaatatgactcctgtatccatatgtccagttccaagtatctgtcc

SEQ ID NO: 43971 - DNA, 201 bp, Homo sapiens
agactaatacagtcagggatgctgcagaacatctccaaacacacaggactcccaccctctacttccaccccaccaacaaagaatgattcagcccaaaatgrcagtagtgaccttgttgagaaatgctgttcaagccatacgtcaccattggaaggttgccaaactgtgctttgcacacacatgctgtctgcacgccttgta

SEQ ID NO: 43972 - DNA, 201 bp, Homo sapiens
tatgagtgaatggcagcgttttgacaggatgatgaataaatatgctgggcccagaggactccaggtgataagcatttctttgtggtctggtaagtgatagyacccattgcttaatttctctaaaatctgcatttgtcaattttgtatttttttatttgaaaggtatttgcttaaataaataggccatataaatctagctcc

SEQ ID NO: 43973 - DNA, 201 bp, Homo sapiens
ttttgtcagttcatctatctgtccatctctttgtccatccatccaactacccacttacccatccatccatacatttatccatccatctacccacccatccrtccatccatccatccatgcatccatccatccatccatcatccatccatgcatgtaagttgcagacatcaacaaactttacccttaaggactttggctggc

SEQ ID NO: 43974 - DNA, 201 bp, Homo sapiens
actcaacagttgctaatgttttgccatgttttgtcagttcatctatctgtccatctctttgtccatccatccaactacccacttacccatccatccatacrtttatccatccatctacccacccatccatccatccatccatccatgcatccatccatccatccatcatccatccatgcatgtaagttgcagacatcaaca

SEQ ID NO: 43975 - DNA, 201 bp, Homo sapiens
agtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttctg

SEQ ID NO: 43976 - DNA, 201 bp, Homo sapiens
cagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttct

SEQ ID NO: 43977 - DNA, 201 bp, Homo sapiens
gcagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaacttc

SEQ ID NO: 43978 - DNA, 201 bp, Homo sapiens
tcttgggctggctcattacaggccactctgtctgaggaacactcaggtttgcaaaccgtttcttaaaattacaggatacctagggacctgttggggtgggwgggaagaaccctatgggcagaaatgtgactttctgtagcaaagatgtactgtttcccactgagaagaatcaaaaatagaaaagtgcttccttgtctctct

SEQ ID NO: 43979 - DNA, 201 bp, Homo sapiens
tgtttacagtgtgggacacctgactttcaccttttatgatacctgcctggggcatgcatgtggtgactttttccatctctggtctctatcttatctcttgygatgaactcaggtctataaagcatttgggcactgcctggcacataggatatgtccagaaaacactagctggtattaaaacagaggaaacatgggaactga

SEQ ID NO: 43980 - DNA, 201 bp, Homo sapiens
tcaatgttgagatcacatacatcctgaaaacactgtttaaataaaattttggcctgcatcctgtttttgaaaacttgcaatggcttgccaacgttttcaasttgagaagtttcacaaaaaaaattcggatttccagcttctttcaaaaacacaggtcaaacatcctgagcctgttctgtggtcagttactcattagcagcc

SEQ ID NO: 43981 - DNA, 201 bp, Homo sapiens
gaacctttctcttataaggatactaatcccatcgtaccccgtcccccatgatctcatttgaaattagtcacctcccaaagccccacctccaagtactgtcmcactggggcatagggcttcagcatatgaatttgggggagctggggagaggaacacatacatttagtccataacaactatctcacttacctctctactaag

SEQ ID NO: 43982 - DNA, 201 bp, Homo sapiens
actctgccagaggttgaaaactcaatgttgagatcacatacatcctgaaaacactgtttaaataaaattttggcctgcatcctgtttttgaaaacttgcartggcttgccaacgttttcaagttgagaagtttcacaaaaaaaattcggatttccagcttctttcaaaaacacaggtcaaacatcctgagcctgttctgtg

SEQ ID NO: 43983 - DNA, 201 bp, Homo sapiens
acctgtagtcccagctgcttgggaggctgacgagtaaggatcacttgagccagcatggtggaggctgccatgatcatgctactgcactccagcctgggcarcagagccagaacctgtcttgtaaagaaaaggaaaaagagagagaagggcagaaagaaagaagggaaggaagaaaggaaaattgggcccaggaatgatctt

SEQ ID NO: 43984 - DNA, 201 bp, Homo sapiens
agggaaggaagaaaggaaaattgggcccaggaatgatctttacaatgcctgacaaccaagagaagaagggaaatgagcttcacattgcctgcaagctctarggtgacaagagccaagagaaattattgttactgtagtgatgttccactgaggatcataaagtactttattactctactgagtatggttttttgttttgtt

SEQ ID NO: 43985 - DNA, 201 bp, Homo sapiens
ccatgttccaggcacggttgtaagcacttacaactagtgactcatttaaccatttcacaaatatttattttgagagcaagcacgggggtttatgtgatggytccacagagcagtgaaaagactcccgccctactgctcgcaacctcagatgtccctgggcactagcccatctgtatgtctttaaaaaaaataaattaaatt

SEQ ID NO: 43986 - DNA, 201 bp, Homo sapiens
tactacgcaaaagcaggaacatcatctgcttttgggtagttaagagttaagtatcactttgagctacaggatcatgattaaaaagcattctgttatcttayttcacaactctccacttttgtaaaagtttaggataccggcagggcagcaaatacctttaaatgattttatttaaatgtcagatttaattaaatccatgac

SEQ ID NO: 43987 - DNA, 201 bp, Homo sapiens
ggcataaaacgtgatttgactcccccttgcccatcacagttctggagttcacatatcatttgttactttgaaaaatgaacttttgttatttgattatggtrataaataatatacatggtagaaggagaagaaaatgaagaaaaatttagaaacttggacagaggaaaatgaaaatgttctattaattccactagcatgaga

SEQ ID NO: 43988 - DNA, 201 bp, Homo sapiens
ggctaccctgagctatgatcacaccacagcactccagcctggccaacatagtgagacactacctagatagcttaggagagttccaatgtttctgaaggatktttttttaaaagaagtattcatttaggtgacacatatttattgagacactaatatatgccaggaattattctattggttcctttggaggagacatgaata

SEQ ID NO: 43989 - DNA, 201 bp, Homo sapiens
gtgggcttttctttctcatttgctttcgcttagtattttccattattcatttggcttcttgaaccctccctatctgtaccccacacttactcttattcacycagaacaggtgtgtgccaccttggagaagatgaagccagagagaaaatcagtcagacaggaattatgttgaaaggtgactgaatacattaccacctccca

SEQ ID NO: 43990 - DNA, 201 bp, Homo sapiens
taacataataccatagactgggcaggttaaacagcagacctctattcctcacagtctagaggctgggaagtccaaggtgaagccatgggcacattctgtgsctgcctgaggctctctttctggttcccagatggatgcctttgtgtgtcctctcatggcagagagaggaaggggtctggaacctttctcttataaggatac

SEQ ID NO: 43991 - DNA, 201 bp, Homo sapiens
taagggttttttccatgtactggtttctctcctgcgtggtcttgttctacccttgaggagggtaccacttcctcattgcttagttgtcagtataaatgctyctttctcagagaggcccatcctgaccatctgtgtttttttcctatcaatgctttaacaaatgaccacccatgggtggcttacataccatgaatgtcttct

SEQ ID NO: 43992 - DNA, 201 bp, Homo sapiens
ttatccatgccatctgaaatcctccttcctttttaacaaggcaagtagaaaacgaaaacaacatcaaaggatacactacacaattgttggagccctaggamccgagagaagagtacaagcaggttcttgaactgttctctccccagcaactataactggaaggaacctcagtttgtccattcattcattcatcagagcagc

SEQ ID NO: 43993 - DNA, 201 bp, Homo sapiens
tgttaccagaatctatcaagctctttcctatctaagggttttttccatgtactggtttctctcctgcgtggtcttgttctacccttgaggagggtaccacytcctcattgcttagttgtcagtataaatgctcctttctcagagaggcccatcctgaccatctgtgtttttttcctatcaatgctttaacaaatgaccacc

SEQ ID NO: 43994 - DNA, 201 bp, Homo sapiens
tgcagtgagccaagatcgcaccactggactccggcctgggtggctgagaaagactcagtcttaaaaaacaaacaaacaaacaaacaaacaaacaaacaaacaaaaacttgtctccaaatgagcagacaccagaatctcatggagggatttttcgaacacgtagcacagggcttcgcccccagcatttttattttcgaactt

SEQ ID NO: 43995 - DNA, 201 bp, Homo sapiens
gaggttgcagtgagccgatgtcatatcactgcactctagcctgggcgacagagtgagactctgtctcagaaaaaaaaaaaaaaaaaaaaaaaaaaaaaaaaggctttcctgaaaggtgattcacaggcctcttcggatcccttcgtgtttagcaatttggatttccacacagccttgctgtgccttctgcccatttgtcct

SEQ ID NO: 43996 - DNA, 201 bp, Homo sapiens
caaagttacacaacggctgtaaaaaataaataaaaaaaaagcaaaattagcactttatcaagtttggggcatatttccaaggccaccagggagcagggaargtcaccaaaagaccgctccttgaaaccaggcaagaagccatctttgcagtgagctgagaggtctgatggccgccagctgagggagggaattccccttttg

SEQ ID NO: 43997 - DNA, 201 bp, Homo sapiens
ataaaatacaatgaatccacaaacagcttcttcttcattatgtaccccatacctattagaccatcataaaatataactatatgagtatcatagaaaagtttaaagctgtctctactctgttatgctaagatatattagtttcataaccactcaatatattcatagttaatttatcctttattttaaaaaaatgtcctgcag

SEQ ID NO: 43998 - DNA, 201 bp, Homo sapiens
gcagactcttcatactcaaagcagtaaaaaataaaataaaataaaatacaatgaatccacaaacagcttcttcttcattatgtaccccatacctattagascatcataaaatataactatatgagtatcatagaaaagtttaaagctgtctctactctgttatgctaagatatattagtttcataaccactcaatatattc

SEQ ID NO: 43999 - DNA, 201 bp, Homo sapiens
gtagtatatttgggcagactcttcatactcaaagcagtaaaaaataaaataaaataaaatacaatgaatccacaaacagcttcttcttcattatgtacccyatacctattagaccatcataaaatataactatatgagtatcatagaaaagtttaaagctgtctctactctgttatgctaagatatattagtttcataacc

SEQ ID NO: 44000 - DNA, 201 bp, Homo sapiens
taggtaaggacagtggtaccattctgacggactctcggatgcttggttttatggagggatcttaaaacagtaatcggcccatatgtgcagcaacctttgcrcctaaatagctgaggacaaagtaggttgcttacttcaagagcccttccctttctcttctttgtcaggcctgtaatgttcctcacccactgagtatttaat

SEQ ID NO: 44001 - DNA, 201 bp, Homo sapiens
gatccatggctccttttcggtcaccttccagccagcaacattgggctgactccttcaatggccatgtctctggttctttgtcttttgcctcctcctcttayttttaaggacccttgtcatttcattggtctcagctggatagctatcaagggtcactttaaggtcagctgactagcaaacctaattctatctgcaacctta

SEQ ID NO: 44002 - DNA, 201 bp, Homo sapiens
ggcaaagcgatctcagggtaaacactgcacaccagtaagtattcttggggcaaatgggaaaagggttaaaatgaccagatctccagagatctcactcactrtggtgaagacagcgccaagccatgagggctccgccccagtgattcaaatacctcccattacggacatgtttcaacatgagatttgagcggggacaaatat

SEQ ID NO: 44003 - DNA, 201 bp, Homo sapiens
atttcatggcaaagcgatctcagggtaaacactgcacaccagtaagtattcttggggcaaatgggaaaagggttaaaatgaccagatctccagagatctcmctcactgtggtgaagacagcgccaagccatgagggctccgccccagtgattcaaatacctcccattacggacatgtttcaacatgagatttgagcgggga

SEQ ID NO: 44004 - DNA, 201 bp, Homo sapiens
tttgtcaaatggggtcatagagggtgagaatcagagtttatgcagggcatagcactagtgtaatgctgggcagagagtgagcatccagcaagtggttttgrcaatgataataattataacccaagcgacacatacaatttaatcaggcactgtgtgtccacagcgatgtcaaggaacaatgcacaaagcagagtttttcca

SEQ ID NO: 44005 - DNA, 201 bp, Homo sapiens
gcccaaatctcagaagttggcgtttccttgcagatatcattggtggccattggaggggaaaaagatgctttggaaaccaggacacagagaaaagtgcctcrtattatacagagccaagagaggtcactgtggaagtacagaggaagccttggcctaattgcacggttaatacaattccgtaactcatcctgccaacacgaa

SEQ ID NO: 44006 - DNA, 201 bp, Homo sapiens
ttcccttccaccatgattgtaagtttcctgagacctccacagccatgccaaattgtgagtcagttaaatctctttgctgtataaattacccaggcttgcakatgtctttattagtggcatgagaacagactaatacagtcagggatgctgcagaacatctccaaacacacaggactcccaccctctacttccaccccacca

SEQ ID NO: 44007 - DNA, 201 bp, Homo sapiens
gtttttatatgcagtttgtatttatccatgccatctgaaatcctccttcctttttaacaaggcaagtagaaaacgaaaacaacatcaaaggatacactacmcaattgttggagccctaggaaccgagagaagagtacaagcaggttcttgaactgttctctccccagcaactataactggaaggaacctcagtttgtccat

SEQ ID NO: 44008 - DNA, 201 bp, Homo sapiens
tcctctgcaagggatggggtcataagacattggtgaggttaggccttcctttgtctcccaggagcacacttgatagcaatgtagggtgaattccaaatctstgagttagtgccatatatagcagtgttgtcagtaagatttctcactggcatctctgcttcccctcttgactctcttgaaatcccttcttcaggcagaagt

SEQ ID NO: 44009 - DNA, 201 bp, Homo sapiens
tgcttctctaccggggcaaattttcccccaagggataattgataatgtctgaggcatttttaattgtcacaacttggggaaggggcaagggattgagggakagtgctcctggcatctggtgggtaggggttagtgatagggttcggctgtgtccccacccaaatctcatcttgagttgtagttctcataatccccacgtgt

SEQ ID NO: 44010 - DNA, 201 bp, Homo sapiens
tgacaaatcctactttttcaggtcctgatgcactaagtctcattcacttctttctatttttcctctctctattgcatattaacccaccatattgagagaayagaaacttttgccttcattatatcacctttacaccccaggacaggtgccctcctcagcggagacaactgtccccctccatcctgcaggagttttgcagcc

SEQ ID NO: 44011 - DNA, 201 bp, Homo sapiens
caccactgctcgcattcccatgttggagttttccctttggggttcttatgccattttaaagactctgaaaacaggaagactttttctcttgggtatttttwtttttttttcctctgcaagggatggggtcataagacattggtgaggttaggccttcctttgtctcccaggagcacacttgatagcaatgtagggtgaatt

SEQ ID NO: 44012 - DNA, 201 bp, Homo sapiens
aattcacgagatcattcatgatgagtcactatatcagttactttaaaaaaaaaaaaaaagatcctgacaaatcctactttttcaggtcctgatgcactaastctcattcacttctttctatttttcctctctctattgcatattaacccaccatattgagagaatagaaacttttgccttcattatatcacctttacaccc

SEQ ID NO: 44013 - DNA, 201 bp, Homo sapiens
ttatcttacaagaggcatatttaggagatgtttccgttctattttatctgcagaattactttccattctcaggtcttttatataagtattcccttgaaccygttccaaaaactggatttttaacccaatagaccataactgcagtgttttattgtgcttacatatttcaaaatgtgaatgtaagtagatttagcaaagtta

SEQ ID NO: 44014 - DNA, 201 bp, Homo sapiens
ccaccctcagccagggcaggagtattccctaatggtagagtcaagtgtttggtttggtcttgtttctaatgactcaagtgatgaggcctggggacgtcccytgggaagctattctgcagcctaataactttcattctgtgatttttttttgtatgtgtctaatattcagagtctgacacaataaggccataaagagctaag

SEQ ID NO: 44015 - DNA, 201 bp, Homo sapiens
tattccagcaattttttttttttagctctctttgtctggaactttgcaaaataaacaccatggtcactccgtgctttgtgagtgacgtgctagaatggaayttcactgttttaaattcagggttaatttcttgctttcaaatgaattatgaaaggaagaggagagacctttggaaaagtctgaatgttgatgccgacgact

SEQ ID NO: 44016 - DNA, 201 bp, Homo sapiens
tcctcaggattattttttctctgtgctgttcactgtaacatcgtccaccctctgagatcttgcttttcagtctactggtatctccacttctctctgcagcrtgatgtctagtcagagtttccattctgtttttatgaccctgggaggactgggacagatctgtgaggtcatcttgtccaccctcagccagggcaggagtat

SEQ ID NO: 44017 - DNA, 201 bp, Homo sapiens
taggaacactcatagtatgtatcagaaactagtgaacacatgttgttttacagctctgtctgcaaaattgcatcgtgggcctctttggggagtgttctcartgtgatttttattctggggtgtcctttggccacaatcctcaggattattttttctctgtgctgttcactgtaacatcgtccaccctctgagatcttgctt

SEQ ID NO: 44018 - DNA, 201 bp, Homo sapiens
gatttattcattcttctccctcacaattttggctcgcacatgcttcctttttagctcatgaccgtgcaattcaactcaacctcatggcatctttttatcarctgtccctgctgcaacaggcttagagttggtttcccaattccctagcgcagaaatccactggcatgagtcatctttcccattggtagattgcagagcaaa

SEQ ID NO: 44019 - DNA, 201 bp, Homo sapiens
cttacaatccgttgcagaaagcctagctccccagcttctcctgaatctacgtttttctattttgtctgaactagccaaggtctctggagtttgctgttatmttgcttcagagaaattagtgacattgaaaggctgttgtcttttttagtgtacttttggttgttaggagaaatttacaaggccatttttttctcccgtctc

SEQ ID NO: 44020 - DNA, 201 bp, Homo sapiens
atacccccgacttcctttcctacgaataaagaggcccaactttttgtccatatgaagaggttggcagagcaaacgcacacgtgcgtaggagctggaattgkcgataatgtcacaatctcaggaaacccaactttgtaaatgtgactttcctttgctactttttgcctattaagcagccatgtatgtaaagtattaaattag

SEQ ID NO: 44021 - DNA, 201 bp, Homo sapiens
gctcactgcaaactacccccgcccccgggttcaagcaattgtcgcacctcagcctcccaagtaactgggattacaggtgcccaccaccaagcccggctaakttttctattttcaatagagatgaggttttgccatattggtcaggctggtcttgaactcttgacctcaggtgattcacccacctcagcctcccaaagtgca

SEQ ID NO: 44022 - DNA, 201 bp, Homo sapiens
acgagctgccacgcctcacctcttgttttcaataccattgataagttgtggtcttcagggacttgtgggcattttcaagttaaatatccaacagtcgtgayttagggcatgaagagctcactcatcaagatgtatgtaattcagattttctgagtgtttaattcggcgtctttggtcacaaggaacagagttttacttgtg

SEQ ID NO: 44023 - DNA, 201 bp, Homo sapiens
aagaaatggagcaagggaggggtttcatcccgccgtgttcatttgcttggctgtcctgaaattgcgaatacgcagttgttacctgctcccggtgggagggrggggatatttatttggcatcttgcaattgataggagctgagtgattttagtaggtagtttaactccttaaaaacttccagtggtttcatattctacctag

SEQ ID NO: 44024 - DNA, 201 bp, Homo sapiens
tgaaacgccttacataaactgaccaggaatctggggcattcgcgttagagacaattttcttctcctcaagataagggatggggaattagtcatagggtatytccagataatgtagttaacacctcgtgtaatattaggtgggcagggagctctgctctcaggaccaaaattgctcctgccagctctaatagggaatgtgtg

SEQ ID NO: 44025 - DNA, 201 bp, Homo sapiens
aagtctcgctttgttgcctaggctggtcttgaactcctgggttcacgtgatcctcctgcctcggcttcccaaagtgctgggattacaggcacgagctgccrcgcctcacctcttgttttcaataccattgataagttgtggtcttcagggacttgtgggcattttcaagttaaatatccaacagtcgtgatttagggcatg

SEQ ID NO: 44026 - DNA, 201 bp, Homo sapiens
aaaggtatttctccccttcacggtaatttggagccaatacttcttgcaccattcatttgtccacagcatgggacaaaggataatgccttaatgcctgctgmaaatagaacagtggtgcttagcagctttagataatgcattgtaggtgttttgcaaaaacatactttcgtgactaaacatcataagctccaagtgagtgat

SEQ ID NO: 44027 - DNA, 201 bp, Homo sapiens
agcaagatcccaaccctattaaaaaattaaaaatgaaaataaaattttaaagaaaggtatttctccccttcacggtaatttggagccaatacttcttgcamcattcatttgtccacagcatgggacaaaggataatgccttaatgcctgctgcaaatagaacagtggtgcttagcagctttagataatgcattgtaggtgt

SEQ ID NO: 44028 - DNA, 201 bp, Homo sapiens
aatagtttaagtagagccactgaaagatggctcacacctttcagctcagtttttttgtaccagtgaggatgaatgtttctgcatgtgggtagttggcaccrgtcttcaatgaattatttttcctttagccgggtctggtggtggcgtgtacctgtaatcccagctacacagaaggctgaggcaggaggataccacgagccc

SEQ ID NO: 44029 - DNA, 201 bp, Homo sapiens
tctatttaaactagtaaacttaatagtttaaaatacttggtagtttaatagtttaagtagagccactgaaagatggctcacacctttcagctcagtttttwtgtaccagtgaggatgaatgtttctgcatgtgggtagttggcaccagtcttcaatgaattatttttcctttagccgggtctggtggtggcgtgtacctgt

SEQ ID NO: 44030 - DNA, 201 bp, Homo sapiens
tcttctatttaaactagtaaacttaatagtttaaaatacttggtagtttaatagtttaagtagagccactgaaagatggctcacacctttcagctcagttkttttgtaccagtgaggatgaatgtttctgcatgtgggtagttggcaccagtcttcaatgaattatttttcctttagccgggtctggtggtggcgtgtacc

SEQ ID NO: 44031 - DNA, 201 bp, Homo sapiens
aaaattcaaaaaattgcaacctgaggcataaatgggttttaagctccatacagtaaaacctagcatatgaaaacagttctggctgatgggttggtagaagkgatagatatagatacatatatacacatatatgcacagtaatagatataggtaaagaccttgatatatgtacatatattgtatgatacatatccatgcata

SEQ ID NO: 44032 - DNA, 201 bp, Homo sapiens
actttggaggctgaggcaggagaatcacttgaacccgagaggcggagattgcattgagccgagatcatgccacagcctgggcaacagagcaagactgtctsataaataaataaataaataagctggacgtggtggcatgtgcctatggtcccagctacttgggaggctgaggtgggaggatggcttgagcccagaggtaga

SEQ ID NO: 44033 - DNA, 201 bp, Homo sapiens
ctcaggatgaggatgttcaatttgtactgctggtggagctgcctttccattaagtgagtctttctccaagggaacagaagtcttaggttgttgatctggckgtcagaacctaggacaggcaaggcagtgggctgttgtagaggagatgaagctgatcagagcacacccacaccagtgacaaccggtcaggacctgggaagg

SEQ ID NO: 44034 - DNA, 201 bp, Homo sapiens
taaagcatttgggcactgcctggcacataggatatgtccagaaaacactagctggtattaaaacagaggaaacatgggaactgagggtggtcagtgacatsacattgtatttcctttatggtgtccttctgagtacagaaccaaacatttcttaggcgtacaatttcctgcctccaaattaatgttatttctaaaaagtag

SEQ ID NO: 44035 - DNA, 201 bp, Homo sapiens
ccttactgttgaagacttgtggaaaagggacatggcccagggaaccagagtggtttgggaaagcactttgtcaagaggcttggggaccccagggtggaagytgccatgcgcatgaggctgtgttagcagaggcagtggcagaagaagacattgcaaacctgcaaaagcaacctctgaggatgggtagacatatacttcatt

SEQ ID NO: 44036 - DNA, 201 bp, Homo sapiens
gttctgtggtcagttactcattagcagcctctgctctaggaggaatagttatgggtcctttcagacatgcaacccccaaaactccatgttgtttacagtgygggacacctgactttcaccttttatgatacctgcctggggcatgcatgtggtgactttttccatctctggtctctatcttatctcttgtgatgaactcag

SEQ ID NO: 44037 - DNA, 201 bp, Homo sapiens
cttgtgatggtttagcttatttagtacaacaaccctgccccttctagtttttatgataacctcattaattgccggtactctcagagccctgattttcttayctataaagtagagattccctatctcatttggaggtgattttaaggcacaaatgagacagtgtatgtaaagcatttggcatagtgcctgattcagagtaag

SEQ ID NO: 44038 - DNA, 201 bp, Homo sapiens
cttttgctcccttttctccccactcttgactcttctctagtttttatatgcagtttgtatttatccatgccatctgaaatcctccttcctttttaacaagrcaagtagaaaacgaaaacaacatcaaaggatacactacacaattgttggagccctaggaaccgagagaagagtacaagcaggttcttgaactgttctctc

SEQ ID NO: 44039 - DNA, 201 bp, Homo sapiens
cacctggctaatttttgtatttttagtagagacggggtttcaccatgttggccaggatggtctcgatctcttgaccttgtgatccgcctgccttggcttcycacagtgctgtgattacaggcgtgagccaccacgcccggcctctttgcacattatttaagggtgttttaacaaaatggcaatttccccaggctggcttgt

SEQ ID NO: 44040 - DNA, 201 bp, Homo sapiens
agagagtattttgtaacctgtgacgctcttttcaagtcttagagaggaagtatggaaagagcatgcgcttttgactgaggaggtcttgggtttaaaggtcraattttgccacttactttctccatggccttggtcaacatcctgaagtctcaggtccttgtctgcctttgctttgacacgagatgttgcctgcctcaggcg

SEQ ID NO: 44041 - DNA, 201 bp, Homo sapiens
ttttttgaggtggaatctccttctgtctcccaggctggaatgcagtggcattttctcggctcactgcagcctccgcctcccaagttcaagccattctccartctcagcctcctcagtggctgggattacaggcatgtgctactacccccggcaaacttttatatttttagtagagacagagttttgccatgttcaccaggc

SEQ ID NO: 44042 - DNA, 201 bp, Homo sapiens
tccttctgtctcccaggctggaatgcagtggcattttctcggctcactgcagcctccgcctcccaagttcaagccattctccagtctcagcctcctcagtrgctgggattacaggcatgtgctactacccccggcaaacttttatatttttagtagagacagagttttgccatgttcaccaggctggacatgaacttctga

SEQ ID NO: 44043 - DNA, 201 bp, Homo sapiens
tggcattttctcggctcactgcagcctccgcctcccaagttcaagccattctccagtctcagcctcctcagtggctgggattacaggcatgtgctactacmcccggcaaacttttatatttttagtagagacagagttttgccatgttcaccaggctggacatgaacttctgacctcaagggatccacctaccttggcctc

SEQ ID NO: 44044 - DNA, 201 bp, Homo sapiens
ggaacatgtgctctgtgtgctggaagctcctggaggccccagggttatctctgctcacttaggtttgtgatgttgggcaaaaggagaaaatgctgagtctrttcggacccaacttccattaatgcctgagaaataatttaaatcgcaagatttccaatcccataagcagccctagcctctcttctcctgatactccacata

SEQ ID NO: 44045 - DNA, 201 bp, Homo sapiens
ttaatatttatcattgactaataatggtagagaaagtaatcatcataacctctgccctttattagtcactcatggtgtcacaagccctttacaaagcactktgcatgcaaatgattcctcataacaaccttgggaggtagttactttcattgtattagctatctcttgctgtgtaagaaattaccacaaatttagtatatt

SEQ ID NO: 44046 - DNA, 201 bp, Homo sapiens
gcctgcagacactcagatttcaaacctctggcttcctgaactgtgaaagaataaattgctgttgggccaggtacagtggctcatgcctgtaatcccagcastttgggaggctgaggcaggtggatcacttcaacccaggagttcgagaccagcctgggcaacaaggcgagaccccgtctctacaaaaaataccaaaaaatg

SEQ ID NO: 44047 - DNA, 201 bp, Homo sapiens
cctctgtttctgtttcaactgcagagcctatttttctttcccttccagctcagctgccttctcctccctgacctcaggtcacccaagactcccactttatkatttccttttacttttagttcattattctctgtgattcagtggaaacataaaaaatggtttttaattttaattaatggcaaacttagaacagacccattt

SEQ ID NO: 44048 - DNA, 201 bp, Homo sapiens
agagatgtgaatgtgatcgtactggtttagggtgggccctacatccaataagaatgtccttagcagagacagaacagagacaccgagagaggaaggtgatkccaagacagaagtaaagattggagtggtgccatctaccagccaaggaatgccaaggctgtggctacaccagaagctggaacagagcctgcaagcatttct

SEQ ID NO: 44049 - DNA, 201 bp, Homo sapiens
tctgcatggcacagcacatggacatgattcatacatgcaagtgaatgagtgaatgggcgatttccagactatccagaaactgtgccccatagtcctacccrtaggaatccaacagggaactgtcaccaccgacccgaggcaggaaccatgtgctctgagccctggccattttgtgtagatggagataaattgtcattgcta

SEQ ID NO: 44050 - DNA, 201 bp, Homo sapiens
ccactttctggctattatgaataatactgcgatatgaacatctggttacttctggctcttatgggtaacacttctataagcgttgccacaggttgcttctratttctattatgagtaatgctgctatgaacattcatatacaagttttagggcagacttctattttcattccaatatctctttatggcatgtcttagcagt

SEQ ID NO: 44051 - DNA, 201 bp, Homo sapiens
tccattaataaaaggatggaccatgaactcccttttatgatatgagccgatcaaatgtgagcagaatagtatcctatttatacaatgtagtttaaaaccarcttcttagaaccatgagctaagggggaatctggatttcaaatgctagttgcatcaaacacgtttccaccccctcaaaacgtggcccaaagtcattagtgt

SEQ ID NO: 44052 - DNA, 201 bp, Homo sapiens
tttttaaaaaacataaaacaacatacattcatcattttgctttctttggatgaagaattgagcctggttcagcatctcttgcaggctgtaattgagggtgrtcattgactggggctggattcgggaaggatccacttccaagctgcacagttgttggcaagatgtagtgttttggtggttcctgggctctgggactcagct

SEQ ID NO: 44053 - DNA, 201 bp, Homo sapiens
ttttgaatactgggctcaagtgattatcctgccttagcctcccaaagtgctggaatttcagaggtgagccactgtgcccagcctcctgttttttttacatrtatatatatatatatatatatatatatatatatatatatatatatacacacacacacacacacatatatatatacacacacacatatatatatacacaca

SEQ ID NO: 44054 - DNA, 201 bp, Homo sapiens
ttcaagaaaacctcactgagcacctaccatgtaggtgctcatcccgataccactatcaggccctttggaccagttgcaaggatgcaggatgaggaaggcartgtgagaaaacagaaggagcaccaggcagtcgtgggcttgatttttattttactattttttaaaaaacataaaacaacatacattcatcattttgctttc

SEQ ID NO: 44055 - DNA, 201 bp, Homo sapiens
ggtgatcctgctgcttggcagcatcttcccagcgtacaacagaggaaaactgcctgttgtagttaaaaaaaaaaagagagagagagagagagactgatacmcaaagagaatcagaaaggagtagagatgaaacaaagatagagctagcatgattgcaagctgaggacatacgaggagtccctgggtcagctgggccataca

SEQ ID NO: 44056 - DNA, 201 bp, Homo sapiens
atgtggagaaaacagtattggaaattattactcagttcaagaaaacctcactgagcacctaccatgtaggtgctcatcccgataccactatcaggcccttkggaccagttgcaaggatgcaggatgaggaaggcaatgtgagaaaacagaaggagcaccaggcagtcgtgggcttgatttttattttactattttttaaaa

SEQ ID NO: 44057 - DNA, 201 bp, Homo sapiens
taatacaaaagttttccccataccaactagtagtgtaagttgatttcatatccttttatttcataaagttttgcttatcgggtttgtcatcctctatttgmaattaaaatgtgtggtctcgagatgaccttaaagtatctgacccccaaatctaatcactcctagcatctgtgaaaattgacaaatatgtcaggtataact

SEQ ID NO: 44058 - DNA, 201 bp, Homo sapiens
cttggccaaatatccgagtgtggaagctctcactgtgaacctgctaacatacatttcagtgtctacaaaatgtcttttgagagaaaacagcagggacattygtgagctcttttttttttctaaccactttcccagtgagacttcagttttcattctccccttagcagctttcaaatatgtacgtaacacaaatgttacatg

SEQ ID NO: 44059 - DNA, 201 bp, Homo sapiens
agttgcagatatggatagccttttcaaaaaatgcatgcaactgagactattggctatgttttgtttattacctactttttccatttaatagtatcttggasattatttggtaccagcacatgtagctcaacctcctaatactgcatgacggataatatgccatcacatggtgtcatttaatatattcattcctatttatag

SEQ ID NO: 44060 - DNA, 201 bp, Homo sapiens
atttctttatcgtaagcacacttctctacattacctttataatccaacaactctgctattagtaaattatagaaacaacttttgtaacactatcttgtttscagagtatatgaaaaatttgaagttaaaattcagctccacgaatactgcagtggtgagaaaatggcgacaaagattagtcttctgtgagaagtctgctaa

SEQ ID NO: 44061 - DNA, 201 bp, Homo sapiens
ttaagttttttataggagtcattaatctccctcagcctcagtttccctatctgtgaagtgagtctaaccaggatgataatgaagagttaggtcaagtgagrttggcagccagacacccaccaccagctgtaacataagaacagatgttctctccagacccccaggtcagctgaggtcgctctgcttggaataatgaactgc

SEQ ID NO: 44062 - DNA, 201 bp, Homo sapiens
tatacaatgtcagtgctctgagctcattaggcgtcatctgagacagtggctgtaggggaggggaggtaggctctgagtcaagcagacctggaattttcttyatgggccattaggaactgtgtgacgctggggcatctgacttcacctttctgagtcttagtttccttacctgttgaataggtctaatgatatcattatggc

SEQ ID NO: 44063 - DNA, 201 bp, Homo sapiens
gagaacttctgatcaaaaatgccagataagaaaaaaaaacctttcgagacatcatttgaatcaattatcaaatgtttccaaagtgcacttgctttgcaaascactgtactactcatctctgcctccatcggagcgagttcaggagagttgtgtttacttttctaaaggagccttttccttcccattttaccagtgcccaaa

SEQ ID NO: 44064 - DNA, 201 bp, Homo sapiens
gtgttattacagggtagaaattcacctatgtcaagtaggcattataccaggtaacaatctcaagactcagcagggaaggatccacttgcaagcccacgtgsttgctggtaggactcagttccttatggcccagtggattgaaggcttcctttcctgcctggtgtttggttccttgccacgtagggatctccatcatggctg

SEQ ID NO: 44065 - DNA, 201 bp, Homo sapiens
gtgcatcttaaaatccacaatgcacagcctggggagaagccttggttttgccagggggaaaaaaagaaaaacacaacattgagtgaggtctagggtgaatrccaaaggtctgttttgaaatgggggtgtgggttattcttctctctttctgatttgcttcagtacagtatgggatggggaagaatcaaaattattatgtca

SEQ ID NO: 44066 - DNA, 201 bp, Homo sapiens
accccagctctgtattcgagcgtggttatctttgtgcatcttaaaatccacaatgcacagcctggggagaagccttggttttgccagggggaaaaaaagaraaacacaacattgagtgaggtctagggtgaatgccaaaggtctgttttgaaatgggggtgtgggttattcttctctctttctgatttgcttcagtacagt

SEQ ID NO: 44067 - DNA, 201 bp, Homo sapiens
ttggtgggaggtgtgcaggacacagctgaaacctttggtgtatagtggatactaaagcaatgctagtcttcttcgtgtgctaccagttagaatgaattttrctgacatcttactggtttctgagggtatacagacacttattgtcaaagatattattgattatctgatccccaaacatatggagttacatcacagcaggtg

SEQ ID NO: 44068 - DNA, 201 bp, Homo sapiens
gaaaatccttggggagccgccatcattccttccacgaaggaatgaaattataacgtaatgtattgttggagcccttagttcaacactgtcttttttcaggycatattaatgcaatggttagcatatcaacttccttctgtttttagtgactctaatacattatattcaccttgttctctgcatgttctttctttaagtcat

SEQ ID NO: 44069 - DNA, 201 bp, Homo sapiens
gggagccgccatcattccttccacgaaggaatgaaattataacgtaatgtattgttggagcccttagttcaacactgtcttttttcaggtcatattaatgsaatggttagcatatcaacttccttctgtttttagtgactctaatacattatattcaccttgttctctgcatgttctttctttaagtcatgttagatccct

SEQ ID NO: 44070 - DNA, 201 bp, Homo sapiens
tgaagtacaggcatatcccacagaatctcttaataccaggccaaaagtaactttatcttgatctgtagttcggacatatttcttggattgtccgcactcawaaaaagagattgcgtaacaccctttgaacaaatggatatttgagaaccatcctgtcttcagatttagattttttcaatttttttttactgtcatatgatt

SEQ ID NO: 44071 - DNA, 201 bp, Homo sapiens
caggactgaagagatgatattgattctcacttgatagaggttagaaagggcctctcccttccctagctgaatagagagggtttcctttttcttttcttttytttttttttttttaaatgggaaacttacagggaataagatctgtttcttcatttgctttgcaagagagttggatttgtacacgatgcctgagctggctcg

SEQ ID NO: 44072 - DNA, 201 bp, Homo sapiens
ttgctcagttacttttttcctgtttttttttcacttttgtcttcctgacttttttcttccatccctatttatgaaaacaaaaagataactaaattgaaacsttgacaatgtaatttgtcagaggaaggcagcctgttttataagctcaggtgatttcatttttgttcacctgtttatttcatgacacttgcaggaaaaaga

SEQ ID NO: 44073 - DNA, 201 bp, Homo sapiens
aggcaaacaaaagaagccacaacagtctaggaagaaatctttaatttctattcagctttaaagagtttgagagcgttttttcccctctgttaacaaacgasttcaagtacatgccttcatattataaaagtacctgaaattgcctagaatagcagcatgcatagcttgttagtatttacatatatttacatagggaaacaa

SEQ ID NO: 44074 - DNA, 201 bp, Homo sapiens
gcctatcatataggaatgatagaggcagcacagtgctgtaatggaaaccataagggcacgcacaatggctcatgcctgtaatcccagcactttgggaggcmgaggcgggaggatcacataagaccaggagtttgagaccagcctggccaacatggtgaaaccccatctctactaaaactacaaaaatagccaggtgtcctg

SEQ ID NO: 44075 - DNA, 201 bp, Homo sapiens
cataagaccaggagtttgagaccagcctggccaacatggtgaaaccccatctctactaaaactacaaaaatagccaggtgtcctggtgcatgtctgtaatyccagctacctgggaggctgaagcatcagaatcgcttcagcttgggagctggagcttgcagccagccaagatcacaccactgctctctatcctgggagaca

SEQ ID NO: 44076 - DNA, 201 bp, Homo sapiens
tatttattgagacactaatatatgccaggaattattctattggttcctttggaggagacatgaataaaggcatggatgtgactgaggaggtaaaggtgaasaattggggaggggtggatggggctgactcatgacctaaagaacatggcatctggggctctcttgaaataatctgcactaaccactcattcacattttttt

SEQ ID NO: 44077 - DNA, 201 bp, Homo sapiens
cttgaacccgggaggtggaggttgcagcgagtcaaggtcacgccagtgtactccagcctcggtgacagagcgagactccgtctcaaaaaaaaaaaaaaaargaaaaagaaaaagaaaaaggtgtttggaagccatgtcccatgaattccaaatacaattgaggactctataaaggactataaaaaaagttgtaataaatta

SEQ ID NO: 44078 - DNA, 201 bp, Homo sapiens
caggattttgaggctaccctgagctatgatcacaccacagcactccagcctggccaacatagtgagacactacctagatagcttaggagagttccaatgtktctgaaggatgtttttttaaaagaagtattcatttaggtgacacatatttattgagacactaatatatgccaggaattattctattggttcctttggagg

SEQ ID NO: 44079 - DNA, 201 bp, Homo sapiens
atatggtgaaacctgtcactactaaaaatccaaaaattagctgggcgtggtggtgagcacctgtaatcccagctactcgggagcctgaggcaggagaatcrcttgaacccgggaggtggaggttgcagcgagtcaaggtcacgccagtgtactccagcctcggtgacagagcgagactccgtctcaaaaaaaaaaaaaaaa

SEQ ID NO: 44080 - DNA, 201 bp, Homo sapiens
aatatggtgaaacctgtcactactaaaaatccaaaaattagctgggcgtggtggtgagcacctgtaatcccagctactcgggagcctgaggcaggagaatyacttgaacccgggaggtggaggttgcagcgagtcaaggtcacgccagtgtactccagcctcggtgacagagcgagactccgtctcaaaaaaaaaaaaaaa

SEQ ID NO: 44081 - DNA, 201 bp, Homo sapiens
cctctttaaggataagactttctgatttttcaactggatttaccattgtggcatctgcacatgagcagactgactgctttttggccctacctggagcctgrgtcctcaggtagctgacccgagagaccgtggagctgcttgtgatatacaatgtcagtgctctgagctcattaggcgtcatctgagacagtggctgtaggg

SEQ ID NO: 44082 - DNA, 201 bp, Homo sapiens
cctggccaatatggtgaaacctgtcactactaaaaatccaaaaattagctgggcgtggtggtgagcacctgtaatcccagctactcgggagcctgaggcargagaatcacttgaacccgggaggtggaggttgcagcgagtcaaggtcacgccagtgtactccagcctcggtgacagagcgagactccgtctcaaaaaaaa

SEQ ID NO: 44083 - DNA, 201 bp, Homo sapiens
gatgggtctttgtttagaggaagctctttatcctggtacgctggaagttggcatagtcttagcagttagtccagatgtgaatttcaggattattctgtgartcttccaagtcctgtctcagcagtgaaataggctcagtgtagcttatgtctaggtggctgagttcattttctagtctaggtaaagggcacctcctgtaat

SEQ ID NO: 44084 - DNA, 201 bp, Homo sapiens
cgagaccatcctggccaatatggtgaaacctgtcactactaaaaatccaaaaattagctgggcgtggtggtgagcacctgtaatcccagctactcgggagmctgaggcaggagaatcacttgaacccgggaggtggaggttgcagcgagtcaaggtcacgccagtgtactccagcctcggtgacagagcgagactccgtct

SEQ ID NO: 44085 - DNA, 201 bp, Homo sapiens
atcgagaccatcctggccaatatggtgaaacctgtcactactaaaaatccaaaaattagctgggcgtggtggtgagcacctgtaatcccagctactcgggwgcctgaggcaggagaatcacttgaacccgggaggtggaggttgcagcgagtcaaggtcacgccagtgtactccagcctcggtgacagagcgagactccgt

SEQ ID NO: 44086 - DNA, 201 bp, Homo sapiens
tgggcagatcacgaggtcaagagatcgagaccatcctggccaatatggtgaaacctgtcactactaaaaatccaaaaattagctgggcgtggtggtgagcmcctgtaatcccagctactcgggagcctgaggcaggagaatcacttgaacccgggaggtggaggttgcagcgagtcaaggtcacgccagtgtactccagcc

SEQ ID NO: 44087 - DNA, 201 bp, Homo sapiens
ctcaagcgatcttcccacctctgccacttgaatagctgggactacaggtgggtaccaccatacccagctgttgaaaaaaaaatggtggggtattactctgktgcccaggctggtgttgaactcctggcctcaagcgatcctcctgcctcggcctcccaaagtgctgggattacaggcttgagctacttccccaggctcttc

SEQ ID NO: 44088 - DNA, 201 bp, Homo sapiens
ttggccattgcccactaagaaaatttaggtggtttttattgggattagtggatgaacttaggattagtgtggcccttccttgagatataatgacaaccttsgtgaaagcaagaccacagggcctatcttcagggaagtgccttgcattttaataccaaccatgccacgtgtatgtgtttcctgggcctgccataacaaatt

SEQ ID NO: 44089 - DNA, 201 bp, Homo sapiens
ttcgtcctgaaatcctccctgctcacaaaacagccagctacttggttttctaaaagacgtaattttgcaggcagacttcgtagagccattctgtgcagaasaagggaagggagaagctgtttgttttacctgtagtatgaagatattctttgcgctgttagaactgagctcattaattctgcctggcaataatttcaaagg

SEQ ID NO: 44090 - DNA, 201 bp, Homo sapiens
tttttcttttttttttttttttttttgagatggagtcttgttcttatgccgaggctggagtgaagtggcaccatctctgctcactacaacatctgcccccygggttcaagcgattctcctgcctcagcctctcgagtagctgggattctgggtgccccccgcaaccatgtcccacgaatttttgtattgttagtagagttg

SEQ ID NO: 44091 - DNA, 201 bp, Homo sapiens
ggaaaatgtgatatgacagactggaaccagcacagggacgcagcccctcacctgctgggggtctttgggtgggtcctgtagccccagagcctctcgatgasctatgaacaggaacagaaccagcaccccgagtggtgacagtgacaaaagggtcctcagtaacagcagtctgctattgttttgaatcattcaaaggaattt

SEQ ID NO: 44092 - DNA, 201 bp, Homo sapiens
caatttcctcatgatactggaaggcagtctccggtcagcacggggctgggtctagagttttcagtttacaaaagtggaaaatgtgatatgacagactggawccagcacagggacgcagcccctcacctgctgggggtctttgggtgggtcctgtagccccagagcctctcgatgagctatgaacaggaacagaaccagcac

SEQ ID NO: 44093 - DNA, 201 bp, Homo sapiens
gcgctgttagaactgagctcattaattctgcctggcaataatttcaaaggtttattttggtgtagatggcgaatacagatgcatacatttatacgcagtayacgagctagctataaccataacagaggttaaagaagtagagtaaaaatgtaaaatgtttcaaataaacacacactaaatatcttcttttatatcttataa

SEQ ID NO: 44094 - DNA, 201 bp, Homo sapiens
ggggtcagggggagggtgcacctgtccgccaccccaatttcctcatgatactggaaggcagtctccggtcagcacggggctgggtctagagttttcagttyacaaaagtggaaaatgtgatatgacagactggaaccagcacagggacgcagcccctcacctgctgggggtctttgggtgggtcctgtagccccagagcct

SEQ ID NO: 44095 - DNA, 201 bp, Homo sapiens
acctacagaaaaaaatgccaagaatgcacgctgggaattcattaagagatttcaggacgttgaaatactgtgcgtacttgcaatccccacttgaccaaagstgtccaaacctcgacagacagcggccagagaaggccccatcatagactctgcgcctggctaattactcaggagcaaagcaggtcgttaggggtcaggggg

SEQ ID NO: 44096 - DNA, 201 bp, Homo sapiens
tgattacaggcgtgagccaccacgcccggcctctttgcacattatttaagggtgttttaacaaaatggcaatttccccaggctggcttgtgtattaccttygcattgcatcccttggctcccatgagtgagcgtggtgacttggtgcgtaggtggtacgtgaagacagttgctcactacccaagaactcagggccctaaac

SEQ ID NO: 44097 - DNA, 201 bp, Homo sapiens
ttggagacctacagaaaaaaatgccaagaatgcacgctgggaattcattaagagatttcaggacgttgaaatactgtgcgtacttgcaatccccacttgascaaaggtgtccaaacctcgacagacagcggccagagaaggccccatcatagactctgcgcctggctaattactcaggagcaaagcaggtcgttaggggtc

SEQ ID NO: 44098 - DNA, 201 bp, Homo sapiens
tgagtccttttcagagagtcatttggagacctacagaaaaaaatgccaagaatgcacgctgggaattcattaagagatttcaggacgttgaaatactgtgygtacttgcaatccccacttgaccaaaggtgtccaaacctcgacagacagcggccagagaaggccccatcatagactctgcgcctggctaattactcagga

SEQ ID NO: 44099 - DNA, 201 bp, Homo sapiens
tgtgctgacaactataaattgatggctagcagttatcaaatgaatgttgatgaaaagcagctacttaacattttcatcccaacaccgagttttggaaggayggataatttagatctgagggcctcaactataaataaacagcaactgctttctaaatcccacctttctgtagttgaagattgtgctgcaaatctgacagat

SEQ ID NO: 44100 - DNA, 201 bp, Homo sapiens
atcaaagttgaaagaattttacagcgaaccaccattaacattttgctataatggctttatcatatatccattcatccgtctatcatatttgtaaaacaaayaatattttaatgccaaacatatacaaaggatagatcagtaatttccgagaaatattagttgacaacttgacatcaaattatgtacggttaagtattgata

SEQ ID NO: 44101 - DNA, 201 bp, Homo sapiens
gactggtgtgcagtggcacgatcacagctcactatggcctcagccaccagggttcaagtgatccttccactcagcctcctgagtagttgggactacatgcstgcaccatcatgcctggctaatttttatttttgtagagacgaggtctccttgtgttgtccaggctggtctcaaacttctggaatcaagtgatcctcctgc

SEQ ID NO: 44102 - DNA, 201 bp, Homo sapiens
gatcttggctcactgcaaactccacctcccaggttcaagggattctcctgcctcagtctcccaagtagctgagattacaggcgcccaccaccaagcccagstaatttttttggttttttttgtattttagtagagacgggatttcaccatgttggccaggctggtctcaaactctggacctcaaatgatccaaccgcctcg

SEQ ID NO: 44103 - DNA, 201 bp, Homo sapiens
gttctttaaattcttctctaaaccccaaggctaagcaatatacaatctagttacaatggtctgcttgctgttaccagaatctatcaagctctttcctatckaagggttttttccatgtactggtttctctcctgcgtggtcttgttctacccttgaggagggtaccacttcctcattgcttagttgtcagtataaatgctc

SEQ ID NO: 44104 - DNA, 201 bp, Homo sapiens
tcatgtttattatcttattttcagtttcaaaagggcatatcctgccccctttcccaagatcagaggataaggaatgtcttgatgttctcagtcgtaaaatyaggctaataacacctcccatggttgtctgtgaggacaacagaaagtaatgttttctctgaaaagtttaaaagggtaaatggcttcatcacatggtgatga

SEQ ID NO: 44105 - DNA, 201 bp, Homo sapiens
tgaggcaggagaatcatttgaacccaggaggcggaggttgcagtgagccaagattgcgccactgcactccagcctgggtgacagagcaagactctgtgttwaaaaaaaaaaaaaaaaagttctaaatcagtggattctgccgataaacatcatctggacggaatgaagctgagggccaatagtttagaggctcagcacccg

SEQ ID NO: 44106 - DNA, 201 bp, Homo sapiens
tctcagttaatgcccacaaatttctgaactttgaacataaataccctcactgcaatacatgtttttctttctctctctttctttctttctctttttttttyttttttgaaaaacttttttggagcagcacctgcatgttgtaaaaacacaaaataaaaaaaaaataaataaaagcagaccccttggttcagatatctttgt

SEQ ID NO: 44107 - DNA, 201 bp, Homo sapiens
aaggtgttgatagaaccccttagtgtcctcctcataccacagacactctcttcccccacttacttggccaatttttttttttttttttttttttttttggkggagtctcgttctgtctcccaggctggagtgcaatggtgcgatctcagctccctgcaacctctgcctcccatattcaagggattctcctgcctcagcctc

SEQ ID NO: 44108 - DNA, 201 bp, Homo sapiens
catgtacaacagcgcctgtgctgggcctgctaggagtcgatattttctggctcaaagaagttccaaaagaattcaaagccagtgtgtctctttctctggamggccaagtgatgcaggtaccacgcttaggtctgctggtgtttagcttgacttaaaacccagccagggaaatatgtttcactttgctggggtgcaggtgga

SEQ ID NO: 44109 - DNA, 201 bp, Homo sapiens
ttatttgtcttttggcttgtatcccacctgttcactttttaccatagctaacctttctaagtggtcaggtgggactcatggagattttccgttctttggaractagcagcgactgcagattactcatcagctgtctccttgagtccacaatgccgggcggtggacgggcttcctgcctcctggcccagggcccctttgccg

SEQ ID NO: 44110 - DNA, 201 bp, Homo sapiens
gctgctgttggctcctgtgttcttgtgatgtacacacatcatggtgtggtgtgtttttatctttggttttgttttcacttcttttttgctttttgtgcctyctcttccctcttccccccacctcatacatacacaaagggcagcatgctactataatttctggaatctcagccatattcttcttttttttgttttaaataa

SEQ ID NO: 44111 - DNA, 201 bp, Homo sapiens
ctcttcgagggtagagtatctgcataaactacttggaattctacatggaatatttgtgtcttctcccccatttatttatttaatcatttatttatatcacrgtacactcatggacatttattttatgctttatgttataatcctatactactttatttattttgttgcttaaatttttccagatggaacaatttggtcttc

SEQ ID NO: 44112 - DNA, 201 bp, Homo sapiens
tggccattgcccactaagaaaatttaggtggtttttattgggattagtggatgaacttaggattagtgtggcccttccttgagatataatgacaaccttgstgaaagcaagaccacagggcctatcttcagggaagtgccttgcattttaataccaaccatgccacgtgtatgtgtttcctgggcctgccataacaaatta

SEQ ID NO: 44113 - DNA, 201 bp, Homo sapiens
ccttggcttggaaacaccacattctaatctctacttcctcccttacatcaccttctcctctggctttgtgtcctttctgtctcttacaaggacaccagtcrttggacttaggacccacctaattgagtatgatctcatctcattccttatcttaattacatttgcaaagaccctgtttccaaataaagtcacattcgttgg

SEQ ID NO: 44114 - DNA, 201 bp, Homo sapiens
tataattgaatcttgaagctagagtttcttggctatcctatttcccttttgtttccaccatgaagaagtggagagccgtgtgacgtcagtggtagagctgrtgtagaagcgccctctctgttcctggcagtgcctgtcctgctaacctcgtgtctcttgctggggtcttcatcagtaagagacctcacaagatgctttatc

SEQ ID NO: 44115 - DNA, 201 bp, Homo sapiens
ctgttcctgaggcccccactgggaacccttagctggagaacacccgtttcattatggaacatggagaaaagggtgattgtcagctccaatttattccatamtatctgattcaatctgtagtttgactttgctaaaggaattaatttttaagatcttaacaaatccagtaacatttaaaatgacctatccagtccatgcata

SEQ ID NO: 44116 - DNA, 201 bp, Homo sapiens
ctttctctgttaccttcggaggaagccttctctagataccatctttaaaacagcaatcttccttctccatccccagcagcacctctgacccccttcacctsctttatttttctccatattatcattgccatcaatccaagcacaatttccagttacttacccattttgctttctccccgctctttgagaatgctggctcca

SEQ ID NO: 44117 - DNA, 201 bp, Homo sapiens
aagtccctttgaggtgatttctggtccacaaattgaggcaaaataatcctcacaatttcttggatattctctgccccagccccgttctattgcaaaggagscttctctaaaaggcttcccaatgccttagaatctacttaagggtatttttgctggagaaagagctgctgtctttgtccacctgtcgttttcctttctacc

SEQ ID NO: 44118 - DNA, 201 bp, Homo sapiens
agttaaacttgttcctcttctccaatcattgatacttttctctcttgcttcccctccccctgcccttcgacacagagtgacaggcctgaagtaaaaagggwaaaggggaaccgagtgactcagcccagagtgggcctcaccgcagcttcctggccactttctcgctctctccttccaagagagaaaggggaggaagcccag

SEQ ID NO: 44119 - DNA, 201 bp, Homo sapiens; identical to SEQ ID NO: 8526

SEQ ID NO: 44120 - DNA, 201 bp, Homo sapiens
aaacaaaacaaatgtcacggtgtggttgggaggaggtggggagagaggcagattttggaggcgaaagatacacagaaacactaaatacctgtctattaatrctgacagtagttgcgtttaggggatgagactctaaatttgtttatttaaattttctcattttaaaaaatgagtcctttcaattatgagatcaaaaagaaa

SEQ ID NO: 44121 - DNA, 201 bp, Homo sapiens
acagagacagatgtatgtacctttcatggacataatttccccaagactgaacacaaaaatgagggtttttggagatctctctggaattaatgtaaacgttrttgaaaacatattattctatggctccttcataaaccctaggccatcccgaggctgtctcactcaggcccctcagccctcataaccccccagctccatagg

SEQ ID NO: 44122 - DNA, 201 bp, Homo sapiens
tcattacatgtgtgtttagcccaccgattattaaggctttaacaatattaaaacctaaagagataacagaggggaagcctttgggagctaggaatcaatcrtgctgggtggcttgaaaacagggcagtaaaatggcagccgcctagcctgtggtctttaatattaataaagccagaggcgatatcacttagttgttccaac

SEQ ID NO: 44123 - DNA, 201 bp, Homo sapiens; identical to SEQ ID NO: 8529

SEQ ID NO: 44124 - DNA, 201 bp, Homo sapiens
ttggtgtctaaagccatgctcagtatatagttatatatttcattcattcatccgttcattcagttatctcacgtttctggagggccctctatgtgcaatasctagtgatacagcagtgaacaaaggaaatccctgccctcagggagctttcattctacttggggaaagagacgtgaaagaaatcaagacatgcaagcaagg

SEQ ID NO: 44125 - DNA, 201 bp, Homo sapiens
cttatttgtcttttggcttgtatcccacctgttcactttttaccatagctaacctttctaagtggtcaggtgggactcatggagattttccgttctttggmgactagcagcgactgcagattactcatcagctgtctccttgagtccacaatgccgggcggtggacgggcttcctgcctcctggcccagggcccctttgcc

SEQ ID NO: 44126 - DNA, 201 bp, Homo sapiens
tcttgctctgttgcccaggctggagtgcagtggcatgatggcatgatcatagttcactataatctcgaactcctggtttcaagtagtcttcctgccttggsctcccaaaatgctaggaatacaggcaggagccactgttactggtctgttttttttccttaaatacataggcaacttcctcgattgtctctcctttattgg

SEQ ID NO: 44127 - DNA, 201 bp, Homo sapiens
ttaaacagagacagatcttgctctgttgcccaggctggagtgcagtggcatgatggcatgatcatagttcactataatctcgaactcctggtttcaagtartcttcctgccttggcctcccaaaatgctaggaatacaggcaggagccactgttactggtctgttttttttccttaaatacataggcaacttcctcgattg

SEQ ID NO: 44128 - DNA, 201 bp, Homo sapiens
atggcagcttcaggccagacaatgtcttgaacttctgtgcctctgcatctgtggtgcagagcagtcgaacaaacaaacaccattgccctccagtggcccayagccttgccacatcctcccatctggctatagtcttccttacgtaatccttattatcacaggacctttgaaactatgaatcagataatgtcacttttcaga

SEQ ID NO: 44129 - DNA, 201 bp, Homo sapiens
gaaacacataaataatcataagatgccagataaactgtattggttttaaattagagacgtgccgaccatgtctccctctgaacagcagcctattatttttrattatggcttgcaaagcaaagtgatttcttgccctctttatagcatccctgacagtattctgtcagtttggatgatatgatgcctcatcactgcacacgt

SEQ ID NO: 44130 - DNA, 201 bp, Homo sapiens
gtgtgtgtggaaaaaaggggctttaatcaagctataaatatctgtttctttgaagttttatgaccaacaattaatgttactggaaggcccataaaaagggytgtttcttgacttggtgggtctgagtgggccagggtcgggttaagatgctagcctcgtggggtgccatcctgacagattctactgtgtgcgtgtgtgtgt

SEQ ID NO: 44131 - DNA, 201 bp, Homo sapiens
acattgtattttatggttgcagagcacacgtatcatcctatctgcttctgacacccagtaagcagctctggcttttataattttgatgaaagaagtttccyaacagtatttcggtgtgcatgctcacacaccagccctggtcgtcagtgaacagattcttccaggtcttcattgtggcggaagaaagtgagatcagagatc

SEQ ID NO: 44132 - DNA, 201 bp, Homo sapiens
cccttgagcaggaataagtgagtggcagagggggtcagggatgttaacgcaaatggagatcccttcacccagaaagacacatctgaaatggagaagatgcytttttcctcctgcaaccaataagagagtgatgaaaattatgacgccttgggaaataagactgcaacgtaaatgtgtgtccaccccctagttttcttttgg

SEQ ID NO: 44133 - DNA, 201 bp, Homo sapiens
gacactggtctgcacaatgagtgtttttgtatatgaaccgaaaaacaggtagcaaaagcaaaaatagacaactgggattacaacaatctaaaaaatttctktacagaaaggaagcaatgaacagagtgaagcagcatcctacagaaagagagagaatatttgcaaaccacacatgtgataagggattaatattcaaaatgt

SEQ ID NO: 44134 - DNA, 201 bp, Homo sapiens
cttctgttaggtgtatctctgctcatgcttgagagtggtggtgtttggaaagactcaatagcatatgcacatgaggaagttgaccaaatgattccacagcrcatactcattttttgctctgattctagcttttcctccaattttattcagaatttgttcttttcttacctcacaccatatagaaaaatcaactcaaagtgg

SEQ ID NO: 44135 - DNA, 201 bp, Homo sapiens
cttgtacttcttttaggctatttttccacctggtactatttggctttactgactgccctcattccccatacaccaccttgttttgttcagattcccctaartcttcattctcgtcccacctccccatcactcctgactacttgaaacacgacttctgtcctcagaaggcagcagtgttccctcctcccgttcatttttcat

SEQ ID NO: 44136 - DNA, 201 bp, Homo sapiens
ctgaattatggagttttagttttgctttagaatttttggatgattagacttgtacttcttttaggctatttttccacctggtactatttggctttactgamtgccctcattccccatacaccaccttgttttgttcagattcccctaagtcttcattctcgtcccacctccccatcactcctgactacttgaaacacgact

SEQ ID NO: 44137 - DNA, 201 bp, Homo sapiens
ataaacacatttatagttctcagagattccttgagagaggaacatctttaaatggataaccacagtcttctaaacacctgaaagggtgtcttttgctgaaytatggagttttagttttgctttagaatttttggatgattagacttgtacttcttttaggctatttttccacctggtactatttggctttactgactgccc

SEQ ID NO: 44138 - DNA, 201 bp, Homo sapiens
gcaacaatggcattctgaatcaatgggactgcagaatttcttagcaaaaataccattccagtaatgcaagagtgcaacgtggtatcattacagtaggtcakagtggcaaaatattttatcaggttaggaagaattctgctttttgctttcccaaacggactgctttggtctttcctcacgcttggcagaacagtgaaaggc

SEQ ID NO: 44139 - DNA, 201 bp, Homo sapiens
cttgtatgggatgtcggtgctttgaaaaaattctatcatcaaagagtaggtttcttagttctgcaaatctggcacctggagatggcattttgaatcggacracctttttagtaagggtcacttgctgttggatcatcgaagggggtgctgagtcttcatttttgttcatccaaatggatatcatttcaatttagctccatg

SEQ ID NO: 44140 - DNA, 201 bp, Homo sapiens
gagagagaaaaaaataattcctagatctagagttggtgtgaggctaaaataagctgcttttagtatcacatttggcaagtagtaaactctggataaatatrcttttgaattgtgtgattattgttgttaccatttattgaaagggaatgatgaatgtagtgagagaaggaaggaagagagagagggaagaaggggaaaaag

SEQ ID NO: 44141 - DNA, 201 bp, Homo sapiens
catgtgctctgtgtgctggaagctcctggaggccccagggttatctctgctcacttaggtttgtgatgttgggcaaaaggagaaaatgctgagtctattcrgacccaacttccattaatgcctgagaaataatttaaatcgcaagatttccaatcccataagcagccctagcctctcttctcctgatactccacataccca

SEQ ID NO: 44142 - DNA, 201 bp, Homo sapiens
catctgcgtggtctctgtggataaagtaagcgtttcattcaacttttaaaaatattgcaaattgaccctcgcacatcttttcttactgccggtcacctagycagcaaagaccccaggtgagatcccactggtttggaggaaggagaggaaagtccccacttgggcaaaaacaatttaggatacctgaagattgcaaagccc

SEQ ID NO: 44143 - DNA, 201 bp, Homo sapiens
tgtgtgctcacccaaaagtagtggagcctcaagctcagggagatgtgactggaaaatccactgaataaatgtctatttaaaaaaatcatagcgtctagggsatatacacttctaagcccattcttcaatggagaattacttatgcgcataagtagtttaaacaaaattagtggaaaaacagggagtttaagggagcaagag

SEQ ID NO: 44144 - DNA, 201 bp, Homo sapiens
acaagtaatactagtaatcatctcactcctgtaaacagtacagttgccatacctcaagtatctagtatacttgggacattagtctgggaatttttctccartcctcacgctagcatttctagtaatgaggaaactgggggtcagggaagcttagtccacatttctcaccttttctccttttctcccatcccccagccagtt

SEQ ID NO: 44145 - DNA, 201 bp, Homo sapiens
tttaactctgtattccaatctaattacatgtctatttccaagtaacgtcacattctgaggcaatggcggttgggacttgaacatatattcttcgggacatkattcaacctataacaagtaatactagtaatcatctcactcctgtaaacagtacagttgccatacctcaagtatctagtatacttgggacattagtctggg

SEQ ID NO: 44146 - DNA, 201 bp, Homo sapiens
caatcccactgcaggtttaggctgcatgtttcatccatttgcagctgtagcattttacaaaccacagcataaaccctaggaataattctgttccccactgkgatagagcattgttattaatataattttacaaacatcattcgtttgaaagctttatccagcctcaccacagctcattagtgaaccttctgacaatcccgg

SEQ ID NO: 44147 - DNA, 201 bp, Homo sapiens
atggctctttttccttcttttgacatacttggagttctagaagtggaattactgggtcggaggtcacaaatggagaggtcttttaaatctcagcctgcaarcaatcccactgcaggtttaggctgcatgtttcatccatttgcagctgtagcattttacaaaccacagcataaaccctaggaataattctgttccccactg

SEQ ID NO: 44148 - DNA, 201 bp, Homo sapiens
ttctgcatggctctttttccttcttttgacatacttggagttctagaagtggaattactgggtcggaggtcacaaatggagaggtcttttaaatctcagcstgcaaacaatcccactgcaggtttaggctgcatgtttcatccatttgcagctgtagcattttacaaaccacagcataaaccctaggaataattctgttcc

SEQ ID NO: 44149 - DNA, 201 bp, Homo sapiens
gacttcttgtgcctgtagagtttattcatatcactctttgcttgctcagcagttgaaatgggatggaggaaagccccctaactccaaaaaaaaaaaaaaaactttcttcccagcctgagacagttgccataattagtaacctgcagctcccttgatatcttgatgatactttattaaaacaaacaaacaacaaaaaacaca

SEQ ID NO: 44150 - DNA, 201 bp, Homo sapiens
agaattggcaggaagggcacaggggcaaggtataggctcacgtctccacattctgcacctcccaggctcctgccattgatgtgagcgggttcctgtactgyatgaagcaggggtttgcatccgaaacaaccacccgtgctgaatatgtaggtgatacgttgatctgtacagcaaaccaccatggcacacatttacctatgt

SEQ ID NO: 44151 - DNA, 201 bp, Homo sapiens
taagatctgtctgcactccttttgtctggcctgtacctgccttttctgaatgaccctgttaattgcaattgactctcatagaatgtggatagcagtgccasttgacaccagactaatgcttctgacttttccatggtgccccagcagcaggctggagggaagggcgggggcggtcagaggagagatagagcacttcagatt

SEQ ID NO: 44152 - DNA, 201 bp, Homo sapiens
acatatcagtcattttttgaggaaaataaatttaaggcttggttatcggtccttgagtcagcacattgagcgttttgtcaattagctcctccccccatctktatggtatggcttttcctgtaattacagtcaagatcctatagccggaggaaggcctgtcaattgagtaagaggctgatgttcatcgcacagtgacagccc

SEQ ID NO: 44153 - DNA, 201 bp, Homo sapiens
agatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagc

SEQ ID NO: 44154 - DNA, 201 bp, Homo sapiens
ggacaacatatcagtcattttttgaggaaaataaatttaaggcttggttatcggtccttgagtcagcacattgagcgttttgtcaattagctcctcccccmatctgtatggtatggcttttcctgtaattacagtcaagatcctatagccggaggaaggcctgtcaattgagtaagaggctgatgttcatcgcacagtgac

SEQ ID NO: 44155 - DNA, 201 bp, Homo sapiens
aggtaccttggaaagactgcatctcctggattttgcatggttctggcttaatggacaacatatcagtcattttttgaggaaaataaatttaaggcttggtyatcggtccttgagtcagcacattgagcgttttgtcaattagctcctccccccatctgtatggtatggcttttcctgtaattacagtcaagatcctatagc

SEQ ID NO: 44156 - DNA, 201 bp, Homo sapiens
gatcctttcagagttactcatacgacttacacattcccatgggagctccaactctgtttggtcccaatgtgccctttttgtctcactccttcctcccacayatcctgctccccactcccctaattactcatgattgcactaacagccacatcctttcacacctctgagcttttggtcatgctgtaatctctacctgagttc

SEQ ID NO: 44157 - DNA, 201 bp, Homo sapiens
gattagcttgaccaacatagtgaaaccccgtctctactaaaaatacaaaaattagccaggcgtggtggcgcatgcctataatcccagctactctgggcctraggcaggaaaatcacttgaacctgggagacagaggtttcagtgagccgagatcgcaccattgcactccagcctgggcaacaagagtgaaactccatctca

SEQ ID NO: 44158 - DNA, 201 bp, Homo sapiens
gtttccttttctgaagattgcctgtcctagacaccagttctctgttctctgtgactctgattcctgtctcctcttctttcactctcatccattttcaatastggcccctcatttcacttcctcagctaaatctacctctcaaagatagacatggacatataaataattttttaaaatcctcttttgcaaaaaaaaaaaaaa

SEQ ID NO: 44159 - DNA, 201 bp, Homo sapiens
gaacaaatataattatcatatacaccctttccattattagctctctccatttttaatgaaaacagtggttggtggtttataagaagttttttgtcggtgtsatctttcacatcagtttgctacccagaatttaaacattccttttttgctgctgttttaatttgaaataagaatggtagcccccaggtcccctaacagtgg

SEQ ID NO: 44160 - DNA, 201 bp, Homo sapiens
ttttggcagccttacttggtagacactatgattcccattacatacatggaatgtacagtaactgaggatcactgtgatattgggaaagtgggacttcagaygctagcctccccttgtagtgcctgcattcttttcacagcccctccccaccttagaatcattttcttcaagggagagtatggtttgtgatgcccttatcag

SEQ ID NO: 44161 - DNA, 201 bp, Homo sapiens
aaattcaggccacaatgacttcaaaaacccttgtatccttgttttgtttcgtttccctgcaaacattgttttagttgagatgaaattcacgtaatatacarttaaccattttaaagtgtacacttcagtggcatttagtgaactcagtgttatgccaccgtcacctctttttagtttcaaaactttgtcatcaccccagaa

SEQ ID NO: 44162 - DNA, 201 bp, Homo sapiens
gaagtgatgcaatctcaggtcactgcaactgctgtctcatgggatcaagtgatcttcacacctcagcctcccaagtaactgggaccacaatgcccagctamtttttatatttttttgtagagacggtgttttgccatgttgcactggctggtctggaactcctgggctcaggagatctgcctgcctcagcctcccagagtg

SEQ ID NO: 44163 - DNA, 201 bp, Homo sapiens
cctgccttgcaagtttggagttaaggccacgcagaccagagttacgtgcacaggttgtaatactctctcttgtccctggttgcctgattcaagttaggggyttcttctggattccgtaggtaggatgctgactctcagctgtcctgatgccactggtgttcctctagtaggcaacattgatggtaaacatagaaagtcatg

SEQ ID NO: 44164 - DNA, 201 bp, Homo sapiens
gatttaatgccaacatgttcttttttggtattaacatattgcattggtgtgaaaactaaaatgccttcagcgatgatcttttcctttggaaaactagattmccactcggatgctacgaggggtaatctgtgctaagtttatggtgtgtctgccagggctctgctttaaaaaacaaaacaaacccttttggaggccttgaca

SEQ ID NO: 44165 - DNA, 201 bp, Homo sapiens
cggaagtctgcctctgtgacagattctggggctctaaggaggaatttacttcttcaaagtacagtttcctgccttgcaagtttggagttaaggccacgcasaccagagttacgtgcacaggttgtaatactctctcttgtccctggttgcctgattcaagttaggggcttcttctggattccgtaggtaggatgctgactc

SEQ ID NO: 44166 - DNA, 201 bp, Homo sapiens
gcaattttttgtttttttcattgcctggtgggtttttttttttttgtctttttaaatgctccatgtagaaaagaattcctggaatagttcttggaacagcrtaggtgaataaatgagcaattattttgtcctcagcactataactgatttgagaaggtcaaaacagaaaataaaaacatgtttcagtagtaccagttcctg

SEQ ID NO: 44167 - DNA, 201 bp, Homo sapiens
agggtcattcatgttgtagcatgtatcagtacttctttttttagggctgagtaatattccatttacggatatgccacatttcatctatgcattcagttcayggacatgtgggttgtttccacattttggctattgtgcataatgcttccaggtacacttgtctacacatttttgtgtggatataggttttccttttttggg

SEQ ID NO: 44168 - DNA, 201 bp, Homo sapiens
ttttcactgatgcagatatttctgatcttttcatctcggttttatttctcactctcccactgcataaaagattaagaaagcactcgcatgaatgtttgcasatcatttaaatattcattttcattaatttattcatagtcgtaaagtttattgcctagaatatagagtcgtagaattttagagctggaagacaggagagaa

SEQ ID NO: 44169 - DNA, 201 bp, Homo sapiens
tggatggtttaataaataagattgatacaaacacaaagcattaagcaaacaaaaggaaataaaaacggcaacaaataaaacttctgtgctttttgaaattytgtttttggcaggcaacattccaaagatctttttcatttaaagtccaggagtcttctgtgtgaaccccacacaggtaccttggaaagactgcatctcctg

SEQ ID NO: 44170 - DNA, 201 bp, Homo sapiens
tattaaataaaatgaacactggggtatttcgctccaagtttggtgttcattatttatctctaaattatgatattcatagaacaactccttgctttttcacsaagaatctagaatctagaattatctgagcgttcgcatcagataactaggaagaaatcagagtcattttctctctaaggcaggctcgatgatacctgcaca

SEQ ID NO: 44171 - DNA, 201 bp, Homo sapiens
tgatgtaggaatgaacagatgaacaaccccacacaacctaaggacaactttgaatcaattcttctaagctggtagcagaagccacctttccatttgacttstatctcgctctttttttctttcttttttttttttttggagacagagtctcactctgttgcctagactagagtgcagtggtatgatctcagctcactgcca

SEQ ID NO: 44172 - DNA, 201 bp, Homo sapiens
cgttcaaggcattcagtttctgagtcctcaaggatggtaaggagagctgcaaatgggctcccttctcaagcaaaggcatcttatgccatcatgcacgtttytacacatctgcctgtagatacactctgtaggacaaaccaggtggctctgtccttcaggcaaagagctccttaattgaaaatgatgtgtgaaatttcaaga

SEQ ID NO: 44173 - DNA, 201 bp, Homo sapiens
gtgtgactaatattagaagcagacacagccatgatgagcaatactctttttttgtttatttttgttgttactgctgtaagccactttcttctccctctccrttaaaatgcaacttaattggtaaagtttagttgactagagatttcatttatttatttatttatttatttatttatttatttgtttgtttgtttgtttgag

SEQ ID NO: 44174 - DNA, 201 bp, Homo sapiens
attattccttaaacaatccaacataaccactatttatatcgtgtttatattgtattaggtattataagtaatctagagatgatttaaagtgtacaggagcrtcacatacattatatgcaaatactatacaattttatgttagggacttgagcatttgtggattttggtatttgggggggttccttgaaccagtcccctttg

SEQ ID NO: 44175 - DNA, 201 bp, Homo sapiens
tagtgggaaatgtttaggggctcaagcacaaccacaaggattcactccttccttggattttgtgcctcttcccctgttcctgaggcccccactgggaaccyttagctggagaacacccgtttcattatggaacatggagaaaagggtgattgtcagctccaatttattccatactatctgattcaatctgtagtttgactt

SEQ ID NO: 44176 - DNA, 201 bp, Homo sapiens
cttgataaaggttggggtttgtaagcttggggctcctcagccatgactgaaacgtactatgagcacggcatctaccgggctgttccacatcctccctgtgkgactaggggccagggcaatgggaatcagtgcagaaataaagctcatgctgtttgctctgccatgagtaacgaagtcctctgtatctgatcctgggtctcc

SEQ ID NO: 44177 - DNA, 201 bp, Homo sapiens
ttcatgcatgaaacactcagggaggtaggagatccatgagatccaagctaaacaattctggaagagttacctgaagttgacacttaattcaagctgcatcrtcttcctcctcccagcagatgaagaccaaaggtggagggtggtgggggtggggggcagggagtaggggggagggggggagggggtgtggggagggtgggg

SEQ ID NO: 44178 - DNA, 201 bp, Homo sapiens
acagttgtattcctaagacatagttgggaccagacctcaagaaaatagccaacaaatactggctgaatgaacgaaagaggccatatgcagtcagcccccctctctctgggttctacatatgtagatttaactaatgacagattaaaagcattcgaacaaacggagggtggtatctgtactgaaaatgtaccaactgctttt

SEQ ID NO: 44179 - DNA, 201 bp, Homo sapiens
gaatgttttgaaatgagcttgattctgtttacccatccttcttaatccaacaactctgctggtctctctgctgacacaagatcgttcgcaggttatagaasgatttaacacgtcaggtaaggtggaatttggtaaattccccaaatttacaaatagatgaaagttgggtaaattccccaaaattacttgatgacaaagatc

SEQ ID NO: 44180 - DNA, 201 bp, Homo sapiens
atttctctttacaaaaagaaaaacaatgtaaggtcccgtgacaattagccttactgccggggagaccataaggagtggtggagactgtggtaaactgcagsgcgcacactctgttaacagaggaggtcactttccattctagctgactgttgtcatatgaggatacacaactatgctggccagtttctttaattttttttc

SEQ ID NO: 44181 - DNA, 201 bp, Homo sapiens
ttaaacaaccagctcccgtgggaaatcacagagggagaactcactcactaccatgaggatggcatgaagcccttcatgagggatccgtccccatgacccaracacctcccggtaggctccatctcctgacatcttcacacaagagatcaaatgtcaacatgagatttggtggggacaggcaaaccagatccaaaccatagt

SEQ ID NO: 44182 - DNA, 201 bp, Homo sapiens
gttccttgttttgtgtaattggtctttagcctgatctgattcatctggcgaaacccctttttccagtaaaagtcgttggcgaggagtgaattgtgatggaracagagacagatgtatgtacctttcatggacataatttccccaagactgaacacaaaaatgagggtttttggagatctctctggaattaatgtaaacgtt

SEQ ID NO: 44183 - DNA, 201 bp, Homo sapiens
gaaatggttctctgagtttcagctgcagttcagggaaaaggccagcagccacgttccttgttttgtgtaattggtctttagcctgatctgattcatctggsgaaacccctttttccagtaaaagtcgttggcgaggagtgaattgtgatggaaacagagacagatgtatgtacctttcatggacataatttccccaagact

SEQ ID NO: 44184 - DNA, 201 bp, Homo sapiens
gcgtagtttcacgcctctaaaagtcccctgaaagtgttattaaaagtactatctggccatgtcctcatttccccagcaaagtccttctgagaatttaggckctttaggctagaggatctcagtgctcagaatgaaatatccctgtactccaagatgcctccagcaattataattgaatcttgaagctagagtttcttggct

SEQ ID NO: 44185 - DNA, 201 bp, Homo sapiens
ggtcttctgaagtataggaaaaggcagcttacagaaaaaaacttgcttgtttactgtcttctgagctgatttctcacctactggcaagtggataggtctastttttgtttagctgtttttctaatttaatcttgtacatgagacagctatagatggatgtatagtctttgaagtggggccagttggctccgtctattagct

SEQ ID NO: 44186 - DNA, 201 bp, Homo sapiens
caggcaaggcttggaataacttgtctaagaatcctcatcttaaccctgtgctagaacaacaagcttggaaggagccagccaacaggagaaagccagagcawgactctgtgctggacaagaagtcctgagcactggggagttgacttcatattggaggcagagaagaattacctgccgatggctgttggcccatggcaacac

SEQ ID NO: 44187 - DNA, 201 bp, Homo sapiens
tagtgttggcaaaaggcttgcaatttattattaagtggaataagcagtttaaaaacagtatgtacagggtggttttctggctatataaacacacaggcatwgaaaatagatatacataaataatgttactataatttgtctgcctcccttctctcagaaaagaccaatgaattatctattatgtgccactcactatttgag

SEQ ID NO: 44188 - DNA, 201 bp, Homo sapiens
tttttctccttggcaggttttcactattaatttgcttgacaaaggatagatacattttccatgtgtggaggtaaaagcagtgcagtgagctaaaaagttarcaaaggtgaagtggtcctaatctgcggccctggtacacttagataggcatcattgcctttcctctgagctcttggtgctgataacagcttccttgaccga

SEQ ID NO: 44189 - DNA, 201 bp, Homo sapiens
tgagtcgccacactcaattatacacttaaatatacatatatatatacaatatacatatgtaaatatatctgcatatacatgtttagggacaaaaacacggragtaccatttctgtctttgtctctctctctctttctctcacttgactctgttgggagctatattagttgttttctctttccaaaccaccttctggaggtc

SEQ ID NO: 44190 - DNA, 201 bp, Homo sapiens
cttcttgatttacatggtggtggagagtggctgagaaaccagggagaaacaggaaggagctgattgaggagaccaaaggagggtggggccgcagctctcargcactcttggtgttcagaaggccagcttgaagaaagatgtgcatatttgcaaatgcatttcttgttcctagtgaagaggtgaggaaggacactgactgtg

SEQ ID NO: 44191 - DNA, 201 bp, Homo sapiens
attcactaagtctttcaccatccttcactcatcttacctccttcttctgtggcatttcataaatttaatgattgtaattgtgattacaacataattgtttrtgtctaccccaggctttgcaacagggaactatatcattattttgcagacacaacaaattctgcaagcatgtatctttggaataaaggagagagggttgga

SEQ ID NO: 44192 - DNA, 201 bp, Homo sapiens
ggttagtgtgtggttaagcaccttcccacaagctcaggggaaaaaaaggtcccctccccagattttttttagaactggaagtttccatttcctggcactgstgaaagctctaggacataaaacttgggagccgatggccttcaggctgcccataatgtgaagagaggtcatttcagacattcagataaagtctgtggctcc

SEQ ID NO: 44193 - DNA, 201 bp, Homo sapiens
gaccccttcttctccaggaaactctgttcctacctgctcctcttgtggctaccttgggaggtgccatttttatcaaggttagtgtgtggttaagcaccttsccacaagctcaggggaaaaaaaggtcccctccccagattttttttagaactggaagtttccatttcctggcactggtgaaagctctaggacataaaactt

SEQ ID NO: 44194 - DNA, 201 bp, Homo sapiens
tcttcttactcaactctcccgagaggcattgtggacgcctgtggggttggtttttggcacccatccctgaccccttcttctccaggaaactctgttcctayctgctcctcttgtggctaccttgggaggtgccatttttatcaaggttagtgtgtggttaagcaccttcccacaagctcaggggaaaaaaaggtcccctcc

SEQ ID NO: 44195 - DNA, 201 bp, Homo sapiens
gcatcgttcttcttactcaactctcccgagaggcattgtggacgcctgtggggttggtttttggcacccatccctgaccccttcttctccaggaaactctsttcctacctgctcctcttgtggctaccttgggaggtgccatttttatcaaggttagtgtgtggttaagcaccttcccacaagctcaggggaaaaaaaggt

SEQ ID NO: 44196 - DNA, 201 bp, Homo sapiens
aacaaagagagatcctgtctccaagtctgtctgtctgtctgtctgtctgtctgtctctctcggaaatattccttcagtgtattagtaaagaagttacttakgagtcacttatgcccttgaagagtgagtgatgtatcaaaatatgtctgtctttattgtttcactttcatccttctttttttggagatggagtcttgctct

SEQ ID NO: 44197 - DNA, 201 bp, Homo sapiens
gttttctattctgggcctccctgcttccagcgatagcaaggagcgaaatgagatgctgtctaagaaaggaaggtgctgcgatctttgattactacacagcytcggcagtgtttgtatgattaatgagtccatgtttcagacgttcccatttaatgtatttgagccttctaacaacattgcctttcatatgttgctgactgt

SEQ ID NO: 44198 - DNA, 201 bp, Homo sapiens
cctgtgcaaggatcgttcactagtgttctgcatcgttcttcttactcaactctcccgagaggcattgtggacgcctgtggggttggtttttggcacccatycctgaccccttcttctccaggaaactctgttcctacctgctcctcttgtggctaccttgggaggtgccatttttatcaaggttagtgtgtggttaagcac

SEQ ID NO: 44199 - DNA, 201 bp, Homo sapiens
atcccctttgcaaaagtaagaattgtatcgtagcctgactcagggttttagccaacttctctggatgctaatgctattctcttctttatacttgtcttccytcccaggcacacatccactggagctttgcagggcctatctgcccttagccctccaatatccttttcattttctttaatagttttattgatatataatgtg

SEQ ID NO: 44200 - DNA, 201 bp, Homo sapiens
tgcgaaggataagataattacacaagaggcaccagaaccactgaatgtggagagctctcataaatgacaagctgcctttgggttaggctctgttgggaacrttagttctgcagtgttgcaagcagatgaaggatgtgagggaagggatcttaaaccagatattcaaatggccctgtggggagctgacaccacactgctgtc

SEQ ID NO: 44201 - DNA, 201 bp, Homo sapiens
taatagagatctttgaaagaaaattcaaagattgaagtttgtattctcctaaactcctgcaaagaagtcctgtgcaaggatcgttcactagtgttctgcaycgttcttcttactcaactctcccgagaggcattgtggacgcctgtggggttggtttttggcacccatccctgaccccttcttctccaggaaactctgttc

SEQ ID NO: 44202 - DNA, 201 bp, Homo sapiens
ccgaattctgaatttcagcgtggaacagggcatggaaagcaaacacaatggggaaaattgccgtggccggtcccgacaatgtgtggattaaaaaaccacaygcatgcacagagacctgatgtgaatggtatttctgagtggaagctaagtaggagctgaaaatggccttttaaaatacagaacataaggatgcaattcaca

SEQ ID NO: 44203 - DNA, 201 bp, Homo sapiens
taagagacctcttctcaacaggatccatgtttgatccgggggaataaagctagagttgctttcttccttgtaatatgtataatgactcatgagagaattcyccactgtcttccccacctgagacctgagaggaggagaaggaagcttggagtcgctgccctgtggcctgaattggtcagtgaccaatcactcagacccagc

SEQ ID NO: 44204 - DNA, 201 bp, Homo sapiens
gctctaacgttggatcatgtgtggagtccccagttttcaacattaaaaataaagtatttgttgaagtggggtttttttcttcttacagtatatgtagaacyattttcttgaaaatgtttcttagaaatttgttacttagaagatttgagccaatgatacattgccgagatttgtaagagtaagaccagcctacgctgagta

SEQ ID NO: 44205 - DNA, 201 bp, Homo sapiens
tgacttcctaaaaccaccgttctcactcaaagccgaatctcatcctgactgaaatgtcactagtccttttttttttttttttttttttttttttttttggkcatattttctccatttggagaggctggctgacccatcaatgggcagtgtgggggaatggagagacctgggattttggggacaacagtgaccatgagggga

SEQ ID NO: 44206 - DNA, 201 bp, Homo sapiens
cttgagcccaggaggcagaggttgcagtgagccgacattgcaccactgcaccccagcctgggccacacagagaaaccttgtatccaaaaaaaaaaaaaaaaagtgaccacactgtggctttgctgctttgcctaagtatttcgtgaaattgatcgttcattcacaatgctcagtgcagtgactttgccgagcacaagtggt

SEQ ID NO: 44207 - DNA, 201 bp, Homo sapiens
aatgtcaggaacctgggtttctaatgatggttggctgtcacccccatttcccacactttaaatgagagaagtaaacatctgacttcctaaaaccaccgttstcactcaaagccgaatctcatcctgactgaaatgtcactagtccttttttttttttttttttttttttttttttttggtcatattttctccatttggaga

SEQ ID NO: 44208 - DNA, 201 bp, Homo sapiens
atttatcattttaggtggagatttgagtttatgtctcctacagacagccgtagactttgtttcattttaagatcagtgttgcagacgctgctgagtgtctycaaatgtctgttctccctttattacctactaataaaatacctaattttcaacagcctgggaagagactatatttccctgcttgcctttgcagctagagtg

SEQ ID NO: 44209 - DNA, 201 bp, Homo sapiens
atagagttatatggatttatcattttaggtggagatttgagtttatgtctcctacagacagccgtagactttgtttcattttaagatcagtgttgcagacrctgctgagtgtctccaaatgtctgttctccctttattacctactaataaaatacctaattttcaacagcctgggaagagactatatttccctgcttgcct

SEQ ID NO: 44210 - DNA, 201 bp, Homo sapiens
gggtgtgttgactatattctccacagaaactttttgaagtagcatcctcactcagcacagaacattttgacaatacacttccagggcaggtggtttcttamtatgtccctccctacccccacatactttgggactcagaatgtagggagtgtactctcgagggatgcggcccatacgtgaatgcatggaggcagcatataa

SEQ ID NO: 44211 - DNA, 201 bp, Homo sapiens
actcatctgcagctgtattcgctgtgcctatggtagtgcctggcaaatgcacagaagtgggtattactgaggactttgtggttcgaatggaatgagtgtgytgctgacagtgttgcgagtcatctgcaaatgaaaagtccttccttctcttcccttctggaaccttccaaagaggctagcctcctgagagggcgtctcctg

SEQ ID NO: 44212 - DNA, 201 bp, Homo sapiens
aagggatggggaattagtcatagggtatttccagataatgtagttaacacctcgtgtaatattaggtgggcagggagctctgctctcaggaccaaaattgytcctgccagctctaatagggaatgtgtgtatttttaaagtctgggtaagcactgtgagtcatttccacaatacgcctccctttggcgtgaaatggggcag

SEQ ID NO: 44213 - DNA, 201 bp, Homo sapiens
tagcgtctaggggatatacacttctaagcccattcttcaatggagaattacttatgcgcataagtagtttaaacaaaattagtggaaaaacagggagtttmagggagcaagagatcaggtcttctgggctcaccacacatcaggtgatttaagctaaaaatggcttaaaataccgcaatcacttgaaacgccttacataaa

SEQ ID NO: 44214 - DNA, 201 bp, Homo sapiens
accttccctgaccactgccacatggaatagtactaatacttcatgctcatcctctgcctgccctgggtttttaatttgtgcgtgtgggtggggtggggggygggggggggcacttatcaccacctgcatattatgcttttgtgcatttcaggttggtctttcccgcaagaaggtaaactcatctgcagctgtattcgctgt

SEQ ID NO: 44215 - DNA, 201 bp, Homo sapiens
tgagatgctcttctcggctcctgtgagggctacccctttaccctttatagtgtctgcccggacatctcctcactagagaccttccctgaccactgccacawggaatagtactaatacttcatgctcatcctctgcctgccctgggtttttaatttgtgcgtgtgggtggggtggggggcgggggggggcacttatcaccac

SEQ ID NO: 44216 - DNA, 201 bp, Homo sapiens
aaaaccagtcttaggttctacaatagtgatgttatctacaggaataattggggaagttccaaatcttgtgacctcctatgcctacatcttagctgaattcmgacccctctcctaatcctaaccttgtggccttttaggagctttacaaaggtggtttcatttcgggaaaggctgttatcattcttgctttaagattaaagt

SEQ ID NO: 44217 - DNA, 201 bp, Homo sapiens
ttggatggagaaaaggtaatggggacctcataatagtcgtggagggacaactgggatttatttccatagggaaggcagagactgtttgccagggaaccaasgcctttcaaagttgaggacacttcccggtgccgtgcggtgtaaatcacagtgcaaactatgcgattatcccctgcagaggaatcgagtgtgactttatgg

SEQ ID NO: 44218 - DNA, 201 bp, Homo sapiens
ttactttgcaggattgctgtaaggattagaaccaccgtctctaaggcattcagcatagtcccttagggtaacatgagtgctcaagaaatagtaaattttartatgtgtctcatttttttccagatgctctggggtcactaccaaccttgcctttcaccctacctgtggatctatgaccctgtccttctcagaacaccactc

SEQ ID NO: 44219 - DNA, 201 bp, Homo sapiens
cattttatagcccatctccctctccagtgaggcttttggccactggccgttaattggtaaggttcttgaaaactgaagtgatggtatcagcatggatgccygtgctttctgatgccactgaagatggatagaagcttcaagttatgctttgtgcagactgaatttttccaatttgtgcttagtagcatcttattatattag

SEQ ID NO: 44220 - DNA, 201 bp, Homo sapiens
tttcacctacaaaatgaaggctacaatatttactttgcaggattgctgtaaggattagaaccaccgtctctaaggcattcagcatagtcccttagggtaamatgagtgctcaagaaatagtaaattttagtatgtgtctcatttttttccagatgctctggggtcactaccaaccttgcctttcaccctacctgtggatct

SEQ ID NO: 44221 - DNA, 201 bp, Homo sapiens
tgaatagattccattttattttatttacattttgtacaaagctgataaataactgaaaccaaattagctcaaactggttatatttctgggtacaaaccagrtgtatagttaatccattgttgtttctgtgtcgaccaccattgtcctcacctatacttgggcagtgggggtggggaggagaacataaaaacccaccaagcc

SEQ ID NO: 44222 - DNA, 201 bp, Homo sapiens
agtttgtccttggcaattccttattgaatagattccattttattttatttacattttgtacaaagctgataaataactgaaaccaaattagctcaaactgrttatatttctgggtacaaaccaggtgtatagttaatccattgttgtttctgtgtcgaccaccattgtcctcacctatacttgggcagtgggggtggggag

SEQ ID NO: 44223 - DNA, 201 bp, Homo sapiens
tgttgccctggctggagtgcaatggcgcgatctcggctcactgcagcctccgccttccgggttcaagtgatgctcctgcctcagcctgcctcccaagtagstgggattataggcgcatgccaccatgcccggctaattttttgtatttttagtagagatggggtttcactatgttggccaggcatctcaatcgttttacta

SEQ ID NO: 44224 - DNA, 201 bp, Homo sapiens
ttttgagatggagtcttgccctgttgccctggctggagtgcaatggcgcgatctcggctcactgcagcctccgccttccgggttcaagtgatgctcctgcstcagcctgcctcccaagtagctgggattataggcgcatgccaccatgcccggctaattttttgtatttttagtagagatggggtttcactatgttggcca

SEQ ID NO: 44225 - DNA, 201 bp, Homo sapiens
agtgagcacattaactatatcgtcaactacctgttctcaaacactttaacaatcagctcaccaatatgggtgtgatcttgacattgagatgtagagcttgrcacctgcatataaagtagaaactcaacagtgtttgagaatttgccattgcatctcagtcttttttatttatatgttttttctttttttgagatggagtct

SEQ ID NO: 44226 - DNA, 201 bp, Homo sapiens
ttcttaaccctttaagaaatatgacttgttctaattgccttttcttatttacattatacttaggctggtgttaggatgccgtggctgccaagtttacacartgcactttctctctctctttcttcttttggtttatgatgtttttcaatagtgtcatggaactcacttaatctgatttcatcaagtaaatatatgggaagt

SEQ ID NO: 44227 - DNA, 201 bp, Homo sapiens
aaggccagttatgtgatggatacttctattaccttatgtctttctgatttcatacacttaaatgtacagtttttatcttccttcaaaaccttatttttccragcaagttttatttattcactttcagtcattactgaagtgaataacaaacatataacagatgctattttgggtcatagctgttttgctaagtaatactta

SEQ ID NO: 44228 - DNA, 201 bp, Homo sapiens
gaaagacagttcaccaaatctatcgattaatagaaatcatccagcagcagtgccactgtaagatgttcaatacgtagcacctttctgtcccttctcctctwgccagttgggacaggattagcaagccaaagactttctgaaataatccttagctatattcttggtattcaccaaggaatttaccaatatgcaaagacttgg

SEQ ID NO: 44229 - DNA, 201 bp, Homo sapiens
tttatccatggattggtatgagccctaatggtgcacccttccgacaatccttcatccttcccagacgtttcatcagccaagtgaaatttgcaattgtttcwgtgattgaaattatgcttggagtgcaggtgtcatggatgaaacagcaatgccttgcggtgacaaattcagtgtagaaataattttagcaagcccagtgat

SEQ ID NO: 44230 - DNA, 201 bp, Homo sapiens
agtcttctctttggtccctgataaatatacatagaatgtatggatgtgagaaagttaaactgatgtctgtgtgtcttcatgtcattaaactttgaatctayggacatgtctttttctttctggcatagtttggaggtcttcattttgtgattgaatacaaaacaccgagggctttaaggaggcatagtggtatgttcagct

SEQ ID NO: 44231 - DNA, 201 bp, Homo sapiens
tagaaggccttaatctcattgtacatacttttctattcctcccagtaccatttaaaggttagtgaaagcaacctttagtatcatctgttttttgggggggkttttttgttgttgttgtttagctgtttatgggtaggagaatgcgtgctcttttagggacatctcttcaaataagaacaggttgtaacctacactcaaaag

SEQ ID NO: 44232 - DNA, 201 bp, Homo sapiens
gcgaatctcactgcataaaggtgattttgaaaacatcacttttcctccacactaatgtgtgagcttagccagagtaggagatatatcttacttaaaaaaamaaaaaacaaacaaacaaaaaaaaaaaactccttcttcatttgttatagttccaggatagagtgtgtacctgtatagagagagtcaggcagatacaggtgt

SEQ ID NO: 44233 - DNA, 201 bp, Homo sapiens
tgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagt

SEQ ID NO: 44234 - DNA, 201 bp, Homo sapiens
caaggtagaagacataggtggtcaagaatttagaaagacccggactcgaatcccagctctgatccatctcagctctgccatattgccaagttccgctgagrctccatttactcacctgttgtatcatctgaattatttccatatccataatgtgcaaggatatccttccatgttattagaaatacagatacaccatcatta

SEQ ID NO: 44235 - DNA, 201 bp, Homo sapiens
ttcataatcagcagaagtcttttctctggaaggaacaaaggattaagttagggagacagtaatggtattgttagcaggctatttcaatgattttctctgcrgaagagtagggaaaggtgacattccaactgggaatattcgactctgcagatccctactcggagtttttcagccctgttttaagtgccgagctgggttttg

SEQ ID NO: 44236 - DNA, 201 bp, Homo sapiens
aaatcacagagtccatttatttctcctcttcgagtcagtatatctcaaaacattttttcaacgttaatagaaatataagaagtgcctggatcagtttttgkttttgttttgtttctttttgagatagggtctcattccgttccctaggcgggactgcagtggcaccattatggtttactgcagccttgacctcccaggccc

SEQ ID NO: 44237 - DNA, 201 bp, Homo sapiens
atttgtctcaaggtcctgataaatgggaactggaggaactggcctactatggtattacaggctagcacatggtttgcattctgagggagctcagaataggyaaggtagaagacataggtggtcaagaatttagaaagacccggactcgaatcccagctctgatccatctcagctctgccatattgccaagttccgctgaga

SEQ ID NO: 44238 - DNA, 201 bp, Homo sapiens
gggcacttcaaacctacaaaacatagtgctaaaattaaggagtgtatagtcgtgtgtttatagggacaggatatttattatctatcacttttgaaaatgtyattggcattatcgttcacttttacaaatacgaaggaaaaatatgaaggagttctagaaaacaccagaagtgattttgccgccatgggcctgaattgaaga

SEQ ID NO: 44239 - DNA, 201 bp, Homo sapiens
cagaggggcagtccaataaaagaggcagaaagggctcttgaaaaatgtccctgggcacttgcccgaatgactttagtgacagtatctactaaaactgataytaattctgttacgtgttatggcgcatacccaagaccctccccataaactatttgaaagaagcaaagttgtaattctccaaatacggacttgtacatttct

SEQ ID NO: 44240 - DNA, 201 bp, Homo sapiens
ctccactggaagaagagcctgtagaatatgcagactattcaaatgcttcctttggtccattgttgtcctttcttttctcttctagaactttccccatagtsatgcatctgtccctgggttatctgatatgtgtttcagcctgttttcccaagtttacctgcctctctgagaagcccatcagccctgagagatacctggaag

SEQ ID NO: 44241 - DNA, 201 bp, Homo sapiens
gggcagagggttgcctgggacaaaggcattataagcttattcatttaacttgagtacagggtttctcaagctttggcactgccaacatgtggggttggatrattttttgttgggatctgccctgtgcattgtaggatgtttagcagcatccctggcctctacccactagatgccagtagcatcccttccccctcttgtcac

SEQ ID NO: 44242 - DNA, 201 bp, Homo sapiens
tgcgcgtgttgcaatttcagatttaatcaggggaatacattaatttctggaactaattacagattttaaaagagtgatgggtctggtacagtggctcacayctgtaatctccacacttggggcggtcaaggtgggaagatcccttgagtccaggagttcaggaccatcctgggcaacatagtgagaccttgtctctatgaa

SEQ ID NO: 44243 - DNA, 201 bp, Homo sapiens
ggagcaagcatttctaacaatcatattgcttaagaagtggatggcaagaagataattactaatatgtctgcaattgatctgaaattgacacagttgatctmactgattcatggggaccctgggagtatgtttgtgtatttgggggttgggatgggggggtgggtggagggtcagagaggtggcaaaagcaggtgggaacag

SEQ ID NO: 44244 - DNA, 201 bp, Homo sapiens
cgagtgctatttctttatggcactgaggagcaagcatttctaacaatcatattgcttaagaagtggatggcaagaagataattactaatatgtctgcaatygatctgaaattgacacagttgatctcactgattcatggggaccctgggagtatgtttgtgtatttgggggttgggatgggggggtgggtggagggtcaga

SEQ ID NO: 44245 - DNA, 201 bp, Homo sapiens
actataaatctttctgctataaagacacatgcacacatatgtttattgcggcattattcacaatagcaaagacttggaaccaacccaaatgtccaacagtrgtagactggattaagaaaatgtggcctttgcctcttttaaaaagttctaagttgctagccagtcggaacaaatacagaatgtgaggtccctttccagcca

SEQ ID NO: 44246 - DNA, 201 bp, Homo sapiens
agcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgt

SEQ ID NO: 44247 - DNA, 201 bp, Homo sapiens
ttgatgtcaaaagtaaagaagttcagaacctacggggcttgctttgggtcccaaattatcttagctttctggaaagagaagaatctataatgtattctccrtggagtatctttactcacttgtgatgagatgtctgtaaaagtaatcagctccatacatctgggcatgatgaccctcaggcccttgagactcaggtgttct

SEQ ID NO: 44248 - DNA, 201 bp, Homo sapiens
tagtctcattttgtaaacccaattacgagcggagctacaatttttatctttgtttaatgtaaccaatgaggccattgtcactgtatggagaatagctttastccatattctctgttttttaagactctcagtctccttgcaggtgcctttggagagttaggtgtttgctgtgatttgagggatagtggccaataattttat

SEQ ID NO: 44249 - DNA, 201 bp, Homo sapiens
gtctgtgctggagagattgattccctggttatttatcttcctctgcccagtgtaaattggtcagcctgatcctattcgcatgataaaaatcataatgtctmaaattacttactcaataaaatgtgggtttgtctattattagtgattattagggttataatgcagcatggaaatttggagcaaattaactatacatgcaag

SEQ ID NO: 44250 - DNA, 201 bp, Homo sapiens
tataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcccaggttcaggcgattctcctgcctc

SEQ ID NO: 44251 - DNA, 201 bp, Homo sapiens
catgccaaaggcagatagcaacactcttcaatggatgtgggtgagaggacagtggaatccagcaggggccattgtttccttccataatatttttaaactgyagcaaagtgatctttttgagacccaaatgtgagtatgccattctaatcttcccaccctcagataaaccacagcaatgattttatactgtctgtagggtaa

SEQ ID NO: 44252 - DNA, 201 bp, Homo sapiens
ctagaataatagactaccaaacacataagcttatttacggtttgcctccttctcatgcttttggaagggaagcactgagggtcattgtatcagtcagcgtwgactaggtttgccgcagtaacaaacgaccccaccatgccatagcttgcaaaaacaaagactgagttcttgtctacactgtagggccgtcaagagctggct

SEQ ID NO: 44253 - DNA, 201 bp, Homo sapiens
actccacatctttgtaactttttatggctctcagccctactttcttaatagtagcagcagtatttatctactgtttattgtattccaggtaaaggatatgygaagcacttttcatgcattatttaacctagctataatactcccatttgacagatgagaggactgaggcttgtagactttccaaggctgtgcagctctagg

SEQ ID NO: 44254 - DNA, 201 bp, Homo sapiens
aagaaggttttgtattttgacaattccttcatctgttaatttagtcagacgaggaaggaaacgagaaaagttattcctatttcatccatctaagactttayatcccatttcaggctgattaaaaggcaaaatcttcacagtaggacaccaaaccctctgtatgccctgcctgcctccccccctctgacccgcctgcctccc

SEQ ID NO: 44255 - DNA, 201 bp, Homo sapiens
cattgaactgaatctccaccttgggcttgagactctgcaaagtgcattaaatgggaaggaaaccaaagggcctgctgccctgcccccgccatagcccaagkctgtggccatggctggggaattggcctgtcagttcaatcaggcagcccctctgactggtgtttttcactaagctggccccatggatggccctggtcatgt

SEQ ID NO: 44256 - DNA, 201 bp, Homo sapiens
tgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactc

SEQ ID NO: 44257 - DNA, 201 bp, Homo sapiens
ggtatggtggtgtgtgcctgtagttccagctactcggtagcctgaggcaggagaatggtttgaacttgggaggtggaggttgcagtgagccgagatcatgycactgcactccagcctgggcgacagagtgagaatccgtctcaaaaaataagtaaataaaataactaactaggctaggcacagtgggtcatgcctgccatc

SEQ ID NO: 44258 - DNA, 201 bp, Homo sapiens
agccatactcagagtggccctaggatggctcctcagatagctgctggcagaaacctgcactcagtacatctatacatggtgtaatgattgactcaagatamttagcatagccatcatctcaaacctttattatttgtgatgagaagattcaaaacccgctttttgaactgttctgaaatatgcaataccttgttgttaact

SEQ ID NO: 44259 - DNA, 201 bp, Homo sapiens
ccatcatttacttacgtaataaatctgttaaataattttaatataaatctattcatctatccatctattaaaagagatttaagttatttctaatctttgcrtattataagttgcatttcagcttataccttgactttctttgacatatacatcaataggtagagtatattcctagaaattcaattgtggaccaatgagatg

SEQ ID NO: 44260 - DNA, 201 bp, Homo sapiens
ggagtgcagtggcgcattcttggctcactgcaaccttcgcctcccaggttgaagcaattcttctgcctcagcctctcgagtagctgggagtccaggcaccygccaacacgtctggctaatttttgtatttttagtagagatggggtttcaccatcttggccaggctggtcttgaactcctgacctcatgatccacccgttt

SEQ ID NO: 44261 - DNA, 201 bp, Homo sapiens
gaactcatccttttttatggctgcatagtattccatggtgtatatgtgccagccatcccgttactgggtgtatacccaaaggactataaatctttctgctrtaaagacacatgcacacatatgtttattgcggcattattcacaatagcaaagacttggaaccaacccaaatgtccaacagtggtagactggattaagaaa

SEQ ID NO: 44262 - DNA, 201 bp, Homo sapiens
aattttatggattacatttattttcatttctgtatatttagttaattcttttaaaaggctgcctgttatcccattgtctgtcttcaccatcatttacttaygtaataaatctgttaaataattttaatataaatctattcatctatccatctattaaaagagatttaagttatttctaatctttgcatattataagttgca

SEQ ID NO: 44263 - DNA, 201 bp, Homo sapiens
gcctcaaatttctttagggttatcctttcattccagcaattgaatttgatttgcactgtttcacttctctacaagggtgtaaaaagtagaggttcctcttsaaagaatttcctccccatctaattaggaataaatagtaacttctcttagaagcaaagttaattcaaagacctgtgctaacattcttaaatatctgctagc

SEQ ID NO: 44264 - DNA, 201 bp, Homo sapiens
tcctcctttttcctgaatatggaaccaaagcctgtgtttttcttgctcacatgtgagtcttctccttgcttcaaccctccccgctgacagccacaagactctgcctccctgcagcctgtggaacataatattcgttgggatcatacattgaccaaagatccgccatgtctttgcaactaacatactcactcatgacttcac

SEQ ID NO: 44265 - DNA, 201 bp, Homo sapiens
gaatggggctacataggttgggggaaggaggtaagagaggaagtgaggagaatagggtgggtcgaacctgttgaaggcccagagcttgcttctcttctgcygcctttaggaaacgagatgaattgttaaacttcttgcactgagctttaccaggtgagctgacagttatcctctgcattcatcaatataagccccataaaa

SEQ ID NO: 44266 - DNA, 201 bp, Homo sapiens
tccgctcatattcttgcatttgctgcagcaaaacctgacctctctttgtgttacctgagtcttgacgaagaagactgaggaaaggcccccccccccccccrccaaattgtcccgttgtctcttggctggtcttgccagctggcacacagcttcctctgaccaccctgctaggtacaaatcccacatgaaaagtctcaatca

SEQ ID NO: 44267 - DNA, 201 bp, Homo sapiens
atccgctcatattcttgcatttgctgcagcaaaacctgacctctctttgtgttacctgagtcttgacgaagaagactgaggaaaggcccccccccccccccaccaaattgtcccgttgtctcttggctggtcttgccagctggcacacagcttcctctgaccaccctgctaggtacaaatcccacatgaaaagtctcaatc

SEQ ID NO: 44268 - DNA, 201 bp, Homo sapiens
ctctaccaccatccccagagtgacctccagaactgtaagggacccccgcctttggtacagagatgggagttaaacacaggtgtccactggagtcatgattsctctattccctggacaaatatgcaatgagaatccctgagggacaggcactgtgctagatacccgagatacaaaagcgacaaggtttctatcctctgacag

SEQ ID NO: 44269 - DNA, 201 bp, Homo sapiens
gcctcgttaccacctttctgagaaattcaagtgccacacagtggtcaccagcattgtagctgccctgatgttccgggctcagctgcaatatagcacatctstaccaccatccccagagtgacctccagaactgtaagggacccccgcctttggtacagagatgggagttaaacacaggtgtccactggagtcatgattcct

SEQ ID NO: 44270 - DNA, 201 bp, Homo sapiens
tctgcttcttaatccattagtacctgagtgggggtatataggttttctcaaatgctctaatctccacagaagttaaaatatccctaaacaggcatgtgcayatatgtctttctttcttttcttaggttaacttttttttttttttttccttttgaatgaccacaaagcatatctacccagcggggttactttttttttcct

SEQ ID NO: 44271 - DNA, 201 bp, Homo sapiens
taatttttcatttttggtagagacggcgtttcaccgtgttggccaggcttgtctcaacccctgagctcaggtgatccgcctgccttggcctgccaaagtgmtgggattacagacatgagccaccaaacctggtcaattttctatggtgtgtgttacattttttaaaattttattttaatgtttatatagaaaaagttgcct

SEQ ID NO: 44272 - DNA, 201 bp, Homo sapiens
catccttcatcaaggtgacataggtctggcgatctttttggcatagacgtgtggacgttgtttttgacatttgtacatgcttttgctcaagttgaaggccsaagtttacccaattcgactgcccccacccagatagaatattcatggttagaccataaactacataactggaaattttaaatctatttttatatgcataca

SEQ ID NO: 44273 - DNA, 201 bp, Homo sapiens
caacctaaataaagccacagccagtgttacagaaatagtgtttcgtgattaaaataatggtacttatttgggagagttacttgccacgtttcagatgattkggaggtagtcttttcaggaatattctgagtttgtttcttgatctcgatagcagcaacctttccatttgctctctgtctggtttctctgtgtctctctttt

SEQ ID NO: 44274 - DNA, 201 bp, Homo sapiens
gtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattata

SEQ ID NO: 44275 - DNA, 201 bp, Homo sapiens
gttcattcagttatctcacgtttctggagggccctctatgtgcaatacctagtgatacagcagtgaacaaaggaaatccctgccctcagggagctttcatkctacttggggaaagagacgtgaaagaaatcaagacatgcaagcaaggataagtgctgtaaagataattcattcctgtttagagggctgaggacaggaaga

SEQ ID NO: 44276 - DNA, 201 bp, Homo sapiens
cattttcatggcgatgtgttataacaggacagaccttgtactttggaatcaaacattctcaactctgctatctgctctttgtggggccctgaacaaaaatmtttactctctttgagccttcgcttcctcattggtcaagacttttctcactgcattatatttgagtgagacccgtatcaatggattgaaattctcagaaac

SEQ ID NO: 44277 - DNA, 201 bp, Homo sapiens
gagcaagcatttctaacaatcatattgcttaagaagtggatggcaagaagataattactaatatgtctgcaattgatctgaaattgacacagttgatctcwctgattcatggggaccctgggagtatgtttgtgtatttgggggttgggatgggggggtgggtggagggtcagagaggtggcaaaagcaggtgggaacagg

SEQ ID NO: 44278 - DNA, 201 bp, Homo sapiens
tagttgtagcaaaagtccagggctgccgctcattcactctgctcggacctttctggtcacttgtcttctgtggtttggtccttgtggccagggacaatgawactctcattgattaggcctgagttatgtgctctctcctagagccaggaagaggcttcggccctgcccagacccggtggcctgagagtcacagtgaggcgc

SEQ ID NO: 44279 - DNA, 201 bp, Homo sapiens
atcattgggataactagaaccacagagatccccctagacttgtcagccagggaacctgacactcttagaccttcttctgagtgctttgtccttgtccggasagctcggggaggagcaaggttgtactgggatttttttccgatcacagaaagtaacttagctagctgttgcccagccaatttgcccaagggagaggttgct

SEQ ID NO: 44280 - DNA, 201 bp, Homo sapiens
aagaaaaattctgtgagtctaattatggaaaaaattactaagatatgttttaacatgccctagacatgcacagaaaaaaaagactggaaggaaatttattragatgttattgtttatgagtgttctaattatgatttttaacaatatattatcagagttttctgacaaagaattaactttttattttttttgagacagagt

SEQ ID NO: 44281 - DNA, 201 bp, Homo sapiens
acatttcaactttcttgaactcctgaaccagccttagattgcctagtaccagggttcttctttttttaaaaaatttatattttattttaagttcaggggtmcatgtgcaggtttgttatataggtaaactggcgtgatgggggtttgttgtacagatgatttcatcacccaggtattaagcctagtgcccattagttattt

SEQ ID NO: 44282 - DNA, 201 bp, Homo sapiens
tattataatgtatgtaatatataatatattctatgtaatatataatatattctatgtaatatatattaatatgtagggaatatgttacatattatgttgaragtgtatatattatatatgggtttctatatattataataaacccatatataatatacataatagactatacacatatacagctaatatatatacacaata

SEQ ID NO: 44283 - DNA, 201 bp, Homo sapiens
gaactcctagcctcaagtgatccgccagcctcagcctcccaaagtgctgggatcacaggcataggctgctgcaccaggcaaggacttttttttttttttttaaacaaacttcactcagtttgaaggcaccattatttgggtttcctgttaattgcagttaatcctattgagtaaatgtatcaaggacaaagagcagaatga

SEQ ID NO: 44284 - DNA, 201 bp, Homo sapiens
tttttttttgagacaaggtctcattctgttgcccagactggagtgcggtggtgcgatctcagctcactgccacctctgcctcccaggcccaagcgatcctsctgcctcagcctcatgagcagctgggaccacaggatgcaccaccatggccagataattgttttgcatctttggtagagacaaggcttcactatgttgccc

SEQ ID NO: 44285 - DNA, 201 bp, Homo sapiens
atctgtaaagtaaaaataaccgtcgtcgtcatttctcaagcgtgacgatactgttacacgtttactgcatattctgcataccaagcacatatccgtcacaygcagtgtggccaacttccgagaggccggcattcagccaaacagcctgaagaaccaggagaaatgcctgagtttccaaatggcttatggtaagttgttgct

SEQ ID NO: 44286 - DNA, 201 bp, Homo sapiens
gtctatatattatattataatgtatgtaatatataatatattctatgtaatatataatatattctatgtaatatatattaatatgtagggaatatgttacrtattatgttgagagtgtatatattatatatgggtttctatatattataataaacccatatataatatacataatagactatacacatatacagctaatat

SEQ ID NO: 44287 - DNA, 201 bp, Homo sapiens
taggtgatcccctcaccttggcctcccaaagtgctgggattacaggcgtgagccacgaccaccagcctcagtgaatgttttttaatttggaaaggattttmtaagaaaggattccaactttcccatttacagagaaggaagctgaggctcacaggtttcactcaaaccataaagctcaggagtaactaaaggaactggagc

SEQ ID NO: 44288 - DNA, 201 bp, Homo sapiens
tatattacatatacataatatatacataatatataatagactctataatatagactctaatatgtagtctatatattatattataatgtatgtaatatatratatattctatgtaatatataatatattctatgtaatatatattaatatgtagggaatatgttacatattatgttgagagtgtatatattatatatgggt

SEQ ID NO: 44289 - DNA, 201 bp, Homo sapiens
atatatgtatatacacatatgtatatatgtatgtatagagagtctattatatatattacatatacataatatatacataatatataatagactctataatrtagactctaatatgtagtctatatattatattataatgtatgtaatatataatatattctatgtaatatataatatattctatgtaatatatattaatat

SEQ ID NO: 44290 - DNA, 201 bp, Homo sapiens
tatatgatatatatatcttattatatattatatatatagatagatatctatatacagatatctgtatacagatatctatatatatagatatctatatatayagatatctgtatacagatatctgtatatatatatagaaagagagggaactgaacgggatgctttttattttgggctgttattaggtagactctcctggga

SEQ ID NO: 44291 - DNA, 201 bp, Homo sapiens
aaacactagggttgctttaaaatgtcaaggccaactcttatgatatgcggaagccttcgcccccttcttgagggtgtttagggattagatgagtgtcccakctgggtttcccatccctgcagagcccacgtgtggggtgctgagaggtacgtggtgggtgactccctggggagcactgtttggtactgatcactgtcccat

SEQ ID NO: 44292 - DNA, 201 bp, Homo sapiens
ccctgtctctacaaaaagtaaaaaataaaataaattggctgggtatggtggcacatgcctgtagtcccacccactcgagaggctgtgatgggagaatcacscgaggctggggaggttgaggccgcagtgagccgagatcgagtcactgcactccagcctggacaacagagtgagaccctgtctcaaaaaaaaaaaaaaaaa

SEQ ID NO: 44293 - DNA, 201 bp, Homo sapiens
tagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggttt

SEQ ID NO: 44294 - DNA, 201 bp, Homo sapiens
attactcatctgaagttatactattttaggatcttggggcagtgaggactttggaaatggaacaggatgctcctttaagttagggtaaaatgaagtctatraaaactgtttttctatatcctcctcctaccccacaaagaaagttagggtaatatattcttatataaaattgacatttttaactttaatgagaaattgctt

SEQ ID NO: 44295 - DNA, 201 bp, Homo sapiens
tgaatactgagtaaataaagaaaagttaacacagtggagtccaggtacagtggctcatgcctgtaatcccagcactttgggaggtcaaggcaggaggatcmcgtgagcccagcagttcaagaccagccttggcaacatggtgagaccccatctctacaaaaaataaaataattagctgggcatggtggtacatgcctgtag

SEQ ID NO: 44296 - DNA, 201 bp, Homo sapiens
acacttcccttctctgtgctttagtcaccctaccctcggtcaactcctaactcctgcctgccacagggcctttgcacatcctctgccggggaggctctccyttcaccttcattaggttatcagatctcagctcacacatcacatcttctgagataccttccagactcccctggccacggtcacttcctttgctgtggactc

SEQ ID NO: 44297 - DNA, 201 bp, Homo sapiens
ccttttcaaaacactaagtgcatcatgttaaccttccactcgcttctttaagtttcctcactccttttaggtgaacaacccaaaccctcatatgccctagrggcccttttcagccctgttgacacttcccttctctgtgctttagtcaccctaccctcggtcaactcctaactcctgcctgccacagggcctttgcacatc

SEQ ID NO: 44298 - DNA, 201 bp, Homo sapiens
cctgctcaagttggtatgactggtgtatggtgccttaatgggtacttaaagtccaggtgagagtggcaggaggcagccaaatgcctaggtagataggagcyggtccctgttgaaaccccacttccaagttgaagacagtttaaagactgaaagccaagctacaagttaaatcctcggaccagattgagaacttgtcttctt

SEQ ID NO: 44299 - DNA, 201 bp, Homo sapiens
atgagacgttgcctttgaagtgtcggaaggatggagaggagaaaagaaaacggagattgaatctggaaaacgcattcatctttagaggcagtgttaatgartacatgaatttagtcctgtaaatgttttctcccttatttgggacttggtgtattgaaggtgtctgttaactgtgctaccaatgagtgcccctgtatccga

SEQ ID NO: 44300 - DNA, 201 bp, Homo sapiens
atgattttctccatggcctttctgataatcctttcatccttcatctcccctgtcgccgttttctttgctttgctttgcttgcttttttttttttttttttktgagacggagttttgctcttgtcgcctaggctggagtgcaacggcacaatcttggttcactgcagcctccgcctcctgggttcaagtgattctcctgcct

SEQ ID NO: 44301 - DNA, 201 bp, Homo sapiens
  misc_feature (1)...(201): n = A,T,C or G, or insertion/deletion polymorphism (see Tables 1-2)
gtccagtatattggcctccagggcaaagctacctaggttctgagtccaattatggccttcatgagtcttgtttctttggacaggttttccagtgtctctgngcctcaacttcctcatgtataaagtggagatgatgccattacaggttgctgctttatggcacataattaatactagctcttatttataggaactgaacaa

SEQ ID NO: 44302 - DNA, 201 bp, Homo sapiens
ataccctttaatgattttctccatggcctttctgataatcctttcatccttcatctcccctgtcgccgttttctttgctttgctttgcttgcttttttttytttttttttttgagacggagttttgctcttgtcgcctaggctggagtgcaacggcacaatcttggttcactgcagcctccgcctcctgggttcaagtgat

SEQ ID NO: 44303 - DNA, 201 bp, Homo sapiens
ccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaac

SEQ ID NO: 44304 - DNA, 201 bp, Homo sapiens
tataccctttaatgattttctccatggcctttctgataatcctttcatccttcatctcccctgtcgccgttttctttgctttgctttgcttgctttttttkttttttttttttgagacggagttttgctcttgtcgcctaggctggagtgcaacggcacaatcttggttcactgcagcctccgcctcctgggttcaagtga

SEQ ID NO: 44305 - DNA, 201 bp, Homo sapiens
ctaagccttctcacacctagactttagacttctggcctccagaatactaagaaaataaatttctattgttttaagctaccacacagatgcaggaaactaayataccctttaatgattttctccatggcctttctgataatcctttcatccttcatctcccctgtcgccgttttctttgctttgctttgcttgctttttttt

SEQ ID NO: 44306 - DNA, 201 bp, Homo sapiens
catggtgaaagaagacagacagtgtaatttccctggaaactcaattttgattcagacgtccacagcatctcatttctgcctttaaaaaatttcaagagtgrcattttggcatgattggactcacaggtggagaaggtatgacaaacattctggaaatcttggaaggtgaaatatagggaagatggcccctatggaggttca

SEQ ID NO: 44307 - DNA, 201 bp, Homo sapiens
ggggtttcaccatgttagccaggatggtcttcatctcctgacctcgcgatctgcccacctcggcctcccaaagtgctgggattacaggcatgagccaccaygcctggccctgatttttaaatttttcatggagacagggtctcaccttgttttccaagctgatctcaaaatcctggcctcaagcaatcctctcctctgcct

SEQ ID NO: 44308 - DNA, 201 bp, Homo sapiens
tacaggcacccaccaccatgcctggctaattttttgtatttttttagtagagacggggtttcaccatgttagccaggatggtcttcatctcctgacctcgygatctgcccacctcggcctcccaaagtgctgggattacaggcatgagccaccacgcctggccctgatttttaaatttttcatggagacagggtctcacct

SEQ ID NO: 44309 - DNA, 201 bp, Homo sapiens
atggggctgactgagactggggatgttcatcacaaagtgttcaggttacatccaggctgattactggccaggagactaggcattcatagtggggcgtcctwtaaggtctgaagaggacagtgaccatccaccacaggcaaacatgtgtgtgttaaaaaggaatgacgttttggtctgtgctacaactgggatgaacctcaa

SEQ ID NO: 44310 - DNA, 201 bp, Homo sapiens
tatatgtagtctgtcattgactgaaagttgtcatgtagcccatgactgtcgtctcttttaggggaaaaaacaaaagcagaaagcaagcaagctggtatcckgcgtatctgtgagctcaggaagcagctgcatgtgcatactggataagcaagggagactccaaccccgggctctctaagggtgtaattgttgcaggcacac

SEQ ID NO: 44311 - DNA, 201 bp, Homo sapiens
catagaaatagtacagtaaaaatatgatattataatctttgggaccgccatcatatatgtagtctgtcattgactgaaagttgtcatgtagcccatgactrtcgtctcttttaggggaaaaaacaaaagcagaaagcaagcaagctggtatcctgcgtatctgtgagctcaggaagcagctgcatgtgcatactggataag

SEQ ID NO: 44312 - DNA, 201 bp, Homo sapiens
aggttgctgtgaggcaagatcacaccactgccttctagcctgggcagcagagtgcgaccttgtctcaaaaaaaaaaaaaaaaaaaaaaaaaaaagaaaaaraaaaaagttggaatgacatcagactcaaaatgtgtcacttcgcagtggggatgcaattctgagaaatgcatggttaggtggtttcatcattgtggaacat

SEQ ID NO: 44313 - DNA, 201 bp, Homo sapiens
ccccatctctgctacagatataaaaattggctgggcatggtggggtgcagctgtaatcccagctgctcaggaggctgaggcaggcgaatcgcttgaacccsggaagcagaggttgtagtgagctgagatcatgccactgtactccagcctgggtgacagagcaagactgtctcaaaaaagaataaaaatgaataaaaatta

SEQ ID NO: 44314 - DNA, 201 bp, Homo sapiens
acttgttaacttctgtattgtcttttctgctgctttatccaactttgcaatctataagcttctgttactggaaaatggtgatggtaaagtaattgctttcytatgttccatcacagagggtagactgctagctctagtatttttcaatgctgctttttaagtgatagatgtataccattcagtaccaaccctgcaccctgg

SEQ ID NO: 44315 - DNA, 201 bp, Homo sapiens
aaatggtgatggtaaagtaattgctttcttatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttatt

SEQ ID NO: 44316 - DNA, 201 bp, Homo sapiens
aagttaaaaaatagcacagaggggatccctgtgatttttactcacttttctacaagcatgactccttatataactacagtacaggatccaaaccaggaaayatgcctgggtacaatgtgagtgtataattccaggtaggtaaaataatggcccttattaggatgtctgcgtcctaatccgcggaaactatggatatgcttt

SEQ ID NO: 44317 - DNA, 201 bp, Homo sapiens
ggaaagtgtatagttctcctttccttacagaaacattattttgttattgttgtttgggtttgggtttctgaagtataaatgcatatgaactggacagaagkattatgcccatgtgccaggtggccaagatggggcttgtgatttgaagcttcttttcctagattcaggaaagtatcactggttaatcagggaatacatctt

SEQ ID NO: 44318 - DNA, 201 bp, Homo sapiens
gttttctgtcactattgatgaatttgcattttctagaattttagataagtgaagttttctagtacttgttctgcatctggtttctttcattccacataatkaccttgggatgtacccatactgctgcctgtatcagtggcttactcattgtcattggtgagtagtactccattgtgtggagaaatcacattgttttaaaaa

SEQ ID NO: 44319 - DNA, 201 bp, Homo sapiens
ttagtgtgatttgggatgaaaattttaaaaaatcaatatgtataatccaccatctttgttccttttatttttatgttactcattcttttaagcttgtcttrgacgtgagtattatgttttattttgctgggagaacaatttgggaaaatttgagcagcaaaccataagtttcttggtgtctgtgtacttggagctctgaat

SEQ ID NO: 44320 - DNA, 201 bp, Homo sapiens
gcagagttattcctcaagcccctggactcgcagagaatcaggtgtatgaagcaagaggaagaagacaagaatcaggaggcaaagagaaggaggaagaagcstcagtggggttgcttctttttatttcttagagccagagctggaagacaaggcctggcatattttggcaggcctggatcagagcctaggtgtgtaaattag

SEQ ID NO: 44321 - DNA, 201 bp, Homo sapiens
ttcctgtgcatatatttttgtgtattccgggaggattttcttttctttttctttttaatcctcctcctcaagggaaacattcttctcacaatagcttcctrgtagaaagttctaactaatgactttaatcgtgtgaatgtattgcagaaatggacaggacaattctcagcccattcatcttacagacctcaagtgaacagg

SEQ ID NO: 44322 - DNA, 201 bp, Homo sapiens
cagcagtacattacagggacagtggttgggtctggagatgtcacccttagctgtttttcacaatgagaggttgttttatcataaataaatcaataaatggyagattatacaccggagttactgagaaatataaaaaaaaaaaaagcccacattttaaagggaatttggtatttttaacaaagcatcagggggccgggagca

SEQ ID NO: 44323 - DNA, 201 bp, Homo sapiens
atccagtcagagtgaatcagcttgcccagtgcttggcatatagctgctcaagaaatattaggcattctttgttattataaatcccctttgtattttaaaaycctcatgtatcactgaaacaaccaactgaaaaccattgagaggctcatggtgaaagaagacagacagtgtaatttccctggaaactcaattttgattcag

SEQ ID NO: 44324 - DNA, 201 bp, Homo sapiens
ggtgcccgccaccaggcctggctaattttttttgtattattagtagagatggggtttcaccgtgttagccaggatggtcttgatctcctgtccttgtggtycgtctgcctcggcctcccaaagtgctaagattacaggcacgagtctccgcacccggccctgtttttgcatttttagtagagacgggttttcaccaggttg

SEQ ID NO: 44325 - DNA, 201 bp, Homo sapiens
tgtggctctccccagggcctcccttcttgttctccccagttgcagacctcagacaggagtctgcttgtcttcctaggcccttgtcagagtggaaggtggcyctccaccacaccagcccactttccagttatcaaaaaggatctttgatttaatatttccagagcaattttggtgatttccattcaaatctgttttttgtca

SEQ ID NO: 44326 - DNA, 201 bp, Homo sapiens
ggcagaggttgctgtgaggcaagatcacaccactgccttctagcctgggcagcagagtgcgaccttgtctcaaaaaaaaaaaaaaaaaaaaaaaaaaaagraaaaaaaaaaagttggaatgacatcagactcaaaatgtgtcacttcgcagtggggatgcaattctgagaaatgcatggttaggtggtttcatcattgtgg

SEQ ID NO: 44327 - DNA, 201 bp, Homo sapiens
ttggagacaagcctgggcaacatggcaaaaccccatctctacaaaaaattttaaaaatttagccgggcaggcatggtggctcatgcctgtagtttcagctrttccggaagctgaggtaaggaggatcgcttgaacctaggaggcagaggttgctgtgaggcaagatcacaccactgccttctagcctgggcagcagagtgc

SEQ ID NO: 44328 - DNA, 201 bp, Homo sapiens
tagtatttgccaaaactagaggatgaatgagtgatgggtaagagagttctcagaaaaatggatataaacaatattgtaaatcatatttggaaaataaataytagaatcattgaatccctgagttatagaaaaatttattaatagcgctatctggctactttttaaagtgtggacatcctcgatgtattagctatgcatctg

SEQ ID NO: 44329 - DNA, 201 bp, Homo sapiens
tttcttaccaggagtacatagtttgttctttaagcaaaaccatatgcatcgtattttaaatggaacagggaggttgttccatgcgtcaacttagtccaaawgtagagggtcaggaaaacaatgatatgagaaaagggccggttactgtctgggaatccataaatactgcttggcaaatggcacattgcatgcttattcctt

SEQ ID NO: 44330 - DNA, 201 bp, Homo sapiens
tcatgtctataagacaccaccatttcaaagccaaagagattgtttcaaacatatcatgctcaccccaatcaatgtgggccgcctcctccacatgaaatcamccagaaagtgattgattctgcagagccataaaccagggtctttcctattttcggcaagtggttctgtgctaaatacagtgctttgaaatttttgttcccc

SEQ ID NO: 44331 - DNA, 201 bp, Homo sapiens
ctttgaaagttgtccttctgcacccattttccccagacctaacctcgatttgtgctccaggtctgagcagaaatgttattccctccagaaagccttccctkgatgttgagggatgaagttgtagccccctcccgaatgcgtcctcagaactcgctggttctcgtcctcgccctcagcatacttgctcattgtttgtttcca

SEQ ID NO: 44332 - DNA, 201 bp, Homo sapiens
tgggctggatttgtcctgtggactgtagtttgctgacatccaggctagatccttaatatacaatgaagtagtaaaacacatgtaaaagtaaaaagcaggcraaatagaataaaatacacatttgcacaccacagtatccaaaaaggttatgtactggggctaaagatttggcttggagtttcctggtagtcaaggcaaaaa

SEQ ID NO: 44333 - DNA, 201 bp, Homo sapiens
gcatgtggcccaccagccatggtttggacaagcttagtctacaggttcttcaagaggggcttgagcatttgaaagacttctagtgggagagatcacaaggkacaagtagaaaatcctgggctggcctgagaggcagacctgtgattattttgctctttgaaagttgtccttctgcacccattttccccagacctaacctcg

SEQ ID NO: 44334 - DNA, 201 bp, Homo sapiens
actttaggcattgatgcgcttaattatgcttttcaacaagattttgcatttttaatatttccttttagagcttccaggaatctcaattattaattgtaccstggatttattggtctttggactctcccgctagtataaagactgtagattcatcaaacattgtttactgtcttcaaacttcaacagtgttttaactatcaa

SEQ ID NO: 44335 - DNA, 201 bp, Homo sapiens
ggggtttcaccatgttagccaggatggtctcgatctcctgacctcatgatctgtcagcctcagcctcctaaagtgctgggattacaggcgtgagccactgygcccggccggggatcttgtattaatagtagggagacagtaagcaagcaaggctcagttaatgataaattgttatcaggagacccagcagtttctgctttt

SEQ ID NO: 44336 - DNA, 201 bp, Homo sapiens
aagaaaattaacactattacgtagtattatctaatatgccctctacattcaaattttcatgtctccaatcctgccccctttggaacttctgttggtgttcratctggaatctgagaattcccttgcatttggttttcatcccccatagtcttcctttttttattttttattttatttatttatttatttatttatttattt

SEQ ID NO: 44337 - DNA, 201 bp, Homo sapiens
gtatttttggtaaagacaaggtttccccatgttggccagccttgtcttgaactcctgacctcaggtgatccacccacctcagcttcccaaagtgctgggawtacaggtgtgagccaccgctcctggcacccatcaaattttcaaaggaagaaatggaatggtgcaaccatggtacatgggaaggaggagggggacacacaa

SEQ ID NO: 44338 - DNA, 201 bp, Homo sapiens
gtttgggcactatagccttaaagtttctcctgctctttgcagatgaatgaaggggcgctttctggaatctttgtggctggggctgctgctctgcactgctrtggctctttttcacaaatgcttatggagctctaactgggggcaaggaactgtgctacggttgggaagagaggagtgggcaaaaggagacactggggcttc

SEQ ID NO: 44339 - DNA, 201 bp, Homo sapiens
aggtattgagtcagctctgtgacgccagtgcaattatcccgattcagcatcagatttattcaccattaaacatgttctaacttgattgcaaacaagccttrtattatttagagggatccacggagctggcagagggggcagaggtgtccgcaggcctcctgcccttccaggcttaatggatgatcatcttccctgctaaaa

SEQ ID NO: 44340 - DNA, 201 bp, Homo sapiens
gatcacacagctagatcacagtgggggaacctgaattatggggatgctcacaaaagggcaaaacacaacggttgctgtcatttgatgctttatgttaagtrtgcatatgctcagttacagaaacctaaattgctaaattgcaaggctgtatatgatatgccaatttggcatattctgtctttttatattctgccaccccta

SEQ ID NO: 44341 - DNA, 201 bp, Homo sapiens
tgaaaaaggggaagggagagggaaggaagaggaaaaagcacaaatgtgcttgtttttggatcagcccctgtactgggcacatggatgcagtcagtcctcartgtaccccaggaaagaggaaactgagtctccatgtggctttctgtctggcctttctcttttgcttgccttgtgctttgaatgcaggcctgctgtttgcct

SEQ ID NO: 44342 - DNA, 201 bp, Homo sapiens
cacagtgggggaacctgaattatggggatgctcacaaaagggcaaaacacaacggttgctgtcatttgatgctttatgttaagtatgcatatgctcagttrcagaaacctaaattgctaaattgcaaggctgtatatgatatgccaatttggcatattctgtctttttatattctgccacccctatcatacttatgaaaat

SEQ ID NO: 44343 - DNA, 201 bp, Homo sapiens
tgttgttttcttttcacttgagtttaataaatgaaaaaggggaagggagagggaaggaagaggaaaaagcacaaatgtgcttgtttttggatcagcccctstactgggcacatggatgcagtcagtcctcagtgtaccccaggaaagaggaaactgagtctccatgtggctttctgtctggcctttctcttttgcttgcct

SEQ ID NO: 44344 - DNA, 201 bp, Homo sapiens
gtgtcaaaacaggagctgtatttcatgtcctgaaaagtgtgcacggttggcctcctctaggtcccacgtgccttctggatggttttaaccctcagcctctytttggcctgtgagtgaaacccatcatttgacacagaggctttctggaaatgatgctcctcttagatgaaagttccctttcagaaatctttcattccctga

SEQ ID NO: 44345 - DNA, 201 bp, Homo sapiens
tactttctaaaattctcgggcctttgcaccttctttttatcaacgcttagttctatgttactgaatatttcttaattaagtgcaggaaagaaaataaccaytttttctccttttaaagaagcacacacacctttcttttattggtattacattccttttccctgttggtgcccctgttggttttccaaattgtcttcccat

SEQ ID NO: 44346 - DNA, 201 bp, Homo sapiens
aaacatctgtgcaccagtaaagggttctgatgtgtgataaatttatttagctattactcatctgaagttatactattttaggatcttggggcagtgaggaytttggaaatggaacaggatgctcctttaagttagggtaaaatgaagtctataaaaactgtttttctatatcctcctcctaccccacaaagaaagttaggg

SEQ ID NO: 44347 - DNA, 201 bp, Homo sapiens
gaggaccttgtgttcctgctggagagtgagagtccctccctccccattccactcccaagagcagtgaagagtcaggaaggtgggcttgttttgttttgttwtgttttgttttgcttgttgagcaagggaatgcggttcccctgtgtcggacttgtttcagaaagacaatgtcactgaggctggggcagggagattagctga

SEQ ID NO: 44348 - DNA, 201 bp, Homo sapiens
taaatgaagcaccgccaggcccagttggggaggaccttgtgttcctgctggagagtgagagtccctccctccccattccactcccaagagcagtgaagagycaggaaggtgggcttgttttgttttgttttgttttgttttgcttgttgagcaagggaatgcggttcccctgtgtcggacttgtttcagaaagacaatgtc

SEQ ID NO: 44349 - DNA, 201 bp, Homo sapiens
aacccaactcctagccactgctttttgagcagctactcagtgcctaagactttgaatagtttattaatcatgtgtcactgcagcaaaggggacatttcggycctgatttcagagatgaaagaaccaaggcatagaaattgagtcactttctggagtgtacacaactagtaagtggattcgagttagttttgctctattcca

SEQ ID NO: 44350 - DNA, 201 bp, Homo sapiens
agtagctggtactacaggtgcctgccaccacgcccggctaattttttatatttttagtagagacagggtttcaccatgttagccactttggtctcaatctmctgacctcgtgattcaactgcctcgccctcccaaagtgctgggattacaggcgtgagccaccgcacccagccgaaaagttataattttaatggtctaaat

SEQ ID NO: 44351 - DNA, 201 bp, Homo sapiens
tttttcaattccagagatgttttcacctggaagattccccagatttggcaaaaacaacccaactcctagccactgctttttgagcagctactcagtgcctwagactttgaatagtttattaatcatgtgtcactgcagcaaaggggacatttcggccctgatttcagagatgaaagaaccaaggcatagaaattgagtcac

SEQ ID NO: 44352 - DNA, 201 bp, Homo sapiens
ctttttacagtcatgtgctttcagcccagtaccctttgctatgccaagatccagctgaaactgaaccaggtgggggaggcctgctaatgcccaggcagtcraaatgacgccatctcatcactccttttcttaaaatttttttttgtctttcttcttggatttccagcaacagggagctgccaccaccgtgtactgtgctgc

SEQ ID NO: 44353 - DNA, 201 bp, Homo sapiens
tgtgagccaccgctcctggcacccatcaaattttcaaaggaagaaatggaatggtgcaaccatggtacatgggaaggaggagggggacacacaagactgtrcctatcatgggggcttcgacctcatctgggaaggtggttggagagagtgagtcctgacctgagctttggaacttatcaagttgagagagaaatttgataa

SEQ ID NO: 44354 - DNA, 201 bp, Homo sapiens
catagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctct

SEQ ID NO: 44355 - DNA, 201 bp, Homo sapiens
aattaatgttgagaatctagtcaatctgccagcagtacgtacataactgttctgtgtatatttcacatggccatatatgttttgcttgtgtggtgctaaaygcaaaggcagagaagcttctgctattgaatgcttagcacagaactcctgtcctccctctttgaaattattccgacagttgcccctcatttggcttgccaa

SEQ ID NO: 44356 - DNA, 201 bp, Homo sapiens
tttccctataacatggggctggggagcaagtgccaaacagggaatgttctgaaaactccttaggcacaagctgaagatatgtttgaggttttggatacagwacatttataggatatcttttggtggtccaagaggacttgagtgtaccttgtaaatacaggattttgtttttaattagattgattcacagagaaccaaacc

SEQ ID NO: 44357 - DNA, 201 bp, Homo sapiens
attctagcaaactgctctcatatcctgtgatcttaaaatttatttattcaccttttcctttttgttaaatagattctgtagaattctctacatctctgaayatagttttacttcttctccaatttttatggcttttgtttctttttcttgttttaatgcactggctatagcctgtaggacagtgttgaacagaggttttga

SEQ ID NO: 44358 - DNA, 201 bp, Homo sapiens
gttccacatcctccctgtgggactaggggccagggcaatgggaatcagtgcagaaataaagctcatgctgtttgctctgccatgagtaacgaagtcctctrtatctgatcctgggtctcctgttttctgctagcttcctcaaaacttggtagctaactcattaacttacaaggaagaggttgaacgtgtagacccttcaca

SEQ ID NO: 44359 - DNA, 201 bp, Homo sapiens
cccagattgatcttttctggatattgggtcaaccataagatggtacctttccctgtgtaacaaagtcagattctgtgaaacacctgttttttgtatggctyatgagatgaggatgatttttacctttttttttttttttttcccttgagacagtgtcattctattgtccaggctggagtgcagtggtgcaatctcagctca

SEQ ID NO: 44360 - DNA, 201 bp, Homo sapiens
gttctgaacttgctgttataattattcacattttcttgcagtgaaaatctacaggtcaaggtcatcttcacgtctttagttcttgttttgcttcaggtcastttagaaccgaatgttaaaaggatattgtctattcgaagggtcagattgtggcacgtggaccaaatccagccccccgaggcccacttttgtaaatcaggt

SEQ ID NO: 44361 - DNA, 201 bp, Homo sapiens
tttgggttgatgagatgctggtatgtatcattcgttcagccattctttcagtaagtcatcacggaagtctgcctctgtgacagattctggggctctaaggmggaatttacttcttcaaagtacagtttcctgccttgcaagtttggagttaaggccacgcagaccagagttacgtgcacaggttgtaatactctctcttgt

SEQ ID NO: 44362 - DNA, 201 bp, Homo sapiens
acagcggagacagtgaggtcctgtaggatgaggttggagagcaggaacttgcccgaggtcatgtgcagagttcgaggcagggcctggatgggaagcccagsatggagaccccaggccgtctctccgccatcttgttgtgatgcttccggaagaatgcctgtcactcttgctgacatccgactgaccaagtgggcaagagga

SEQ ID NO: 44363 - DNA, 201 bp, Homo sapiens
gcatcagccttagcccagacccccaaagttcctgggcttcattctgctttgcattcatctcaaagttaagccttctggctggcaggggtttctgagacagwctgacagtattagcgtgctgcagtttcatgatggcaagaaggaggttaccaaagccgttttcatacaccttaactcatgagtggtagtgagtggccccag

SEQ ID NO: 44364 - DNA, 201 bp, Homo sapiens
ggaggtatgtgctgaggatctctttggcttctgcatctcaaaggatgagtgatttagccaggtggagaggttggggcggtatcctgaatgaaagaatagcrcagacaaaagtagtgagttgaaaacagaacagcatggcaggctcccagtaatcccatgagtcacgtgttctgcccacatggaatggatggtggagaaggg

SEQ ID NO: 44365 - DNA, 201 bp, Homo sapiens
aggatcctaaagagaagatgtaattataagatctaaaacgtggaggggggtggtgaattcagcctgcaggcatgtgtttgctgcccccacccccacatccyctttttttaaagttcgcataaaaacctggattcttggtttctcttaaaaaactggaaggtctggcacctttgctcccacatttcccgggcgcagcccttg

SEQ ID NO: 44366 - DNA, 201 bp, Homo sapiens
tttggctcgttttcagtttttattaatttcctgtgcttctggttcatgaatcccaagtcatgatgtgaatcagttcagttcagcaagcactgagctcccaygatataacaggtttttttcttttccgagctgtggcccatgcagagtttactgagacttggctcttgcctttatgctttaaggatcctaaagagaagatgt

SEQ ID NO: 44367 - DNA, 201 bp, Homo sapiens
agttttccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataa

SEQ ID NO: 44368 - DNA, 201 bp, Homo sapiens
atgctaatagtaatgatactagtaataaaatcaggataatgctgtttttaattcaccacactgtatgccatttgcttaaaatcagaaaggactcatcggtraggagtagggtggtagtatcattttggtctgcctttcacccccacaagacaacatccttaacagcagctatgttgaaggtttaggagtgcttgtcattag

SEQ ID NO: 44369 - DNA, 201 bp, Homo sapiens
ccaagcaccttggataggcaatgggaaatgttcacaacgttcccatttttacctataacagcagtagcaataatgctaatagtaatgatactagtaataaratcaggataatgctgtttttaattcaccacactgtatgccatttgcttaaaatcagaaaggactcatcggtaaggagtagggtggtagtatcattttggt

SEQ ID NO: 44370 - DNA, 201 bp, Homo sapiens
cctcattacctatagaataactccaaactttctgatgattaagtgagatatcatgtaaagtaccaagcaccttggataggcaatgggaaatgttcacaacrttcccatttttacctataacagcagtagcaataatgctaatagtaatgatactagtaataaaatcaggataatgctgtttttaattcaccacactgtatg

SEQ ID NO: 44371 - DNA, 201 bp, Homo sapiens
agcaccatgccattcacacttcagaaccaagctcagatccatgtgtgacactctggaatgtggcagctgatggaggaagggggctgaagttgaatctgcastagttgagttaaccttcccatggtgcctgcactagcagggactggactgagaccccagctttcccagtcaggccttcatttttctctcatggtgagagct

SEQ ID NO: 44372 - DNA, 201 bp, Homo sapiens
tgggcttgcttccacttgtggccaggagaggatatttcttactccagatcaaagagttgagacattgccttcccacaattcccagtgagcccaactccttrccacaattcccaccccatgccttccccaaattcctgatgagccctatgccttcccacaattccctgtaaattttgctccttcccacaaccccagtgagcc

SEQ ID NO: 44373 - DNA, 201 bp, Homo sapiens
gggaatagatgaagcaagctgcttctttcaaatgctcttccaatatgaagcaaaatattattgatctagactgcctgctactttcatttaccatgttactrctcgtgggattacaggcacaaaggtttcataaatttcaaatgaaatatgaacatttgttgtcaaagtactgttaaggtatgaaaaccctgctagtattag

SEQ ID NO: 44374 - DNA, 201 bp, Homo sapiens
agctgaaactgaaccaggtgggggaggcctgctaatgcccaggcagtcgaaatgacgccatctcatcactccttttcttaaaatttttttttgtctttctycttggatttccagcaacagggagctgccaccaccgtgtactgtgctgctgtcccagaactggagggtctgggagggatgtacttcaacaactgctgccgc

SEQ ID NO: 44375 - DNA, 201 bp, Homo sapiens
tattcagttgcccagctcttttcattccctgtcctttccccctctggctgggtctgcctttccaaccgctaccaccttccaccaccattttttttttgttkcctctgcaagcaacatctgaaaggcccagacccagcttgttggccttgggctctgataagatctgtctgcactccttttgtctggcctgtacctgccttt

SEQ ID NO: 44376 - DNA, 201 bp, Homo sapiens
tgttgcaaatttccagtggctagttcagggacagtgccggggcttgaacccctgtctctgtgtctcccagctcataaggtgtgctaccaagtcacccatgwgtagcaattaggcgacttctaacatgtccagctttaaacctgtgacctcaaggcaaatgacttccacatctcattagcactccccagagccttccagccc

SEQ ID NO: 44377 - DNA, 201 bp, Homo sapiens
gattcctccccattctataaaataacagctaccatttcctgagggcatactgagtgctgacaggcacatcaacatcagaccatcaccttcttatacctcaraatagtctgcagggtgactcagaagctcctggctggtaagtggcagatccagagatgaaacccagatctaactggacccaagacagaaatttctagaaca

SEQ ID NO: 44378 - DNA, 201 bp, Homo sapiens
cccagtgtgtcacgccattacatgcttacagcctatttttacaaagtttgaatattgtaatttgcctttaaaaaattgttttaaagatctgcctaggtcarcaaattttatttactctctagaaccatttgattggggtactgccttaagaaataaagcagattccttcagtcgcatgtgggcctggagtcactggaaaat

SEQ ID NO: 44379 - DNA, 201 bp, Homo sapiens
tggttttaaaagacgccatggttgccatgaggaggacaatgcgtaggaggcaggagtgaaagctaaaggatatgctgggaggtgaccctggagttaaagaragcaactaaggtgaccaggtgacaataatggagatagagaaaacaggatggattcaggaaacatgaccacactgagcatattcaaatgtaattgtcagtt

SEQ ID NO: 44380 - DNA, 201 bp, Homo sapiens
ttcattgttgtccttttttattaaaacaggttttgtttttttgtgtgtgtgttattttgttttttgtttttttgtttttcgggggctggagtagtgtgcaragcctggcggtgattgttctcattagaaagtatagtgtaatactcaataaattacttttgttctcaccttgggaagtggactcagaggccaagtgacttt

SEQ ID NO: 44381 - DNA, 201 bp, Homo sapiens
ttttttttttttgagacagggccttgctttgtcaccctggctcaagtgcagtggtagaatcatagctcactgcagcctcaaactctttggctccagtgatyctcccacctcaacctcccaagtagctgggactacaggcgtgtaccaccatgaccagctaatcttttagtttttgtagagacaagttcttgctatgttgcc

SEQ ID NO: 44382 - DNA, 201 bp, Homo sapiens
ctttttctttcttttttttttttttgagacagggccttgctttgtcaccctggctcaagtgcagtggtagaatcatagctcactgcagcctcaaactcttkggctccagtgatcctcccacctcaacctcccaagtagctgggactacaggcgtgtaccaccatgaccagctaatcttttagtttttgtagagacaagttc

SEQ ID NO: 44383 - DNA, 201 bp, Homo sapiens
gcttggaaggtggcgcaaataactgcttgaggctccctctcttgggccaagcttgactctggattttcattgttgtccttttttattaaaacaggttttgkttttttgtgtgtgtgttattttgttttttgtttttttgtttttcgggggctggagtagtgtgcagagcctggcggtgattgttctcattagaaagtatag

SEQ ID NO: 44384 - DNA, 201 bp, Homo sapiens
gctggagtgcagtggtgcgatctcagctcactgcagcctctgccccctgggttgaagcgattctcctgcctcagcctcccgagtacctgggactacaggckcccatcaccatgacaggctgattttcttttttttcgtaggacgaggtttcagcatgttcgccaggctggtcttggattcctgatctcacatgattcacca

SEQ ID NO: 44385 - DNA, 201 bp, Homo sapiens
ccttggtctcagggtggttgaccttttgccgatgtgtttttctttcttttcttttcttttcttttgttttcttttcttttctcttctcttcttttcttttytaacagtcttgctctgtcttccaggctggagtgcagtggtgcgatctcagctcactgcagcctctgccccctgggttgaagcgattctcctgcctcagcc

SEQ ID NO: 44386 - DNA, 201 bp, Homo sapiens
tttccacaccctcagcacctccagtttttcctggccttggtctcagggtggttgaccttttgccgatgtgtttttctttcttttcttttcttttcttttgktttcttttcttttctcttctcttcttttcttttctaacagtcttgctctgtcttccaggctggagtgcagtggtgcgatctcagctcactgcagcctctg

SEQ ID NO: 44387 - DNA, 201 bp, Homo sapiens
tggacaagaggtcacattgccttttctagcttggaaggtggcgcaaataactgcttgaggctccctctcttgggccaagcttgactctggattttcattgktgtccttttttattaaaacaggttttgtttttttgtgtgtgtgttattttgttttttgtttttttgtttttcgggggctggagtagtgtgcagagcctgg

SEQ ID NO: 44388 - DNA, 201 bp, Homo sapiens
ttccttttgagcccagctctccctttgtgacccagcaacttccttccccgatgatggccaagccttgaggatgtgaaactgcccagtgccccaatctggartccaccatcctgggtctagctggggacatccttgaatcagcctctgggaatcactgaaccaacatgagtcacttgctactgtgagatctcaaaacacatg

SEQ ID NO: 44389 - DNA, 201 bp, Homo sapiens
catttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcagcctc

SEQ ID NO: 44390 - DNA, 201 bp, Homo sapiens
tcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcagcct

SEQ ID NO: 44391 - DNA, 201 bp, Homo sapiens
atcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcagcc

SEQ ID NO: 44392 - DNA, 201 bp, Homo sapiens
aggcctgagcaaaagacacagaaaggatttctttatcgtaagcacacttctctacattacctttataatccaacaactctgctattagtaaattatagaamcaacttttgtaacactatcttgtttgcagagtatatgaaaaatttgaagttaaaattcagctccacgaatactgcagtggtgagaaaatggcgacaaaga

SEQ ID NO: 44393 - DNA, 201 bp, Homo sapiens
aggccaagaaaggggtgggagaaacgagcaaggtgttgatagaaccccttagtgtcctcctcataccacagacactctcttcccccacttacttggccaawttttttttttttttttttttttttttggtggagtctcgttctgtctcccaggctggagtgcaatggtgcgatctcagctccctgcaacctctgcctccca

SEQ ID NO: 44394 - DNA, 201 bp, Homo sapiens
aatcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcagc

SEQ ID NO: 44395 - DNA, 201 bp, Homo sapiens
cacgaacaaattgccaaatgcaaggcctgagcaaaagacacagaaaggatttctttatcgtaagcacacttctctacattacctttataatccaacaactytgctattagtaaattatagaaacaacttttgtaacactatcttgtttgcagagtatatgaaaaatttgaagttaaaattcagctccacgaatactgcagt

SEQ ID NO: 44396 - DNA, 201 bp, Homo sapiens
tgcactcctgtctgggagacagagggaggagactccatcaacactaataataataaagtaaataaaagggcactaaccctactcaggaagccttcactctmatgacataattacctcccaaagtccgcacttcctaatgttaccactctggaggttagaatttcaacatataaattttggggggacacattcagaccacaa

SEQ ID NO: 44397 - DNA, 201 bp, Homo sapiens
aaatcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatctcagctcactgcag

SEQ ID NO: 44398 - DNA, 201 bp, Homo sapiens
tcccatcacgaacaaattgccaaatgcaaggcctgagcaaaagacacagaaaggatttctttatcgtaagcacacttctctacattacctttataatccamcaactctgctattagtaaattatagaaacaacttttgtaacactatcttgtttgcagagtatatgaaaaatttgaagttaaaattcagctccacgaatac

SEQ ID NO: 44399 - DNA, 201 bp, Homo sapiens
cttgaagccaagcaaaatcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgatc

SEQ ID NO: 44400 - DNA, 201 bp, Homo sapiens
tcttgaagccaagcaaaatcatttccacaccctcagcacctccagtttttcctggccttggtctcagggtggttgaccttttgccgatgtgtttttctttcttttcttttcttttcttttgttttcttttcttttctcttctcttcttttcttttctaacagtcttgctctgtcttccaggctggagtgcagtggtgcgat

SEQ ID NO: 44401 - DNA, 201 bp, Homo sapiens
ttgataatgctgatgtgactggacttttgacaagcagtctgggacttctgctgaaaagtgctcttgaagccaagcaaaatcatttccacaccctcagcacytccagtttttcctggccttggtctcagggtggttgaccttttgccgatgtgtttttctttcttttcttttcttttcttttgttttcttttcttttctctt

SEQ ID NO: 44402 - DNA, 201 bp, Homo sapiens
ccaagcccagagttcatttaagtggcagcgatgggaccaaattataggccaggtctgtcttatgaaagatgataaatggatgtgtcatatcgggaaagaartcactctgtcatcatatgacaggctggcttgatttctttgcaccagtgtccctaaaagttgggatgggggtgtgaagcgtgccagctttcaaagccagtt

SEQ ID NO: 44403 - DNA, 201 bp, Homo sapiens
tgtttaatttataatttttgtttttatcattaaaagcaacagattgctgtattcttgcctgccactgacatggacttaattgtttcatttagacatttaartgggcaatacacttaaaatgcagatataactttaattgtcaaaacatgcttattttaggaaatgtgtttctccagtaaagctcagtatctggggcttttt

SEQ ID NO: 44404 - DNA, 201 bp, Homo sapiens
cagcccaacacaaatgtataaacttgcttaaaacatgatgagatattttttgccattttttttcaactcatcagctatcattagggttagtgtattaataytttatgcacagcccaagataattctttgtccagtgtcacccagggaagccaaaagattggacaccctgggaataaaacagaaaaaaggtgtaaaaggctt

SEQ ID NO: 44405 - DNA, 201 bp, Homo sapiens
cctcctaatactgcatgacggataatatgccatcacatggtgtcatttaatatattcattcctatttatagacattgaagttagatccatgtcttactatyacacatgacttagtaatgaatgttcctgcatgtatatttggtctgcttgagcaaggatattgggagggaggatttccagcagcagaagtggtggaacaaa

SEQ ID NO: 44406 - DNA, 201 bp, Homo sapiens
tgttgtgggcttggggaaacagaaggaaattggagacattgatatgcttcctgagaggtggaaggggccacttaacacagctttcatttttcagttgccartgggagaggagctggggtgggcatataatgagtaacattcaaagctccttctgtctttttttcagagaattcacaaaacaactcagggcctcctggtcct

SEQ ID NO: 44407 - DNA, 201 bp, Homo sapiens
actaaaatgccagcatcactgttacttactgtgtttctctggatgtattacttaacctctctggctttatttctgcccgccctccccccgccccccccccscaatgcctcaatctgtggcagagttgttacattattgaaaaagaacataaagcatattttctggcatacagcatatgtttaatttataatttttgttttt

SEQ ID NO: 44408 - DNA, 201 bp, Homo sapiens
tattctgtctttttatattctgccacccctatcatacttatgaaaatgccaggttgtaatcattcactgggagaaacaaggggttgaacattgttatcgcrcaaaggaagctgggcctagtaaaggaatgtaaatactaaaatgccagcatcactgttacttactgtgtttctctggatgtattacttaacctctctggct

SEQ ID NO: 44409 - DNA, 201 bp, Homo sapiens
aaatgtccagctttctttcttttattcaaaatttatacttcataattgaagttcacctcccaaaagacatagcttggtttagcatagagctatgatgtgtkttctctttgttccttttgcacactttccttgtctggaggcgttgggcttggatccttcattcttcatgaggctgatgtttttccatttcggtttccttaa

SEQ ID NO: 44410 - DNA, 201 bp, Homo sapiens
ggctggagtacagtggcacgatctcagctcactacatctctgcctcccgggttcacgccattctcctgcctcagcctcctgagtaggtgggactacaggcmcccgccaccatgcccggctaatttttttatttttagtagaaacggggtttcaccatgttagccaggatggtctcgatctcctgacctcatgatctgtcag

SEQ ID NO: 44411 - DNA, 201 bp, Homo sapiens
aaaatgtccagctttctttcttttattcaaaatttatacttcataattgaagttcacctcccaaaagacatagcttggtttagcatagagctatgatgtgktttctctttgttccttttgcacactttccttgtctggaggcgttgggcttggatccttcattcttcatgaggctgatgtttttccatttcggtttcctta

SEQ ID NO: 44412 - DNA, 201 bp, Homo sapiens
gtttacatgaggggctgctgcttgtgttgtacattctataggtttgttcaatgcataatgacaggtgtctgtcatttcattatggagtgaaaccattccartttcatacagcgtagtttcacgcctctaaaagtcccctgaaagtgttattaaaagtactatctggccatgtcctcatttccccagcaaagtccttctgag

SEQ ID NO: 44413 - DNA, 201 bp, Homo sapiens
aactcctgagggatgctcaggaaaccaaaaaggatgtctgcatggaggacaagaaggcacaaatcgtctgatttcaccccatcctaagatcttgtgactthagctttgttttggactggggcattggatctcccacatgccctctcttaagtcgtgcatttgacgcatatttaataagcacctactgtgtgccattagaga

SEQ ID NO: 44414 - DNA, 201 bp, Homo sapiens
ggtgcctaaagtttgagaacttctgatcaaaaatgccagataagaaaaaaaaacctttcgagacatcatttgaatcaattatcaaatgtttccaaagtgcrcttgctttgcaaaccactgtactactcatctctgcctccatcggagcgagttcaggagagttgtgtttacttttctaaaggagccttttccttcccattt

SEQ ID NO: 44415 - DNA, 201 bp, Homo sapiens
atttaaggtactgttaaaaagaaaaaacacagaacaacacagtgagagcagaaaaggtatcatctcctccccctcttcttctcttttagaaaccttgctgcgtgatccactgatggtaaatatttcatgtactttgcatatcagcctgagttccttttgtgaagtcaggtaaatggaatgtaaatcccctcgtcctccaga

SEQ ID NO: 44416 - DNA, 201 bp, Homo sapiens
gatttagaatcagaaagtgtgagttcaaattgccttcggctcttcacctgggtgggcgatttgaatagagctcacagccctgaaaaccctggttttcagaytctttattggtaaatgaagtcagcttagtgatatgagaattatgaaacataaatccctttgtaaaaatataaaataatcttacaatcatcatcgtcatcc

SEQ ID NO: 44417 - DNA, 201 bp, Homo sapiens
catttaaggtactgttaaaaagaaaaaacacagaacaacacagtgagagcagaaaaggtatcatctcctccccctcttcttctcttttagaaaccttgctgcgtgatccactgatggtaaatatttcatgtactttgcatatcagcctgagttccttttgtgaagtcaggtaaatggaatgtaaatcccctcgtcctccag

SEQ ID NO: 44418 - DNA, 201 bp, Homo sapiens
tcatttaaggtactgttaaaaagaaaaaacacagaacaacacagtgagagcagaaaaggtatcatctcctccccctcttcttctcttttagaaaccttgctgcgtgatccactgatggtaaatatttcatgtactttgcatatcagcctgagttccttttgtgaagtcaggtaaatggaatgtaaatcccctcgtcctcca

SEQ ID NO: 44419 - DNA, 201 bp, Homo sapiens
gcctgccttggcctgccaaagtgctgggattacagacatgagccaccaaacctggtcaattttctatggtgtgtgttacattttttaaaattttattttamtgtttatatagaaaaagttgccttatcaaccattataatcatggtatttagtgagtgtaatctgttctgatgtaatacttagtttaactggtaaaaaata

SEQ ID NO: 44420 - DNA, 201 bp, Homo sapiens
tgcagtggtgtgatctcggcacactgcaaccttcgcctcccaggttcaggcgattctcctgcctcagcctcctgggtagctgggactacgggagcatactmccacacccaggtaatttttcatttttggtagagacggcgtttcaccgtgttggccaggcttgtctcaacccctgagctcaggtgatccgcctgccttggc

SEQ ID NO: 44421 - DNA, 201 bp, Homo sapiens
caggcctggagtgcagtggtgtgatctcggcacactgcaaccttcgcctcccaggttcaggcgattctcctgcctcagcctcctgggtagctgggactacrggagcatactaccacacccaggtaatttttcatttttggtagagacggcgtttcaccgtgttggccaggcttgtctcaacccctgagctcaggtgatccg

SEQ ID NO: 44422 - DNA, 201 bp, Homo sapiens
ttcaaattattcccccctttacagacacagaaactaagatttagagaggttatgcaatgtgccaacagggagaagttggagctggaatttgaaccaggctrgctgactccaaagctgtgtcctcaagcagtacatcagagccgaggaaggtcaagtttggaacgccatttagctgctctcagggagtctgattactgtttc

SEQ ID NO: 44423 - DNA, 201 bp, Homo sapiens
tagttctgtccctgaaggtgagggccagacaacacatcaaaactgactttttattttttttcaaagttgttaagactatctaagattcagatctccctaawactgttcctagttagtatttagaacgtatttgtttagaggatactagcctgaaatagccctatctccaggttgtctgatgcgatgaggatgtggtgttaa

SEQ ID NO: 44424 - DNA, 201 bp, Homo sapiens
ttccttctactttggtgccccatgatgatgtgcatcttttttatttctgcatcatatccatatagtgatatcatgtataatgatgtttaagaagacagttwtttttgtttaaattgttataaataagtaagtgtatgcaccactatgccatgtagcatatcaagattatttttctttcctgcaccttattttttccctgga

SEQ ID NO: 44425 - DNA, 201 bp, Homo sapiens
aaggtaatattggcatatttatttttatctgtgtaatttttgcaacttataaccccttcaggtccaaatgaaacaggcaaccaggtaataaaccaattacrttctaatacagattacttcatgacagtgtcttattttccagtttatatgtaggtgagattctttggagaccgtcttcgtaatatagctagtttttgtcca

SEQ ID NO: 44426 - DNA, 201 bp, Homo sapiens
aatatgttcgattgaggtttgtgtctgtaatttggaacggctttttgttgcaactaaaatattcatttgcagaaattatcactgagggtgttagcttcttyatgcttgcgtttcttgcatttgttactaaataaaatatttagaagtcacgtcgattttcaaaatgatagttaaggatgaaggtaatattggcatatttat

SEQ ID NO: 44427 - DNA, 201 bp, Homo sapiens
tgagactacaggcgcatgccaccaccgccagctaatttttgtatttttagtggagacgaggtttcaccgtgttggccgggatgctctcgatcttttgaccwcgtgatccgcccgccttggcctcccatagtgctgggattataggcgtgaaccaccgtgcccggcagggagtaacatttctatgcaactatatgtgggtgt

SEQ ID NO: 44428 - DNA, 201 bp, Homo sapiens
cctcagcctcccgagtaggtgagactacaggcgcatgccaccaccgccagctaatttttgtatttttagtggagacgaggtttcaccgtgttggccgggaygctctcgatcttttgaccacgtgatccgcccgccttggcctcccatagtgctgggattataggcgtgaaccaccgtgcccggcagggagtaacatttcta

SEQ ID NO: 44429 - DNA, 201 bp, Homo sapiens
atgtcctaaattaatgtgtttaaagagaaaatttcaccagtggtaattttttttttttttcccctgagaaagtcttgctctgttgccaggctatagtgcastggcgtgatctcagctcactacaatctctgcctcctgggttcaagcaattctcctgcctcagcctcccgagtaggtgagactacaggcgcatgccaccac

SEQ ID NO: 44430 - DNA, 201 bp, Homo sapiens
atattttaccacaaattaaagaaaattaatatttccaacaagccaaagctctatgtaaatgtcctaaattaatgtgtttaaagagaaaatttcaccagtgrtaattttttttttttttcccctgagaaagtcttgctctgttgccaggctatagtgcactggcgtgatctcagctcactacaatctctgcctcctgggttc

SEQ ID NO: 44431 - DNA, 201 bp, Homo sapiens
cctcccaaagtactggattacaggcatgagtcactgcctggtgctttctttttgtctttttctaataaccattgctatagatggttgtccttaacgcgtawatgtttaaaatacctaaatgcctaaacgtttgaaaacattccttaaaaattgaagttatagcatactaacaagtgttcatttttataattgctgatttaa

SEQ ID NO: 44432 - DNA, 201 bp, Homo sapiens
ataagccctgaagtctggacactgagagaattctaggcttgacttctctgtacagccatcttgggagtgctcaaccctttgaatcggatgtctagaatggmctcagatgtcactgtgcaggtgactcacgcctagaatcctctgcctatcgtgacagggagaagcctgtgtgaccctgtggccatctcagtctctgcaggg

SEQ ID NO: 44433 - DNA, 201 bp, Homo sapiens
taagccctgaagtctggacactgagagaattctaggcttgacttctctgtacagccatcttgggagtgctcaaccctttgaatcggatgtctagaatggaytcagatgtcactgtgcaggtgactcacgcctagaatcctctgcctatcgtgacagggagaagcctgtgtgaccctgtggccatctcagtctctgcagggc

SEQ ID NO: 44434 - DNA, 201 bp, Homo sapiens
ctcttccccacttgcccacgagcagcaactcctgtttcttgtttttttccttttctttttcttttcttttgagacagagtctcgctccgtcgcctgggctrgagtgcagtggtgcaatctcagctcactgcaacctctgcctcctgggttcaagcgattctcatgcctcagactcctgagtagctggtattataggcgcac

SEQ ID NO: 44435 - DNA, 201 bp, Homo sapiens
acaagatgtttaaatcactagtaaaatttggccagacacggtggctcatgcctataatcctagcacgttgggaggctgaggtgggtggagcacctgaggtkaggagttcgagaccagcctggtcaacatggtgaaaccccatctgtactgtaaatacaaaaaattagctgggcatggtggcaggcacttgtaatcccagct

SEQ ID NO: 44436 - DNA, 201 bp, Homo sapiens
cagagcttacaagttattcaacagccagatttctattctgatatgcccttttagttttcaaagcatcgaaaaagggtaatctttagaaccgaagtatttgsaaaactcctagacttgaataaggtatttttgaatttgaagagctaagaacccatcaaatcaaaatgctaataattcttccaagtcaaaaggtaactctca

SEQ ID NO: 44437 - DNA, 201 bp, Homo sapiens
gctgctttatggtatttgtgatatatcatgtgaatatacttgagggtcatgagaagttcatatgtgtgtgtgtagtgtgggccccagactttcgccacacygctggctaaagtggccatgtttttgtacgtctctgcagagcttacaagttattcaacagccagatttctattctgatatgcccttttagttttcaaagca

SEQ ID NO: 44438 - DNA, 201 bp, Homo sapiens
tgccttggcctcctaaactgccgggattacaggtgtgagccaccacacccagcccctctccctattttaatgcgaggtaattaacaaccttaatttcaccrgtaacctgaattctcctttgccacgcagtctaccatattcacgggtttcagggattaggacctggacatctttggttgggaaatgggcatcattttgtct

SEQ ID NO: 44439 - DNA, 201 bp, Homo sapiens
gcaaccaaagggagcataactctgataagaataataaaaagaaacaattcagcaactctcttacagatttttatcatcatcccattcataattgattccaracgtgcatgaatctttcaagataagtgtcttattgattatcctgaaaacaagcgatcacttggtgtcctgagattcgctcactgccctcccctgattacc

SEQ ID NO: 44440 - DNA, 201 bp, Homo sapiens
caaatgcagcatcgcttgaagctgtgataaaatatcacacctttggaaatcaaggctcttcttgtttatttatttaactcacattaattagccttaatttwaaaaaaatgagaagagccagcatcatgatgcaagcattgactttgctcacaaaaacatcttgtggtcaacagtggggcttagggggcaggttttgtggct

SEQ ID NO: 44441 - DNA, 201 bp, Homo sapiens
atgtgtggccaatctcacaagatactaattctttttttcaaatgcagcatcgcttgaagctgtgataaaatatcacacctttggaaatcaaggctcttctkgtttatttatttaactcacattaattagccttaatttaaaaaaaatgagaagagccagcatcatgatgcaagcattgactttgctcacaaaaacatcttg

SEQ ID NO: 44442 - DNA, 201 bp, Homo sapiens
ttttttttttaatacttttctttttgccggcatctgcgtagaatttttttttttttttttggtagtttcttaatggtctttagcaaaggaagtaagtgacrctgatcggtgaaggcagacagtaagatttataatgtatttgtgctagctgattgccaacagaaccggcctttcccagtggtgctgtacgcagactcggaa

SEQ ID NO: 44443 - DNA, 201 bp, Homo sapiens
ttgggagaaattgccacttggtctgtgtctacacagacccaagaggagaagggatttgacaatggtctgattaattgaatcagtggtttgggggagtgggstgtctgtattgatccaattaaatagataattgtcagaatcgaggtcatgtctataagacaccaccatttcaaagccaaagagattgtttcaaacatatca

SEQ ID NO: 44444 - DNA, 201 bp, Homo sapiens
ctagtgatgttagccttgacctctcggttaacgtggtatctgccagatttctccactgtaaaggatcatttttttcctttgtaattaataaatatattggrggaggtactttgggactacttctctaattttcatccattaattttagcatccctctggggatcttgcctgcaatgattaatactgtggtattctcatgac

SEQ ID NO: 44445 - DNA, 201 bp, Homo sapiens
gagccgagatcatgccactgcactccagcctgggcgacagagtgagaatccgtctcaaaaaataagtaaataaaataactaactaggctaggcacagtggrtcatgcctgccatcccagcactttgggagtccaaggcaagaggatcacttgagcccaggatttcgagaccaacctggacaacgtacagagacctcatctc

SEQ ID NO: 44446 - DNA, 201 bp, Homo sapiens
aaaatgtgtagggaaggacccttccttgcctctttcagcttctggtagccctagatgttcattggcctgtggcagggtaattccagtctctgcctccatcwgcacaagccattctccctgtatcttttcacatcatcttccctctattactgtttgtctctgttttctgatctcctcttcttctaagggtgacagttttac

SEQ ID NO: 44447 - DNA, 201 bp, Homo sapiens
tgttgaaggtcatttgaaaaatactctgtctttattctttgaaatggatttactctcaagaaagttgcatgtcactttacttggaagagacgggtctcagkgaggtgtgcctccgctttcatgaaaagtctcccgtctgcagaagcattggctgacatggaagattttttttttttttaatacttttctttttgccggcat

SEQ ID NO: 44448 - DNA, 201 bp, Homo sapiens
gcaaagtcaagttggagatggctctcgatatgcatgagtgtgttagactgcttttcttctattttttaaaaatgcacccaaatgtaaaagacacttttacstttttgatttgatgttgaaggtcatttgaaaaatactctgtctttattctttgaaatggatttactctcaagaaagttgcatgtcactttacttggaaga

SEQ ID NO: 44449 - DNA, 201 bp, Homo sapiens
taatttttgtatttttagttagacaccaggtttcaccatgttagccatgctggcctcgaactcctcacttcaggtgatctgactgccttggcctccgaaartgctgggatgacaggcgtgagctgccttgcctagccaaataactccattatttaagaaaaattaaccagtatttattgaatacttactgggccctgtgct

SEQ ID NO: 44450 - DNA, 201 bp, Homo sapiens
tcctcaggtagccactggtgtgtggggtcataccaagtcatttggtttacatcgggaatgccttttgtcgttatgtctagacccctggagaacagcccacrgcaatgcacttgtggaaattcggactgtggattacactgagtaacaatcctaataatacctgcacacaatcagttgcctgtccaaaaagcaataaagaac

SEQ ID NO: 44451 - DNA, 201 bp, Homo sapiens
gtgggtacttacttagggaactgtggaggtgtcctcaggtagccactggtgtgtggggtcataccaagtcatttggtttacatcgggaatgccttttgtcrttatgtctagacccctggagaacagcccacggcaatgcacttgtggaaattcggactgtggattacactgagtaacaatcctaataatacctgcacacaa

SEQ ID NO: 44452 - DNA, 201 bp, Homo sapiens
ctgacttcctttctccagctgtgagactcccctgtacaatttttctggagggtctagagtcacatgagtcacgccaagccgccctttcagtgcgaaggaakccaagcagagccctcctctgctgtgggtacttacttagggaactgtggaggtgtcctcaggtagccactggtgtgtggggtcataccaagtcatttggtt

SEQ ID NO: 44453 - DNA, 201 bp, Homo sapiens
agtcctacctgacttcctttctccagctgtgagactcccctgtacaatttttctggagggtctagagtcacatgagtcacgccaagccgccctttcagtgygaaggaatccaagcagagccctcctctgctgtgggtacttacttagggaactgtggaggtgtcctcaggtagccactggtgtgtggggtcataccaagtc

SEQ ID NO: 44454 - DNA, 201 bp, Homo sapiens
gagatagaacggagtacccagttgcactgagggaagagcagggatagaagtgggctccgggtctaggagacggtggaaagagaggactgctcctagcgtgwgagtgtcagggaagcttgctgggggaaatacaaggaaggaagagaatgcaggcagctcaaaagagccgggcaaggagacctgcagagcgagcggaggcct

SEQ ID NO: 44455 - DNA, 201 bp, Homo sapiens
aaattcccctcctgctttccatatgttatatagttaactgtaaaagtggcaccacctcttaaacagccagctattctgatcatttgaaatctggaacattstttcctacggtggttgacttttcactgcctttgaggttctttccaagtaaaggcgttattctttgtggtgtgctcctggaggtcactaacaaaacgtctc

SEQ ID NO: 44456 - DNA, 201 bp, Homo sapiens
catggaatattgtcagacagagaaactcacctgagcctctgtgttcagagtatttattgggtcttcgttgcgtaggtgtgattgggtgattgcccacatakttgatctcagcctccaagtcaactgataactgtggtacagtgtccctaccctaagcaatattgttggtcctttaagaatggttcatctgcaacctaaggt

SEQ ID NO: 44457 - DNA, 201 bp, Homo sapiens
tctgctcagtctacctttagcagaagattaaaaatgaaaactcttcttgttagaggtagaagagatcctttcccaaaccatagattcatggaactgtcaamgagcagcactgaactttgtactcaatgccttaatttttccagttgaggataattcacactaaacaagggatttcacctctctgactcatgcatcaggaac

SEQ ID NO: 44458 - DNA, 201 bp, Homo sapiens
aaaaaaaaaaaggaaccagatggccctgcccttgagcaggctgtggtctggcctggtggagagacagagaatcagttaattccagggtcatgtattaggtrgtaagatagtggttcacaccaaaaacatagaaaatgatcacttagcctgatccagaagttcaggaaagggctctgagcaggagatggaagacctcttggc

SEQ ID NO: 44459 - DNA, 201 bp, Homo sapiens
ttctggtcaaatacgttcttctctgattaggcctctcattttaaggcagttgagaagactcacagatgtgattcactggcaatggctctggttcaccaagsttagctctgctcagtctacctttagcagaagattaaaaatgaaaactcttcttgttagaggtagaagagatcctttcccaaaccatagattcatggaact

SEQ ID NO: 44460 - DNA, 201 bp, Homo sapiens
atgagtctaccatccagattcagtaattattacatgtggccattgttgttttatctctctccacccacttcccccatgcctgaaaatttaccaaagtaaaygcaagacattatatattgttattcatagacattttgagtaactaaaagtaaggtctctttaaaaaatgataattacagtatcatcatcacacccaaaaac

SEQ ID NO: 44461 - DNA, 201 bp, Homo sapiens
cagatgccgatgaccagtaagaccacatctgtgggcacaaaagagcccatttatgttttttatgggaacctaagaaggaaatgcttttctggtcaaatackttcttctctgattaggcctctcattttaaggcagttgagaagactcacagatgtgattcactggcaatggctctggttcaccaagcttagctctgctcag

SEQ ID NO: 44462 - DNA, 201 bp, Homo sapiens
ccagcatgtgatcatacatctacctaacctctcccattggttgaatttaatatactagtgaattttccattgcaaagatgaggttacgaatcatagtgttsatactcagaaggactttataaatattttgcctttttgaagtatatacaagaaatgaaaaaaaaaacaggaataaataaaaagaataaaaagagccaggac

SEQ ID NO: 44463 - DNA, 201 bp, Homo sapiens
gtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctca

SEQ ID NO: 44464 - DNA, 201 bp, Homo sapiens
tctcagatgccgatgaccagtaagaccacatctgtgggcacaaaagagcccatttatgttttttatgggaacctaagaaggaaatgcttttctggtcaaakacgttcttctctgattaggcctctcattttaaggcagttgagaagactcacagatgtgattcactggcaatggctctggttcaccaagcttagctctgct

SEQ ID NO: 44465 - DNA, 201 bp, Homo sapiens
ggtgtgcaaagagggcggtgagatgctgagagtaatggggctggcccaggaggaagtgagaggaagcaaagtgagacagaggtggtgtgtgagcgtgtgtttgtgtgtgtgtgtgtgtgtgtgtgtgtgtgtgtgtgtgattgagagagagagagacagatggagggaaagagaggcgggggattccaggtacagtggctc

SEQ ID NO: 44466 - DNA, 201 bp, Homo sapiens
taaaggtccccagtggtccaggtttttccttctcagcttggaaagcagcaggaaaactgcactgcatttatccaaagggtgtgattggtaagtgtgggtastgatatagaataaatcaacgtggctgggtgcagtggctcacgtctataatcccattactttgggaggccaaggtgggtggatcacaaggtcaggagattg

SEQ ID NO: 44467 - DNA, 201 bp, Homo sapiens
caccagggctcatgagccgagagcccctgcttcccttggaaaacggaaatttctatctccaactagggaaaaatttgcatgtgtagaattttggttttttsttcggcgtgtttatttaatttaacattacctatcctacgattatttcaaggtgattttattactagtcagctttcttttccctagcacaaaactcatgca

SEQ ID NO: 44468 - DNA, 201 bp, Homo sapiens
ttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggaggaagggtgaagagtagcaaatttaccgtcatcagcaggtgtgtaaatgt

SEQ ID NO: 44469 - DNA, 201 bp, Homo sapiens
gcatttgggattaacagctaaagatagcaggattccttctaaagcaataaaaatgttgtaaagttgattgtggaaattctttcacaactctttgattgtastaaaactttgaacactttaaatgggtgaattgtatggtatatgaatcatatctcaacaaagctgttaaaaaattgtatgaaaactgtgatgggattcaag

SEQ ID NO: 44470 - DNA, 201 bp, Homo sapiens
ctcccgagtagctgggattacaggggcacatgccaccatgcccagctaattttgtatttctagtacagacagggtttcaccgtgttggccaggctggtctsaaactcctgacctcaagtgatccaaccgcctcagcctcccaaagtgctgggatgacaggtgtgagccaccacacccagccactctctttcaactagaaca

SEQ ID NO: 44471 - DNA, 201 bp, Homo sapiens
ctctctctctctctttttttttttttctttttgaggaagggtctctctctgtcacctggctggaatacaatggtgctatcttggcccactgcaccctccayctccctggttcaagggattctcgtgcctcagcctcccgagtagctgggattacaggggcacatgccaccatgcccagctaattttgtatttctagtacag

SEQ ID NO: 44472 - DNA, 201 bp, Homo sapiens
gtatgtgtttaatctaccattccttgtggcacagtgcgtggtctgcatggcacagtgtgtggtctgtatggcacagtgcatggtccgcatggcacagcgcrtggtccgcgtggcacagcgcgtggtccgcgtggcacagcgcgtggtccgcgtggcacagcgcgtggtctgcgtggcacagtgcgtggtctgcatggcaca

SEQ ID NO: 44473 - DNA, 201 bp, Homo sapiens
gcaacctctgtcgattctccttcctcggcctccgtagtagtcaggactacaggcatgcaccaccatagctggctaatttttgtatttttagttagacaccrggtttcaccatgttagccatgctggcctcgaactcctcacttcaggtgatctgactgccttggcctccgaaagtgctgggatgacaggcgtgagctgcct

SEQ ID NO: 44474 - DNA, 201 bp, Homo sapiens
attagtgaagcagaggttgaaggaggtcacttgctttttatcccaatgtcaaataactccataattttttttattattttttgagacagagtcttgctctkttggccaggctagagtgcagtggcgcgatcttggctcactgcaacctctgtcgattctccttcctcggcctccgtagtagtcaggactacaggcatgcac

SEQ ID NO: 44475 - DNA, 201 bp, Homo sapiens
gtcattgattgaaagagtcatggcatagatgctgaagttttgatgggaactttgcaggatgttcgtttgtttatcattagccctgggagagtcatccctcrcctcccaccaccccttaatttaaagggatttaaaatattttcaagtacatcctgatatcagcacgtggtacactgagcctagttgatggaattgtgaaaa

SEQ ID NO: 44476 - DNA, 201 bp, Homo sapiens
tgggcagcgtagtagaagggtcttgagatttggagtcgtaacgagttttcaaaactcataactatattacagtttgcgcaagtcatttaacctatctgaascttcatttcctctcccacacaggataaaataaggataataacagccattttagagttcgtattaatatttaagtgggagaatgcagccagtaccctgaga

SEQ ID NO: 44477 - DNA, 201 bp, Homo sapiens
taaacttctgtaattataatcctagagaagctaaaatattcagtaaaaattactagcaatgaaataatttgaagagttggctagatgtaaggtaaatatayacaaattagctggtatatactagttataatttaagatggagatagaaaaaaaccccattcaaaatattaacacaactatcagatatttaagaataaatgt

SEQ ID NO: 44478 - DNA, 201 bp, Homo sapiens
cttcttggtgttgtgataagcccgtctagcacggagggccagaaggaagcagtgtccattaggatgactctccattgcttcttggtgttgtgataagcccrtctagcacggagggccagaaggaagcagtgtccattaggatgactcttcagtgcttcttggcgttgtgattagcccgtctaacagggcgggccagaagga

SEQ ID NO: 44479 - DNA, 201 bp, Homo sapiens
cctcaaccttggcaaaataaactttctaaattagctgagacctggctcagattttcagggttcacagacctgtcaacatgaactgtcagtggtgatagcamccgttttcaagtctcattttaatcggaaggaagttttaccagctctttggctttgtagaaggtcgagttctccaaatttaagagattcaaaaatgtcctc

SEQ ID NO: 44480 - DNA, 201 bp, Homo sapiens
agtctattggatgcggtggtgtggccgatttcttggacttgctacattcttaggcaagtgacatctcccttcatttgtacagagggagttagaattgaatygaacttccaccgcagcatccgccagctcttataatcacttgccctttgctgatggtgagtttttagctgctttctctcctaccatacagcactgacacct

SEQ ID NO: 44481 - DNA, 201 bp, Homo sapiens
tctgaactgcctttccatattctcggtccagctttctataagattgctctcatttactggtgagagctctgtgtaaattaaggaaaccatcaccaccttcraatggctgactattgtaaatattttaatgtttgtcgtttgtttgcaaccttgtaattttttcctgtgcagcaattttaactttctatattcaaatatact

SEQ ID NO: 44482 - DNA, 201 bp, Homo sapiens
agggagcagtgatggagcacaggctggaaaactgagttgaggggtcagtggtggaccctgaaggttagactaagaaatttagactccagcctacataaatktagactccatgcagaatgactggatgtcctataggacatgcaaagccacagggaattttggaacaggaaattgtgctcaaagctgaattttgaggaggta

SEQ ID NO: 44483 - DNA, 201 bp, Homo sapiens
ggtctggattcaaatcacatgtgccaactgttctactttggcagaattacctactgctttgggcctcgggtactaaatttgtgaaatgggaaaaataatasttcccacctcatagagttgcagtggagattgaatgagtttgtagataaaaagcgtctgcgttgtgtctggtacatggtaaggggttcgtaaatactgagt

SEQ ID NO: 44484 - DNA, 201 bp, Homo sapiens
atactgtctatagaagttttggttctgcttttgaccttaacactaaaatacccttccataatattataggcttttcatgtacatcgtttttaagatggctrtaaattccacttagtggctatgactgtagttttttttttaactcttcccctaatagtgaaaatttagattgtttctaaattttccttactataagtaagg

SEQ ID NO: 44485 - DNA, 201 bp, Homo sapiens
ggctctgtgtcccaactcaaatgtcatctcgaattgtaatccccacgtgtcaaaggagggaccaggtggaggtaatttgatcatgggggtggttttccccmtgctgttctcatgctagtgagtgagttgtcatgagatctgatggctttgtaagtgtttggtagttcgttctgtgttcattctccctcctgccgccttgtg

SEQ ID NO: 44486 - DNA, 201 bp, Homo sapiens
actgtacaccccctatcctggcatctaaacatatttgtaatcatactgtctatagaagttttggttctgcttttgaccttaacactaaaatacccttccayaatattataggcttttcatgtacatcgtttttaagatggctataaattccacttagtggctatgactgtagttttttttttaactcttcccctaatagtg

SEQ ID NO: 44487 - DNA, 201 bp, Homo sapiens
taacactaacaagctaattcaggtatgataataaaaaccttcacagggttagccatccatctatctgtccatccatctattcactcatgcattcatccacstgttcatccattcatctgtccattcatccatctatccatccatctacttctaggttgtgagaacccgtagtattgactctcagtgtgataggaaggccag

SEQ ID NO: 44488 - DNA, 201 bp, Homo sapiens
gttagtagaaactaatttctcttgcttttctctaaagtatacttgatttgaaatatgtgccctgaagttttgctatgttgaaaaaaatgatgagccgggcrcagtggctcacgcctgtaatcccagcactttggaaggccaaggcgggtggatcacctgaggtcaggagtttgagaccagcctgaccaacatgttgaaacc

SEQ ID NO: 44489 - DNA, 201 bp, Homo sapiens
cccaaagtgctgagattacatgcatgagccaccatgcctggcctctggccttcttttcactttagaaaaaaacaaaaaacaaaaaacaaaaaaaaacacamaaaaaacttttttttttagaactgttttagtttgggagccaaaattgagcagaaagtacagagagttcccgtatacctccggcagagccctggctcacta

SEQ ID NO: 44490 - DNA, 201 bp, Homo sapiens
ttttagtcagggtacataagtgtcagctgctacgacaaacaacttgcaacgtctcattatcttcatacaacaaacgctgatttgttcctttcattacatayccagtgtgagttggctggaaggtccaccctacacaaccactcgtgaaggcagacttgaaggggactccactgtcttggagctacactctaaaacaaatag

SEQ ID NO: 44491 - DNA, 201 bp, Homo sapiens
cttcctaggctgtccaccatgacatcagcctgcccatgcaatgcttgagatttgccctgtgactcaacccaaatctaaagcccgagtcgtatgaatccagracacctgcctgcaaatgcatttttcatgtataggttattcactctggtctttgagattatgtaattagcatatgttgtcatagtgatgtatttattataa

SEQ ID NO: 44492 - DNA, 201 bp, Homo sapiens
agcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagtttgggagccaaaattgagcagaaagtacagagagttcccgtatacctccggcagagccctggct

SEQ ID NO: 44493 - DNA, 201 bp, Homo sapiens
ttatgagggaggctgagatgtgagaagcacatgggtgttgggagagcactaaaggtctctagcccagaagcatgacttccagccaagtgagacagggaagsccagaaaaatgtgtcacagaacttatggcatcagaatctgattcccaggcatgctttccaccatatgcatagacatttgcaccccagggatagcaccatt

SEQ ID NO: 44494 - DNA, 201 bp, Homo sapiens
gagatgagtcaggtgtgccgcagcactcaggtcagacttgaggcaagtgagaggtgtgagttattcagagtcccagagagcttgggccaaaagagattctrtttttactggagcatgtgagggtggatcacaactaggatggcgcgaagttcacctcgtgtaagcacaccaggctgcagggataataactgcactttttaa

SEQ ID NO: 44495 - DNA, 201 bp, Homo sapiens
ttgtacaattatttgagtatactaaaacagctgtacagtatacataggtagattttatggtatgtgcattatatttcagtaaagttctttaataaattagytaatgcttattgtagaaaagttggaaaataccaaaaaccataaacaggaaataggaaaaaaagtaatcctgactgtatatctggaaatcttttcgtgggg

SEQ ID NO: 44496 - DNA, 201 bp, Homo sapiens
ttctaggcacattaaacggtcagtgcacaggtcctcatttttctcatgcttccatttccatattctcaatcaatcactgatggccagctgtcaacaggcaycatttttggtgggacctgaagatgtatatcccttgttttcagattcctcgcctctcatcatgtaaggtgatgctctgagctgggtcttaaagcttctggg

SEQ ID NO: 44497 - DNA, 201 bp, Homo sapiens
ctcagtttcctgagtagctgagaccacaggcacgggacaccatgccagtctaatttttaaattttttgtagggacagggcctcactgtgttgcccaggctyatctcaaactcctggcttcaagtgatccttctgcattgtcccccacaaagtattgggaatgtattctttcctgatcaggaaactccgcagagagaaagtg

SEQ ID NO: 44498 - DNA, 201 bp, Homo sapiens
gtacactgatggtgttttgggaataagagtgtaggtagatagagggtggctagtgattgctaatttttttttttttttttgagttaaaaaagtgctataawattagaatgtagttatggttgtacaattatttgagtatactaaaacagctgtacagtatacataggtagattttatggtatgtgcattatatttcagtaa

SEQ ID NO: 44499 - DNA, 201 bp, Homo sapiens
atatgcacccggctagggacctctttaatggtcattcatttgggagatgacctttggttcctaaactggtggacataccaaggactaaaggagtgacttgytctcagttctttgtcattcagctgctttaatattaatatgacacccgttttgggcttgaaaagttttccttctgctgagaaatgatgatggtgacaatga

SEQ ID NO: 44500 - DNA, 201 bp, Homo sapiens
tgttctatttatttatttgttattattatgttttttgagacagagtctcgttctgtcactcaggctggagtgcggtggcatgattgtagctcactccagtsttgagctcctggactcaagagatcctcctgcctcagtttcctgagtagctgagaccacaggcacgggacaccatgccagtctaatttttaaattttttgt

SEQ ID NO: 44501 - DNA, 201 bp, Homo sapiens
tcagagtaggcatgattgcatattctttagatggatgggtggatggatggatggatggttggatggttgggtggatgtatggttggatgattggatggatsatggttgagtgagtgggtggatggataggtggaaggatgaatggatgcatggctgagtggatagaaggtggatggatggagggatggatggttggatggt

SEQ ID NO: 44502 - DNA, 201 bp, Homo sapiens
acgtattgtatggttccatttagtatataaaatgtccggaataggcgaatctataggacagaaagtacactgatggtgttttgggaataagagtgtaggtrgatagagggtggctagtgattgctaatttttttttttttttttgagttaaaaaagtgctataaaattagaatgtagttatggttgtacaattatttgagt

SEQ ID NO: 44503 - DNA, 201 bp, Homo sapiens
gaaaacagtttggccattattcaaaaagttaaacattgaattaccatatgacccaataatcccactcctagatgtatcttgaagagaaatgaaaacatgcrtttccatagcatcttacaaatgaatgtacatagtagtgatattcctaatagccaataaatggaaacaatccaaatatccatcattggtgaatggataaac

SEQ ID NO: 44504 - DNA, 201 bp, Homo sapiens
gggaaatacttacaaattaaatattaaataagggatttgtatctagaataaagaacttttacaattcaataatgaaaactcatttaaaaaatgagcataaratctaaatagatattcctccaaatatgatacacaaattgccaatgaatacataaaagatgttcaatctcattagggaaatgcaaatgaaagccacaatga

SEQ ID NO: 44505 - DNA, 201 bp, Homo sapiens
agccctatgcctttgggaaggagaggaaggactaatatttgtgtggtacaaaggatgtgcctggcataccccatatcttttacaaagacataaatgtcttstgaataaaagtatgatgatgatgatcatggtgatgaagatgagggtgatgatgttgatgatgatgatggtgatggtgatgatggtagtatgataatgctg

SEQ ID NO: 44506 - DNA, 201 bp, Homo sapiens
cttgaaggggagggaaattgttagctacacgaccaagagacagaagagaggaaggagtttgtacccacaactcagctttattttatgtaagctctttctgyaaagggaaagtagctctttgtaccaaagcaagggcctctgaatgagagctgggagaggccagaatgggcctgtaagaggttgatgtgtatgagacctgaa

SEQ ID NO: 44507 - DNA, 201 bp, Homo sapiens
gcaatagaaattcaaggtatgaaattcaaggtgtggtctcagagtcattttatcttacagcttctctgctgtgttttctcagtatgtgaaatgggaacatsacttaccatctactcacctcctgtttgagttcaagggaaggtttgcagattggcctgaaggaagacttctcttgaaaaactcaaaccaaagagcacaccg

SEQ ID NO: 44508 - DNA, 201 bp, Homo sapiens
tatgactatttcatgagtgcttactatataccaggcgctgttacagcccgtgtaatgccacctgggagttggggggagtcaccatcgtccatccgtctgtscatccatccatccatcctgcctccctccatcctttctctttttcacaatgtctcttgctccgccccctctcttcccctccttccttcctatccagtgctt

SEQ ID NO: 44509 - DNA, 201 bp, Homo sapiens
gctactagggccacatcttcccctttcttctcccccaggtttgtcccatttgtactgactctgacccaggttgtcatgacttgagactcactagaagtttsagaaagatgcagactgctttaaaaaaaaaaaaaaagggcaaggggaggtgtgagaagaaagtataattctttttcttctaactggagatataaaaatcat

SEQ ID NO: 44510 - DNA, 201 bp, Homo sapiens
atagaatgatccaagtttataatttgtaaataagtagacatcttttgaggcgtatgcccttaatttttctaactgatgaaagcgtacttccatcaactcargacagttcaaagcagcttggagcctcttggattttaaaaagactctgtggcctctgtctctcttggttttcagtgctcagctgaggtctactctgtttat

SEQ ID NO: 44511 - DNA, 201 bp, Homo sapiens
ggactattgttgtccatatttcacagatgaggaaagagatgtgctaagaaaagaggtggcagagtagggattccagctcagtagccactttcagggtcccrtacttttcaatgtaagcatattggctctcaatttaaaaatgttattttttacagatagtacacagatgcactgacacaggtaccctctccagtcctctga

SEQ ID NO: 44512 - DNA, 201 bp, Homo sapiens
tatagaacatttctaccatagtagaatgctcttttggatacatctgctttaaagcattagtccccaaagtgtgaaggatgaaccacttgggttccgagagraaacattataacttctgtttatccattaaactctttcatttattattaaacatctcaacacatttattgggtggcaggtactgttttaagtgttttgcat

SEQ ID NO: 44513 - DNA, 201 bp, Homo sapiens
aagcatgatggcaattgcctgactctgtcctcggtggggacaggagagctgagcataaggatctaagtttagacgccctcctaggattaccaacgtaggcrtgatcaggcccataaaatactgcacatcttggcatcttacctataaaaataatgcagatacattcgtaactccccaggttttcgggagtggaaatgaggg

SEQ ID NO: 44514 - DNA, 201 bp, Homo sapiens
aactcaaaacaagccagtaattcagaaaaagcccagttcttctcacaaagaaagatctaagtgtgatatgagagtatatgcatggagaatattttctgagstggtgatgagctgcagggggcctctcccagcccccgcactggttgcacttttaaataagagaaaaaaacagtgataggactgacctgcgtgtagaagttt

SEQ ID NO: 44515 - DNA, 201 bp, Homo sapiens
tgggagaaaccatcagttatgcagtttacaatatctctaaactcaaaacaagccagtaattcagaaaaagcccagttcttctcacaaagaaagatctaagwgtgatatgagagtatatgcatggagaatattttctgagctggtgatgagctgcagggggcctctcccagcccccgcactggttgcacttttaaataagag

SEQ ID NO: 44516 - DNA, 201 bp, Homo sapiens
agatgttgttgttcatgtttcccagcccattggtgatgacacagaggcaggagccggggctgcagactaaattatatacatctcaagggcagttagacaaytagctcgcccacaggaacattgcaataagcacagtatctgctttcccagcaaagccaagtgcaagttcctgcctgctctgatgacctcttgtgcctccag

SEQ ID NO: 44517 - DNA, 201 bp, Homo sapiens
ttgcaatattagggacatgctaatacaattattcattgtatatgttaattcaaattaaatggaatgtcctatattttatagggcaaacttaggcttacgcytgggtggaatgagcaatccctgtcgccaaagaaggtccccagcatagcagttggctggagaaggaagggctgaccataagttgcactaaactgctctcag

SEQ ID NO: 44518 - DNA, 201 bp, Homo sapiens
attttggtctgtaaggacattaataatgttttggtaaaacctcagttatcatctgctattactgttatttcataagacacatcattttccttcaaaattamaatgaaaactcataagcatacatcaaagttgaaagaattttacagcgaaccaccattaacattttgctataatggctttatcatatatccattcatccgt

SEQ ID NO: 44519 - DNA, 201 bp, Homo sapiens
ctgcattaaatccttctataagttttcatagttctgtgcatttcctcttggcagcaatgcactgagctgcagttttacatttttgtttttttgttttttgrgtttttttttttttttgagacaaaagtctcgctctgtcccccacgctggagtacagtggcacgatcttagctcactgcaacctccacctcccaggttcag

SEQ ID NO: 44520 - DNA, 201 bp, Homo sapiens
taacattgaaaaaaaatgtggtaacatagggttgcctgtgtcttattttggtctgtaaggacattaataatgttttggtaaaacctcagttatcatctgcyattactgttatttcataagacacatcattttccttcaaaattacaatgaaaactcataagcatacatcaaagttgaaagaattttacagcgaaccaccat

SEQ ID NO: 44521 - DNA, 201 bp, Homo sapiens
aaaaagatgttgggttggaaagctaagttacagcaggtgaacttgaatttgaggaaagacaaagcaaaccctggctattaaaggaacacacacacacacayacacacacacacacacacacacgtttctggtattaggaaatggagatttctaacataataaaaaagattgaacttaaaaatgacttccattaaatagggt

SEQ ID NO: 44522 - DNA, 201 bp, Homo sapiens
atttgtatgttgcacccaacggggttttctccataggggttaggcgtaacgtctttggtaaacttggcacctgtagaaaggtcttgtggtgggcagggggstgtgaatgggggaatgagaactagggaacccaggacccaggacccaggacgagagttcagcaaagaccatttacagaagctatccttccaaaacggccac

SEQ ID NO: 44523 - DNA, 201 bp, Homo sapiens
cctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgaggaaacgctctcttcttcttgcaggg

SEQ ID NO: 44524 - DNA, 201 bp, Homo sapiens
cacgcaggcattaaatggattgtgaagagggactttgttcccgctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaag

SEQ ID NO: 44525 - DNA, 201 bp, Homo sapiens
ttactgtttatatacccggccacttctgccaaaatatgctggccttttagtcttttggttttttctctcttttggtttgttggcttatgttcgctgcttgrtctgactactggttttatttctaaggatttttttttaagttggcatctttttttctttgactttccttgtatgcccccctttctcccctgcattgtcttg

SEQ ID NO: 44526 - DNA, 201 bp, Homo sapiens
ttgaccaatttttgtaaatctcttctgttactgtttatatacccggccacttctgccaaaatatgctggccttttagtcttttggttttttctctcttttkgtttgttggcttatgttcgctgcttgatctgactactggttttatttctaaggatttttttttaagttggcatctttttttctttgactttccttgtatg

SEQ ID NO: 44527 - DNA, 201 bp, Homo sapiens
ctcaaatgctctaatctccacagaagttaaaatatccctaaacaggcatgtgcatatatgtctttctttcttttcttaggttaacttttttttttttttttccttttgaatgaccacaaagcatatctacccagcggggttactttttttttccttttcagtattcatgacgtcaagtccctgtttgttatcttattgtcc

SEQ ID NO: 44528 - DNA, 201 bp, Homo sapiens
gtattccaaataattggtggaaggatggaaaggttaaatggaaattatgtaagggctgcaaagagattcatatatgactatttcatgagtgcttactatayaccaggcgctgttacagcccgtgtaatgccacctgggagttggggggagtcaccatcgtccatccgtctgtccatccatccatccatcctgcctccctcc

SEQ ID NO: 44529 - DNA, 201 bp, Homo sapiens
tactgaaatggcttagaatgccattttatcacatggtcaaattattcaatgatcaaatatcgaattattaaaaattatcaaaaggaagttccctgaaacaygaaagtgtttgggctttgtaggtacccaagtctactgggaaaaatccccatttctgggtaacccagccccttttaatgacaacttcagttctccaaattc

SEQ ID NO: 44530 - DNA, 201 bp, Homo sapiens
cccatctcatgttgacttaatttctccagcattcagttaagacctagccgaagcataattgtcagcatagtagagctggctctcctctttctaattgcccwgcagagtttttggggagtctgtatgcaattgtgtacaccccaatgccccaaaaccctcttctatttcctttagcactcttgagctgaagaagccccactc

SEQ ID NO: 44531 - DNA, 201 bp, Homo sapiens
gagaggatgtagagaaataggaacacttttacactgttggtgggactgtaaaccagttcaaccattgtggaagacattgtggcgattcctcaaggatctasaactagaaataccatttgacccagccatcccattactgggtatatacccaaaggattatatatcatgctgctataaagacacatgcacatgtatgtttat

SEQ ID NO: 44532 - DNA, 201 bp, Homo sapiens
gggtccctcccacaacatgtgggaattatgggagctacaattcaatatgagatttggatggggacacagccaaaccatatcacaggatagttccccatatsaaggtccttaacttaatcacacttgcatttgattttatcatgcaaggtagcatactcacaggtgggattaggacttagacaccttcagcaagaaacatta

SEQ ID NO: 44533 - DNA, 201 bp, Homo sapiens
ctcactttcgccatttaatagctttgggtctacaagtaaccaccccagatttttctcctcctctatgcaccagtcatatcaagaattactgtaacttcatwggatttttgtcaggacgctatgatgagaagaacatatgccaaggagacagttttctggcaaatcagaggcctgtaagaaatgatggctttttgcttgtat

SEQ ID NO: 44534 - DNA, 201 bp, Homo sapiens
ctttgagggtcctcaaaatagaaggtcagagagtagacttttaaaagtcttgcactgtttacaagtcagatgctttttggcagagtgactctcagctcccyccaacaatcccttcttgtcgttcagtagtagatagactctatcagggaaaaataggagaaataaaataagacagcatatggaaggcattgctgaaagtct

SEQ ID NO: 44535 - DNA, 201 bp, Homo sapiens
cctctgcagttatttttcatgcacactcggattacactgctcggtgatattacatctgcatgcgtcttgccctctgacacggcaaacacagatgctgcccraatccttgtaaagccatatatcttaagtaggaaggagcatctttgcaggggaggtgaattgatttgcaaagcagcctgacacatggtctcttatttctcc

SEQ ID NO: 44536 - DNA, 201 bp, Homo sapiens
tacccctgattggttgctttccacgaccattcagccgtttgcataggagctgtaactttgtaacttcgcttcaccctctgattggttgcttttcacaaccwatcagacatttgcataggagtgtaacttctttccacaaccaatctgactgattgtgggccattacttcatttccatgaggtgtacaccaagtggccaatg

SEQ ID NO: 44537 - DNA, 201 bp, Homo sapiens
tagggtctggtcaaggaaagggccacttcctgggcctcccaaaaagaggaaggagaaggccctggcttgtggaagagtaagaggggcctcgttaatgtctmccaagcacagtaccccaactccccacatacagtcccaacccttactgcagccgggaggttaggtgtctgccgtgctcatgaacaggaagtgaacccgatc

SEQ ID NO: 44538 - DNA, 201 bp, Homo sapiens
catgtagattgtacatcgtttgtcgataaatcagtgtacaaatactaggggtgagtgtgctcaaaacttatttttactgataatagtccatgatcaaggcrgtttggagaccactcaggacagggaaaacgcagactcatgtgacccatcagggcttcagggtgtcctctggtgaagggcagcagcaggacagagccccac

SEQ ID NO: 44539 - DNA, 201 bp, Homo sapiens
actatcgtattcagcaaccaaaattttatcacttgcctgatactgcctggtgagcaggtggaaatgtagacacccaaacacccttcatggattcccagctsctgagagtttgaatagtatgtgaagtctgtagagacaaaattgttgttttccccagttgtaaagtgtgcaatattatccttgcaaaattgtctgtttatt

SEQ ID NO: 44540 - DNA, 201 bp, Homo sapiens
attgggtagcaccgatatagaacatttctaccatagtagaatgctcttttggatacatctgctttaaagcattagtccccaaagtgtgaaggatgaaccamttgggttccgagaggaaacattataacttctgtttatccattaaactctttcatttattattaaacatctcaacacatttattgggtggcaggtactgtt

SEQ ID NO: 44541 - DNA, 201 bp, Homo sapiens
tatggagtgtcagaaatagtgaagcttctggagcttcactgtccaatatggtagccacgtgtgactattaaaatgtaaattaattaaaattaaaagttcarttgctctgaaatagcagccacatttcaaatcttcagtagccagatgtggttattggctaccatattgggtagcaccgatatagaacatttctaccatagt

SEQ ID NO: 44542 - DNA, 201 bp, Homo sapiens
atcactgtgtaacttcatccaatacgtattgaatacctactatgtgtctggcaccacttcagacagtaaggatatggatatgaatttgtatcagtcaagcyttccaggatcttattatctagagagaaagattaaaacatatgcaaataattttgatagaagcaaagacctaactcagcctgagaggaggttgggtttaga

SEQ ID NO: 44543 - DNA, 201 bp, Homo sapiens
cttcttccccctacttccttcttatatctggctatctgggagagaaaaaatttaatacaattgattactttttagaagagttaatttttacttattactgkggattttttgttttttaacagtcacaccgaggagaagactcagtgggaacatccaaaaactggaaaaagaaaacgagtggcaggaggtttgtatgttgtt

SEQ ID NO: 44544 - DNA, 201 bp, Homo sapiens
tgactcccagtgggtggtattttctcctagagtgcatttctgcttcttaaccagcagaagaaagcccattaactaacccctcaggggtcaccatgggcaamggagtgcatattaagaactgtctggaaagaaaagaaggtcattggaatcttcttcaccccttccctggtactgatggttgcatttcaatggatttctcca

SEQ ID NO: 44545 - DNA, 201 bp, Homo sapiens
acaggcaaaatgataagtcaggtcctgccgggtgactaaggcagtgtggcaatgcttcaagcctttaaaaccatatcccagtggccccaaagcattaataygtctggaacattgcctgtccaatatctagagaggcgcctgcagaatttgattcctaggtacatcaagtttttgagctggaagaaacttgagacgctcttt

SEQ ID NO: 44546 - DNA, 201 bp, Homo sapiens
cacatctgaacttcaggtgaagtttcaaaccaccaggcaacatgcattacaggcaaaatgataagtcaggtcctgccgggtgactaaggcagtgtggcaaygcttcaagcctttaaaaccatatcccagtggccccaaagcattaatatgtctggaacattgcctgtccaatatctagagaggcgcctgcagaatttgatt

SEQ ID NO: 44547 - DNA, 201 bp, Homo sapiens
ctgagagtgggaactgaggagattcaagccttttgcccgtcgatcgcagttcagatctgttgattttgaccattgcatcttgcctcacatctgaacttcargtgaagtttcaaaccaccaggcaacatgcattacaggcaaaatgataagtcaggtcctgccgggtgactaaggcagtgtggcaatgcttcaagcctttaa

SEQ ID NO: 44548 - DNA, 201 bp, Homo sapiens
gaaggcgatcatgttggcacagggcataagagagtagcggggctgagagtgggaactgaggagattcaagccttttgcccgtcgatcgcagttcagatctrttgattttgaccattgcatcttgcctcacatctgaacttcaggtgaagtttcaaaccaccaggcaacatgcattacaggcaaaatgataagtcaggtcct

SEQ ID NO: 44549 - DNA, 201 bp, Homo sapiens
cgcagcgctatcatatgctccacatgctttctaatgtcttttgtttgtattaggaaaaaacataaccctctcctactgagaaccagagagagcccctcagrttctgagaatgacgacattcaacatcgtactccaaagggggttaggtttgtgtgctaggggtgaacgctgtgcaatttaattctgtttccaaaagatctt

SEQ ID NO: 44550 - DNA, 201 bp, Homo sapiens
atcctgcgtcctctcccttcccccattggctctgttcttcctgccagtgctcttccccctgctcactgggttccagctgtgcgggcctccctgctgttcawtggaatgagacccatgcccctcctggttatcccactcagagtgcccttcaacagctacagggctggcccatcctttctctgttaccttcggaggaagcct

SEQ ID NO: 44551 - DNA, 201 bp, Homo sapiens
agaaagtgagatcagagatcccgaggaagggcttcagtttcaccagtagtggagctagggagtaggggggcagaagccgcaggaagtcagtgcaggacgcyggaggccactcctaattgcttcatgtgttgttgccgtgctgatgaccttggaggcgctgctggtcctggatccttgcgaccttttcttccaagaggaaat

SEQ ID NO: 44552 - DNA, 201 bp, Homo sapiens
cgggggagctgacattgcataaataataaaacaaatggagccacatttagttatcactcatctagcggaagtcgatcttcttgggacatgagtaggctctmacctggcaggtttttcaacatggaaccattatttgtcacatgtgttctgtgtgccagggactgagttcttctcaacggagtttacatgtgagaggagcaa

SEQ ID NO: 44553 - DNA, 201 bp, Homo sapiens
cagcctagacttggatccctaagcacagcctgtggatgggacgttttaaggtaaagggaggacgcagagcattgcagcccgttggttgttttctccagcayagccatgcaaaatccatgtagcggcaggaattttgcagctggagttgctcccctgagactctgatcagataaagacagggtttgctgaacaccgtaggtc

SEQ ID NO: 44554 - DNA, 201 bp, Homo sapiens
gcaatcttccttctccatccccagcagcacctctgacccccttcacctgctttatttttctccatattatcattgccatcaatccaagcacaatttccagytacttacccattttgctttctccccgctctttgagaatgctggctccaacagggcaggtatttcacctgttttgtttatgcctgcatccccatcactagg

SEQ ID NO: 44555 - DNA, 201 bp, Homo sapiens
tggagagtggctgagaaaccagggagaaacaggaaggagctgattgaggagaccaaaggagggtggggccgcagctctcaggcactcttggtgttcagaargccagcttgaagaaagatgtgcatatttgcaaatgcatttcttgttcctagtgaagaggtgaggaaggacactgactgtgctagagctgtacaaagagaa

SEQ ID NO: 44556 - DNA, 201 bp, Homo sapiens
tagctaatgagaagcaaacgcatcataatgacctgggacatatgacactgaagcctactctctttccacaaagcttgatgtactcagatagtaattagtamacattttcataaataatcttaaccttttcaagcatttttgtcgattggattgtagcactcaaaagtaaggtctgttttactaatataaaattgggcctgt

SEQ ID NO: 44557 - DNA, 201 bp, Homo sapiens
gtttctttgacttactggaaaaaaaaataataggaaagaaaatgtgatcagttggtatatttggctctctttcatcaacacttttatggacctgcattgcwgtgtttctgtgatgtgtataaaacacagtttcagtgatcgtgcaagcctcagttttagaagataaaaagatatgaacttgaacccaagcttctctgtcaa

SEQ ID NO: 44558 - DNA, 201 bp, Homo sapiens
aagcgattctcctgcctcagcctcctgagtacctgggaccacaggcacatgccaccatgccagctaatttttagtagagatggggtttcaccatgttggcsaggctggtctcaaactcctgacctcaagtgatctgcctgccttggcctcctaaactgccgggattacaggtgtgagccaccacacccagcccctctccct

SEQ ID NO: 44559 - DNA, 201 bp, Homo sapiens
cccagacacttacatattcctagccattccttttgcttaagtttgcagagatttgtgcttaaaactgaataaacaatctcagggtttttgtgtgtgtgtgkatgtgtgtgtgcgtgttatatgaagtcttgctagaatgcataaacaaacaaaaaaaatatcatactctcagatcctggatactgtggtcgcctggacttc

SEQ ID NO: 44560 - DNA, 201 bp, Homo sapiens
aactctggagacagaggttggcgtgagctgagatcgcaccactgcactccggcctgggtgacagagcaagactctgcctcaaaaaaaaaaaaaaaaaaagraaaaaaaaagattgaacatgtggaatatgagacaaatgaaaaagattgaattccgttccaactgggcttttgaatttattttcgcacttcctattttttg

SEQ ID NO: 44561 - DNA, 201 bp, Homo sapiens
agaaaagagctttggaaattctacatacataatatatataaattttccattcatagtgtgttagcagctttttctacaaatctcttggcgggtggggggayatttcactcttctatgaatcaaataatatatggctttttcctattggaaaaaattagtcgtgtgaactttattcttcaagaaaaagtagtttttatctgc

SEQ ID NO: 44562 - DNA, 201 bp, Homo sapiens
cgcactgtgccagaatagatacagctacgtcaaaatgccgcatttattttgccattacttttcactgactaaaaccatttgctaatgaaagttctagctgmcataatttcagcacctgctgatggaaaggtggactcactggtcatggggagtacagtaaaattaggagagtagatagaatcctgaagcatttgagctgca

SEQ ID NO: 44563 - DNA, 201 bp, Homo sapiens
tgccaaagcgtctgcagaccagtctgtacagttgattatagatatattaatgaccacttctgagctaaaaaatgatctagaataatagactaccaaacacrtaagcttatttacggtttgcctccttctcatgcttttggaagggaagcactgagggtcattgtatcagtcagcgtagactaggtttgccgcagtaacaaa

SEQ ID NO: 44564 - DNA, 201 bp, Homo sapiens
ttatctcaacccatttaaatgtcttttccttgcaatgttttgtaatattacatgtagattgtacatcgtttgtcgataaatcagtgtacaaatactagggrtgagtgtgctcaaaacttatttttactgataatagtccatgatcaaggcagtttggagaccactcaggacagggaaaacgcagactcatgtgacccatca

SEQ ID NO: 44565 - DNA, 201 bp, Homo sapiens
tttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgc

SEQ ID NO: 44566 - DNA, 201 bp, Homo sapiens
ttcaacctggcaaccctgtgacctcagcactaggatatggatagaaaacatagtagcccctatttacctttatcttttatctcaacccatttaaatgtctwttccttgcaatgttttgtaatattacatgtagattgtacatcgtttgtcgataaatcagtgtacaaatactaggggtgagtgtgctcaaaacttattttt

SEQ ID NO: 44567 - DNA, 201 bp, Homo sapiens
gcagagctggctgtgtgggagaccagagttttattattactcaaataagtctcccccaaaactcagggatagagatttttaaggagaatttagtgagaagrgggtcagggaatggggagtattgattggtcaggtttaagatggaatcagggagttgaagctggcctcttgcactgagtcagttcctgggtgggagccaca

SEQ ID NO: 44568 - DNA, 201 bp, Homo sapiens
tgttaaagtaaattttaattttagataaacaatggataattttttagcaaaaggatgttccacatttaactggacattatctctgtctctctccctccttmcctgcctcctatcctctcttcccaccccctacgatgtctatgtatagtttcaacctggcaaccctgtgacctcagcactaggatatggatagaaaacata

SEQ ID NO: 44569 - DNA, 201 bp, Homo sapiens
aatcttagctaagatttatcagaaattaaaactgtatacttaactaaccacctagataggtgcaggcatatatgaattcaccgaaatttgactcaactccyttggttaatttaaataaaataaaagtaaataaggggaaattgcatactcctatctggactgttttcttatggttttggaatctctggcaggtagaagtaa

SEQ ID NO: 44570 - DNA, 201 bp, Homo sapiens
ggtatgtcacttaaaccttgtgttggagtttcctccttgttacatggaggtcacaagaataacaaactatgcatagatcacctaatttagtcattccaackgtgtggagagatagaggattaggatggactttatttcctaagtgagaaacgttggctttagtaaaagtgtagtggtttgtagggtcatccccctaaagat

SEQ ID NO: 44571 - DNA, 201 bp, Homo sapiens
tgtggggaggactttggacttggggattggactccatgggagaggtcagctccttgtctccctggtggtgagacagggaatggtagagtgtgtcctacctrtgtgcctgccttgctctacatcagtgcttcttggatattttggtatcaggactctaaactcttagtagttatccaggacccaaaatagcatttgtttatc

SEQ ID NO: 44572 - DNA, 201 bp, Homo sapiens
ctgtagttcatgaaacattcccttcgattctttgaactctctcatacctttcccttaaattcttctttttcccttatgtcaagcttctttcagtaacaacwgaaaggctaatagtagtgctgtgtggggaggactttggacttggggattggactccatgggagaggtcagctccttgtctccctggtggtgagacaggga

SEQ ID NO: 44573 - DNA, 201 bp, Homo sapiens
tccagtccgtgggggccctggtgctactgctgtagttcatgaaacattcccttcgattctttgaactctctcatacctttcccttaaattcttctttttcscttatgtcaagcttctttcagtaacaactgaaaggctaatagtagtgctgtgtggggaggactttggacttggggattggactccatgggagaggtcagc

SEQ ID NO: 44574 - DNA, 201 bp, Homo sapiens
tagggaggctgaggcaggagaatcacttcaacccggaaggcggaggtttcagtgagctgagatccagcctgggtgacagagcaagactccatctcaaagcraaacaaaacaaatgagggtcctcatcagcgtgcctttgacactgtcctctggtcctggtgatctgaatacatcaccacagaactgccagggtacgtgttt

SEQ ID NO: 44575 - DNA, 201 bp, Homo sapiens
ccatgcccaccttgctgttgcaccccccaccccaaggaaagccttcccacctttggaagctgcattaattcttccaggccacaagggggccgttgagttastggttcactgcactggctggcaggaaagagttttaatgcaggctccaaaggtgcttaatttcctgtggtccttatgaatatgcatacagtatgtgctcag

SEQ ID NO: 44576 - DNA, 201 bp, Homo sapiens
tattcaaaatgtacacacagcgtaaatgcaagaaaagaatctgatgtaaaaatggcccttccaacatctagcattattgtgtgttgaataaatacttgttygattaggtctaatcactcttcatgattggatttccaaaatgtggactctcagcagtacattacagggacagtggttgggtctggagatgtcacccttagc

SEQ ID NO: 44577 - DNA, 201 bp, Homo sapiens
ctgtgggggctgttttggttaaccactcgcatcagttttaagtctccacaggcagaaccagaccatcgtgaacttcttgatttacatggtggtggagagtrgctgagaaaccagggagaaacaggaaggagctgattgaggagaccaaaggagggtggggccgcagctctcaggcactcttggtgttcagaaggccagctt

SEQ ID NO: 44578 - DNA, 201 bp, Homo sapiens
agacagttaggttcgaaggaaaacaaagacaattgcacggcacagagggaatatactgctacggtaaaccgatcactaacacccggccctgaatttgcttmaaagttttcactaaggcacaaagggagccgtgtggagctccggagttcccatctgaggtcttgtctaactccttggcaacttttatgtatttgtatagga

SEQ ID NO: 44579 - DNA, 201 bp, Homo sapiens
caaaatgcattacaggctctaatgcacgataagacagttaggttcgaaggaaaacaaagacaattgcacggcacagagggaatatactgctacggtaaacygatcactaacacccggccctgaatttgcttcaaagttttcactaaggcacaaagggagccgtgtggagctccggagttcccatctgaggtcttgtctaac

SEQ ID NO: 44580 - DNA, 201 bp, Homo sapiens
catccttccaaaatgcattacaggctctaatgcacgataagacagttaggttcgaaggaaaacaaagacaattgcacggcacagagggaatatactgctayggtaaaccgatcactaacacccggccctgaatttgcttcaaagttttcactaaggcacaaagggagccgtgtggagctccggagttcccatctgaggtct

SEQ ID NO: 44581 - DNA, 201 bp, Homo sapiens
aaaacctcacaccagtgttgttttattcatctgcttatgcacgcgtatggctgcaacatccttccaaaatgcattacaggctctaatgcacgataagacarttaggttcgaaggaaaacaaagacaattgcacggcacagagggaatatactgctacggtaaaccgatcactaacacccggccctgaatttgcttcaaagt

SEQ ID NO: 44582 - DNA, 201 bp, Homo sapiens
aaatgatgctcttggttccttgtctgtctttttgcccatccaacccacccttcacacatggccgagttatgccaaactttgcaagaggtgccaggtgggcrcaaagaaaagaggactgcactcaaggaacttagtctttgaggccaagcacggtggctcatgtctgtaatcctagcactttgggaggctgacacaggcaga

SEQ ID NO: 44583 - DNA, 201 bp, Homo sapiens
cttccctgttggccattactaatgtcaagaacaaagctgtgtaaagtcactaagattttggaggtatcggctgttgcagtagaacctagcctatctcaccygacacaaacgttttctttctcacaaaacctcacaccagtgttgttttattcatctgcttatgcacgcgtatggctgcaacatccttccaaaatgcattac

SEQ ID NO: 44584 - DNA, 201 bp, Homo sapiens
gtcaacagagcttccctgttggccattactaatgtcaagaacaaagctgtgtaaagtcactaagattttggaggtatcggctgttgcagtagaacctagcytatctcacctgacacaaacgttttctttctcacaaaacctcacaccagtgttgttttattcatctgcttatgcacgcgtatggctgcaacatccttccaa

SEQ ID NO: 44585 - DNA, 201 bp, Homo sapiens
atgccccagcaattaaggaagcaatgttcagatgaaacccatgtcttcctcctgggtccctgagtgaccacagtcaacagagcttccctgttggccattastaatgtcaagaacaaagctgtgtaaagtcactaagattttggaggtatcggctgttgcagtagaacctagcctatctcacctgacacaaacgttttcttt

SEQ ID NO: 44586 - DNA, 201 bp, Homo sapiens
tggttcaccctgaccccttcctatgccccagcaattaaggaagcaatgttcagatgaaacccatgtcttcctcctgggtccctgagtgaccacagtcaacrgagcttccctgttggccattactaatgtcaagaacaaagctgtgtaaagtcactaagattttggaggtatcggctgttgcagtagaacctagcctatctc

SEQ ID NO: 44587 - DNA, 201 bp, Homo sapiens
agacagggggattgccataaagaaagagtttaggtccaggcacggtggctcatgcctgtaatcccagcattttgggaggccaaggagggtggttcaactgmggtcaggagtttgagaccatcctggccaaggtggtgaaaccccatccctactaaagatactaatattagccaggcgtagtggtaggcgcctgtaatccta

SEQ ID NO: 44588 - DNA, 201 bp, Homo sapiens
gaaatattaagagccagtgtgtggttcaccctgaccccttcctatgccccagcaattaaggaagcaatgttcagatgaaacccatgtcttcctcctgggtycctgagtgaccacagtcaacagagcttccctgttggccattactaatgtcaagaacaaagctgtgtaaagtcactaagattttggaggtatcggctgttg

SEQ ID NO: 44589 - DNA, 201 bp, Homo sapiens
cttgaaattgtttttgatcatgtgacaaggtcttctgaccctttatcacccacagtgttttattcatttgctctaaaccagcagtaggtgaagttaggaayaatatgtcaagcttcctaactccatggtgctctcattgttgtgtgtgtgtgtctgtgaataaacacggaaataattacgcaaataagctattggcaggtg

SEQ ID NO: 44590 - DNA, 201 bp, Homo sapiens
atgacgtgaattcacacgggcctctcctacaaatctgagtgtacatcaagtgaggggcgtccctccgcacctcactgttgggctgatcaatcccattcccmctccattatgtgtgtatttctaagtggcagatttgccttaggaaatggaagaaggggatgaaatagtgaccaacacaaattactgggttggcgggagttg

SEQ ID NO: 44591 - DNA, 201 bp, Homo sapiens
ttaaattcaggactttaagcttatattccctccttgggctaccaaaacggagatgtgcaatatacaagccctcctgacttttttttttttttttttttttyctgcagagagcgttgctgctccttctctattttatttctttattactgtttttttaaatgaaggagtcagtaacaaaccgttcatcattttgccagagta

SEQ ID NO: 44592 - DNA, 201 bp, Homo sapiens
gttaaattcaggactttaagcttatattccctccttgggctaccaaaacggagatgtgcaatatacaagccctcctgacttttttttttttttttttttttcctgcagagagcgttgctgctccttctctattttatttctttattactgtttttttaaatgaaggagtcagtaacaaaccgttcatcattttgccagagt

SEQ ID NO: 44593 - DNA, 201 bp, Homo sapiens
taatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaa

SEQ ID NO: 44594 - DNA, 201 bp, Homo sapiens
ctaatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattcctta

SEQ ID NO: 44595 - DNA, 201 bp, Homo sapiens
gtctctgtttttttttttttttttttttttcctctaaataaacaaaggaatagaagatcctgtgaagagctgggtgtggtggctcatggctgtaatctcascactttaggaggccaaggcaggaggattgcttgagcccagtagttcaagatcagtctgggcaacataatgaaaacctaatgtctacaaaaagtataaaaa

SEQ ID NO: 44596 - DNA, 201 bp, Homo sapiens
agcttctatcctatgaaagtgaatataaaattcttaaagtttatagggtctgctgggtttaaggaggagaaatttgagttttcatattgtcagtctcaaascttttctgaaattggaagtgatgaagtgacagtctggctatatgtgtgtgtgtgtggtgtgtgtgtgtgtgtgtgtgtgtgtgtgtgtgtgtgtgtgtgt

SEQ ID NO: 44597 - DNA, 201 bp, Homo sapiens
gtttaatttttaggtctgtatttaaaaatctgtgtagtgacaacaattattcttattgtatgaacatattgtcggctggagagtattcagctgtcagacamagtgttctctaaagtgttcagccatcagacagaaactctattgctggtggcggggttgtgggctgggggaaccagagtatttgctcttctttagaagtca

SEQ ID NO: 44598 - DNA, 201 bp, Homo sapiens
tcgaactagttcaccaaagcttctatcctatgaaagtgaatataaaattcttaaagtttatagggtctgctgggtttaaggaggagaaatttgagttttcrtattgtcagtctcaaaccttttctgaaattggaagtgatgaagtgacagtctggctatatgtgtgtgtgtgtggtgtgtgtgtgtgtgtgtgtgtgtgtg

SEQ ID NO: 44599 - DNA, 201 bp, Homo sapiens
aaaggccttgctgggtgaggctggatttaatacatgttagggagatttctctttcacgtttgcttggtgtgtgtttggcggggggaacttacactcttagyaaagtagctagaaaaaaaaataacgtgcaaggggcctattttttcctccttcttctccgtcttaagtcctgaaatgttttagtgacccagaatgaagctt

SEQ ID NO: 44600 - DNA, 201 bp, Homo sapiens
acacgaaaactaaaaacttatacatcattttatattttgaaattcccaatttgcaatgttatttttttttcttctttttttttttatgacacttttcttcyggaaaaaatccttaggacccagttactctctttcaggattttatatcataatgtgtctgtgagagacagagccagatgttcaggatttcagaccaccata

SEQ ID NO: 44601 - DNA, 201 bp, Homo sapiens
tagaaatctggccgtgcctcttttggttaaaatttcaattaaaacatcagatggcacttttttcctattgccattaggagaatattcaattgactgaaaargacatttgaaaatttcctcgtattttcagcatatttgtttctagagttggagaaacaactatttgtctagagagaagtactctgaaaagacaaaggcctt

SEQ ID NO: 44602 - DNA, 201 bp, Homo sapiens
accatggctgaagggttattctggggagccttccctgtggaagccccattaaccatccctgctcattcctcccgtgagaccaccatttgctaaatcttctrtcaggtgatgtgggatccaagaagaaacaataatcagaagcttgccttacaggcatgcacaatttcgggtggactgtcacatgtgcactgaaaaagtcga

SEQ ID NO: 44603 - DNA, 201 bp, Homo sapiens
gaataaaggcatggatgtgactgaggaggtaaaggtgaagaattggggaggggtggatggggctgactcatgacctaaagaacatggcatctggggctctyttgaaataatctgcactaaccactcattcacatttttttgagtctgtaagatcccaggcactcttggtagcaggggggttaggtgggtgaagggacaagt

SEQ ID NO: 44604 - DNA, 201 bp, Homo sapiens
agacatgaataaaggcatggatgtgactgaggaggtaaaggtgaagaattggggaggggtggatggggctgactcatgacctaaagaacatggcatctggrgctctcttgaaataatctgcactaaccactcattcacatttttttgagtctgtaagatcccaggcactcttggtagcaggggggttaggtgggtgaaggg

SEQ ID NO: 44605 - DNA, 201 bp, Homo sapiens
gttccaatgtttctgaaggatgtttttttaaaagaagtattcatttaggtgacacatatttattgagacactaatatatgccaggaattattctattggtkcctttggaggagacatgaataaaggcatggatgtgactgaggaggtaaaggtgaagaattggggaggggtggatggggctgactcatgacctaaagaaca

SEQ ID NO: 44606 - DNA, 201 bp, Homo sapiens
tgatcacaccacagcactccagcctggccaacatagtgagacactacctagatagcttaggagagttccaatgtttctgaaggatgtttttttaaaagaartattcatttaggtgacacatatttattgagacactaatatatgccaggaattattctattggttcctttggaggagacatgaataaaggcatggatgtga

SEQ ID NO: 44607 - DNA, 201 bp, Homo sapiens
cccctacttgagggcgcaggtaggggcactttgctgcctcctttgacaataagcattgccattgccatgtgatttgctttgcctaatgaaatgtgagtgayacttccagatggaaatattaagagccagtgtgtggttcaccctgaccccttcctatgccccagcaattaaggaagcaatgttcagatgaaacccatgtct

SEQ ID NO: 44608 - DNA, 201 bp, Homo sapiens
aatgtggaaatctacatcagagagtggtgtgagtggttcccaaaatgcctacctggcactcctaccaaagacacagcagagaacttggggcctcttgtttyagccattttcatcttcactgtaaatctagacaagataatgaatgaagaacctgacacatttaaggaactccatagttgggagcccagtgtgagtcattat

SEQ ID NO: 44609 - DNA, 201 bp, Homo sapiens
agcccaaaggaactgtgtgcctcgcatcttggtccatcttcatgggttgatcattgtggttcatatcactgtttcatgaaacacagcccgccagaaagtcscgagtgttttgatttcatcctatacctatagttacaggccatttaagatccacagtctgctcttttagcttctgccagcacatttggacatctgtgcagt

SEQ ID NO: 44610 - DNA, 201 bp, Homo sapiens
tgcacgtcgcagaagatcaggaatttgcacattatagtcacaaccatacctagaaccaaattgcctaacactgaatcccaaatccaaattcctgggagatmgaattcaattcttctcttgccacaaatcagctgtttatactcctctttgcacgttgcagaagatcaggaatttgcacattatagccacaaccatacccag

SEQ ID NO: 44611 - DNA, 201 bp, Homo sapiens
tcatggattattggttgtgagtaataggaacctttcaatctaacttaggaaaaaacgttagggagccaaggaggaagagtgggtgtgatgatgcatcaggrtaccagagaatcccgtggaatcccacagtgacacagccaagccttgggaggggtgacactagcgatagagacagaaacccacacaggagtccttttctct

SEQ ID NO: 44612 - DNA, 201 bp, Homo sapiens
ctaccccaggctttgcaacagggaactatatcattattttgcagacacaacaaattctgcaagcatgtatctttggaataaaggagagagggttggacacraatgtgattacaacatatgcttctctgggcatagctttgccccattgcacgaatatagaaaatttggcaggctgaaaataagcggaaagatcctcaagct

SEQ ID NO: 44613 - DNA, 201 bp, Homo sapiens
acaacataattgtttgtgtctaccccaggctttgcaacagggaactatatcattattttgcagacacaacaaattctgcaagcatgtatctttggaataarggagagagggttggacacaaatgtgattacaacatatgcttctctgggcatagctttgccccattgcacgaatatagaaaatttggcaggctgaaaataa

SEQ ID NO: 44614 - DNA, 201 bp, Homo sapiens
ccttcactcatcttacctccttcttctgtggcatttcataaatttaatgattgtaattgtgattacaacataattgtttgtgtctaccccaggctttgcawcagggaactatatcattattttgcagacacaacaaattctgcaagcatgtatctttggaataaaggagagagggttggacacaaatgtgattacaacata

SEQ ID NO: 44615 - DNA, 201 bp, Homo sapiens
ctttgacctgtcattcactaagtctttcaccatccttcactcatcttacctccttcttctgtggcatttcataaatttaatgattgtaattgtgattacarcataattgtttgtgtctaccccaggctttgcaacagggaactatatcattattttgcagacacaacaaattctgcaagcatgtatctttggaataaagga

SEQ ID NO: 44616 - DNA, 201 bp, Homo sapiens
actgttttaagacacttggtacacattgatatgtattgtccaattgctttccagaaactatataaaatattacaaagaaaaacatatatatatatatatatgtaaaatatatatatgaagggagaaataaatgtaaatgaaaagaaaaacatatagagaaagaatatgtctaaaagaaactgcagaggcagctataattaa

SEQ ID NO: 44617 - DNA, 201 bp, Homo sapiens
aggttgtttgccccaaccccctgttacattcttgaaccatatgtttcccattgtttgcacttcccctagtcacctggtgctttaatttttgcctgtaaccwtctgaaactttccttaaatgttcggctttgacctgtcattcactaagtctttcaccatccttcactcatcttacctccttcttctgtggcatttcataaa

SEQ ID NO: 44618 - DNA, 201 bp, Homo sapiens
aactgttttaagacacttggtacacattgatatgtattgtccaattgctttccagaaactatataaaatattacaaagaaaaacatatatatatatatatatgtaaaatatatatatgaagggagaaataaatgtaaatgaaaagaaaaacatatagagaaagaatatgtctaaaagaaactgcagaggcagctataatta

SEQ ID NO: 44619 - DNA, 201 bp, Homo sapiens
aaactgttttaagacacttggtacacattgatatgtattgtccaattgctttccagaaactatataaaatattacaaagaaaaacatatatatatatatawatgtaaaatatatatatgaagggagaaataaatgtaaatgaaaagaaaaacatatagagaaagaatatgtctaaaagaaactgcagaggcagctataatt

SEQ ID NO: 44620 - DNA, 201 bp, Homo sapiens
gtcttgaagtcctgaccttaagtgatccaccctcctcggcctcccaaagtgctcggattacaggcatgaaccactgcgcctgactgtacttttttttttttaaagtatacccatacccattgtacacatttggtattttttctttaaaaaaaaaaagcatttactttttgcctcatgaatctctgagtacattttgtgcat

SEQ ID NO: 44621 - DNA, 201 bp, Homo sapiens
cagagcaagagtccatttacaaaacaaaaacaaagaactgacaataaatagttttctccgttttgtgacttatttttaattattaagaataagtgtcataragccaatactttctaacatgtgtatagtatgttatagttttcaaagtctttgacaattatacctagggagccaggacagtatttgtatcatcatttcatt

SEQ ID NO: 44622 - DNA, 201 bp, Homo sapiens
gttcacgcctgtaatcccagcgctttgggaggccgaggcaggcggatcacctaaggtcgggagttcgagaccagtctgatcaacatggagaaaccctgtckttactaaaaatacaaaattagccaggcatggtggcacatgcctgtaatcccagctacttgggaggctgaggcaggagagtcgcttgaacttgggaggcag

SEQ ID NO: 44623 - DNA, 201 bp, Homo sapiens
ggcaggagaatccctatggtctcttgagtccaggagtttgagaccagcctgggcaagatagcaaaatactatctctacaaaaaaatgaaaaaaaaaaaaaraaaaaagcctgtcatagtggtacatgcctatagtcttagctattcaggaggctgaggtgggaggatcgcttgagcccaggaatttgaggttgcagtgagc

SEQ ID NO: 44624 - DNA, 201 bp, Homo sapiens
acttcttattttaatattgtacccattgtactttagtctaagtgatggctgcttatggccatgccctttcttctgcactttgggtgttttgtctggaattktctctcctttccttttgtgaaaaaggatgaattttccgagactctgttatgacagaaactcaccagttctctgttgttaatcaacaaatagattgtgaat

SEQ ID NO: 44625 - DNA, 201 bp, Homo sapiens
ttgcaataatgtaattgaaataatgtaatacaatcctgcttaatattacactgtatatattcattgacttatagactgagctccttatcttgttcattgcyatggctttagcaccttttgaacagtggtgcttggcttttggtaggtggtcaacaaatgtgtattaagtatatgaactgttggaagggtctgctgtgaagg

SEQ ID NO: 44626 - DNA, 201 bp, Homo sapiens
tgactttcttacctacgctaccttataatccttttataaattttgctttacgttttaacaacggaaaacacttaaggtttttttcctttctttttttttttaattcttccgccagctatctttaaaagcagttctaaaacttcttattttaatattgtacccattgtactttagtctaagtgatggctgcttatggccatg

SEQ ID NO: 44627 - DNA, 201 bp, Homo sapiens
ttaagcattgctaaattggaaaaccatggaatatagagatccagtagttaagagcctactgggagagacagcataataattacaataagtgcagaacttgmaataatgtaattgaaataatgtaatacaatcctgcttaatattacactgtatatattcattgacttatagactgagctccttatcttgttcattgctatg

SEQ ID NO: 44628 - DNA, 201 bp, Homo sapiens
ctttgggaggccggggtgggcggatcacaaggtcaggagtttgaaaccagcctgaccaaccctgtctctactaaaattatttaaaaaaaaaatagctgggyatggtggcacacgtctgtaatcccagctactcgagtggctgaggcaggagaatcgcttgaacccaggaggtgaaggttgcagtgagctgagatggcgccg

SEQ ID NO: 44629 - DNA, 201 bp, Homo sapiens
gcaggctgccaagaatagcagttagaaatagctagtatcaggcctggtgtagtggctcatgcctgtaatcccagtgctttgacaggctgagggaggagaaytgcttgagcccaggagatcgagaccagccagggtaacatagggagaccctcatctctacaccgaatttaaaaacttagctgggcatggtggtgcctacct

SEQ ID NO: 44630 - DNA, 201 bp, Homo sapiens
attcaagattggaaaatgttcatgttaaattattgttggccgactgtgggttcatttaattaggttctctgttttggggtatgttgaaaatttttcataakaaaatattattcagaggtctcaagaggcaggctgccaagaatagcagttagaaatagctagtatcaggcctggtgtagtggctcatgcctgtaatcccag

SEQ ID NO: 44631 - DNA, 201 bp, Homo sapiens
ctctttctcgatccttgcagtttcccttttgacctgtgggtacacatggtactgacgcaattggcacctcagatggttcttcctgacagctacccttgcamctgactcaggatacaaactacctttttttttggagacagatctcactttatcacccagtctggagtgtaattgacgcaatcctggctggctgcagccttg

SEQ ID NO: 44632 - DNA, 201 bp, Homo sapiens
acattgaaaacttatccaggagaggaaaggctctttcagctgctctttctcgatccttgcagtttcccttttgacctgtgggtacacatggtactgacgcrattggcacctcagatggttcttcctgacagctacccttgcaactgactcaggatacaaactacctttttttttggagacagatctcactttatcacccag

SEQ ID NO: 44633 - DNA, 201 bp, Homo sapiens
gctcagcacacttggtgcagtctctctggcttggtaattggtcccaagaaaatagtttttttccaattatggcaacattgaaaacttatccaggagaggawaggctctttcagctgctctttctcgatccttgcagtttcccttttgacctgtgggtacacatggtactgacgcaattggcacctcagatggttcttcctg

SEQ ID NO: 44634 - DNA, 201 bp, Homo sapiens
gcagagtaaacagacaacccgcagagtgggagaaaatctatacaaatctatacgtctatacaaggactaatatccaggatctacatggaactcaaattagmaagaaaaaagctaacaatcccatcaaaaagtgggctaaggacatgaatagacagttctcaaaagaagatacacaaatgaccaccatacgtgaaaaaatgc

SEQ ID NO: 44635 - DNA, 201 bp, Homo sapiens
ttgagcctaggaggttgagagtgcagtgagccgtgttgctgccactgtactccagcctgggcaacaggacaagaccgtgtctccaaaaggaaaaaaataawaaagcactgtctctctctacccttgcagtatccctgtaggagagagttactattagctcccagtttataggtgagtgatatggtttggatgtgtccccac

SEQ ID NO: 44636 - DNA, 201 bp, Homo sapiens
taccatatccaatttttgcctctctttttttcttgggttccccccgacaaaaaaaaatatgacagaagtatcacccatccagccagccagccatcaatccrgtatccattcatccatccatccatctaggcatcccaggtgactcattcctgtgaccttgggagacagtctttcttcctagaggttgtttgccccaacccc

SEQ ID NO: 44637 - DNA, 201 bp, Homo sapiens
tagcccataagtgactcacgtcacttctgactaccatatccaatttttgcctctctttttttcttgggttccccccgacaaaaaaaaatatgacagaagtrtcacccatccagccagccagccatcaatccggtatccattcatccatccatccatctaggcatcccaggtgactcattcctgtgaccttgggagacagtc

SEQ ID NO: 44638 - DNA, 201 bp, Homo sapiens
gacagtgggtatttaatcaccttagcccataagtgactcacgtcacttctgactaccatatccaatttttgcctctctttttttcttgggttccccccgamaaaaaaaaatatgacagaagtatcacccatccagccagccagccatcaatccggtatccattcatccatccatccatctaggcatcccaggtgactcatt

SEQ ID NO: 44639 - DNA, 201 bp, Homo sapiens
aagacagtgggtatttaatcaccttagcccataagtgactcacgtcacttctgactaccatatccaatttttgcctctctttttttcttgggttccccccracaaaaaaaaatatgacagaagtatcacccatccagccagccagccatcaatccggtatccattcatccatccatccatctaggcatcccaggtgactca

SEQ ID NO: 44640 - DNA, 201 bp, Homo sapiens
atggtccatttaaagtgcttaaaccaattgccaggcacataataggtgctcaataaatacttcctttatttccctgttaggcctctcccaaccagagatcraagatgattggccctgaagttatttttccccccaaatttgatagaaatcagtagagatgctaaaatataatacatttgacctgcattgatcaaggtaggc

SEQ ID NO: 44641 - DNA, 201 bp, Homo sapiens
ggtgataatgagacctatccctaacggttaaagtgacatggtccatttaaagtgcttaaaccaattgccaggcacataataggtgctcaataaatacttcstttatttccctgttaggcctctcccaaccagagatcaaagatgattggccctgaagttatttttccccccaaatttgatagaaatcagtagagatgctaa

SEQ ID NO: 44642 - DNA, 201 bp, Homo sapiens
gttgtctgtgtttaaaggacttgatggataaagggagatttaacagtttatagccagattggactcaaccatgatgatttctggtccatcttttagaatgkcttcacttctcttggcctttatttctccaagtggtgataatgagacctatccctaacggttaaagtgacatggtccatttaaagtgcttaaaccaattgc

SEQ ID NO: 44643 - DNA, 201 bp, Homo sapiens
gttgagaggagagtcccttgaatgccacgcaacatttctctctgtaggtgtcctctgcacactgtccaaactccatttttaaccttgactgcatagtaccrtgtacattcattaagcatccctcgccataggagaatctgagttcctgggagcatttaacacagttcctggccttgagtaaaaacttcataagcacttgtt

SEQ ID NO: 44644 - DNA, 201 bp, Homo sapiens
ccaaatccttttgttttgttatcatttgctaatagagatctttgaaagaaaattcaaagattgaagtttgtattctcctaaactcctgcaaagaagtcctstgcaaggatcgttcactagtgttctgcatcgttcttcttactcaactctcccgagaggcattgtggacgcctgtggggttggtttttggcacccatccct

SEQ ID NO: 44645 - DNA, 201 bp, Homo sapiens
ataatgtttaacataatatctgggtatcctgtggcccagtcaagtggacacatacaattagacatcatggtggttatgccaagttttttttttttttttttgagatggagtcttgctctgttgccagggtggagtgcagtggtgcaaccttggctcaccacaacctctgcctcccaggttcaagcgattctcctgcctcag

SEQ ID NO: 44646 - DNA, 201 bp, Homo sapiens
atggaggcagcatataaggttgcaaagcactgaccttctctttttatgattcccatttattccatagactgtgaagtctgcctgtacatttccaggctagyagtttttaatcaaatgtatgatcactttcttctgatgaacacagttaaggggctttgttgttcaggtgagtctcacattgtactcctctcctaagagcat

SEQ ID NO: 44647 - DNA, 201 bp, Homo sapiens
caaccaatggtacagttcatgtctgagtctgagcagctgagaagcaggagataaaaaggcatcagttccattccatatccaagtctgagtccaagggcagsagaagctgatgtctcagcttgaagtcaggcatagagaggcaattctttctcactcagccttttattttattcaggccttcaacagattgtatgaagccac

SEQ ID NO: 44648 - DNA, 201 bp, Homo sapiens
gtgctgggattacaggtgtgagccaccacggctggccaatatctactagttttgaaattaaaaaaaaaaaaaaaaaaatatatatatatatatatatatakatatatgaaaaaaaggacaaacgatttcagttgcacaactataatcgatgaagtggctccttgatgttctcggggcaatctgagacactggggagaaccc

SEQ ID NO: 44649 - DNA, 201 bp, Homo sapiens
ccacctcagcctcccaaagtgctgggattacaggtgtgagccaccacggctggccaatatctactagttttgaaattaaaaaaaaaaaaaaaaaaatatawatatatatatatatatatatatatgaaaaaaaggacaaacgatttcagttgcacaactataatcgatgaagtggctccttgatgttctcggggcaatctg

SEQ ID NO: 44650 - DNA, 201 bp, Homo sapiens
tcccacctcagcctcccaaagtgctgggattacaggtgtgagccaccacggctggccaatatctactagttttgaaattaaaaaaaaaaaaaaaaaaatawatatatatatatatatatatatatatgaaaaaaaggacaaacgatttcagttgcacaactataatcgatgaagtggctccttgatgttctcggggcaatc

SEQ ID NO: 44651 - DNA, 201 bp, Homo sapiens
cctcccacctcagcctcccaaagtgctgggattacaggtgtgagccaccacggctggccaatatctactagttttgaaattaaaaaaaaaaaaaaaaaaawatatatatatatatatatatatatatatgaaaaaaaggacaaacgatttcagttgcacaactataatcgatgaagtggctccttgatgttctcggggcaa

SEQ ID NO: 44652 - DNA, 201 bp, Homo sapiens
ttctttagtggcgatttatcagatttcagtgtacccatctgagcagcatatgctgtacccaatatgtagtcatatatatatatgtgtgtgtgtgtgtgtgkatgtatatatatgtgtgtgtatgtatatatatgtatgtatctgtatatgtataatggctgtacatgatataattttgagttggaaaaagcaaattgaaga

SEQ ID NO: 44653 - DNA, 201 bp, Homo sapiens
atagcaaaaaaaggaaaaatgaaagaaattaaaaagatacctctatatacatacattgtgtgtttgtgtgtgtgtgtgtgtgtgtgtgtgtgtgtgtgtgkataaattggctgtgcatgatataagtttttatttcaatcgttttaggggtaaagtggtttttgattacatggagaagttctttagtggcgatttatcaga

SEQ ID NO: 44654 - DNA, 201 bp, Homo sapiens
ggtggttcacacctgtaatctccacactttgggaggctgaagtaggctgaagtgggaggatggttagagcctaggagttcgagaccagtctgggcaacaamgtgagatcctgtctctacaaaaaataaaaaaaattatctgggtatagtggtgtgcacctgaagtcccagctaactgggagtctgaggcaaggaaattgtt

SEQ ID NO: 44655 - DNA, 201 bp, Homo sapiens
tataaaaggcagtgttttaagttctagaattaaaagcaattgcagcaaataccaagtgagattttctgtattttgagagtttgtgtgtgcaatggttttcyactgactaatcaggctgataaaacaacctgaaaatggctttcccatggagtttatatatttcgtcagagacctaaaatggtataaatgttcaataatagc

SEQ ID NO: 44656 - DNA, 201 bp, Homo sapiens
tacatagtgacatgaaaattgtgtattcacattgttctattgatttcgttgagaaagtgaccttgtatgcacacatgagaatttagagatctatatatacygcctggcctcttctttgtaagggtataacagcagtggttaacatgcatttttttttttaacagttagatttactcttcctttgcacagactaatagcaca

SEQ ID NO: 44657 - DNA, 201 bp, Homo sapiens
gacaaaggtgacagaaaggaaatctcctaagttggcctacagggtgctttagaaaacatctggctgggcatggtggttcacacctgtaatctccacacttygggaggctgaagtaggctgaagtgggaggatggttagagcctaggagttcgagaccagtctgggcaacaacgtgagatcctgtctctacaaaaaataaaa

SEQ ID NO: 44658 - DNA, 201 bp, Homo sapiens
tttaagtgatgcatcagaatttcatgatgagcaaatgcctatggatgccctcatttctcatccttcttgactgtctgctaagattcactcttggtcttgtstttgagcttttctgttcagtgatgtaatgggacaggctctcctgtcatcaagagttcccatcatacctgggcactgccatttcctctgtggtagatgctt

SEQ ID NO: 44659 - DNA, 201 bp, Homo sapiens
atacaggcactttgtctcccagtggaatataagttctttgaggccaaggactgtgtcttattctgtgttgcatccctttggcttcagcctcattgtcttgmgtttattaagcatttggaacatttcagctgaatgagtgaatgagtgaatgagtgaagccatcagtcaaatcagaacactgctcacacatgcatcccaagt

SEQ ID NO: 44660 - DNA, 201 bp, Homo sapiens
ctaagcagacatactcgatacatcttcactaatgagttctgacttcataaaatgtattaatgacttctttttgaaagtaagagtgctttgaataccagtcrttattgctttagaagttcataaaagcaaaagcacagtatttcccccagtgtttgtgcgataagagaatagatgtaggtccagcgcctagaattttagcta

SEQ ID NO: 44661 - DNA, 201 bp, Homo sapiens
gtttgtgcagtgggaagttggagaaagtacaaatgaaagcctctctgcagtgaacctcatgactgctttagagaggtgcttatgtaataactgcagtggtrtcgctttagaaaaagttacagagcttgtctttctagagcaacctcttggcttatcttaattaccagcagtccatagtgagactggagggaagaaaaaaag

SEQ ID NO: 44662 - DNA, 201 bp, Homo sapiens
cagtgcagtgatgcaatcttggctcactgcaacctctgcctcgcaggctcaaatgattctcctacctcagcctcctgagtagctgggattacaggtgcccrcccccatgcccagccaatttttgtatttttagtagagatgcggtttcaccatgttgaccaggctggtctcgatctcctgacctcaggtgatccatccatt

SEQ ID NO: 44663 - DNA, 201 bp, Homo sapiens
gtggagagacagagaatcagttaattccagggtcatgtattaggtagtaagatagtggttcacaccaaaaacatagaaaatgatcacttagcctgatccasaagttcaggaaagggctctgagcaggagatggaagacctcttggctggttaaatggagatcaagtggcagcttggactcctgctgcaattaaaaaattac

SEQ ID NO: 44664 - DNA, 201 bp, Homo sapiens
tctgagagcagggccaagaaagggaaagagagagagaggaaaaaaaacaaaaaagaaaaagaaaaaagagaggtgggtagggagggaggagagacatggayccacggggaatgggaagagaaatagaaatagggaatttgaaatggaaataaaacaaaagggcaggaaaggaagaaataaagagaatgagataaaaggaaa

SEQ ID NO: 44665 - DNA, 201 bp, Homo sapiens
ttcgttcttaaccaacatggcaccccaggttcagtggtgagagtgtcactggcaacttctgaaataacatctctgttagtttgtggagtgggctaaatggscagcccttctacgagctccctcatggttgcgggggactaccaatcactctctactttttttttttttttttaataggtcttgtcatttgtaaatgcagaa

SEQ ID NO: 44666 - DNA, 201 bp, Homo sapiens
atcttcacctgggaatgttctcctaatagtcacttttgttataaatcttcacctagcatgggagttaagtgcattttaaaactagacctggggactatgtrtcctaaaatgcaaaaatagcccccaaaatgaaaattaatgttgagaatctagtcaatctgccagcagtacgtacataactgttctgtgtatatttcacat

SEQ ID NO: 44667 - DNA, 201 bp, Homo sapiens
gtgccccatagctgcaaagtcacaggaagcttgcagcaggccagtggtaacctctgagtgacttctgagttcccagagctaggaccatgacttttcccctrgattcttaagtacccggctaaaattgtgtttgccgaatgaaagtgtgatcctggaggccatgttgtttgtggttcatggaagggtgcttgttcagcttgg

SEQ ID NO: 44668 - DNA, 201 bp, Homo sapiens
gtgaatgggtttggagccaacagggataatagacaacgctatcaagaggggggccaaccacacatgtgcagccactgtatgacgtctggattttccttgasttatggtgatcactattgggaggtggtaagcaaacaggtgacataatttgaatcatggttttaaaagacgccatggttgccatgaggaggacaatgcgta

SEQ ID NO: 44669 - DNA, 201 bp, Homo sapiens
ggggatgggaggggggctccggaagatccctaacccattgtggacacaccatttatgttagtggaatctggtaagagtgattgaggagagagcattgggtsaatgaccctgtaatccttataaaaatagtagcaacggtaactaatgatgtttatgaactgcctaagaatgccatgactgtgtcaagcacttcccataact

SEQ ID NO: 44670 - DNA, 201 bp, Homo sapiens
acgaagtgttgtaatacaaggcaaagaaaatacaaacccatccttagtcatttagaaagacaacctggttgagaatttaagatgatggtttagggcatagyttgtggaattcgatgggttgcactgtaagtttcagtttccttatctgtaaaagtaggaataatatctagacctaaaggttattttgaagattaaatgaga

SEQ ID NO: 44671 - DNA, 201 bp, Homo sapiens
agagactgtttgccagggaaccaaggcctttcaaagttgaggacacttcccggtgccgtgcggtgtaaatcacagtgcaaactatgcgattatcccctgcwgaggaatcgagtgtgactttatgggattcttcaccaagcacttaggaataatctgatataaaacagcaggggtggagagtaatgacaacttcaaattagt

SEQ ID NO: 44672 - DNA, 201 bp, Homo sapiens
ccattttaaggctgtgtgagcactgatccatgacagtattggttcaggggcaaagaatgggaggaaagaaaaagacaagttatagctgcactgaaaacaarctgggcatgtcctaattttgctcagggctacttctcttagagtcgttaaggttttgagcatattaacagcaatactgatcatagctaatatgcctctatg

SEQ ID NO: 44673 - DNA, 201 bp, Homo sapiens
tgttatttcactgatggaaaaacaagcacagagaggctaaggaatatgctgaagcttgcacagctagtaaatggcagaacattcagactggaattcagacktatacactcacattcataccacacagcctctcgaagggacgtgccccttgaacgcaagagaggtacattgggtggccatggtgctcacagtctctcaatc

SEQ ID NO: 44674 - DNA, 201 bp, Homo sapiens
tatagttatgcaaatgaaaaccattaatcctggagcctctgacttgcaaggtgtgcttcagaaatttgcagcttctatttaggtaggaagagtttgccagyccgaaaactccagtaagcaaacagctttatagtaccccagccatagaaagtgagagctttcgaagaatctgtggttagaactaagaggatttttctttct

SEQ ID NO: 44675 - DNA, 201 bp, Homo sapiens
aaactttatttacaaaaacaagaggagggccagattttgcctttgtcaaggaagtaagcataatagtgcaagcagcacgtgcccgctctttcacactgggrcaaacacaggggatttattcggcacaattgagtaatgtggatgaggctgctcagggctggcagttgtaggacgcaaaaccttgaggggcatcgatattct

SEQ ID NO: 44676 - DNA, 201 bp, Homo sapiens
tgagtcccccatcctcccctgtgtagaatgaggctaatgctagtgctcatttcatagagttgctacaataatcaatgagataatgtgcataaagatttacrtacataataactgctcaataaagggtagatgttaaaattagcatcagcgagctctagaagatgctaagttctctggaaagatcagctctgctcctgtcaa

SEQ ID NO: 44677 - DNA, 201 bp, Homo sapiens
attctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttctctcactggtttctatggctct

SEQ ID NO: 44678 - DNA, 201 bp, Homo sapiens
cttggaacatggaagttcattgactttgttgcctagcagggcctggagctgggtttcttgcctgatcaatgtatatcattttgccaagagacagagtctgygctggagagattgattccctggttatttatcttcctctgcccagtgtaaattggtcagcctgatcctattcgcatgataaaaatcataatgtctcaaatt

SEQ ID NO: 44679 - DNA, 201 bp, Homo sapiens
cattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttctctcactggtttctatggctc

SEQ ID NO: 44680 - DNA, 201 bp, Homo sapiens
ttttgctgttacgagcatggatttagctcatttttaccatcttccctagttgtatcaccttcctcccattatgtttgtaacttcagattttgtatatttcrcatatgtcaatatgtaaacattttatatatatatatatgcatgcacacacatgcatacatatatgtaatggtatatatacatgtaagtttccatttttgc

SEQ ID NO: 44681 - DNA, 201 bp, Homo sapiens
cagcactttgggaggccaaggtgggtgggtcacctgaggtcaggacttcgagaccagcctggccaacatggtgaaaccgcatctctactaaaaataaaaawaaaaaaaaattagccaggcatggtggtgcatgtctgttatcccagctacttgggaggctaaggcaggagaatcacttgaacctgggaggcagcggttgca

SEQ ID NO: 44682 - DNA, 201 bp, Homo sapiens
tggtagctcatgcctgtaatcccagcactttgggaggccaaggtgggtgggtcacctgaggtcaggacttcgagaccagcctggccaacatggtgaaaccscatctctactaaaaataaaaaaaaaaaaaaattagccaggcatggtggtgcatgtctgttatcccagctacttgggaggctaaggcaggagaatcacttg

SEQ ID NO: 44683 - DNA, 201 bp, Homo sapiens
gagcctgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcag

SEQ ID NO: 44684 - DNA, 201 bp, Homo sapiens
gtgaaatgagccccggctcagcaggccagttgtcttcagtgacccccagtgaggcagcaggtgggacttgattctggaggcaagactcaactccatagacrgggcttacacaccggaccaaattgaggactagctaaaacagggatagggtgggtgcacctttccatgagctgtgtccgccagtgtgtcatgtcagtttac

SEQ ID NO: 44685 - DNA, 201 bp, Homo sapiens
tggagctaaggaatgaaaagttgcttaaacattttcctgttgccagtttttcttaaacattagtgctattcttttttttttttttttttttttttttttttccttcttcaaccctgactctgattcacaaagaatagggaagcttagccaactgcagtttcaaagtattgcttcttaagcctgggccaagtgtgtagactt

SEQ ID NO: 44686 - DNA, 201 bp, Homo sapiens
atggcctgggaggcaagtgtgatcattcaggtaatcaaagtaactacagaaacagaggtatggattagctagtcattgcagatgtggcattgagcatatargcgtggtgtacatcttagaacttcatctggaaatgcctgtgggggagttggatttcaagatcatcgtcaatgtcatgtcactgtaatttcatttacatta

SEQ ID NO: 44687 - DNA, 201 bp, Homo sapiens
caagtgtgtttaatgtgaaaatagaaatggagggcttttaaaagagcttactcaaaatcctgccaattactgaaatctaccagacaagaaggagccactcyttttttttttttttttttttttttttttgatacaatgaggggaaatgtttcttccacaaaagcctggccgtttgtctttaaaaattttcatcttttgggt

SEQ ID NO: 44688 - DNA, 201 bp, Homo sapiens
taagttcttaagatttggcagctgtggatcgtgtttagtaagcacgatctctaactctttggaactcagaactatgtaattgaaatggcctgggaggcaartgtgatcattcaggtaatcaaagtaactacagaaacagaggtatggattagctagtcattgcagatgtggcattgagcatataagcgtggtgtacatctt

SEQ ID NO: 44689 - DNA, 201 bp, Homo sapiens
cgtctagttataggaaaatactgagatacttgtgagatgttttctttttttttttttccaacttgtatacacgttgttctataagtggttgattgtttttyaggaaaaaaaaattcagcatctcaaatgtacctttaatattgcttctgatttttgttgttttgctatcatagcgttacctacctcacagagatgttttag

SEQ ID NO: 44690 - DNA, 201 bp, Homo sapiens
agatttccccttttcataaggacaccagtcctattggattagggctcccccattatgacctcatttatccttaattatgaccataaaggccccatctccaratgcagtcatgttgggggttagggcttcagtgtatgagtttgggatggcaggggagcagttcagctcgtgagaatcgtaagattcctgatctgtttctct

SEQ ID NO: 44691 - DNA, 201 bp, Homo sapiens
acctgaggtctagggctaaactcttgcctttacctgttccatgcttagccgttcctgctttttgcctagaacctcagtgctattgctcacacagacccagytcatgtccccaggccatgaccactgcctccccttctcccacctgtgcaggtgttaagcatcagtacataactgaggagtaggagggcagcagcccaaatc

SEQ ID NO: 44692 - DNA, 201 bp, Homo sapiens
agttcctctccaaactgtcaaggacagtgccaagatctgcgaatatagaaagattaagagtttttttctgccttgttgggtcttctttctagcatgccagsaacatttttctcatcttttgaacattagggaataacacccaatgccaccctataatctcgagacagaagtggaggatcctcttaagacaagaaatctttc

SEQ ID NO: 44693 - DNA, 201 bp, Homo sapiens
atgttaacctcctttggaaacacccgcacagacacacccaggaacagcaccttgcatccttcaatccaatcacattgacactcaatattaaccatctcagyaggcttcttcgtgttcacatagtctcctcaccgtgtgctgtgtccagatttccccttttcataaggacaccagtcctattggattagggctcccccatta

SEQ ID NO: 44694 - DNA, 201 bp, Homo sapiens
ccgctgacttaaatgttaacctcctttggaaacacccgcacagacacacccaggaacagcaccttgcatccttcaatccaatcacattgacactcaatatyaaccatctcagtaggcttcttcgtgttcacatagtctcctcaccgtgtgctgtgtccagatttccccttttcataaggacaccagtcctattggattagg

SEQ ID NO: 44695 - DNA, 201 bp, Homo sapiens
ccaccatacccagccaaaatattcttttcaaagtgattagaagtaggagaagcttgctctctttttattggcacttctgtcttacatgcactttttgattkaaattattctgtcttctatgaaatgacagtgattggaggtggtttatttttttttaagtctgcttactcggaaaaataaaacaaagttgacaacctgatt

SEQ ID NO: 44696 - DNA, 201 bp, Homo sapiens
actcctgggctcaagcaatctgctcacctgggtctcccaaagtgttgggattataggtgtgaaccaccatacccagccaaaatattcttttcaaagtgatwagaagtaggagaagcttgctctctttttattggcacttctgtcttacatgcactttttgattgaaattattctgtcttctatgaaatgacagtgattgga

SEQ ID NO: 44697 - DNA, 201 bp, Homo sapiens
ttcccttcggaaaactccctgggtgccccagcattatgtggtaaaggacatgtatttccaactggcaggggctctgcaaagtttctctgcctcctttgctmaccaaaccctaaataattgtctggatgttccttttattgtcacctctgaaacaagacgaagatttggacggtttgctttagagtgcattaacttctttat

SEQ ID NO: 44698 - DNA, 201 bp, Homo sapiens
agaataaaatatcatcaggagcagctcatgtgaccagaatgtgacaaagtctttgctctacaggtcaagttgggacttactgaggagaaatgaggggactkcaaagtccaggttgcaccatccactttatagatgaggaaagtaagaacccacagcatcttgcacgtagaattcaatatatgtcctgcttcttgaatcaca

SEQ ID NO: 44699 - DNA, 201 bp, Homo sapiens
gggattcatacggacattatttagacacacttccacctacagagtcacatattgtatagaataaaatatcatcaggagcagctcatgtgaccagaatgtgrcaaagtctttgctctacaggtcaagttgggacttactgaggagaaatgaggggacttcaaagtccaggttgcaccatccactttatagatgaggaaagta

SEQ ID NO: 44700 - DNA, 201 bp, Homo sapiens
tctgtctcaaaaaaaaaaaaaagtgtactttttgaggaaagttctatttttcattattttccactatgaatgaagaagaaaataatatacatacattactkggattcatacggacattatttagacacacttccacctacagagtcacatattgtatagaataaaatatcatcaggagcagctcatgtgaccagaatgtga

SEQ ID NO: 44701 - DNA, 201 bp, Homo sapiens
ttgctcctgggttgcaggacgcatccatggatggagcatgggttttgggctgtggggggacaatgaggtggttcctgaaatccctagttactagcagacargtgcatcagacaagtgcatttcaccgttctgagcttcagtctcttatccaagcagaaacatggccagaatgcaatgtcctaatacatgtaattcattacg

SEQ ID NO: 44702 - DNA, 201 bp, Homo sapiens
aaaacagtccatcttgttggaaggctgtcaagctgtgtaataaaagaattactgttctccctttgcatttatgcattgcatgtctctgttgaattcagagygctttatagacctctgatcagcttccagcatcctcttggtatgagttctagggggagatgaggaatgtgcctaattcccttgagtgatttacttggtgtt

SEQ ID NO: 44703 - DNA, 201 bp, Homo sapiens
ttaggatgtcagtcccagttttaattacaagtgttcctggttgtggcattcatgtaattgggggctgatttatgccaaatgatatgcactgatgtaagggsctggagcccaagagggaggggaggccaagaagaggcagtggccccccaccaagcccggaactgaggtggcacatgtcagcggctttgctcagaagcaccc

SEQ ID NO: 44704 - DNA, 201 bp, Homo sapiens
acaccagcaactgtatcacccagttcactgagagttaaaatcacccatgtgacgttctctctgcaggcacatagtaagtgctggataaatgatagggattsatattgaccagctttgacacatgaataggagagggttaggcaaagacaaagagagatggggatgccaagtaccctctgggcagaggaaaccatgagtgca

SEQ ID NO: 44705 - DNA, 201 bp, Homo sapiens
tttttttccttaaaaaaatttcttttaatgcaacagatttaagggaccagggtgttctctagagcaggggtccatgacctctaggccacaaaccaatagcrgagccgtggcctgttataaattgggtggcatggcagggagtgagtggtgggcaagcataggaagctgcgtctgtgcttagagccgctctctgtcactctc

SEQ ID NO: 44706 - DNA, 201 bp, Homo sapiens
gttttctggagccaggatgagctgggaccaacaccagcaactgtatcacccagttcactgagagttaaaatcacccatgtgacgttctctctgcaggcacmtagtaagtgctggataaatgatagggattgatattgaccagctttgacacatgaataggagagggttaggcaaagacaaagagagatggggatgccaagt

SEQ ID NO: 44707 - DNA, 201 bp, Homo sapiens
ttatagtttcctaagtatttgtattgcagcattgctttcagtggccaacaaaacaaaacaaaacaaaattggaaacaacataaaataatattaccggagawacaatgagtaacatgtataggattttttttttttttttttgacggagtcttgctctgttgcccaggctccagtgcagtggcgtgatgttggctcactgca

SEQ ID NO: 44708 - DNA, 201 bp, Homo sapiens
ttcctttgtttgcaaaatagtaacaatattttccttccaagtgatggtgaggatttaagagttaacctgagtgtctgctgcatagtaggtgctcaataaastataacgtctttatttcttttccttccaatgagaagtcacttcctggagggaagccacctccaggaacagtcctggttcaactcatgaggagggtcactg

SEQ ID NO: 44709 - DNA, 201 bp, Homo sapiens
tcctgtcaattgggaaaatatcgtgaggcggagatgtgagatgtgatcacgtttataaagtctgcggcaagaggatgataaagtcacttctcaactccttstcaactcctcctcctggcttattaatgcccatcctttaacctgtcctctgctttatctcttggaatccttagggcctttttaaccccatatacgaagcaa

SEQ ID NO: 44710 - DNA, 201 bp, Homo sapiens
ggctggcttccccaggaggctttcacaaatgcttaccgagcatctgctgtgtgccagacaagagtgaggagctggggactcagagaggagcagacgagggrgacactcacattagagagtggcgtgtgctgagggaaggtgcctcaggcgacagatgggaccagggcctttaactcagtggcagcttcagagacagatctg

SEQ ID NO: 44711 - DNA, 201 bp, Homo sapiens
catggcctgctcacaaatcttatgataaaactctacccactgagaagcacaaggtgtgaggctattgatgaggagttgaaggtgacagagactgagaaagkgctgcacacctttggcctaaagggtaatgagcaacacacaaggattgggagatgttcatggcaagaaaaattcagaagggacattgttgtttcactaatt

SEQ ID NO: 44712 - DNA, 201 bp, Homo sapiens
tactcatgcctagacttcttgctttttaaaaataatccacccatgaaacaagtgtttatttacaaggctggcttccccaggaggctttcacaaatgcttaycgagcatctgctgtgtgccagacaagagtgaggagctggggactcagagaggagcagacgagggagacactcacattagagagtggcgtgtgctgaggga

SEQ ID NO: 44713 - DNA, 201 bp, Homo sapiens
aagcgattctcctgcctcagcccataggcacatgccaccacacctgactaatgtttgtatttttggtaaagacaaggtttccccatgttggccagccttgycttgaactcctgacctcaggtgatccacccacctcagcttcccaaagtgctgggattacaggtgtgagccaccgctcctggcacccatcaaattttcaaa

SEQ ID NO: 44714 - DNA, 201 bp, Homo sapiens
aatagaatgactaacattttctgagggtgtctcacgtgaaagtaaatcgctcatgtttgttctttttaaaagatgcccttcgtattgtgtatcttgcagtsttgctttctcaaacttaagccaactatatcgtcatttttgcaaaatcactgcgtcagtttactattatttaatgtttattgctaccaattttaagaaatc

SEQ ID NO: 44715 - DNA, 201 bp, Homo sapiens
tcacagctttctgcagcattgaccttgtgggctcaagcaatcctcctgcctcagcctcccaagtagcttagaaccacaggcatataccaccatacctggayatgtttttaactttaatttttatttttgtagagatgaggtctccctatgttgcccaggttgctctcaaactcctaggctcaagcagtcttcccaccctgg

SEQ ID NO: 44716 - DNA, 201 bp, Homo sapiens
tcctgggttcaagcgattctcctgcctcagcccataggcacatgccaccacacctgactaatgtttgtatttttggtaaagacaaggtttccccatgttgkccagccttgtcttgaactcctgacctcaggtgatccacccacctcagcttcccaaagtgctgggattacaggtgtgagccaccgctcctggcacccatca

SEQ ID NO: 44717 - DNA, 201 bp, Homo sapiens
taaatctgtgtttgccagtttgcctccaccactgatgtgctgttggggtttggggacataatttcatcactttctaccacctttccttaaaactaggcttygtgccaggtgcggtggctcacgcctgtaatcctagcactttcggaggccggggtgggtggatcccaaggtcaagagattgagaccatcctggccaacatg

SEQ ID NO: 44718 - DNA, 201 bp, Homo sapiens
aattgttacagagagaaagagggtaggtctgtgaatggaattgaacaggtaggttgaacaagataaatgccgaggaagcaagtgtatttaaataaacagtwgtttatggaaggctttggaaatccactatattaatctggaattttatgaaattttaccagaacttaaattattaatagttgaggacaaagaccaaccatt

SEQ ID NO: 44719 - DNA, 201 bp, Homo sapiens
aacttgttgtaacatgtaagaaattacatctgggctaaaaggttcaataatgattactcttataatggaatcttctacaaagcaagggatttcatgatatscctatgcttttaaaaaattattgtgatacagtgaaacaaggaagaacgtgtagctggaaaaatagtatttgcttgtaatatacattcagattcataacag

SEQ ID NO: 44720 - DNA, 201 bp, Homo sapiens
aagctatgaacagttgccacagctgggctgaagagttacctgtgagccttccaggggtgtaagccaagagaaagacagttcaccaaatctatcgattaatrgaaatcatccagcagcagtgccactgtaagatgttcaatacgtagcacctttctgtcccttctcctctagccagttgggacaggattagcaagccaaaga

SEQ ID NO: 44721 - DNA, 201 bp, Homo sapiens
gtccttagacagaaagcatcttatcattcacaagcttagctatgcaatatattcctccctccccccaaggtagttgttgttgggtttgtttttttttttttaagagatttacagtgatctttccatataggtttttctcgaaacatatatatttttaatttctcaccatctcaggggtaaataaatatattaaaataagct

SEQ ID NO: 44722 - DNA, 201 bp, Homo sapiens
agtttcttgcctaaatttgtgatctccctttggcttcataaataacggtacatttcatgaagagctggtctcagtctacacaagcctaactgaatggggtrcataggaagggttgcattgtgtgacaaggtttaaatctaattgttttaagtctttgagttatttgctcaccaggctgtgcttgatggttttactttttgt

SEQ ID NO: 44723 - DNA, 201 bp, Homo sapiens
gttggatatagccttatgttcccagcaggaaggaagaaaggaaaggagggagggaggtaagggtgagagagagacaagaaaggaaaggaggaaggaaggaygggaaggagggaagaagagagtttggtcaacatttgttgattgtgaatgaacaaactaatgaacactaaatgaacaaatgaatgaatgaatggacaaatg

SEQ ID NO: 44724 - DNA, 201 bp, Homo sapiens
agtccttagacagaaagcatcttatcattcacaagcttagctatgcaatatattcctccctccccccaaggtagttgttgttgggtttgtttttttttttttaagagatttacagtgatctttccatataggtttttctcgaaacatatatatttttaatttctcaccatctcaggggtaaataaatatattaaaataagc

SEQ ID NO: 44725 - DNA, 201 bp, Homo sapiens
tttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgc

SEQ ID NO: 44726 - DNA, 201 bp, Homo sapiens
ccaaataagaacacataattacaagactgtattgtataatcatgcaggacacaaggtatgcaattttaagggtcaaagtggtaaaaaaaaaaaaaaaaaawggaaaatcaaatataaaaaggcagccccgacaggtacgagcttgtagtcatttccccaaatgcctaaagtagacccattcccattgctctaatttgtaga

SEQ ID NO: 44727 - DNA, 201 bp, Homo sapiens
cccaaataagaacacataattacaagactgtattgtataatcatgcaggacacaaggtatgcaattttaagggtcaaagtggtaaaaaaaaaaaaaaaaaaaggaaaatcaaatataaaaaggcagccccgacaggtacgagcttgtagtcatttccccaaatgcctaaagtagacccattcccattgctctaatttgtag

SEQ ID NO: 44728 - DNA, 201 bp, Homo sapiens
aaaatatttgaaaaaaaaaagtgaaatttttgatatagaagaggatgtagggcaggtagggctcagaaggacccatgccatatagcaaagttcttagtaayacaggctttgggttacagcaggctagattcaaatcctgctgtggtcagaatgtctgtgtcaccccagcattcatttgttaggagatggggtcttttggga

SEQ ID NO: 44729 - DNA, 201 bp, Homo sapiens
gagaatcacttgaacccgagaggcaggggttacagtgagtgcggtggcagctgggacattaaccaagttgtgaaaggagccatgatgttattagctgagtyatgtcactgcacctccagcctgggcaacagagtcagactctgtctcaaaaaaaaaaaaaagtgtactttttgaggaaagttctatttttcattattttcc

SEQ ID NO: 44730 - DNA, 201 bp, Homo sapiens
taatgattaaatgattctggttattagcataaaacacagctgtagtacataagaggtaacctttattgtttaaatattattcaatgtgcctacatagcacmcagcaaaaaaaactttttttcagactattcagccattatggaaataacttataattacattcagaaatgttgcaaatgcaactcatccttgcagtgggat

SEQ ID NO: 44731 - DNA, 201 bp, Homo sapiens
aaaatacaaaaatcagccaggcatggtggcgcatgcttgtagtcccagcgacttgagaggctgagggatgagaatcacttgaacccgagaggcaggggttrcagtgagtgcggtggcagctgggacattaaccaagttgtgaaaggagccatgatgttattagctgagtcatgtcactgcacctccagcctgggcaacaga

SEQ ID NO: 44732 - DNA, 201 bp, Homo sapiens
tgcaataggaaatctctttatttcgttggtgctcaagtgataccattaagtcccttaagatgcggaatttccttgcccccgctgccccctttctttctttyatcttatctatatatctgtatctatatctaatctattttttgagaaaggctctcactctgttgctcaggctggagtgaagtgatgcaatctcaggtcact

SEQ ID NO: 44733 - DNA, 201 bp, Homo sapiens
cagttcctcctagtgggcagtttgctgctgctgtcttacctcctcatcctcacccctttcacctctcccctggtaactgatttatttttccctcttggagktgcttattcttttcttcttccagttgcatctctccctctacttagatacacatttccattttacttctatttggtagtctcagaacttggcttttattgg

SEQ ID NO: 44734 - DNA, 201 bp, Homo sapiens
atagtgatagtaaaaagaaccatgtgaactgggcgtggtggctcatgtctgtaaagccagcacttcgggagtccaaggtaggagggtcacttgagcccagsaattggagaccagcctgggcaacatcatgagaccccatctgtatccaaataaaagcaacaaaaaaatgagacatgggggtgcatgtctgtggtcccagct

SEQ ID NO: 44735 - DNA, 201 bp, Homo sapiens
ggtgcagcacctcacacctgtaatttcaacacgtagggaggctgaggcaggaggatctcctgaagcccagaattcaagaccaggctgggcagcatagcackacccatctctactataaatttaaaaattaactgggtgtggtggtgcacatctctagtctcagctgcttgggactactagaaaggtaaggcaagagaatcc

SEQ ID NO: 44736 - DNA, 201 bp, Homo sapiens
gttgattctcttcaaaaacttggcagtagcccttggatcccattaattgcattcaacagtcatgtattttattaatttttgttcctaaagaaaaaaaaaaatccagattgcttagaaaataaatgtgactcacgcagagcagaatccgaattttctaagtgatgaacatgttaacatattattttaatctaaagacatcct

SEQ ID NO: 44737 - DNA, 201 bp, Homo sapiens
agctccctccctaatcttgctagaaggtagggctaatgcattgtcaattcagaaatagggggtgttcctgagtctggggacactctagtgaaattctatgkgtaaaataatttgtacaagtttatatttttagctaaattaaaatactcacattcccattattttttagaggttgtaagctaagtaataacattctagaaa

SEQ ID NO: 44738 - DNA, 201 bp, Homo sapiens
ggtggaggttgcagtgagctgagatcacaccactgcactccagcctgggtgacagagcaagactgtctcaaaaaaaaaaaaaaaaaaaaaaaaattcaacwtacgaattttgcgaggacgcaaacatttaatccgtagtactgatgtggatatgatttgagctaagactctgctgttgattctcttcaaaaacttggcagt

SEQ ID NO: 44739 - DNA, 201 bp, Homo sapiens
taaatagatgcacaaagcagagggaatcaagtagaataacatggtttatttgtgtgtgtattgttctgtttttggtaaaatcatgcttatcatatcttcartgcatcatttattctgagtccacattgctgcctttgagccggggccctgaggtatctcctatactctggctggggtgagggcggcaggtcctctgggcca

SEQ ID NO: 44740 - DNA, 201 bp, Homo sapiens
ctgcttttgccatcaaatggttattgaaagaactatctgtgttgacagccttttgggtttcatacagtcctttccagcttgggcagtatagataaatagaygcacaaagcagagggaatcaagtagaataacatggtttatttgtgtgtgtattgttctgtttttggtaaaatcatgcttatcatatcttcaatgcatcat

SEQ ID NO: 44741 - DNA, 201 bp, Homo sapiens
ctacgttggcagagctcagtagtcatgacagtaaccatatgcccacaaagcctaaaatatttactatctggctctttgcagaaaatgcgctgaaccttgcrtgttgtgtcacccctggaggtagcaccttgtaattaagcacatgaatatctcacatcagaatgaatgaatattcacactcagtgggacaaacaacttctg

SEQ ID NO: 44742 - DNA, 201 bp, Homo sapiens
tttcacagtgtttctagctcccctttccaatacatctctctctctctttctctctctctctctctctctctcacacacacacacacacacacacacacacmgccaaatcagacaccaacataaactgtagagttaacattctttttccaccctcacactttttttagctccgatctgtgttcaatttctgcctgagagagt

SEQ ID NO: 44743 - DNA, 201 bp, Homo sapiens
tttcatgcttcttaaactggggtatgagtggccccaggtttccctgttgggggtactgataccagagttcatttgaagtcattggaaaccaaggcatattytcttaaagagacaactgtttttggtgaataggccatgttgtttatagtaaaaacaaacatgaatattctgtaatagaagatatcgtttgcatggtgtttt

SEQ ID NO: 44744 - DNA, 201 bp, Homo sapiens
agcagctttagataatgcattgtaggtgttttgcaaaaacatactttcgtgactaaacatcataagctccaagtgagtgatttccccgcgtaaatgaatgwttctgtgaggataacacttctaagatgtgagatttcaataaatgaatctgtaggctgctgtgatggatacctttggtggggtaggaaggatcgtcattta

SEQ ID NO: 44745 - DNA, 201 bp, Homo sapiens
gctgtttgttggtttcagcaaacaaagggagatcacagcacctgtcccaggccttgtcttccagccccacaaacgtgcacctgcagccggagaccaggggrccccgatcaggtggcagggcctttaattggagccacgtgtgtataatgagcagcgcacacacacaaaggcgagctaaaaatgtctccacccttctaaata

SEQ ID NO: 44746 - DNA, 201 bp, Homo sapiens
cttgctgtttgttggtttcagcaaacaaagggagatcacagcacctgtcccaggccttgtcttccagccccacaaacgtgcacctgcagccggagaccagkgggccccgatcaggtggcagggcctttaattggagccacgtgtgtataatgagcagcgcacacacacaaaggcgagctaaaaatgtctccacccttctaa

SEQ ID NO: 44747 - DNA, 201 bp, Homo sapiens
agtctgtgaaatccccatttcacagatgttgaaactgagacttagaagcattatgcaccatgccaaaggccatggaaggacagagcttgggcatgctcccracaccaggtcatactgatgtcactctccctactcccttcactccctccagcacctggccttcacctgaaggtgctgaccttgctgtttgttggtttcagc

SEQ ID NO: 44748 - DNA, 201 bp, Homo sapiens
ctgcgttcaggcctccatgacatctgcgaaattcctccccctttgcttggtagcctaactcactcaggggggcaaattatcccatcatattcacagttgcygcccacactcaagagaggggattctataggaaatggaagtcttgggggccatcttgaatcctgactaccatagtctgtgaaatccccatttcacagatgt

SEQ ID NO: 44749 - DNA, 201 bp, Homo sapiens
aaccaactgcgttcaggcctccatgacatctgcgaaattcctccccctttgcttggtagcctaactcactcaggggggcaaattatcccatcatattcacmgttgccgcccacactcaagagaggggattctataggaaatggaagtcttgggggccatcttgaatcctgactaccatagtctgtgaaatccccatttcac

SEQ ID NO: 44750 - DNA, 201 bp, Homo sapiens
gactcagggtccctttcctccatcttcaaagccaacagcacctggctgagtctttctcatgctggcatccttctggctctctcttcagattccctcttccrctttaaggacctttgtgatagttttgcacccactggatgacccagaatcatcttcctcttttaagatcagctgattagcaacgtcagttccacccacaat

SEQ ID NO: 44751 - DNA, 201 bp, Homo sapiens
ccacagagcggctgtcagattccaaaggcatcataccatctgcttttccaatcttctgctcttcaatgtagacatatgttcgagtggttcgtgtgtgtgcstggtgaggggggtgctattttccgggggaagaggaggaggagaggatgcttaactccaagagtcctcaaagcaaactgaaataaaattttaagtgatgcc

SEQ ID NO: 44752 - DNA, 201 bp, Homo sapiens
tgttcccttcccgcttcccacctgcctcgtatggaaaacacccaaagtaggcactgtttatagagccatcgcttgcagaacatctccccggcctccgacayatgtgccataaatgctgcagagctgcgtccacagtccctgctccggagaagagcattttgcttgttttcaaacacaagcatcctctcccgcgcctgggag

SEQ ID NO: 44753 - DNA, 201 bp, Homo sapiens
cctggagctacgacgagggtaccctggacccctgtcctaaatgttctttgactctgcttagccactgaggatgtttgcatttgattcatttgcttattatkatcaagaaacgttacctgtcaacattggataaaccatccgagggaaattaatcaaaacccccttcagacaaactgcatcacatcgattctctccttatag

SEQ ID NO: 44754 - DNA, 201 bp, Homo sapiens
tgtcattttatagtgagttgtattacttgctaggtgagctggtatctcctttgataacacaaagaaggcctgggtttgcttggcaatttgttccaatattsttttcagttttaaataagttttgaacaaaaagttttagcattttacataaaaacctctaaagctctcaggctaattagtaatgtagcatatacaaattaa

SEQ ID NO: 44755 - DNA, 201 bp, Homo sapiens
cccgtctctactaaaaatgcaaaaaattagctgggatttggtggcgcctgcctataattgcagctacttggaaggctgaggcgggagaatcacttgaaccrgagaggcagaggttgcagtgagccgagatcgcgccactgcactgcagcctgggcgacagtgaaacttttgtctcaaaaacaacaacaacaacaacaacaa

SEQ ID NO: 44756 - DNA, 201 bp, Homo sapiens
gtatgagtgggtcaagaacaagattcggccccaaggagatacgcgactttctactttgttttctatttggatttcacacaaaggctcgaaggtctcctggkaggccatgctcagaagtctgggttgtcccctgcccaggacaggctcaccctggcctgtgtcctaggtattgtggggccgctgtaggaggatggtggttaa

SEQ ID NO: 44757 - DNA, 201 bp, Homo sapiens
ctgtcgtggtcttggcctttctcttgtgttccccagatgggtttcactgctctaaggatcataccttcgcaggccatctgaagttagtgaatctgaggcawacagaagggctgggtgcggtggctcatacctgtaatcccagcactttgggataatgagatgggtggatcacctgaggtcagaagttcgagaccagcctgg

SEQ ID NO: 44758 - DNA, 201 bp, Homo sapiens
ttgtttcaggattattattttttttaaatttattttatttttttgggacagggtcttgctctgttgcccgggctggagtgcagtggtgcgatctcagctcmctgcaacctgcttcctgggttcaggtgattgtcctgcctcagcctccctagtagctgggattacaggcgcacgccagcacgcctgactgatttctgtatt

SEQ ID NO: 44759 - DNA, 201 bp, Homo sapiens
ctaggaagggctggaaagctccatgcccctaccccatacctcgccctatgtgtcttttcatctctgtccttagtactgtcctttataataaagcagtaagkggtagcaagtgttttcctgagttctgtcatctgctccagcaaattaatcaaacccaaagagggggttatgggaacttccacctgaagcccctcagccaga

SEQ ID NO: 44760 - DNA, 201 bp, Homo sapiens
cagtctattgttacaatattgcgtgtgttaggcatcaggaaacagaatctctttgtctcctgtccttctttcacctgccccaaggcaggactctaatcttycccacctttttgattgtgagtcttcagaccctccccagagagtcagtcctgccttatgccctggggaaaggaatgctgacctcatgaagctcccataaaa

SEQ ID NO: 44761 - DNA, 201 bp, Homo sapiens
aataagcccatttgaagtgtaacattcaactttttttagtatattcgcatggttatgtaattttcatcaaaatctaattttagagtatctttttgtccccstaaaagtaactctgtgcccatagttggcagtttgtcatatcactcaatcactgtttcctttaaagagcttatcattaaagacagcaggcagttacacaac

SEQ ID NO: 44762 - DNA, 201 bp, Homo sapiens
atggttttaaaataccaaaaaatatttcttcaatttttttctgctactcataatgtagcatctgtagagcgacacacttttgaatttgagttaatatttcytttttattttattttattttttgagatggagtctcattctgtcgcccaggctggagtgcagtggcgcgatctctgctcaccgcaacctccgcctcctggg

SEQ ID NO: 44763 - DNA, 201 bp, Homo sapiens
atgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatatttc

SEQ ID NO: 44764 - DNA, 201 bp, Homo sapiens
catgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatattt

SEQ ID NO: 44765 - DNA, 201 bp, Homo sapiens
acatgaatattggttgatattttcatttttattaagaagtaaggcaaaaacaaaataagacatatgtcagaacttcacttatccttctttgctgaattgtataatggttttaaaataccaaaaaatatttcttcaatttttttctgctactcataatgtagcatctgtagagcgacacacttttgaatttgagttaatatt

SEQ ID NO: 44766 - DNA, 201 bp, Homo sapiens
gcatttatctttgatgctgggaatgcgttcattttctttatcttgccattactgtacctctattgggaaatttactctctcttcatagataggatccgathcagtacatatttataaaaccacacttacatttaaatacaggcctttcccatttcacagtgtttctagctcccctttccaatacatctctctctctctttc

SEQ ID NO: 44767 - DNA, 201 bp, Homo sapiens
ggaggagttgttgttttcttttcacttgagtttaataaatgaaaaaggggaagggagagggaaggaagaggaaaaagcacaaatgtgcttgtttttggatsagcccctgtactgggcacatggatgcagtcagtcctcagtgtaccccaggaaagaggaaactgagtctccatgtggctttctgtctggcctttctctttt

SEQ ID NO: 44768 - DNA, 201 bp, Homo sapiens
gggttttccctcagcttgctggggccgtgcacctatgtgagattttattatttgtaattttgggggggttaatttcacagcttaattctggcctttatgcrtttagagctcccctcttgtgtttcagaaaggaggagttgttgttttcttttcacttgagtttaataaatgaaaaaggggaagggagagggaaggaagagg

SEQ ID NO: 44769 - DNA, 201 bp, Homo sapiens
aaaaaaaatccccaaaaaatctcataatgttttaagaaagtttatgaatttgtgttgggccagattcaaagttgtcctgggccgcatgtggcccaccagcyatggtttggacaagcttagtctacaggttcttcaagaggggcttgagcatttgaaagacttctagtgggagagatcacaaggtacaagtagaaaatcctg

SEQ ID NO: 44770 - DNA, 201 bp, Homo sapiens
actctgcaatgctgagtacttctcatccttcaggtctactgcaagtgtcacctggccaacacaccatgccttcccagtctctggtgttactctctgcataytgtagaccatcatcttgtttgcatacttgtctgttatctctttatcatccttctacccacatcaggcaattccaagagagaagaccactggttttgtttg

SEQ ID NO: 44771 - DNA, 201 bp, Homo sapiens
atgctttgtaattttttttaaggattgatactagctagggtgttgataagaaacagcaggcatagttactgggtgattgagaagagtttaacaaaagactrtattagtctgttttcatgctactgataaaggcatacccaatactaggtcatttacaaaagaaaaaggtttattggacttacagttccttgtggctgggga

SEQ ID NO: 44772 - DNA, 201 bp, Homo sapiens
gcaatctatggtctttatcacttctccattaactgtccttgttttattaatgctgattactttttgatttggtttggttctttggagttgtttgcatttcrtgagtcttggcatctttttggtagagaaccttgctaggttctcacaatgtagaaattaagcagaaaacagaggtctcaatttgccttttcagcgtgaatg

SEQ ID NO: 44773 - DNA, 201 bp, Homo sapiens
aaggcaatcaaagtctattgtcacaaggaatgggaggaacggggacgtgatctaacatttgctgagatcctgctgtataccgggaacagaacatatatggkttcatttcatcctcccattatcaccgtgaggcctcttccgcttatctattgctgagtaacaaggtgtacccctcaatttactggcgtaaaacgacaacag

SEQ ID NO: 44774 - DNA, 201 bp, Homo sapiens
tgccaggctgctctcgaactcctgacctcaggtgattcacctgccttggcctcccaaagtgctgggattacaggtgtgagccaccgcacccggcccctgcstttttattttgctaaacctgatgacccttgccatagcagaactaaagtgatgatgatgattacagcagatcagttattttgagctctgactttgcatgag

SEQ ID NO: 44775 - DNA, 201 bp, Homo sapiens
ggagctggtggcagggggagagacttcaaattgagccagacctcaggcatgaagggaggggagagagggggaaatgtggaggaagggggcgtttgtgcagkgggaagttggagaaagtacaaatgaaagcctctctgcagtgaacctcatgactgctttagagaggtgcttatgtaataactgcagtggtgtcgctttaga

SEQ ID NO: 44776 - DNA, 201 bp, Homo sapiens
gctccaggtaaccactcatctactttctgtctctatatagatttgcctattctagacttttcatataaataaatcagatactgtgtggccctttgtgtctygatccttacacttagcatcatgttttcaagggtcattcatgttgtagcatgtatcagtacttctttttttagggctgagtaatattccatttacggatat

SEQ ID NO: 44777 - DNA, 201 bp, Homo sapiens
aaattggcacttgtacccttgaaatacataaaactttataaaaaattaaaaagagttactgtaatgattataaaatgaaaattctacgtcatgagaaagcrttgtgccatattttcaccgggagcatttttttttccttaggggaaatgaaaaataatggcatctatgatcttagatttagtaaaacgcagtatcttcttc

SEQ ID NO: 44778 - DNA, 201 bp, Homo sapiens
ccagagtgattggtgataaaaatggaggcctacttaagtctaagagagttcttgtgaaagtgggagggggatgagggttggaaaattgcctgttaggtgcmatgttcactattcagatgatggatacactaaaagtgcagacttcaccactacgccatatatgcgtgtaagaaattggcacttgtacccttgaaatacata

SEQ ID NO: 44779 - DNA, 201 bp, Homo sapiens
ggaatgcagtggcacgatgttggctcactgcaaaccctgcctcccaggttcaagcgattctcctctcccagcctcccgagtctctgggattacagacgtgyatcaccaggcccagctaatttttatatttttactcgagacgtagtttcaccatgttggccaggctggtctcaaactcgtgaccttaggtgatatgcgccc

SEQ ID NO: 44780 - DNA, 201 bp, Homo sapiens
tcaagcgattctcctctcccagcctcccgagtctctgggattacagacgtgcatcaccaggcccagctaatttttatatttttactcgagacgtagtttcrccatgttggccaggctggtctcaaactcgtgaccttaggtgatatgcgcccctcagcctcccaaagtgctgggattataggcatgagccaccacgcccag

SEQ ID NO: 44781 - DNA, 201 bp, Homo sapiens
tgatgatccagagctttggagtcagcgagacagtagagagtggtggagatggtggcgcacaagagggtcagtgccccatctcaaggaacagctgcacctcrgcctacgcgattgtgaaaatgtgagcatatgcaggccagaccttggcttctctgtcttcatttttcacaggagccagaagtttggatgtgcaatgtgaaa

SEQ ID NO: 44782 - DNA, 201 bp, Homo sapiens
tccagagctttggagtcagcgagacagtagagagtggtggagatggtggcgcacaagagggtcagtgccccatctcaaggaacagctgcacctcggcctaygcgattgtgaaaatgtgagcatatgcaggccagaccttggcttctctgtcttcatttttcacaggagccagaagtttggatgtgcaatgtgaaatctcac

SEQ ID NO: 44783 - DNA, 201 bp, Homo sapiens
tgtgatctgtctacatatgtagctgtttgtattcatggtgattaaatagttgggtgctagacatgcccttagcgagcagctcatgagagcagattttgccwgtttcttccaaaatctggattcagtgacatcgtgttggtagcttgaaactgaccgtggtgagaatatttacaccatggaaattggcaaatgctactaata

SEQ ID NO: 44784 - DNA, 201 bp, Homo sapiens
ggtagaattcacaaagctggttttatgtctccttctcttcctcttccagtgttgtcttttccctgcattgagatagcattgcatggagatccttgtactcytcgaacagaggctgcagatggacacaggatctgctcagggagataagatcacctgctaattctgctttctccatcagagtctgaatgatcagtgatgggg

SEQ ID NO: 44785 - DNA, 201 bp, Homo sapiens
cggatcatctgaggtcgggagttcgagaccagcctgaccaacatggagaaaccccgtctctactaaaaatacaaaattagccaggcgtagtggcacatgcstgtaatcccagctactcgagaggctgaggcaggagaatcgcttcaacccagaaggcggaagttgcggtgagccgagattgcaccattgcactccagcctg

SEQ ID NO: 44786 - DNA, 201 bp, Homo sapiens
agtcacaaaaattatgactccggcaccgaggtacttatctgacaaatgcaatgcgaatggtcttgttcttatcaatgagatcagatttcagaaatgaatgygaagaccgaggcgttgctttgtgcacagataaccttgcaggcgcaaactcccaaaccagaataaaagaattctctatgaaataatgggccaggaagccca

SEQ ID NO: 44787 - DNA, 201 bp, Homo sapiens
tcagtggagggtcagcgtgacagccttttgcacccacatctgggttcttgtccagtgtccaggaggaatgaggtctcatgagcaaattttaaggatggcaratgtgggggattttattgctgatgaaagtggctttcactgggaagataagctaaaaagaagacaaagcaggaaggtaattttcccctggagctatgccat

SEQ ID NO: 44788 - DNA, 201 bp, Homo sapiens
tccagcaatctgcctggtgctaatatttatataacacactcgccagactccatggcctgagtccgggggtggcttttcggggtgcagcttggatggcatcrgaacctgcaagaagccaagacgcctgttctccacggcggagcccgctggtcggtcactcctgttcctttcgtgtccgttgggtgcaggcattatttccag

SEQ ID NO: 44789 - DNA, 201 bp, Homo sapiens
gtgagccctcttactgaattatgtggctggggttcttgggtatgttttgttctattttctggttggtggttttctttctgtcgggtcccgtgggctctttytggacctcttctcagaatgtttttcgttttttttattttttgagatggagtcttgcactgtgtcctgggctggaatgcaatggcaagatccctgctcact

SEQ ID NO: 44790 - DNA, 201 bp, Homo sapiens
ttaacattctttggcagttgtaatttattaattgatttttaaatttggccggtgaaaatgaactttaggtaggggtttgaggaaaatgaaaaggcctattkgtttttcagtggctggttcttcgtgttcagcattaaggattggtagaaatcaggcaacctctatgtaacctcagccatcttggattcccagcttactcac

SEQ ID NO: 44791 - DNA, 201 bp, Homo sapiens
ggacaggaaacacacaggggctccagcaatctgcctggtgctaatatttatataacacactcgccagactccatggcctgagtccgggggtggcttttcgkggtgcagcttggatggcatcagaacctgcaagaagccaagacgcctgttctccacggcggagcccgctggtcggtcactcctgttcctttcgtgtccgtt

SEQ ID NO: 44792 - DNA, 201 bp, Homo sapiens
caggagccagaagtttggatgtgcaatgtgaaatctcacaaattaaacatgttacataactgtattttgtttcctatctctgctgtaataaattttctcawtgttagtgacttagaaccacacaaaagttacactttacagttttggaggtcagtggtccaaaataggtctcagtgggctaaaatcgatgtgtcagcagga

SEQ ID NO: 44793 - DNA, 201 bp, Homo sapiens
tgccaggtgtgataaatgactaatcagcacgcaggagcctcagtcctcaaaggaggactattacagtgttatcagctgcgggcctgggtgtacggagcccsgaacagggatggggacaggaccttgcgctgtgcggcttggcatgctgctccagagtgagcccatggctgtctcttagttttgtcaccggcggctttatgt

SEQ ID NO: 44794 - DNA, 201 bp, Homo sapiens
tgcttgtcaagagggtaatgtgtcattaactggggactctgcctcgcctctcctctcggacatgacagtgcggctggataagagaagagtaattatagttmagcagggctgccaggtgtgataaatgactaatcagcacgcaggagcctcagtcctcaaaggaggactattacagtgttatcagctgcgggcctgggtgta

SEQ ID NO: 44795 - DNA, 201 bp, Homo sapiens
cccaaatcctttggctcatggccccttcctctatcttcaaagccagggatggctgctcaagtccttctcaaactgccctgttcctggttctctctcttctkcttctgcttttaaggaaccttgtaacttcagggagtctaccctgataatctgggataatctgcctatttgaaggtcagccaattagcaatcttaatgcca

SEQ ID NO: 44796 - DNA, 201 bp, Homo sapiens
tgctcaagtccttctcaaactgccctgttcctggttctctctcttctgcttctgcttttaaggaaccttgtaacttcagggagtctaccctgataatctgsgataatctgcctatttgaaggtcagccaattagcaatcttaatgccatctacaaccttaattaccatttgctatgtaacatatttatagatatcagggat

SEQ ID NO: 44797 - DNA, 201 bp, Homo sapiens
aatgctaagttggctttctccccaaaccttctaagtaggcaatcaggatttaacgacccgcaaatttccaattttttagtttatgaaaaaatatatctacrtataatttttgcctccattagagtctcatctttaaaaaaaaaaattattcagtgacttcctccctctctttccaatgaggaaaactggactatttatgct

SEQ ID NO: 44798 - DNA, 201 bp, Homo sapiens
ctcaaactgccctgttcctggttctctctcttctgcttctgcttttaaggaaccttgtaacttcagggagtctaccctgataatctgggataatctgcctrtttgaaggtcagccaattagcaatcttaatgccatctacaaccttaattaccatttgctatgtaacatatttatagatatcagggattagttcatgaaca

SEQ ID NO: 44799 - DNA, 201 bp, Homo sapiens
cggaggaaagtgtcctctgagccctccttgagggacataaatagccccaaaagtcactgaatgctaagttggctttctccccaaaccttctaagtaggcartcaggatttaacgacccgcaaatttccaattttttagtttatgaaaaaatatatctacatataatttttgcctccattagagtctcatctttaaaaaaaa

SEQ ID NO: 44800 - DNA, 201 bp, Homo sapiens
ttgaaggtcagccaattagcaatcttaatgccatctacaaccttaattaccatttgctatgtaacatatttatagatatcagggattagttcatgaacatmttggggtagagggcattccacatacagcagtacctataatgtatatgcttcttaaagaatgcatgagtctttattttatgtccttggagtgtatagcaga

SEQ ID NO: 44801 - DNA, 201 bp, Homo sapiens
atgcattagctggaaggtaacaagaggaaatcgcctgccagggtccctgactcccggaggaaagtgtcctctgagccctccttgagggacataaatagccycaaaagtcactgaatgctaagttggctttctccccaaaccttctaagtaggcaatcaggatttaacgacccgcaaatttccaattttttagtttatgaaa

SEQ ID NO: 44802 - DNA, 201 bp, Homo sapiens
tataatcaatatttagtgatttgacttcttaagtccttaaaaaaaaaaaaatccaggtgcaaaacacaaagacagggctcatgtcaagggagggaacctcrctcttctactctcagtgaaagaaaggcaagaccactccagcctattttttttttctttcccttggcccttgtcaaaagggtagccagttttctgttacca

SEQ ID NO: 44803 - DNA, 201 bp, Homo sapiens
gttactgctgtaagccactttcttctccctctccgttaaaatgcaacttaattggtaaagtttagttgactagagatttcatttatttatttatttatttrtttatttatttatttgtttgtttgtttgtttgagatgagtcttgctcttttgcccaagctggagtgcagtggcatgatctcggctcactgcagcctctgc

SEQ ID NO: 44804 - DNA, 201 bp, Homo sapiens
tggtggtgcatgcctataatcccaacacttttggaggccaaggtgaggagaccacctgaggtcaggaattcaagactactgggcaacatggtgaagctctstctatcctaaaaatgcaaaaattagccgggagtggtggtgcatgtctgtagtcacagctacttgggaggctgaggcaggcgaactgcttgaacctgggag

SEQ ID NO: 44805 - DNA, 201 bp, Homo sapiens
ctgaagcttcaaatatgaacccttgccaccagctgcataaatatgatagccaaagggtttcaaatttgtgatttgtcataaacgctcctattgcaggctgrgtctagtccttcttgactttgtggaaggagaaggcttgaggaagtattcacaattggagaagggcgccttctgttatgttcttagctcactaaaagtggt

SEQ ID NO: 44806 - DNA, 201 bp, Homo sapiens
ttgcctaggctggagtacaatggcgcgatctcagctcacagcaatctctgcctcctgggttcaagcgattctcctgcctcagcctcccgagtagctgggawtacaggcatgcgccaccatacctagctaattttgtgtttttagtaaagacagggtttctccctgttgttcagggtggtcttgaactcctgacctcaggtg

SEQ ID NO: 44807 - DNA, 201 bp, Homo sapiens
gctgagaaaggattcccagtccccctggtaaaaagtctgaaggatgccgaggagttcactgtgcccttagataataacagtttgtcttggctctgatcacycctttttgtgacttagctggctgggaagtagcaaaagtatcttccaagctcagcttctctctgcttgcattctttccaaatacgtgattccaaagcccat

SEQ ID NO: 44808 - DNA, 201 bp, Homo sapiens
agtatgcaagtgttgtatggatgtgagcgtctgcgtaggtttttatttttctctctcagaatgaaaggtttgattcgtaccagctccccatcccttcccaygatcccatcttaatgtctgttgtggaagttggcccacagaagcctcaaggctaaccaacaagaaagatcacttcatatgcattagctggaaggtaacaag

SEQ ID NO: 44809 - DNA, 201 bp, Homo sapiens
caaagccagcaacagaaactctcttgtgcatggagtcccctcctgctttgaatctctctgactttccttgactttgatgtctaggtctggatttcaagggytcagaaactctctcatgcatgtagttccctcctgctttgaatctctctgactttccttgattttgatgtctaggtctggatttcaagggctcacgtgatg

SEQ ID NO: 44810 - DNA, 201 bp, Homo sapiens
ttttttttttttttttttgtttttcctcccagcctctctcctttcccattatgcacaatgcgctgagaaaggattcccagtccccctggtaaaaagtctgraggatgccgaggagttcactgtgcccttagataataacagtttgtcttggctctgatcacccctttttgtgacttagctggctgggaagtagcaaaagta

SEQ ID NO: 44811 - DNA, 201 bp, Homo sapiens
agtgagctcattttacgttgtatgtaccagtatgcaagtgttgtatggatgtgagcgtctgcgtaggtttttatttttctctctcagaatgaaaggtttgrttcgtaccagctccccatcccttcccacgatcccatcttaatgtctgttgtggaagttggcccacagaagcctcaaggctaaccaacaagaaagatcact

SEQ ID NO: 44812 - DNA, 201 bp, Homo sapiens
atttatgacttggcttacaatccgttgcagaaagcctagctccccagcttctcctgaatctacgtttttctattttgtctgaactagccaaggtctctggwgtttgctgttatattgcttcagagaaattagtgacattgaaaggctgttgtcttttttagtgtacttttggttgttaggagaaatttacaaggccatttt

SEQ ID NO: 44813 - DNA, 201 bp, Homo sapiens
tccccactttcaggctctcctttcacacgcatgcattaattcgttcattcttggaatctacccacctgtgatgtgctagttactaaagatgcagcaatgartgaaaggtaatcctgtccttgaggcattcacaggtaaagaagcctgcttgggacattgggccgtgagctccaacaatgtcactattcttctaggctttgt

SEQ ID NO: 44814 - DNA, 201 bp, Homo sapiens
tcctcctcaagggaaacattcttctcacaatagcttcctggtagaaagttctaactaatgactttaatcgtgtgaatgtattgcagaaatggacaggacarttctcagcccattcatcttacagacctcaagtgaacaggcacaaaacaacaggctccaccctccttcccccctctatctcatactttacctcaatttatg

SEQ ID NO: 44815 - DNA, 201 bp, Homo sapiens
caccacccaagttgtaagatggtagagcgaacaggccagaatgtgataaagtaaaatgaaagaagaaaaaggaggaaggaaaaagagagagggagaagcasatagaggaaagaaggaagaaggaaggaggaaggagggagggagggagacagggaaggaaggaagtctggcaagagggcacagtcagacctgccaggatcc

SEQ ID NO: 44816 - DNA, 201 bp, Homo sapiens
cccggtctctactaaaaatacgaaaaaaattagccaggtgtggtggtgggtgcctgcaatcccagctactctggaggctgaggcaggggaattgcttgaayccgggaggcagaggttgcagtgaacccagattgcgcctctgcactccagcctgggcaaaagagtgacactctatctcaaaaaaacaaaacaaaacaaaaa

SEQ ID NO: 44817 - DNA, 201 bp, Homo sapiens
cattctatcaatgccaaaatgcacatcacactgacaacagctctttgtttacaccggggagcccccaaagccccagggtaattccatcaccacccaagttktaagatggtagagcgaacaggccagaatgtgataaagtaaaatgaaagaagaaaaaggaggaaggaaaaagagagagggagaagcagatagaggaaagaa

SEQ ID NO: 44818 - DNA, 201 bp, Homo sapiens
ctagttactaaagatgcagcaatgaatgaaaggtaatcctgtccttgaggcattcacaggtaaagaagcctgcttgggacattgggccgtgagctccaacratgtcactattcttctaggctttgtggacctttggtcaccccttctgtaagaccaactcccttatctgcctgtacagtgttctgcgaatcccggtctcta

SEQ ID NO: 44819 - DNA, 201 bp, Homo sapiens
caactgttctctgcacgacctagttctgggctagggaatggctgtctagcttcagtggatttccagggtccggagctactaaaggtcaacagctgtgttaytgcaaactctgtggcctgcattctatcaatgccaaaatgcacatcacactgacaacagctctttgtttacaccggggagcccccaaagccccagggtaat

SEQ ID NO: 44820 - DNA, 201 bp, Homo sapiens
ctgtagtcacagctacttgggaggctgaggcaggcgaactgcttgaacctgggaggtggaggttgcagtgagctgagatggagccactgcactccagcctrggtcacagagggagactctgtctcaaaagaaaagaaaagtagagaggatagtataatgaggttcctgtctgccagtcactctatagtaactattaggaaa

SEQ ID NO: 44821 - DNA, 201 bp, Homo sapiens
ttctccctctccccactttcaggctctcctttcacacgcatgcattaattcgttcattcttggaatctacccacctgtgatgtgctagttactaaagatgyagcaatgaatgaaaggtaatcctgtccttgaggcattcacaggtaaagaagcctgcttgggacattgggccgtgagctccaacaatgtcactattcttct

SEQ ID NO: 44822 - DNA, 201 bp, Homo sapiens
cagggggttgggaaactcacctgaaggatcttctccctctccccactttcaggctctcctttcacacgcatgcattaattcgttcattcttggaatctacmcacctgtgatgtgctagttactaaagatgcagcaatgaatgaaaggtaatcctgtccttgaggcattcacaggtaaagaagcctgcttgggacattgggc

SEQ ID NO: 44823 - DNA, 201 bp, Homo sapiens
tttgagtttttaattttttgtagagatgaggtcttgctatgttgtccaggttggtcttgaacccctgagtccaaaagatgctgctgtcttggcctcccacygtgctgagattacaggcatgagccaccatatctggcctatgttagctatttctgaaacttcatttctgtctgtaaatggcaatcataatatatgtcacgt

SEQ ID NO: 44824 - DNA, 201 bp, Homo sapiens
tattcattagtggatgcaggggcgaaatgaaactcagggggttgggaaactcacctgaaggatcttctccctctccccactttcaggctctcctttcacaygcatgcattaattcgttcattcttggaatctacccacctgtgatgtgctagttactaaagatgcagcaatgaatgaaaggtaatcctgtccttgaggcat

SEQ ID NO: 44825 - DNA, 201 bp, Homo sapiens
attagctgggcatggtgctgtgcacctgtaatcccagctactcaggaggttgaggcacgaggatcacttaaacccaggaggaggagattgcagtgagccarttgcgccactgcactccagcctgcaatgcagagtgaaactgtcttaaaacaaacaaacaaacaaaaagcaaaaatctgaaaagacatctcaaaagccaat

SEQ ID NO: 44826 - DNA, 201 bp, Homo sapiens
ccagtcactctatagtaactattaggaaacccctttttttctctgaagtcattgctcctgtgtgtgtgtgtctgtatataaaaaaaagtatgtatacatayacgtatatgtatgtgtatagataaaaatgcatgtatggtgctgggcgcagtggctcacgcctgtaatcccagcactttgggaggctgaggcgggcgaatc

SEQ ID NO: 44827 - DNA, 201 bp, Homo sapiens
acctcagtttcctttcctatacaacgcaagccataaggttaacccctcctcgtggtgatgttaagatgaaacaggaaggtgaggggcttaacacatttccstgttcccataagctttcaggagatcttggtagttttcatctcggtcttcattaccatcatcactgcttcagactcctgtccatgtggggccctgtggtct

SEQ ID NO: 44828 - DNA, 201 bp, Homo sapiens
gaatgtggccctgtgccggtgcccaaaccagcaggctgcacgtatgcactgacagaatggtacatcccaccactgctctgtgtctgtgtgcgactgtcagytgctctctactgctcctcatagacttcctgtctgcctttttctgcatttctcagtctccccatctccccttcttatctaatccccttccttcctctctca

SEQ ID NO: 44829 - DNA, 201 bp, Homo sapiens
gtgtgtgtgtctgtatataaaaaaaagtatgtatacatatacgtatatgtatgtgtatagataaaaatgcatgtatggtgctgggcgcagtggctcacgcytgtaatcccagcactttgggaggctgaggcgggcgaatcacgaggtcaggagatcgagaccatcctggctaacacggtgaaaccgtgtctctactaaaag

SEQ ID NO: 44830 - DNA, 201 bp, Homo sapiens
ttaccaccctcccacttttggcaatgagacagcaagcttggaatttggagtccatgttaaatccaggtcccagccaggcacagtggctcacgcctgtaatyccagcattttgggaggctgagatgggaggatcacttgagcccaggagtttgaggccagcctggtcaacacaaggagacttcatctctataaataataaaa

SEQ ID NO: 44831 - DNA, 201 bp, Homo sapiens
ttctggagttatgaaatgatggtatcctgctgggctgagtggggagggattctcaagctgtacatagctgacacacaggtttctaaaaggttgtctttcamccccattttcagaagtaccaggttccacattttctgagcctttgctggctctctgataggaattgtgttacttctcagctgtccccatggctagcttaag

SEQ ID NO: 44832 - DNA, 201 bp, Homo sapiens
tgctgggcgcagtggctcacgcctgtaatcccagcactttgggaggctgaggcgggcgaatcacgaggtcaggagatcgagaccatcctggctaacacggygaaaccgtgtctctactaaaagtacaaaaaattagcctggcgtggtggcgggcacctgtagtcccagctactcgggaggctgagaccgaagaattacttg

SEQ ID NO: 44833 - DNA, 201 bp, Homo sapiens
gagggcggtgagatgctgagagtaatggggctggcccaggaggaagtgagaggaagcaaagtgagacagaggtggtgtgtgagcgtgtgtttgtgtgtgtktgtgtgtgtgtgtgtgtgtgtgtgtgtgattgagagagagagagacagatggagggaaagagaggcgggggattccaggtacagtggctcatgtctgtaa

SEQ ID NO: 44834 - DNA, 201 bp, Homo sapiens
tggctaacacggtgaaaccgtgtctctactaaaagtacaaaaaattagcctggcgtggtggcgggcacctgtagtcccagctactcgggaggctgagaccsaagaattacttgatgaaacatggcagacgacatagaccagcagcaaactaccaacactgtggaggaccccctggatcttaggctcagcccagaggagcga

SEQ ID NO: 44835 - DNA, 201 bp, Homo sapiens
tgtagtcccagctactcgggaggctgagaccgaagaattacttgatgaaacatggcagacgacatagaccagcagcaaactaccaacactgtggaggaccycctggatcttaggctcagcccagaggagcgaatttgtgtgaaaatgagaaacgaccgagagcttcgaggcagattacatacttatgatcaacatttaaat

SEQ ID NO: 44836 - DNA, 201 bp, Homo sapiens
tactatagaaattgatgaggaaacatatgaagagacatatgaatcaacaaaacagaatattccagtgttctttctccggggagatggcattttcctggttscccctccactgagagttggctgaaacaaagaatttgtcctgtatggaaaacaggagactttgtacagtggcctctctaaaggtgcaagatattcaaaaga

SEQ ID NO: 44837 - DNA, 201 bp, Homo sapiens
gtattgttgaaaactcttggtaggggttttttttttaattggctggaagcacttcatcatatagttgtaccaaagtttgcttaacatcccccttattactsagcctttgggtggtatccagttctttgctttgataaataatgctgagatgaacatctttctgcatggctctttttccttcttttgacatacttggagttc

SEQ ID NO: 44838 - DNA, 201 bp, Homo sapiens
ctaatgtgattgtctgtaggtctagcaattggaggttgttcgtttctttgagacaaggtctcactctgttgcccaggctggagtgcagtggtacaatttcrgctcactgcaacctttgcatcctgggctcaagcaatcctcccacgtcaacctccagaatagctaagacccaggtgcgcaccaacacacttggctaatttt

SEQ ID NO: 44839 - DNA, 201 bp, Homo sapiens
ctctctcgaagctccatgcccaccttgctgttgcaccccccaccccaaggaaagccttcccacctttggaagctgcattaattcttccaggccacaagggkgccgttgagttactggttcactgcactggctggcaggaaagagttttaatgcaggctccaaaggtgcttaatttcctgtggtccttatgaatatgcatac

SEQ ID NO: 44840 - DNA, 201 bp, Homo sapiens
ctggctaatttttgtatttttagtagagacggggtttcaccatgttggccaggatggtctcgatctcttgaccttgtgatccgcctgccttggcttctcamagtgctgtgattacaggcgtgagccaccacgcccggcctctttgcacattatttaagggtgttttaacaaaatggcaatttccccaggctggcttgtgta

SEQ ID NO: 44841 - DNA, 201 bp, Homo sapiens
aggcagttttgctgtgttgcccagactggtcttgaactcttgagctcaagaaatccttccacctcagcttgacattacaggtaagagccaccgtgtccggsccccctttcttcttttttaaagtggggtattaaggctcagaaaagagtgtttctgccactgcagaggattgctgacattattagttgctcactctgtcca

SEQ ID NO: 44842 - DNA, 201 bp, Homo sapiens
gcagccaaggtcacagctggaaataaaactgtgtattccaaatcagaggggcaatgcaggaatggatcaaaggaatgaaggatcaagttgtcagccaagakaaccaagagccagacacagggaacctgtgacaaaaacgaaaaccaataaaaacatatattgagcattgaccaggtgcccaatattttaatgtcccatggg

SEQ ID NO: 44843 - DNA, 201 bp, Homo sapiens
gattgtaagtttcctgagacctccacagccatgccaaattgtgagtcagttaaatctctttgctgtataaattacccaggcttgcatatgtctttattagyggcatgagaacagactaatacagtcagggatgctgcagaacatctccaaacacacaggactcccaccctctacttccaccccaccaacaaagaatgattc

SEQ ID NO: 44844 - DNA, 201 bp, Homo sapiens
ttgagaagggccctgtccgcagcctgaggagcctcaactgttctctgcacgacctagttctgggctagggaatggctgtctagcttcagtggatttccagrgtccggagctactaaaggtcaacagctgtgttattgcaaactctgtggcctgcattctatcaatgccaaaatgcacatcacactgacaacagctctttgt

SEQ ID NO: 44845 - DNA, 201 bp, Homo sapiens
gaaaattcaaaaaattgcaacctgaggcataaatgggttttaagctccatacagtaaaacctagcatatgaaaacagttctggctgatgggttggtagaartgatagatatagatacatatatacacatatatgcacagtaatagatataggtaaagaccttgatatatgtacatatattgtatgatacatatccatgcat

SEQ ID NO: 44846 - DNA, 201 bp, Homo sapiens
taaatactgagactgagcagtcttgtggattcaggaattgggcatccagttgggaccctttgcaagaagggtgttagggagcagagagcatgagtaagccrgaagcagagcaggagagagaatggagcaggtgtgcaaagagggcggtgagatgctgagagtaatggggctggcccaggaggaagtgagaggaagcaaagt

SEQ ID NO: 44847 - DNA, 201 bp, Homo sapiens
tatatcctaccgctcaaagccatcaccaaggtctgatcgtgaaaattcaaaaaattgcaacctgaggcataaatgggttttaagctccatacagtaaaacytagcatatgaaaacagttctggctgatgggttggtagaagtgatagatatagatacatatatacacatatatgcacagtaatagatataggtaaagacct

SEQ ID NO: 44848 - DNA, 201 bp, Homo sapiens
gatattttctactatggatgaatgctcctcttttgaattttcatttttgtctgacataactcaaagtgcttgctttgggagttcttgttaaccctgacaawtcttgtcaaatatcttactcctgggctgtgctggggatggcagcagagtggggtggttggatgggaaggcgggaaagagctagcttggagatgatacgct

SEQ ID NO: 44849 - DNA, 201 bp, Homo sapiens
agtttgattagttcaatatcaagagctaaatacattagcttatatatatgtctgatgaactcatctttgcttccttggatccccaagatagaatggccctratgcagtcaaaccaccctgcagaatcttaacagcaccacaaatattgcatccaggcatcctgcccatgctggcttgcaggctggggatccctgtccatag

SEQ ID NO: 44850 - DNA, 201 bp, Homo sapiens
atttagagttctgaagatgctgaacccttattgtatctccccagggttagtgagtaattgggaatagtgttccatcttggatgcccccatccactaaccakctttcctcttcgggtggttctaagaattctaattcaattagaaggccttctttttagtttgattagttcaatatcaagagctaaatacattagcttatat

SEQ ID NO: 44851 - DNA, 201 bp, Homo sapiens
aacctttttgatgcctccaggcaatttcctacaagctctaatatcttcctctttactcccatatgtggtatctctggtaccctatatatcattcactcaastgtttgttttgaaccacttattttggcaagacttcttcagacaggagagccctgagagctcttcaaaggctgggcctgatggtgtttgtcagagaggttc

SEQ ID NO: 44852 - DNA, 201 bp, Homo sapiens
gagaatcacttgaacccgggaggcagaggttgcagtgagccaagatcacgctattgcactccagcccaggcaacaagagcaaaactctgtctcaaaaaaawtaaaaaaaaaaaaaaagaaagaaaattaatttctcagaggtagtaataggggtggctgtcaccatccttggccaaggagagggagcagatactggagaca

SEQ ID NO: 44853 - DNA, 201 bp, Homo sapiens
tgcttacaacatgattccggtgaaaccacaggtctcgtcatgtcccttctgtatccatggtagtcccagtgggaaagaggtaacaaacccaaattgagtamtttcaagaaattttaataacaaaggggctattttataaagggggggtggtcaaggtgtagggaaacataaaagagagcgaatttctggtctggtgctgtg

SEQ ID NO: 44854 - DNA, 201 bp, Homo sapiens
cacacatacattcctggttctgtcagcatttccctaggcgagatgagtcacacatttatatttttacatatgcagcgcgcttgcaattttccactggggawgatagaaaaacttattgaaaatagttaatcagttttacaaagatgccataggtagaggtgcttccagacctatagttttgaaagtcacctagaggatacc

SEQ ID NO: 44855 - DNA, 201 bp, Homo sapiens
taaaacatatataaaattatttttatcaaacatgacagatcaaaagccttctggaaaggagagatggtaactaatttaggcagtgtcttttgctttcacawggtgtacccagtactattaatatgaatttatcacatggaaacaaacttttaaaaaaattaattttgtgaattaaataaagcagcatgcaaatttactatc

SEQ ID NO: 44856 - DNA, 201 bp, Homo sapiens
gtccccgtgccatgaatcacttcacatctctggctagtacagatctctccctgtcactagtggaagtcgcctgcactacattcagaataggggccaggcgyggtggctcacgctgtaatcccagaacgttgggaggccaaggtgggaggatcacttgaagtcaggagtttcagaccagcctgacaaacatggtgaaaccca

SEQ ID NO: 44857 - DNA, 201 bp, Homo sapiens
gtgatctgcccgccttggcctcccaaagtgctggcattacaggcatgagccatcgcgcccggccagagggctattctttgtcttttatttgctttgagtcyggtataaccatgtggcacatacccctgtacatgtttgccaagactgctatatggtagagcttggaattcttaggagctttatcaggtaattgcaagtccc

SEQ ID NO: 44858 - DNA, 201 bp, Homo sapiens
ctattctttttttttttttttttttttttttgtgagatggagtcttgctctgttacccaggctggagtgcagtggtgcagtctcagctgactgcaagctcygcatcccaggttcacgctattctcctgcctcagcctcccgagtagctgggactacaggcgcctgccaccatgcccggctattttttttgtatttttagta

SEQ ID NO: 44859 - DNA, 201 bp, Homo sapiens
tgaagcagtccatctgttatgagagctattctttttttttttttttttttttttttgtgagatggagtcttgctctgttacccaggctggagtgcagtggygcagtctcagctgactgcaagctccgcatcccaggttcacgctattctcctgcctcagcctcccgagtagctgggactacaggcgcctgccaccatgccc

SEQ ID NO: 44860 - DNA, 201 bp, Homo sapiens
ctgggtgggtggaggttcagggatatctgggaaggactaagaatagctttttcttttagtagatcaggagtttcctcttacacacaaaaagctccaaattyaaactagcttaagaggaaagggtcattactggctgacaaaatgcgaagttttgtgcaagagtcagcaaagtttctctgtgatgggatatttaataaatat

SEQ ID NO: 44861 - DNA, 201 bp, Homo sapiens
atctcttttcacgctgttgcattgaggagaggaaaaaatcccttaaatttgaattccatgtggatgctcttatttaatatgccgtttcaaagcctgtatgygatcaagccagagtattatcaggctctgagttcctgtgtgtattcccttggtccatgctccatctcaagtgtttctccacactgggataggcagcatatt

SEQ ID NO: 44862 - DNA, 201 bp, Homo sapiens
cagtaagtattcttggggcaaatgggaaaagggttaaaatgaccagatctccagagatctcactcactgtggtgaagacagcgccaagccatgagggctcygccccagtgattcaaatacctcccattacggacatgtttcaacatgagatttgagcggggacaaatatccaaactatatcaggatcccagcagactgggt

SEQ ID NO: 44863 - DNA, 201 bp, Homo sapiens
gaaaacggagattgaatctggaaaacgcattcatctttagaggcagtgttaatgaatacatgaatttagtcctgtaaatgttttctcccttatttgggacwtggtgtattgaaggtgtctgttaactgtgctaccaatgagtgcccctgtatccgagggaaactggagaagtgtacttgggctaccgggttaccaagagca

SEQ ID NO: 44864 - DNA, 201 bp, Homo sapiens
gatttcataagaaatccacatctgagagtcccagaaggtaagatattcccctttcttctaaatatacttgaccaccaccattcaggttcttctattaaccytcctatatttgccaaccctcaacctgttagaaacaagaaatgggactctggagtagatgttagcaacatcatgagctcaaacccctccagcttacagcgg

SEQ ID NO: 44865 - DNA, 201 bp, Homo sapiens
gagttgtcaggattctcgtaaaattcctgggtgatggcttcttctgttctctttatttccttaactgaacatctgtctaattgttcacctccatcgctttmgtgctttcctcatgctttctctctttccagacaataaactttattttcttcataagaattcagtctacgcaagggtattaggcagcttgtttgcaccttt

SEQ ID NO: 44866 - DNA, 201 bp, Homo sapiens
tagcttatagtttattttattctttaatgattttttaaaaatatttctctcacttacttgaaaagcagtcttagaaattaactggaatgggtaatttattygtctttcttcttttgtaaaataatggcagtttgtaactcagatttttgtatgaggaataaataaaatactgtctgttttcctttgatctttctatttgtg

SEQ ID NO: 44867 - DNA, 201 bp, Homo sapiens
ttttttgttagtttttgagacagagtctcggtctcttgcccaggctggaatgcagtggcacgatgttggctcactgcaaaccctgcctcccaggttcaagygattctcctctcccagcctcccgagtctctgggattacagacgtgcatcaccaggcccagctaatttttatatttttactcgagacgtagtttcaccatg

SEQ ID NO: 44868 - DNA, 201 bp, Homo sapiens
catgaatcgctgtgcctggcctcaactttaaatttttatattgaataatctttgatttgtattgtcatgttgttttatagcagttactgctgttttagtgkgatttgggatgaaaattttaaaaaatcaatatgtataatccaccatctttgttccttttatttttatgttactcattcttttaagcttgtcttagacgtg

SEQ ID NO: 44869 - DNA, 201 bp, Homo sapiens
tgcaaagacaggcgctgctctctggcagggacagcgtgtagggtttgcatgatttgtggggccgtttcatgtttgcacggtttggcttggcttgggactcdgccagtggtcactgcagtttaacaaactccccccgggtgtgaaggaaagcgagataaatgcaggaaaaaggatacattttgaaatctggaaattttacat

SEQ ID NO: 44870 - DNA, 201 bp, Homo sapiens
ctgggcaaggaaacaaaactgaacaacattagcaaaatcactacatattataggaatcaagtacattctgaacggcttaatcctacagtttagatatgaascctaagggtaagatgaacgtcttagatgatctgagatatccaaatacctgtaacaaacatttgtatggtgtatgtagggcaggaaccccatcagaattgg

SEQ ID NO: 44871 - DNA, 201 bp, Homo sapiens
catgctatctcgacttctgtgtgtctcctttttgtccatctcttaaatcagtcacttggcagcagcaagacatgtggccactccagaccatttgatcgaaragctcttgttaggagattaggctgctaatctgcaagcgagctaatggaaatcattctgggcaaggaaacaaaactgaacaacattagcaaaatcactaca

SEQ ID NO: 44872 - DNA, 201 bp, Homo sapiens
gaccattaatcatgctatctcgacttctgtgtgtctcctttttgtccatctcttaaatcagtcacttggcagcagcaagacatgtggccactccagaccawttgatcgaagagctcttgttaggagattaggctgctaatctgcaagcgagctaatggaaatcattctgggcaaggaaacaaaactgaacaacattagcaa

SEQ ID NO: 44873 - DNA, 201 bp, Homo sapiens
tccattagagacctggcgtataattgtgggagggagaagccagtggagcagtcaggggactccctggctgtttctgtgtctggtcttatgggtctgggcaytgaattcagtcacaaaccctagcatgctcctttgctacctcaggggacaaagtcaagaaaataacactaggattgccaccctgctctctctctctctctc

SEQ ID NO: 44874 - DNA, 201 bp, Homo sapiens
gtgactttgagacatatctcctacagcaggtggagttagcttaactaatgcagaacgataggactggtgaagcagtccatctgttatgagagctattcttyttttttttttttttttttttttgtgagatggagtcttgctctgttacccaggctggagtgcagtggtgcagtctcagctgactgcaagctccgcatccca

SEQ ID NO: 44875 - DNA, 201 bp, Homo sapiens
aatagcacagcttttttccactttcaaatgtataacaaaatagaactttatatttccagatggactgcctggaacccggggagtggctcagctaccaggcyccagtggcccttgtcttgttatttcctccattagagacctggcgtataattgtgggagggagaagccagtggagcagtcaggggactccctggctgtttc

SEQ ID NO: 44876 - DNA, 201 bp, Homo sapiens
atagttctctctgtgaccctgtagaatgcactgaagcaaaaataacaggtaatgctaatcataaagttttacaaatctcctgaagagtcttgttggtttcygtgttgatgaagcaggaaatttccctgacccctttgcaggcaggaagtggagtgcggatgctggaactagctggctgctttggtgccagtagaggtgaac

SEQ ID NO: 44877 - DNA, 201 bp, Homo sapiens
taaactctgcatgtggtctccatgatgtcctggctgtgttagcatcagaaatggctttgcccacatctcccaactctgccctcttattaggatttctctgygctggctgatgcctgagccatctaatgatctttacgggaataaccaaaaatgctgggtggggggggaaaacgccagcagatctctttagggcagagtagg

SEQ ID NO: 44878 - DNA, 201 bp, Homo sapiens
acctggctaatttttgtattttttgtagaggtggagtttcgccatgttggccaggctggtcttgaattcctgacttcaagtgatgagactgcctcagccasccaaagtgctgggattacaggcatgagccatcgcgcccagccagacttgtatctcttaatgagtttaactacatttaaccatgtatgtgtcagtcctact

SEQ ID NO: 44879 - DNA, 201 bp, Homo sapiens
tcaggagattgagaccatcctggctaacatggtgaaaccccatctctactaaaaatacaaaaaattagctgggtgtgttggtgggcacctgtacttccagstgcttgggaagctgaggcaggagaatcacttgaactcagaaggccaaggttgtagtaagctgagattgcaccactgcactgcagccttggcaacagagcg

SEQ ID NO: 44880 - DNA, 201 bp, Homo sapiens
agttctgtgtttatacttctcatttagcccataccccactatattaaaagaagatgtataagtgtatgtgtttaatctaccattccttgtggcacagtgcrtggtctgcatggcacagtgtgtggtctgtatggcacagtgcatggtccgcatggcacagcgcatggtccgcgtggcacagcgcgtggtccgcgtggcaca

SEQ ID NO: 44881 - DNA, 201 bp, Homo sapiens
acatggtgaaaccccatctctactaacaatacaaaattagctgggtgtggtgatgcacacctgtaatccctgctacacaggaagctgaggcaggagaatcrcttgaacccaggaggtgaggttgtggtgagccgagatcatgccattgcactccagcctgggcaaaaagagcggggtaaaaaaacaacaaaaaaatgatgt

SEQ ID NO: 44882 - DNA, 201 bp, Homo sapiens
gcaggctgcacaggaagcatagaagcttctgctactgggggcgcctcaggaaacttataatcatggcagaaggtaaaggggaagcaggcacatcttacatsgccagagcaggagcaacagagagcgactggggaggcgctacacacttttcaaccaccgaatcgcatgagaactctctcactgggacaacaccaaggagat

SEQ ID NO: 44883 - DNA, 201 bp, Homo sapiens
ttggcctcccagagtgctgggattacaggtgtgagccactatgcccaataccccctatgtagacttttaaagaaatacaggaaacagccaagactggtgtsattcagatttagcttgggagagtctagtgggtgttaggttcccacaggatgaaggatcaccatgaacggtcaggacctgacttaggaggactcagaagct

SEQ ID NO: 44884 - DNA, 201 bp, Homo sapiens
gagggtggcagtgatcttgaggggggtctgggagggaggagccagcctggcctggtctggcctggcccagtgtgccagctagggcaggtgcaatggctcaygcctataatcccagcactttgggaggccgaggcaggtggatcacctgaggtcaggagttcaagaccagcctgaccaacatggtgaaaccccatctctact

SEQ ID NO: 44885 - DNA, 201 bp, Homo sapiens
gatgctgttcatttgccttattcgttatgaccatagaagtttgtggggtggcactctttattctgtcctcgccccgcaagcaaagcacacaccacaagctrtaaggagatgagctcagtaggcctgtcctttactttattttccctattagaatcccaccatagacgccctctctgcatgtgtccttgtctgggggagtcg

SEQ ID NO: 44886 - DNA, 201 bp, Homo sapiens
cctgcttaggaaatttgggttgagggtggcagtgatcttgaggggggtctgggagggaggagccagcctggcctggtctggcctggcccagtgtgccagckagggcaggtgcaatggctcacgcctataatcccagcactttgggaggccgaggcaggtggatcacctgaggtcaggagttcaagaccagcctgaccaaca

SEQ ID NO: 44887 - DNA, 201 bp, Homo sapiens
cctccagatgctgttcatttgccttattcgttatgaccatagaagtttgtggggtggcactctttattctgtcctcgccccgcaagcaaagcacacaccasaagctataaggagatgagctcagtaggcctgtcctttactttattttccctattagaatcccaccatagacgccctctctgcatgtgtccttgtctgggg

SEQ ID NO: 44888 - DNA, 201 bp, Homo sapiens
tggtgtttgtcagagaggttcgagctcttaaatttaaatggcctcccacagggaagcagaagtccttttggatcctccagaggactgagatcctccagatsctgttcatttgccttattcgttatgaccatagaagtttgtggggtggcactctttattctgtcctcgccccgcaagcaaagcacacaccacaagctataa

SEQ ID NO: 44889 - DNA, 201 bp, Homo sapiens
tcaaaggctgggcctgatggtgtttgtcagagaggttcgagctcttaaatttaaatggcctcccacagggaagcagaagtccttttggatcctccagaggmctgagatcctccagatgctgttcatttgccttattcgttatgaccatagaagtttgtggggtggcactctttattctgtcctcgccccgcaagcaaagca

SEQ ID NO: 44890 - DNA, 201 bp, Homo sapiens
ttctgtcatatgggtttaccatacttttctcaatccacaatctcatcagagtcccaatagttgcctgatatgtctccatcagttgtgaggtatgtttcaartgatttattactagaaattcttagcgagctgaagtttgtaaattttctcaagctactttattgatatataacacagatacataaactttgcccattcaaa

SEQ ID NO: 44891 - DNA, 201 bp, Homo sapiens
gcgtttagccagcgccccgctctgggctccagcaacattagggcattgttattccatccgaatgacaatttcaagctcacgtctttgttgtccatcctcgwatatcctgcaccgttcctggcacagagtaggcactggataattatttcttggatgaaagaatgaacaaatgaatgaatgaatgaaagtttttttccttgc

SEQ ID NO: 44892 - DNA, 201 bp, Homo sapiens
ctgtgactctatcgtgtgaattagcagagcttggctattattcccctacttcggtagatactggctgtacagaagggaaccccagtttcaatgagtacctrtgtgctgggcacttagctggtttttacacacatacttcatttgaagggaaggaattgactgaaaagaattctccattccaacttcccaagtcagttgcca

SEQ ID NO: 44893 - DNA, 201 bp, Homo sapiens
taagatttacagatattaacgactccttgggaaaactggacttcagtcgcctctctccaacaaaaaacgactattgggcgatgctggcttataacaggtcsaagctctgcaacatcctcttctccaacgagctgcaccgtcgcctctccccacgcggggtcacgtcgaacgcagtgcatcctggaaatatgatgtactcca

SEQ ID NO: 44894 - DNA, 201 bp, Homo sapiens
ctctagagtggcaggcgaactctgattttgaggaaaaaggatagggtaatggtgttgacacaggcactgttgaatacgtatgtacatattttaatagtttkctcattaatcaaatggaaatgctatcgattttataggatcgttgtgagaagaagtgagaattgaaatgaaaggcatctagtcttccccggtccccatcca

SEQ ID NO: 44895 - DNA, 201 bp, Homo sapiens
tgggaatctcaagttcccaggagccaaccacaagagcttcacagctcagaattttcaagatgtggatgtaggcagggagcctatgtagtaattcaagtaarcatctcttcttcttgttttccttataggatgatagaaggtcagtgcttgttcaccccagtgaggtggagcctctgaggtgggaggttttctctcatcctt

SEQ ID NO: 44896 - DNA, 201 bp, Homo sapiens
cattgttacatcctacaagcgtgcttacctgcatcaccttgctgggctgtttcagcattggaatatcactgggaatctcaagttcccaggagccaaccacragagcttcacagctcagaattttcaagatgtggatgtaggcagggagcctatgtagtaattcaagtaaacatctcttcttcttgttttccttataggatg

SEQ ID NO: 44897 - DNA, 201 bp, Homo sapiens
tatgtatttttgataaatacctaggtgtgaaattattgactcttagtgtttaacttgtaagaatgctgccaaacagttgtctaaagtaattgtatcattttaacccctcgctagaagtgtgtaagagtttatgttgcttcacatcctcatcagcactttgtaatttcagtctttttaattatagcctttttgtgggtgaga

SEQ ID NO: 44898 - DNA, 201 bp, Homo sapiens
cctagagcaggttgggcaagaggcttttctctcagtcaccagccccaaaccctgtggtcttgccagcccaggacgtgtcaagactgcagcctttgctgacytgtgaccatctccaagtccatgcccaggcccctactaggagttgagggcaacaggggcagtgggtctctcctgcttaggaaatttgggttgagggtggca

SEQ ID NO: 44899 - DNA, 201 bp, Homo sapiens
gtttttagacagaatatcacttttttatattattcatggtaatgtaattcccccctttaatctcttcagggtttcccattcagtcatgatatgcggttcaragaaagttggatcgaccattaatcatgctatctcgacttctgtgtgtctcctttttgtccatctcttaaatcagtcacttggcagcagcaagacatgtgg

SEQ ID NO: 44900 - DNA, 201 bp, Homo sapiens
agaagatccattgcaaaatgaaaatatggggttctagccaggggcagggaacttaatctcccttttccatgggcccaacacctgaatctagggcaaacagstgtcccccagattggatcctctgctctaggacacattcttgtcctagagcaggttgggcaagaggcttttctctcagtcaccagccccaaaccctgtggt

SEQ ID NO: 44901 - DNA, 201 bp, Homo sapiens
ggagggacaatagaacctctgtagaatcaaaggcagaattaaaatctgcatgttaatagctttcctgccagccacgaatagattcattcttcacgtctcaratatataaagcttatttcaaaataaattctggggagcgttcaacctgattgaatctgctgtaagctctgttaatatatttgttcgagtcacttgcactca

SEQ ID NO: 44902 - DNA, 201 bp, Homo sapiens
ggttatttccttgaggagaaaggaaaggagaagttgagtacttttcagtgtttgttactacaaaagcatggtggcatgccattgttctgagaggaaggggsttttttgccttgtcagctcctgatgaaaaagatgttgggttggaaagctaagttacagcaggtgaacttgaatttgaggaaagacaaagcaaaccctggc

SEQ ID NO: 44903 - DNA, 201 bp, Homo sapiens
gtgggcttagaagaaaaccagaggtctgtgcacactatggatttttactacaatgatgccctttcacatacagcgagaaggattaagaggtactgtattgktggttgataaagtcaaacttgtgaacagagcaaaagggcattgcttggtcattgcagcttccacccatgcaccttacacagaagtttgggccctaacatg

SEQ ID NO: 44904 - DNA, 201 bp, Homo sapiens
ttttcccttcttgataggttgtagattccatgtctaatccatgcttttccaatattccctcctaatctttcagttgaattatggtctttagctcaaatgcrtgacatgatgtgtgtgcctttggagtggggcggtattagtcagtcgatggttatttccttgaggagaaaggaaaggagaagttgagtacttttcagtgtt

SEQ ID NO: 44905 - DNA, 201 bp, Homo sapiens
caggtttgtcccatttgtactgactctgacccaggttgtcatgacttgagactcactagaagtttcagaaagatgcagactgctttaaaaaaaaaaaaaaagggcaaggggaggtgtgagaagaaagtataattctttttcttctaactggagatataaaaatcatataagcatgatttatgatttgattggaacattgta

SEQ ID NO: 44906 - DNA, 201 bp, Homo sapiens
tcattatggccccctcccccaggagccttttgagatacgactttcctaatggtctttgcccatgaaatctgaataccacagatgtgctgaatgcctgttcrtgtaccatatacacatggtatatgcctcgtaaatgaaagggtgaacagtgtttattccccaactgtcgtccctcaaaaccaatgttaacacccctggatg

SEQ ID NO: 44907 - DNA, 201 bp, Homo sapiens
ttattacagcgcaggtgcatcttgcttttgagtgctaactgagatgaaaggagtgaggaaacgctctcttcttcttgcaggggagggctggcaaattcagygaatgcagagtcggctgggagcctttcggctggaaagctcttcctctgatgagctgtctgttacagattttcagggatggcccttgataaggcaggggtg

SEQ ID NO: 44908 - DNA, 201 bp, Homo sapiens
catgatctcggctcactgcaagctctgcctcctaggctcatgccattctcctccctcagcctcctgagtagctgggactgcaggcgccagccaccacgccyggctaattttttatatttttagtagagacggggtttcaccatgctaaccaggatggtctcgatctcctgacctcgtgatccaccagccttggcctcccaa

SEQ ID NO: 44909 - DNA, 201 bp, Homo sapiens
gcctagttatgatgtgatgaatccgtctctgttaaggttatcaactttaataaaccatgtattatttccttaaatattgtgcaatgtgcagggaattattkcagttttgttttttatttagcacaaacctaaatattacacgtagcaaatgtcacccgatgcaactgtctgtcctgaagaggaggacagattattctgtgg

SEQ ID NO: 44910 - DNA, 201 bp, Homo sapiens
tcttttttttttttttttttgaaatggagtcttgccctgtcccccaggctggtgtgcagtggcatgatctcggctcactgcaagctctgcctcctaggctyatgccattctcctccctcagcctcctgagtagctgggactgcaggcgccagccaccacgcccggctaattttttatatttttagtagagacggggtttca

SEQ ID NO: 44911 - DNA, 201 bp, Homo sapiens
agcacaaagcaaagcagttaaatgaataaccgccttccagtacagataataaagcaggagaattttgtgtgtcacatcaataaacatcttaattgaacagyacgtgggttcttccctagtacctgccttgctatacactagccttggaaagagtcttggtaaattgttcagcctcaagttccacaacaaaatgggattctg

SEQ ID NO: 44912 - DNA, 201 bp, Homo sapiens
tttggatttgtgttagagaaaaactgtctctaatgaccgcacagcacaaagcaaagcagttaaatgaataaccgccttccagtacagataataaagcaggrgaattttgtgtgtcacatcaataaacatcttaattgaacagcacgtgggttcttccctagtacctgccttgctatacactagccttggaaagagtcttgg

SEQ ID NO: 44913 - DNA, 201 bp, Homo sapiens
tctaaaccaaaggacctaaataaaatattaatttttcatagtgtttaatatgtgccagtatatataaattcaaggtaaggtagacagctgtaaactggatsccctgctgtacccagcaaatgctgagagccctgcttcccctcttgtattcaaatggctctataagagaggaagtagtacagctatcagtaacaatgccat

SEQ ID NO: 44914 - DNA, 201 bp, Homo sapiens
gtaaggcaagagacccgtaattgattcataagatcccttcctccgatcgcattgaagagttaattatttttcctgcagttgggactcagctgttgtttccmctgggattaaacagctgtcagcattgttaatgacatcaaattcatgcattaaaatcctctcattcccttcccgtataaggtggggttgcggaaatctctg

SEQ ID NO: 44915 - DNA, 201 bp, Homo sapiens
ccttctcagagtcagtaggatagtttcccttcctggaagattgagatgaaataaagctttaggagttggtatcgcacgcaggcattaaatggattgtgaasagggactttgttcccgctcagtcttgtctctgcctccgtaaaggagtaagttaaaaaagaaagtttctttttttaaaaaaaagccttactgctcaataaa

SEQ ID NO: 44916 - DNA, 201 bp, Homo sapiens
atagtcactggaaggaagtcagcaagcaggggtgaaaaaaaaaaaaaataaaagaacctgaagccgccaagagaggctcactgaccatctctgggggaggragggtgaagagtagcaaatttaccgtcatcagcaggtgtgtaaatgttccatttacattgaatggcacatgtcataaagtacataccgctgcacatccca

SEQ ID NO: 44917 - DNA, 201 bp, Homo sapiens
aatcaaaaaagccagtcacaaaggaccctatgttatatgatttcatttacatgaaataccccaaagaggcaaatctgcagaaacagaaagtagagtggttkccaggggctggggatggggtgtggatggaggcatttgggattaacagctaaagatagcaggattccttctaaagcaataaaaatgttgtaaagttgattg

SEQ ID NO: 44918 - DNA, 201 bp, Homo sapiens
aggtcttgtgtacccaccgatcgcaattgagcatatagtacatgctgtcctgtgtacccactgatccctggtcctgcccctggtatgagggtattaacatyttgcattagtgtggcacatttgctacaattaataaaccaatatcgatacattattaactagtctatagtttacatgaggggctgctgcttgtgttgtaca

SEQ ID NO: 44919 - DNA, 201 bp, Homo sapiens
ttcgcatgttgaaaacattgtactaatcaaaaaagccagtcacaaaggaccctatgttatatgatttcatttacatgaaataccccaaagaggcaaatctrcagaaacagaaagtagagtggttgccaggggctggggatggggtgtggatggaggcatttgggattaacagctaaagatagcaggattccttctaaagca

SEQ ID NO: 44920 - DNA, 201 bp, Homo sapiens
tggagataaattgtcattgctaattgccagagaccaggtcctggtggtagccaaactgttccctagggagttctcaccaaccttgcaaaatgagatggcartcttcatcgtggatgcaattatgtttcattgttaaccatcacaagcaacgggacattatgatgactgttataagttggtttcacatgtaaactttgacct

SEQ ID NO: 44921 - DNA, 201 bp, Homo sapiens
caggacctgacttaggaggactcagaagctggagactgcagaggatggcacagagttccaaatctttggggtgtgtaagagtaggagaggcaggatgggaraggatgggagtgatgccacataaatcaactctgttgcagcctccggggccacatcagtagctgcaggaggaggagggaacagggagacagggagcctttc

SEQ ID NO: 44922 - DNA, 201 bp, Homo sapiens
aacggggagatggccatgattgcttttagattgccacttccacattgagtgaattttataataagaagccattttttccccgacaggctgcccttgtgccygcctctctgactttgaggtcctcattattgtgggtttaaatgaaggatgttcattcaggcagggatggggggatggggggaggccaccaggcatcagcgc

SEQ ID NO: 44923 - DNA, 201 bp, Homo sapiens
gaagaggcacagaagttcagggcgtgagagggtatgcgagagatgtcaacaatccaggagctggcttgcttcttcctttagtcagtggtgcaagcttcaartggataattcaaatgaatcaatggaaaggcctcttttaacatttgatttgtttcttcaaagaacacagatgaagtttttctcatctctttagattagtga

SEQ ID NO: 44924 - DNA, 201 bp, Homo sapiens
tagtttagatactttccttttacatatatatttcctgatcagcttctccatttcttttaaaaagccttgctgggagtttatttgctttggtattgaatctsttgatcaatttgaggaggatcaaaatcctgaaagtgttgagcgttaccatccatgagcatgcatctctccatttatttaaggcttctttatttataaaca

SEQ ID NO: 44925 - DNA, 201 bp, Homo sapiens
atctaagaggtaataaccctaatacctcttagtgttgctgtgagaattaactaaagtaccatcttcatgtggtcagcacaatggctgacacatagcaagaycttggtaagttatagctgttgctgtcattcctgcagctgttatctttgtcattacgcttactgttattattagctctgctatcagagtgatgctgtggct

SEQ ID NO: 44926 - DNA, 201 bp, Homo sapiens
ggacacattgattccacaacactgaccttctatcagatcagccaggatgctctttttcaaacttctgtcaatctttccccaccttcacaatgtgcccctaktattattaatatttaaaatattgaagatctaattaatgttgaaatttttctttaaatcaattcatagattcattaactttgttttaaaaggaaatgttct

SEQ ID NO: 44927 - DNA, 201 bp, Homo sapiens
tgtttgtaagaatcagttgaggacagatgggactatttgcatggattggtgtcatgtttgaagtcagttaccagagggtttctttcaacagagtatcccamaaaaaaaaaaaaaaaaaaaaaaaaaaaagtaaattgcacagaccccagcttaggacctggacttaatcttcatgatgtttgtaaagtaatacttcttgga

SEQ ID NO: 44928 - DNA, 201 bp, Homo sapiens
aaactcctgagggatgctcaggaaaccaaaaaggatgtctgcatggaggacaagaaggcacaaatcgtctgatttcaccccatcctaagatcttgtgactycagctttgttttggactggggcattggatctcccacatgccctctcttaagtcgtgcatttgacgcatatttaataagcacctactgtgtgccattagag

SEQ ID NO: 44929 - DNA, 201 bp, Homo sapiens
ccgctgatctgcatagcacttcgcaatgaagctgtgctctagaaacataccacgatctactggactttcttaaataaggtggttgttcaggaaattcctcyagttaattttactttaattccccctacaagaatgccgagacacctctgcctattttctctttctgtgtttgttgtttcttttgtttttgttttcgagact

SEQ ID NO: 44930 - DNA, 201 bp, Homo sapiens
ttaggttcccacaggatgaaggatcaccatgaacggtcaggacctgacttaggaggactcagaagctggagactgcagaggatggcacagagttccaaatmtttggggtgtgtaagagtaggagaggcaggatgggagaggatgggagtgatgccacataaatcaactctgttgcagcctccggggccacatcagtagctg

SEQ ID NO: 44931 - DNA, 201 bp, Homo sapiens
gagtgcagtggcatgatcatggctcactgcagcctcccgggctcaagctttccacccacctcagcctcctgagttgctgggaccacaagtatgcaccaacrtgcctggttaatttttgtggttttttttttttttttttttttcctgctgagatggggatttcaccatgttctccaggctggtttcaaactcctgagtcca

SEQ ID NO: 44932 - DNA, 201 bp, Homo sapiens
cctaaggtattgctgtcctcaccgtcctatggggagataggtcactttcccaagtctgggcagccagcagcagggctaagatcaccactcagaccctgtgwttttatttttcatctcctcacatctggcgctgaatgtcaggaccttcctggcctctgggaaagacacaggatggctgttttgagaggagtgtgaaataca

SEQ ID NO: 44933 - DNA, 201 bp, Homo sapiens
ccaagtttacctgcctctctgagaagcccatcagccctgagagatacctggaaggaaagaggaaaatgcgggattcaaatcatgttgcaagtggatgaatytagccccaaacaactgggaggcaactactcctgcctgccgaggccttttttttttttttttttttttgagactcactctgtcacccaggctggagtgcag

SEQ ID NO: 44934 - DNA, 201 bp, Homo sapiens
ctcaaatttctggctggtacaccctgggtaaggtccacaggctggatgggttttggaacatgtcttgattgtactttttcctcttggtttggaaagcaacrtaccctaggtaaggagagatttctgacaacagctcagcaatcacagtttccagaaaatggctccagtggatcaactatgagttaagtaaaaaaaaagtca

SEQ ID NO: 44935 - DNA, 201 bp, Homo sapiens
gttatctgatatgtgtttcagcctgttttcccaagtttacctgcctctctgagaagcccatcagccctgagagatacctggaaggaaagaggaaaatgcgkgattcaaatcatgttgcaagtggatgaatctagccccaaacaactgggaggcaactactcctgcctgccgaggccttttttttttttttttttttttgag

SEQ ID NO: 44936 - DNA, 201 bp, Homo sapiens
ggttatctgatatgtgtttcagcctgttttcccaagtttacctgcctctctgagaagcccatcagccctgagagatacctggaaggaaagaggaaaatgcsggattcaaatcatgttgcaagtggatgaatctagccccaaacaactgggaggcaactactcctgcctgccgaggccttttttttttttttttttttttga

SEQ ID NO: 44937 - DNA, 201 bp, Homo sapiens
tcttttctcttctagaactttccccatagtcatgcatctgtccctgggttatctgatatgtgtttcagcctgttttcccaagtttacctgcctctctgagragcccatcagccctgagagatacctggaaggaaagaggaaaatgcgggattcaaatcatgttgcaagtggatgaatctagccccaaacaactgggaggca

SEQ ID NO: 44938 - DNA, 201 bp, Homo sapiens
gggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgc

SEQ ID NO: 44939 - DNA, 201 bp, Homo sapiens
tcctttcttttctcttctagaactttccccatagtcatgcatctgtccctgggttatctgatatgtgtttcagcctgttttcccaagtttacctgcctctytgagaagcccatcagccctgagagatacctggaaggaaagaggaaaatgcgggattcaaatcatgttgcaagtggatgaatctagccccaaacaactggg

SEQ ID NO: 44940 - DNA, 201 bp, Homo sapiens
cgttgtgtctggtacatggtaaggggttcgtaaatactgagttatttcttattaacatttattattgtctccactggaagaagagcctgtagaatatgcaractattcaaatgcttcctttggtccattgttgtcctttcttttctcttctagaactttccccatagtcatgcatctgtccctgggttatctgatatgtgt

SEQ ID NO: 44941 - DNA, 201 bp, Homo sapiens
catgcaaggtgctgtttatgaacaagggagtttcctgcagctttaataaagaagagaaaagaaaagaaagaaaggaaaattcgcatgttgaaaacattgtrctaatcaaaaaagccagtcacaaaggaccctatgttatatgatttcatttacatgaaataccccaaagaggcaaatctgcagaaacagaaagtagagtgg

SEQ ID NO: 44942 - DNA, 201 bp, Homo sapiens
gtgctgtattccgtaggaaaatgtagatgaatgtgggtcattgggaaataaagtgggtggaagtattggcgagcatttctttcccactctctacctcgccyggtctagccgctgataggtagttactctttagtatgcccaagttcaaattacgtatgactgtgattctaacacggaagcgccctccttttctagtagctt

SEQ ID NO: 44943 - DNA, 201 bp, Homo sapiens
gtgctgtcagggcccgtggcaaagggttccctcattccctctgcagttatttttcatgcacactcggattacactgctcggtgatattacatctgcatgcstcttgccctctgacacggcaaacacagatgctgcccgaatccttgtaaagccatatatcttaagtaggaaggagcatctttgcaggggaggtgaattgat

SEQ ID NO: 44944 - DNA, 201 bp, Homo sapiens
actgcagcctcaaacttctaggctgaagtgatcctcccacctcaacgtcctgagtagggagggcactacaggcgcatgcctccacatctgactaattactraatttttaaaaatttttttagacactgagtctcaccgtcttgccctggctggtctcaaactcctgggctcatacaattcccctgcctcagaatcccaaag

SEQ ID NO: 44945 - DNA, 201 bp, Homo sapiens
gtgttaatcttacacctacccattagtctataaaactcctgagggatgctcaggaaaccaaaaaggatgtctgcatggaggacaagaaggcacaaatcgtytgatttcaccccatcctaagatcttgtgacttcagctttgttttggactggggcattggatctcccacatgccctctcttaagtcgtgcatttgacgcat

SEQ ID NO: 44946 - DNA, 201 bp, Homo sapiens
gggagggaagaaccctatgggcagaaatgtgactttctgtagcaaagatgtactgtttcccactgagaagaatcaaaaatagaaaagtgcttccttgtctytctatattgttattaaaacaagtagatgcattttcattgaatcaaggcagttttcctttataaaatgtcctatttcatatcactgttcaaacttgacatc

SEQ ID NO: 44947 - DNA, 201 bp, Homo sapiens
tcaggtgggactcatggagattttccgttctttggagactagcagcgactgcagattactcatcagctgtctccttgagtccacaatgccgggcggtggaygggcttcctgcctcctggcccagggcccctttgccggctcttagtgtagagcactagttgtaccatctggtagttgtttgtgcctgcgactctcttccct

SEQ ID NO: 44948 - DNA, 201 bp, Homo sapiens
ttacaggatacctagggacctgttggggtgggagggaagaaccctatgggcagaaatgtgactttctgtagcaaagatgtactgtttcccactgagaagawtcaaaaatagaaaagtgcttccttgtctctctatattgttattaaaacaagtagatgcattttcattgaatcaaggcagttttcctttataaaatgtcct

SEQ ID NO: 44949 - DNA, 201 bp, Homo sapiens
ggctgaggtgggctggatcacttgaggccgggagtttgaaaccagcctagctaacacggtgaaacccttctctactaaaaatacaaaaatattatctgggygtggtggagctttcctgtagtcccagctactctagaggctgaagcatgagaatcacttgaacccaggaggtggaggttgccatgagcagagatcgtgcca

SEQ ID NO: 44950 - DNA, 201 bp, Homo sapiens
gagaggattccttgagtccgggagttgaagaccagtctgggcaacatagtgaggccttatctcttcaaaaataaaaaaaattagctgcccatggtggtgtrtgcctgtggtcccagctacttgggcagctgaggcaggagaattgctggagtacaggagattgaagctgcagtgaactgtgactacactgctgcactcaac

SEQ ID NO: 44951 - DNA, 201 bp, Homo sapiens
taaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacataca

SEQ ID NO: 44952 - DNA, 201 bp, Homo sapiens
tgtaagtactctgatatgcaccacctagattctacaattaacatttccctctatttgcatctctatccatttaccattcctcttgtctatccatcagtctrtcttgattcatttcaaaataagttgtaggtcaggtgcagtggctcacacctgtaataccagcattttgagaggcagaggtgagaggattccttgagtccg

SEQ ID NO: 44953 - DNA, 201 bp, Homo sapiens
cctattgccttcagatttacatcaagcacaatttggcaggtattagggatggacccagcagccaagtctttgttgccttaaacagatcccttgtctcttgycaggacctccttccaggctgctcctgagcaagtctggatgtgacttctacctatgatccagtgggttgggccataaaggagctttggaaagggacagtct

SEQ ID NO: 44954 - DNA, 201 bp, Homo sapiens
actaccttgcttgcctatgggacatgttcccatttcagtgcatacttgacctttaccataaatcacatatttgtaaactgtaccctcctgctgttttattrggcatggagaagcagtcttttctttttcttgatggcctgggttgaccagatcctgacttttgtggagacattaaagtgctagaaatgataatggtgaaag

SEQ ID NO: 44955 - DNA, 201 bp, Homo sapiens
gatgtatggatgggtgggttggtgggtgcatggatgggtgagtaaggggggataaatgaaaggcttgttcttctgaagggactctttacaaagagtctttsatcttccagcttcacgtgcaagagaatccccaaggtgagcttgttaaaataagcatattctgggtatcacttcctgattttctggttcagtaagtctgag

SEQ ID NO: 44956 - DNA, 201 bp, Homo sapiens
acaagggccctgacagccttttctggacttgtagtatgtgcaagaattaagctttttctgtatcaagtcaccgtgttatgggggttgttcctcactgcagsagaaccttgttcatccgtattagaacagtgtggtgtttcatgttagcagagtgtatcaggatcttttgttttttttttttaaattaaggatgctgtatga

SEQ ID NO: 44957 - DNA, 201 bp, Homo sapiens
atggataggtagatggatggatgcgtgggtgtgtggaatggtgggtggtaggtgggtacatagatggatgtatggatgggtgggttggtgggtgcatggaygggtgagtaaggggggataaatgaaaggcttgttcttctgaagggactctttacaaagagtctttgatcttccagcttcacgtgcaagagaatccccaag

SEQ ID NO: 44958 - DNA, 201 bp, Homo sapiens
taaaaggtctatgcagattaacgaggaaaaatgagggaaattactgtaaggtttttaaaacatgatagttatatatgaactgatgattatataattgaacrtgcctaaattgatgtagttctctgtaaaactagttggtgtaaggaaacttggtctttgaccatcaaggaggttgcagtttgtggcatggcacaaagataa

SEQ ID NO: 44959 - DNA, 201 bp, Homo sapiens
aaggttctcacagtctggagggaacagagagccatcagggacaataggtccctgtgccatcagctactgggatgtatgactttccagtagaggtacacagmacttgttccaaaaggagcctatgtagctttgggagttctctatttagtcaccttattttttttgtcttcttgttaaactagcatcctgttttactgaatc

SEQ ID NO: 44960 - DNA, 201 bp, Homo sapiens
catggttggggtagtgggcacaggggaaggaaggttatgtaattttaaaattcttcctttgattcaaaagaaaaaaacatgtttgttgcattcaactccawagggtgagcatagcttagtggggagagatttggactaaaaaataagagttctgggttcaagatctgaggtaaattatttgctaggccttagtttcccatc

SEQ ID NO: 44961 - DNA, 201 bp, Homo sapiens
tgccttgcagtttccaaagtaagctgaacagtgttttttaacagtgctgcccctctctcccactagaaatgcgagtccatccttttaccaagtgtggtacracaaaggtttctctggttttcttttggtattctcagacaactgaaatataaattacatggtatgtgcaggtatcaccaggatgcaattagtttgatgaaa

SEQ ID NO: 44962 - DNA, 201 bp, Homo sapiens
taatctcaaagctgtccctgcgctggtgcggctggcccacttgtgcctttgtgaatttgcagagaagaggctgggcgtggggggacacatgactaatccgscctttcttttgtttgtgcaacaactcaattcactgtcaccacatcagcacatttgctgcaaatctcagtgccctctcactttcgttttatttaatgcgtt

SEQ ID NO: 44963 - DNA, 201 bp, Homo sapiens
aacctccaccacgaaggttccagacagagtgaaatttctgtatttgctgaccctgtcgccagtagcctggaataaacagcaaaaatagttcttgaggcttygtggcaaatgtgacctacctttgtagttcttgggtaggtgtgtgactgtggcctatgaggccaagttgcaaggtctttggatgaactttgtggcatctgg

SEQ ID NO: 44964 - DNA, 201 bp, Homo sapiens
agccaagggatggctcagaagggtgaaggaactcacccgaattgcacagctggtgagctcagagtcaggctccttgcttggtccatctggcttccaaactscaagtctgtctgctccaccccatggcccatctttttaccatgtttagtatcaatgttcatactttgcagattttgctttcaaactctctagctgcggttt

SEQ ID NO: 44965 - DNA, 201 bp, Homo sapiens
aaacttttaaaaaaattaattttgtgaattaaataaagcagcatgcaaatttactatcgtattcagcaaccaaaattttatcacttgcctgatactgcctrgtgagcaggtggaaatgtagacacccaaacacccttcatggattcccagctgctgagagtttgaatagtatgtgaagtctgtagagacaaaattgttgtt

SEQ ID NO: 44966 - DNA, 201 bp, Homo sapiens
cttttgaaggtggtttgtttttttattcctttataagtacagttgtagatttacaaagtaattgagtatatagtacataaggtcttgtgtacccaccgatygcaattgagcatatagtacatgctgtcctgtgtacccactgatccctggtcctgcccctggtatgagggtattaacatcttgcattagtgtggcacattt

SEQ ID NO: 44967 - DNA, 201 bp, Homo sapiens
gatcactgagtgtgccttttgctctgttaagtgtgcattcagaactttactaacatgggttccacaggaaatattagccccattttgcaaatgaagaggcwgaggctcagaaatttaaaattgcttcatgtcgcacagttcagtgtaaagttgcaatgcaaactaagatgtttctgttgcttataatcttaactataataa

SEQ ID NO: 44968 - DNA, 201 bp, Homo sapiens
ctgggactacaggtgggtaccaccatacccagctgttgaaaaaaaaatggtggggtattactctgttgcccaggctggtgttgaactcctggcctcaagcratcctcctgcctcggcctcccaaagtgctgggattacaggcttgagctacttccccaggctcttcccccgtttgttaatacataccatgaccttggcctt

SEQ ID NO: 44969 - DNA, 201 bp, Homo sapiens
aaaagagtgtttggctaacttgcataaaaaggatctcatttttctttgtaacacattactacatacagtgaccatagtgtttctctaatttcttcaggacktactttgaagatgaagaagtatgtgtatccgctttttgtctttcagaataacatactgctgtctgtaaaaatacagataatttctctcttaaattccata

SEQ ID NO: 44970 - DNA, 201 bp, Homo sapiens
caccactgtacagcatctttacttaatctgccctctttcacgtgtgtgcatccctggcatgcttaaacaagaaaggcaaatgagagagagcgagtgagtgygagcgagagagccctgaggtgccagaaggctgtggttcctttgtgtctacagaaaagatataacgattgaattagactcttaaatatctgtggatgtcag

SEQ ID NO: 44971 - DNA, 201 bp, Homo sapiens
agagctgcaggcattaatgcaaagctgcactgcctcacgaggtcgctgatgcactctcattccttttcctccagggactcctgcactttgccaggcgtggrccagaatgccactcgtattgtttatcttaatgcttagtgatagtagctacctccagtgcacgccgcattagcctctccaatgagtttctcctttatttta

SEQ ID NO: 44972 - DNA, 201 bp, Homo sapiens
ttaaggaaactcggctcaaactagcttcggggactcgctgtggccataggtgccctaggctgcagtctgagagtgaaactgaggtctcactcccttcatastctgctctccgtctctgcctcatctggcttctcagggtggtggggcgtgggcactaatttgatttgatcacttagagacaacagcttacaaaatgctacc

SEQ ID NO: 44973 - DNA, 201 bp, Homo sapiens
ttgatgtaaaggactacctgaggctggctaatgtataaagaaaagaggtttaattggctcatggttccgcaggccatacaggaagcccagttagggaggcstaaggaaacttaaaatcatggcagaagatgaaagggaaacaggcatgttctgcatggctggagtaggaggcaaggagcgaaggaggaggtactacccact

SEQ ID NO: 44974 - DNA, 201 bp, Homo sapiens
tcttacacgttttacgggctatcagtagatgcatctaataatcctaacactgtcatccttatacttgaggtcttattgtccacttctaccttagctatgtwaacagatgagtaacctactctggatttacccagatagtgctgttaggcaccacacacgatgagattggaggcacctgggtgtcagcctcttgggctggct

SEQ ID NO: 44975 - DNA, 201 bp, Homo sapiens
ctggagtgacagagtgtgtcaagcctgcagctcgtcccgtgtctaatggaacagaaacaagcaccctgctgcccttgttttccagtggctcaccggggctytgcgaggtttattaatcttagcgtataatggaaaatgtgttgccatgtgaaatctagagcctctgttcactactccgcgaattgaaggcggcaggagtct

SEQ ID NO: 44976 - DNA, 201 bp, Homo sapiens
ccagccagggtggtctcgaggaggcccattaccggctggagtgacagagtgtgtcaagcctgcagctcgtcccgtgtctaatggaacagaaacaagcaccytgctgcccttgttttccagtggctcaccggggctctgcgaggtttattaatcttagcgtataatggaaaatgtgttgccatgtgaaatctagagcctctg

SEQ ID NO: 44977 - DNA, 201 bp, Homo sapiens
ttattttcaaatgcatgtctttagaaccagaatgtgtgtagctgttttctggcctgaatttgggctgagatgatgagaagtttagttgccactttcagctwagtggaagtgttttccccatttggactccgggtcattgacaaacgtcatcactgtttttagttgaaatgtgcttccatgtggctgttcatcagcacaccc

SEQ ID NO: 44978 - DNA, 201 bp, Homo sapiens
ttatgaaacctcttttaactttattttttatattttttttattttcttgtttctttttatttttaaaatttatttttgttttttttgttttgagacagggycttgctctattgcccaggctggatggagtgcagtggcccaatcatggcagcctcagcctcctaaactcaagcagttctcctgcctcagcctcccgagtag

SEQ ID NO: 44979 - DNA, 201 bp, Homo sapiens
tgttgcccaggctcatctcaaactcctggcttcaagtgatccttctgcattgtcccccacaaagtattgggaatgtattctttcctgatcaggaaactccrcagagagaaagtgacagttgaagactatattgaattttggcccacaggaaaaggaaactttgctgttagggtcagctggaggagagactgcaggggtcag

SEQ ID NO: 44980 - DNA, 201 bp, Homo sapiens
ggatgattggatggatgatggttgagtgagtgggtggatggataggtggaaggatgaatggatgcatggctgagtggatagaaggtggatggatggagggrtggatggttggatggttggataattggatggatgcatggatgtttgggtggatgaacagatgaatggatgcatggatgaatgagtagttggatggatgga

SEQ ID NO: 44981 - DNA, 201 bp, Homo sapiens
ctgctctcatcacctggtttcaaagtcgagccagacgttctgtctcagctcagattctacctaccctgaggttcgcagctgggcatgatcgagccactctmcactctcctgtagcatttttgggctttgagtttatttgacacttttcacttgctgccttatattgcgtttatttttattaattacttcagtagtcattta

SEQ ID NO: 44982 - DNA, 201 bp, Homo sapiens
agtgggagaacatggtatcagaaccaggagagggtcctctggctttctgagttctgccaaaaaccaagttttgctgccttgggcctgtggcttctcctccytgattgtcgctggccttgctgtaaattgtgaggcatccatgtgaggcacaggatggttccaaggaccaactgaggctgtctgtgctgaggctgggagggt

SEQ ID NO: 44983 - DNA, 201 bp, Homo sapiens
gcttcccaaagtgctgggtttacaggtatgagccaccacacctggcctgtttttgtgtttgtttattaattcctatttttcccacctgacagtacgctccrtagggcatgtgtttgtttcggttccccaacgtatccctactgcccagcagaaggcttagctgttaacaagtgtttattgaatgagtaagtgaatgagtac

SEQ ID NO: 44984 - DNA, 201 bp, Homo sapiens
tccagcaggggccattgtttccttccataatatttttaaactgtagcaaagtgatctttttgagacccaaatgtgagtatgccattctaatcttcccaccytcagataaaccacagcaatgattttatactgtctgtagggtaaagacagacccctaatcataacctacaatccctcgacccagtgacctagcccccgtgt

SEQ ID NO: 44985 - DNA, 201 bp, Homo sapiens
tacattgtctagtgggagaaatctccgttgtagattctgacatgtcactccacatctttgtaactttttatggctctcagccctactttcttaatagtagyagcagtatttatctactgtttattgtattccaggtaaaggatatgcgaagcacttttcatgcattatttaacctagctataatactcccatttgacagat

SEQ ID NO: 44986 - DNA, 201 bp, Homo sapiens
tctaccttgcggggcaaacacaacaagtaaaaggttttcctcttgaaggattgaacgcctcaatgcgtgcatcctacattgtctagtgggagaaatctccsttgtagattctgacatgtcactccacatctttgtaactttttatggctctcagccctactttcttaatagtagcagcagtatttatctactgtttattgt

SEQ ID NO: 44987 - DNA, 201 bp, Homo sapiens
tttagtcttttggttttttctctcttttggtttgttggcttatgttcgctgcttgatctgactactggttttatttctaaggatttttttttaagttggcrtctttttttctttgactttccttgtatgcccccctttctcccctgcattgtcttgcttcattcatttctttccaggttcctgcaaattgtttttatttag

SEQ ID NO: 44988 - DNA, 201 bp, Homo sapiens
gacagagtgacaccctgtgtcaaaaaaagaaaaagaaaaagaaagaaaaagctttgcctgtatatgtagaacaaatgaaaaccaaataacagtggcaccakttcttctttcagtttccatggaatatcaagcacgatttgagttgagcaatttgatttgattgatcttcttaaatgtataatctcaaactttacaataaga

SEQ ID NO: 44989 - DNA, 201 bp, Homo sapiens
acgtatatatgcgtatatatatacgtatatatgcgtatatatatacgtatatatacgtatatatgcgtatatatatacgtatatatacgtatatatatatrtgtgtatatatatatataaaaatatatttaaataatgttaaggctagagtagaatgacatcatgggaaggcttattgaaacttggagtggattcgtagtc

SEQ ID NO: 44990 - DNA, 201 bp, Homo sapiens
gaaaagaggtttaattggctcatggttccgcaggccatacaggaagcccagttagggaggcgtaaggaaacttaaaatcatggcagaagatgaaagggaarcaggcatgttctgcatggctggagtaggaggcaaggagcgaaggaggaggtactacccacttttaaacaaccagatctggtgagaactcactcactgtca

SEQ ID NO: 44991 - DNA, 201 bp, Homo sapiens
agttgcacaattcacacaccaggctgccactttggcccctgcgtcaccttcaccaccacccaatgtgtcctgctcatcactgaggtttgtcatttttactytgagtctgtccattgtcatcatctccaccatcaccccttttgttctcattgccacccttgcctggggtgagtgaagacgctcttctctggcttccaccct

SEQ ID NO: 44992 - DNA, 201 bp, Homo sapiens
agaagtggtggaacaaaggcactgtgtacacctttgaaacaattaacttcaccaaaattactaaactgtcctctagaatggttaaaccaatttcctctctwccattcacacgtgagaatgcctgtggccccccagaaattatctccagcagcagcaacagagaggactggaatgccattgacaggtcccacaagtcagcaa

SEQ ID NO: 44993 - DNA, 201 bp, Homo sapiens
tggtagtagtagtagtgaatgccctgactttggggtttgcagtaagctaggattaagtgcttcacagtgaggcacagtggggagctactctgaggatgaawtgcctagtaaataagtgaggtttgtataaccgaggccagatcttagaacctcctgctatctgtacatagaagaatgttttagtcagaggcaaggcaaggt

SEQ ID NO: 44994 - DNA, 201 bp, Homo sapiens
tgaatgccctgactttggggtttgcagtaagctaggattaagtgcttcacagtgaggcacagtggggagctactctgaggatgaattgcctagtaaataartgaggtttgtataaccgaggccagatcttagaacctcctgctatctgtacatagaagaatgttttagtcagaggcaaggcaaggtcaccaggattcactg

SEQ ID NO: 44995 - DNA, 201 bp, Homo sapiens
gaatgccctgactttggggtttgcagtaagctaggattaagtgcttcacagtgaggcacagtggggagctactctgaggatgaattgcctagtaaataagkgaggtttgtataaccgaggccagatcttagaacctcctgctatctgtacatagaagaatgttttagtcagaggcaaggcaaggtcaccaggattcactga

SEQ ID NO: 44996 - DNA, 201 bp, Homo sapiens
aagaatgttttagtcagaggcaaggcaaggtcaccaggattcactgagagtgttggtcagcatttcatctgcatatacaggactggaaaataagagagcgyaatgagacatctagtttttttctctttcgtttgttctgtttcccactgagagaattttctagctttatgtggagaaaacagtattggaaattattactca

SEQ ID NO: 44997 - DNA, 201 bp, Homo sapiens
aaagggggttaaaagggtttaggggaagtttagttgtcttccttttatctctaactctaaaacccaactgctggctgaattaaaagtctcttacataatgrtcagaggagttttgagtatcggatctttgtgtacttgctttttaaattcagtcacgtcttaaatagtacttttcactctcctcctctccacaccacttta

SEQ ID NO: 44998 - DNA, 201 bp, Homo sapiens
gtatagtagtgggagaacatggtatcagaaccaggagagggtcctctggctttctgagttctgccaaaaaccaagttttgctgccttgggcctgtggcttytcctccctgattgtcgctggccttgctgtaaattgtgaggcatccatgtgaggcacaggatggttccaaggaccaactgaggctgtctgtgctgaggctg

SEQ ID NO: 44999 - DNA, 201 bp, Homo sapiens
agtgattcagaaaatagcaagtatagtagtgggagaacatggtatcagaaccaggagagggtcctctggctttctgagttctgccaaaaaccaagttttgytgccttgggcctgtggcttctcctccctgattgtcgctggccttgctgtaaattgtgaggcatccatgtgaggcacaggatggttccaaggaccaactga

SEQ ID NO: 45000 - DNA, 201 bp, Homo sapiens
gtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctgg

SEQ ID NO: 45001 - DNA, 201 bp, Homo sapiens
agaatccctatggtctcttgagtccaggagtttgagaccagcctgggcaagatagcaaaatactatctctacaaaaaaatgaaaaaaaaaaaaaaaaaaaagcctgtcatagtggtacatgcctatagtcttagctattcaggaggctgaggtgggaggatcgcttgagcccaggaatttgaggttgcagtgagctatcat

SEQ ID NO: 45002 - DNA, 201 bp, Homo sapiens
accctgggtgacagagtgacaccctgtgtcaaaaaaagaaaaagaaaaagaaagaaaaagctttgcctgtatatgtagaacaaatgaaaaccaaataacartggcaccagttcttctttcagtttccatggaatatcaagcacgatttgagttgagcaatttgatttgattgatcttcttaaatgtataatctcaaacttt

SEQ ID NO: 45003 - DNA, 201 bp, Homo sapiens
cagtcctgggaaacaaacaaaatagagggcgatggctccactctgtgtggccccgtcaatggcctggacgcagctgaaaaaatccagaagagtgtaggacrctggaaaagtagcagggtgtgcgattgcagggatgggaccagcagtaaaaggtagccctgccaagaccattaagcttcctgcaactccttctggatccca

SEQ ID NO: 45004 - DNA, 201 bp, Homo sapiens
agacagaagaaaaattgattcccgtagctctctgggcagtgggatgggggtaaagcaaggaattaataaaaacccaccagaatacattatttcagacaatsaaggagagcgttacattttaaaggtacttcatctcagaaagtttgagacatacttttcacacgtggcatgaagagaaaatggaatggaatgagcactaat

SEQ ID NO: 45005 - DNA, 201 bp, Homo sapiens
atgcctttgtgtgtcctctcatggcagagagaggaaggggtctggaacctttctcttataaggatactaatcccatcgtaccccgtcccccatgatctcawttgaaattagtcacctcccaaagccccacctccaagtactgtcacactggggcatagggcttcagcatatgaatttgggggagctggggagaggaacaca

SEQ ID NO: 45006 - DNA, 201 bp, Homo sapiens
ttctaacacggaagcgccctccttttctagtagcttggatgtgattggtatggagaagcagagtgggtgcgtctttgtgtgttcttgacatagttaaagartttggtatagtcaattccctttaaagtagtaggcttcttaaataattctagttgttcctcgtgctgccaagccatcttgaagaatttttcttcatttgta

SEQ ID NO: 45007 - DNA, 201 bp, Homo sapiens
ctgataggtagttactctttagtatgcccaagttcaaattacgtatgactgtgattctaacacggaagcgccctccttttctagtagcttggatgtgattkgtatggagaagcagagtgggtgcgtctttgtgtgttcttgacatagttaaagagtttggtatagtcaattccctttaaagtagtaggcttcttaaataat

SEQ ID NO: 45008 - DNA, 201 bp, Homo sapiens
atcccccctactcacaggaaagaagaaattctcaggtttcctttcccaggtttgaaaaggcagttaatcgccttacaatgaaattatatttttaaaaaagktatcataatcaaataaaagaagtacttcatgtaagtcaaggattgtgcttttactactattttttctttttttgtaatcatggtggttctttttgcccac

SEQ ID NO: 45009 - DNA, 201 bp, Homo sapiens
caaagaaagccctggagacagagcgttagccgttgctcctcgtaagcgcatcattaccttcctccgaacaaagtcctttttttttttttgtcagtagaggrtgaaaacattattggattcaggagttcatagtagtcctgtatgaagctggggacggggggatagagttatgaaatggaccatttcaaatggcattatctt

SEQ ID NO: 45010 - DNA, 201 bp, Homo sapiens
tcctcttctagaaagcgttcttgcagttagattaacaagcagatatactgaactggtgcatgaatgaataggaaatatcccagttgcaaaggataaatctrtcatgtagtggagagcgtgttcaggcaaaacatttggttctgcggtcgcttggaggattgggcccgtgctataattaatgccactagcagtaaaaggaca

SEQ ID NO: 45011 - DNA, 201 bp, Homo sapiens
tatcacttttcccttgttatgaccagaaagactcacagccatgaatttcactgaagtttatgattggtccctgattgcctcacatcttgcaaagaatcctyttctagaaagcgttcttgcagttagattaacaagcagatatactgaactggtgcatgaatgaataggaaatatcccagttgcaaaggataaatctatcat

SEQ ID NO: 45012 - DNA, 201 bp, Homo sapiens
ttttgagaggagtgtgaaatacatgaaggcaggacttccacacacctggacgtgaactagaggtgaggtggggaaagacaggaagtagatcagtgttgccyagaccctaccttttccaactagggtgtggaccatccttcagagcttggcctccaagttggaacccgtgtataccactgacagtgtttcctgggatggtga

SEQ ID NO: 45013 - DNA, 201 bp, Homo sapiens
tggatgttgatttctaaaggaggtaaaacttgaaggtagacaagctctttgtgtccatacatttgatgggtcatcctatgaaggagggcccatctcttacrgcaggcagcgtggcgtaggcctcagagtcaggcatctggggcccagccttttctctgcaggtgcgggtggctcttggcacatgatgtaggtttttgtttt

SEQ ID NO: 45014 - DNA, 201 bp, Homo sapiens
cgcgttccccttgtctgtgcaattcccaacagaggcaagtgcgcatttgagacaggttgagggttcaagctgtccaatccctgctcatctgcagcacaccraggaatgtggactaatgaaaaataaactgcatgcatgcagtgcccatcacactgcctgcattttctaatcttcacaataactctgtgttgagaaatattc

SEQ ID NO: 45015 - DNA, 201 bp, Homo sapiens
ctgcagaggtgctgcagtattaactgaggcaacgttgcaccgtttctagaatgatatttagggctcatattgacccagtaggaagtatagttaccttgggmcaggggagctacctgagtggagtcaacttttaggttatagggaccaagttgaaacatgcttaaaattcacaagtctgtaccattctgtccttcaggtacc

SEQ ID NO: 45016 - DNA, 201 bp, Homo sapiens
tcctggttttcagcctgaggaggaaggtggctttatttaactccttcagccccggaacatcacagggcccttctttgtgcattctgggttctaacagcccyttgaacagtgcttgagagtatttccattataaatgtcgaatcggcattgaaggaacatctgttttaagtcaacttagactcaatccaggaaaaaaaataa

SEQ ID NO: 45017 - DNA, 201 bp, Homo sapiens
tgatctcattgttcagttgtcacctatgagtgagaatatgcgttgtttggtgttttgttcttgcgatagtttactgacagtgatgatttccaatttcatcsatgtccctacaaaggacatgaactcatccttttttatggctgcatagtattccatggtgtatatgtgccagccatcccgttactgggtgtatacccaaag

SEQ ID NO: 45018 - DNA, 201 bp, Homo sapiens
gtgtgtgtgtgtgtgtgtgtgtgtgtgtatacctagtctagggctaggtttgggaactattttctcccgtaagttaaactgaactagactgtatgtcaaaraagagtctcaatgtcaacttaatccattgtcatgactgtaaaatgctatttcattataccagcaattcccctgtggatttctcctgactctctatgcagc

SEQ ID NO: 45019 - DNA, 201 bp, Homo sapiens
ttccttttatctctaactctaaaacccaactgctggctgaattaaaagtctcttacataatggtcagaggagttttgagtatcggatctttgtgtacttgytttttaaattcagtcacgtcttaaatagtacttttcactctcctcctctccacaccactttatgtgtttgctagtagcttccatgaaactctatgggtga

SEQ ID NO: 45020 - DNA, 201 bp, Homo sapiens
atcagtggttaccaggcagtgttgcattttttccatcccatacctctgtgtgtgttccttatctgtttctaggatgtgccctctgccccgtcacatcacaytctgtgctgctctcagccaaagctcttcttaaatacactagccatcaaaaccatacaacttggctgggtgcggtggctcacacctgtaatcttagcattt

SEQ ID NO: 45021 - DNA, 201 bp, Homo sapiens
atatgaaaacaggaaaacacatggagtcttggagggtagggaagtcttgatgagtaagattgggtctgagataaacctaaaagagggtcaagattttgacrgagggctggaagggaggaacgataggaaactgaccttttttcagatctcttcttgtgcgtggcctggggttaagtgctttacatgcatcccctcattgac

SEQ ID NO: 45022 - DNA, 201 bp, Homo sapiens
tatacacacacatatatatatatacatatacacacacacacacacacacacacacacacacacatatattttttttttcttttagatggagtgtctctctrttgcccaggctggggtgcagtgacatgatctctgctcactacaacctctgcctcctgggttcaagtgattctcctgccttagcctcccaagtagctggga

SEQ ID NO: 45023 - DNA, 201 bp, Homo sapiens
gaaactgttttctctggccaggagacaggcttcgttttcgaaactcacccaggaaggcagtgttcttcttttcaaaaggcatttttctgttgactgtgcaygaagccacatagtaataaacagtttccatatccaagcagctaaggcttgtgccttgcaagttaagtggaacatcacgatctatatctcagttttccttat

SEQ ID NO: 45024 - DNA, 201 bp, Homo sapiens
aaaacttaacaattgtggaagcaatgaattgaaggactagggtcaccagtggagtcccataaataggttgtttatgatccctgtgaaacaagaagaccctyttaatttcatgcttcttaaactggggtatgagtggccccaggtttccctgttgggggtactgataccagagttcatttgaagtcattggaaaccaaggca

SEQ ID NO: 45025 - DNA, 201 bp, Homo sapiens
cttctctttgcgtcaccagagaggaagatcccctaagacaaagcattccctgtagtttttagcataactagtactggctcagtaagtatccactggggttsggaatacaactgccctgcctcttgagcagccatgcctgcttccgaggtggtgctgcatgctattcaggaggacagaccatggatgggaatcctgagccac

SEQ ID NO: 45026 - DNA, 201 bp, Homo sapiens
catgtaaatgaattgtattttatgtaaccattccctagtgttggatagctaggccatttataatttggacactattttaaaaaataactcaggcttatttwactatttatttttgccttacactttttgtaaaagtaatcagagcagtaataatagatgactccccaaaatccttttgcctctaatgattagtctaagccc

SEQ ID NO: 45027 - DNA, 201 bp, Homo sapiens
gttttatgtttgatggttttttctttttctttcttttttttttttttgagacagggccttgctttgtcaccctggctcaagtgcagtggtagaatcatagstcactgcagcctcaaactctttggctccagtgatcctcccacctcaacctcccaagtagctgggactacaggcgtgtaccaccatgaccagctaatcttt

SEQ ID NO: 45028 - DNA, 201 bp, Homo sapiens
atttttatttaaaaatttttttaaagagtgatctttggttttctcagtagatgctttcctctgaatagcaagcatatagatagtcttctccttcagacccmcgaccatggctatattatttagtctacagtggttctttgtacaaagtgcttctgcaaagctcttagagcacccagagctggctttggaaagcaagacatt

SEQ ID NO: 45029 - DNA, 201 bp, Homo sapiens
aaatcacagcccatctcctccaatcatttggggtattaggattcccttcactccaactcccactggaaaacctctttgccatgacacagagattccacaaycttctatttttatttaaaaatttttttaaagagtgatctttggttttctcagtagatgctttcctctgaatagcaagcatatagatagtcttctccttca

SEQ ID NO: 45030 - DNA, 201 bp, Homo sapiens
accataatctgctataaattcagttgaaaaatagaaatagtgagaaatccaggttgtgctctgtcgtaatttaagcctaatatgtgattgtctacatgttyacaagttaccgcctttttatttcttctctttttctgttttcttcttccatttttatgttttgctatgccattcattcattctattcttttcatttctttt

SEQ ID NO: 45031 - DNA, 201 bp, Homo sapiens
gagttagagataggaaaataccataatctgctataaattcagttgaaaaatagaaatagtgagaaatccaggttgtgctctgtcgtaatttaagcctaatrtgtgattgtctacatgtttacaagttaccgcctttttatttcttctctttttctgttttcttcttccatttttatgttttgctatgccattcattcattc

SEQ ID NO: 45032 - DNA, 201 bp, Homo sapiens
ctctagagcaggggtccatgacctctaggccacaaaccaatagcggagccgtggcctgttataaattgggtggcatggcagggagtgagtggtgggcaagyataggaagctgcgtctgtgcttagagccgctctctgtcactctcattagtgcctcaggtcctccccctgtcagatcagcaacagcattagtctcatagga

SEQ ID NO: 45033 - DNA, 201 bp, Homo sapiens
ttgctctcagctgggtgcagtggcttatgcctgtaatcccagcagtttgggaggccaaggcggggagggtcatgaggtcaagagatcaagaccatcctggscaacattgtgaaaccccatctctactaaagatacaaaaaattagctgggtgtagtggtgcacacctctagtcctagctacttgggaggctgaggcaggaa

SEQ ID NO: 45034 - DNA, 201 bp, Homo sapiens
cccttccgacaatccttcatccttcccagacgtttcatcagccaagtgaaatttgcaattgtttcagtgattgaaattatgcttggagtgcaggtgtcatsgatgaaacagcaatgccttgcggtgacaaattcagtgtagaaataattttagcaagcccagtgattggaaaacaatgactcaactttaagctatattgat

SEQ ID NO: 45035 - DNA, 201 bp, Homo sapiens
gcccgtgaatttagttaaaggtttttaatgtcacttttattacatttttactgtgcattcatgtgcacacacacacttttaagcatttttgatttatatawccctctgcatattttgtgccttgtgatgtgtttaacgaatgacagtgtctttagtgcattgctacttggggtttctacactggaagtgtaatccgaggcc

SEQ ID NO: 45036 - DNA, 201 bp, Homo sapiens
cccaacctctgctttggaaggcctaactcagttaaacattacaagttcatgcagcacggtgtgatggctcacgcctgtgatcctagcacttttggaggctyatgtgggtggatcgcttgagctgaggagtttgagactgggcaacatggtgaagccgtgtttctacaaaaaatacaaaaaaaaaaaaaaattagccaggcg

SEQ ID NO: 45037 - DNA, 201 bp, Homo sapiens
gagggggacatttgggaatggcatttttagtactcacaaggtaactggggcactcttggtcttggggaggggaggtggctggggacgcagagggtcctgcrgtgggtggatacttacaacatagaaatgtcctggctcttgatgctggctacaccctcagtaagagatactgtcctagggtcatttttttcaacccacact

SEQ ID NO: 45038 - DNA, 201 bp, Homo sapiens
ggactgtcttagtcagtccaggctgctataacagaataccgttgactgggtggcttgatttttttttttttctcccagttctggaggctggaagtcagatrtcagggcaccagcatggttggtttctggtgagtgctcttttctgcatttgtggacagctgccttcttgctgtgtcctcacttagtagacagagagagaga

SEQ ID NO: 45039 - DNA, 201 bp, Homo sapiens
gcaacagagtgagatgctgttttgtttttgtttttttttgtttgtttgtttggttttttttggaaaaagaaagaatcaccataaaaaagatgggtaactcrgaaatttcaaatgcttgaatttcttgggttgggaagaatatcccaaaatgtgtttccaactacctcactgattttgacttcacagggagaatattttgat

SEQ ID NO: 45040 - DNA, 201 bp, Homo sapiens
ccaacacccgacaggcatcttagaaagtggagggtgtaagttataaagagagattacttccaacacgtttctttaaagcctgctggctaaattaggtgggrccttctttgtgtcctctctgttcttgctagtctggcctttgtataatagggaagcagatatatctggaagcctctaagtgtgcatcatggaaattgtttg

SEQ ID NO: 45041 - DNA, 201 bp, Homo sapiens
cgcctgccttggccttccaaagtgctgggatatacattttttttttttttttgagagatggagtgtcactctgttgccgaggctggagtgtagtggcgcartctcggctcactgcaacctcctcctccggggttcaagcgattctcctgcctcagcctccccagtagctgggattacagtcgtgtgccaccacgcctggtt

SEQ ID NO: 45042 - DNA, 201 bp, Homo sapiens
acccgacaggcatcttagaaagtggagggtgtaagttataaagagagattacttccaacacgtttctttaaagcctgctggctaaattaggtgggaccttmtttgtgtcctctctgttcttgctagtctggcctttgtataatagggaagcagatatatctggaagcctctaagtgtgcatcatggaaattgtttgaaatg

SEQ ID NO: 45043 - DNA, 201 bp, Homo sapiens
ctacctgtggtcccagctgcttgggaggttgaggcaggaggattgcctgagcctggtagaggtggaggctgcagtgagctgtgattgtgccactgcacttyagcctgggtgacaaagtgagactctgtctcaaaaaaaaaaaaaaaaaaaaaaaaaaaagctagtagcacaccccaaaacttctagacagggcatggtgtg

SEQ ID NO: 45044 - DNA, 201 bp, Homo sapiens
gtgacaaagtgagactctgtctcaaaaaaaaaaaaaaaaaaaaaaaaaaaagctagtagcacaccccaaaacttctagacagggcatggtgtgagctggartagacaactagttcatggtaacaggaccagcagagctccgtcttgatgctgttattatttggtatctgttaggagctgaattatgtgtccccaaaattca

SEQ ID NO: 45045 - DNA, 201 bp, Homo sapiens
tatttggtatctgttaggagctgaattatgtgtccccaaaattcatgtgatgaagccctaattcacagtacctcataatgttactctatttggagatacarccttttaaaggatggttaagttaaaatgaggttgcttggatggtccctaattcagtttaatttgggtccttataaaaagaggaaatttggatgcacagag

SEQ ID NO: 45046 - DNA, 201 bp, Homo sapiens
cctccggagaagccaaacctgctgacaccttgaccttgaatgtgcagccttcagaactgtgagaaaatcaatttctgttgtttaagccacctagtctgtcrcattttcttatggcaacccctgtagataatacagtcccattctctggggaaacagatacctccgccagggtcctgatctgaatatgatttggggtgatgg

SEQ ID NO: 45047 - DNA, 201 bp, Homo sapiens
ctaaaatgccagcatcactgttacttactgtgtttctctggatgtattacttaacctctctggctttatttctgcccgccctccccccgcccccccccccsaatgcctcaatctgtggcagagttgttacattattgaaaaagaacataaagcatattttctggcatacagcatatgtttaatttataatttttgttttta

SEQ ID NO: 45048 - DNA, 201 bp, Homo sapiens
gggcctagtaaaggaatgtaaatactaaaatgccagcatcactgttacttactgtgtttctctggatgtattacttaacctctctggctttatttctgccygccctccccccgccccccccccccaatgcctcaatctgtggcagagttgttacattattgaaaaagaacataaagcatattttctggcatacagcatatg

SEQ ID NO: 45049 - DNA, 201 bp, Homo sapiens
gtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatg

SEQ ID NO: 45050 - DNA, 201 bp, Homo sapiens
tagagaaaaggtggcttggctgtttggtttatgtcctaaaaccttatcgtaatgtgattctccttaacagagggattcgtaagcttaggactgatagagawttggcttttctgctgttggattgatagctccttgactgctgaagccattgcccatctgttcaactgttgtattcacgaggaggttagacccctgacccaa

SEQ ID NO: 45051 - DNA, 201 bp, Homo sapiens
gcatattctgtctttttatattctgccacccctatcatacttatgaaaatgccaggttgtaatcattcactgggagaaacaaggggttgaacattgttatygcacaaaggaagctgggcctagtaaaggaatgtaaatactaaaatgccagcatcactgttacttactgtgtttctctggatgtattacttaacctctctg

SEQ ID NO: 45052 - DNA, 201 bp, Homo sapiens
ctattcatgtgttcttgaattaaattttcatggcaagcctaagaggccatgactgtccacattttgcctctgagagacgcaaggcttggaggcaggaaatsactcactgaaggccacagcacaaagtggggacttgagtcccgatctcactgattctaaagtccttgctctccaacctctgtccatctgaaatggaaaagc

SEQ ID NO: 45053 - DNA, 201 bp, Homo sapiens
gggctatcaaaaatatagtttcgtttggaaaacaaaggggtgaggtgggtccaaagtacaggaagctataccatgcaaatgaaaatattttttccaaagcyatctgctaatccctgtgatttaaaaatgtgcgtgtttttagtttctgtctaatttcaaccttttcttgctttagtgattaattaccaggtttctctatta

SEQ ID NO: 45054 - DNA, 201 bp, Homo sapiens
ccaatttggcatattctgtctttttatattctgccacccctatcatacttatgaaaatgccaggttgtaatcattcactgggagaaacaaggggttgaacrttgttatcgcacaaaggaagctgggcctagtaaaggaatgtaaatactaaaatgccagcatcactgttacttactgtgtttctctggatgtattacttaa

SEQ ID NO: 45055 - DNA, 201 bp, Homo sapiens
tcagttacagaaacctaaattgctaaattgcaaggctgtatatgatatgccaatttggcatattctgtctttttatattctgccacccctatcatacttakgaaaatgccaggttgtaatcattcactgggagaaacaaggggttgaacattgttatcgcacaaaggaagctgggcctagtaaaggaatgtaaatactaaa

SEQ ID NO: 45056 - DNA, 201 bp, Homo sapiens
aattgttttattattgttatctttatggagttaagggcacataaaatattcttacagagagaaattctgtagtttccacaagtaaccagagaattgttcawggcagagaattattttttcaatgcctattttctcctgaattttctgacggagttagagataggaaaataccataatctgctataaattcagttgaaaaat

SEQ ID NO: 45057 - DNA, 201 bp, Homo sapiens
ctttgccactcagccccagaggtgcttctgcttccctgcaggcttgccctggagcctggcgctagggccctggggctcccttgctcctgcgtgccccctgygcctgccttcctgctgcctggcctttctcccatctgctttcttcctgagtggcccctggccaggggactcgggtgcatacatggtttccaaacgcctttc

SEQ ID NO: 45058 - DNA, 201 bp, Homo sapiens
agatgcctccagcaattataattgaatcttgaagctagagtttcttggctatcctatttcccttttgtttccaccatgaagaagtggagagccgtgtgacstcagtggtagagctgatgtagaagcgccctctctgttcctggcagtgcctgtcctgctaacctcgtgtctcttgctggggtcttcatcagtaagagacct

SEQ ID NO: 45059 - DNA, 201 bp, Homo sapiens
cccctgcgcctgccttcctgctgcctggcctttctcccatctgctttcttcctgagtggcccctggccaggggactcgggtgcatacatggtttccaaacrcctttcctccagccctcccgactagtgtcttaaatctcaagctggcctctctggctccgctgtttttttttttttttttttttaatttaatttaacttta

SEQ ID NO: 45060 - DNA, 201 bp, Homo sapiens
tcctgacctcacgtgatccacccgccttggcctcctaaagggttgggattacaggtgtcagctagtgcacctgaccctaggataatcttaattttaagtarctggtaactcataaatttttaaacactctgcagttcaaagaaaacatgtttgtggtaggtagccagtttataacctgtgtaagactgtgttattagcaaa

SEQ ID NO: 45061 - DNA, 201 bp, Homo sapiens
aaaattagaggctaaaagttttggcttataaaaatggtatttcctgagtttttacaattatagtattaagatattcctaggtttttgtttgttttcgagasgaagtttcgctctcatttcccaggatggagtgcagtggtgcaatctcctccgcctcccagtttaagccattctcctgcctcagcctcctgagtagctggg

SEQ ID NO: 45062 - DNA, 201 bp, Homo sapiens
ggagtgttgaggacctgtcaaacaacacagtccccatctgtactttgggagggaaggacttcttaattccagctgcctgttgccatgggggaacatagacscagaactgccatcttttctaatttttttaaaaattagaggctaaaagttttggcttataaaaatggtatttcctgagtttttacaattatagtattaaga

SEQ ID NO: 45063 - DNA, 201 bp, Homo sapiens
ttaaagcgatagtcctattttctaagtaaaagtccaggcatgtgacttaaaaaagaaaaaaaaaaatgttttctggtcaagtcacatgcctctgaggtttktttttttctttctttcttttctttttttttctttttcccagactcctcatacccctcctaggagacagtgattccctggcttcaccaggcaggctcttgg

SEQ ID NO: 45064 - DNA, 201 bp, Homo sapiens
ctcttctttttttttttttttaaaggagtttcaagggtaagatctgctgtcttgtgaatgtcaaagaagtttctcattcgcccctttcttctctctcccastgtctttaatttgttaatgctttcgacttattttgctttggataattttcaaagtactgctttctctagagatctctaaaaggcagaagttctggctatt

SEQ ID NO: 45065 - DNA, 201 bp, Homo sapiens
tgttaatttagtcagacgaggaaggaaacgagaaaagttattcctatttcatccatctaagactttatatcccatttcaggctgattaaaaggcaaaatcktcacagtaggacaccaaaccctctgtatgccctgcctgcctccccccctctgacccgcctgcctcccccctgtgagctttttccacctactggcctcttg

SEQ ID NO: 45066 - DNA, 201 bp, Homo sapiens
tggagctgagtctttcatcaaaaacaaggactcctggcagatgcccagaggcatttataagcagtcccatcacgaacaaattgccaaatgcaaggcctgarcaaaagacacagaaaggatttctttatcgtaagcacacttctctacattacctttataatccaacaactctgctattagtaaattatagaaacaactttt

SEQ ID NO: 45067 - DNA, 201 bp, Homo sapiens
tctagaataagtccgtctcacgttacagtgcttaggaagtgttagatgtactgtcatttcttcaacatatatgtcctatattagtctattctcacactgcwagtgaagacatacctgagatggggtaatttgtaaaagaaagaagtttaacggactcatagttgcacatggctggggaggccacacgatcatggcggaagg

SEQ ID NO: 45068 - DNA, 201 bp, Homo sapiens
gtgtgcagaagggcttttggataaaaggggtctagttaagagatgttaaaaaaacaaacttgaaaagcatagcaggctgccaggacatgtctgagtaccgygcagatagtggggaatagtctatggattctgcttacaccatggacaaccaggctgggccatgggttgtgttttttttcctctcattttatagaaatgtta

SEQ ID NO: 45069 - DNA, 201 bp, Homo sapiens
aatacaaatataatagaaataattatgtttgtttaaaatatacacagaaccaaatagtcatagagtagtatttcaggtggggggccctcctctagggcagwggagacaatgtcacctgtcgggaacatttggcaatgtctggagacattgttggttgtggtgcggtgacataactattggcatcgagtggatggagggcag

SEQ ID NO: 45070 - DNA, 201 bp, Homo sapiens
aagccatacgtcaccattggaaggttgccaaactgtgctttgcacacacatgctgtctgcacgccttgtatttttctctttgcttagtcctgctcatgctstctaaacaccccagacatcatatctctttaagaaactctggctgagtcccataatgttctggggcaacttctgtcttcccttttccctctggcaaagaat

SEQ ID NO: 45071 - DNA, 201 bp, Homo sapiens
attcatcatgaaaatacagctctcaaggcggaagtgcttgttaactttgcactctatagccaagtgcgatgatcagaaaatacatacattgaagacaccasaaaatagtgtatggattggtgattttgactaagactggaatgtgggtgtgtgcactcctcatgttccggtttctgtgatcattcaggcatgcacaggtat

SEQ ID NO: 45072 - DNA, 201 bp, Homo sapiens
cattcagttcacggacatgtgggttgtttccacattttggctattgtgcataatgcttccaggtacacttgtctacacatttttgtgtggatataggtttwccttttttggggtatgctcctaagagtgcaatttctggatcacggggaactccttgtttaaccttttgaggagccaccagattgttctccacagcagcca

SEQ ID NO: 45073 - DNA, 201 bp, Homo sapiens
taatgattttgaacatgaaaactatgcttattgctcatatctatgttattttattatttactttttttgagatggagtctcgttctgttgcccagtctggrgagcagtggtgtgatcttggtttactgcaacctctgcctactgggttcaagcgattttcctgcctcagtctcttgagtagctggtgttacagaagcctgc

SEQ ID NO: 45074 - DNA, 201 bp, Homo sapiens
actttacattttgagtttcgatttttttttttcacctgggctagtaatacgtggtaggatactctctcacaatgctaggccacagcagcgagctgcagctyccagtgatcacaagggcaaagaatcgatattctaccaggcacggtgttgcctgataaccttgcccagctgtaggctaatgtaagtgttcttttttatatt

SEQ ID NO: 45075 - DNA, 201 bp, Homo sapiens
gcctgggtgatagagcgagaccctgtctctgaagatacaagaaggccacatgtggtggttcacccctgtaatcccagcagtctgtgagactgaggcagaargattgcttgagaagtttgagattggcctgggaaatatagcaagatcccaaccctattaaaaaattaaaaatgaaaataaaattttaaagaaaggtatttc

SEQ ID NO: 45076 - DNA, 201 bp, Homo sapiens
tggaaagttactctctaagtcagggcttcttttcttcaactttggtgtgagactccgctggagagctggttagaaaaacacaagtctcgggccccaccccscagagcccctcattctctagttctgggttggggcccaggagtctgcttttctagcaagcgcccagatgtcactgatgcttacagctctcagaccacagtt

SEQ ID NO: 45077 - DNA, 201 bp, Homo sapiens
tccatgctccaaatgactgtgacgactgagaaaatgcatgtatgtaaagtctgcagctggtgacattgtagacactcagcaaatggcctttggtgttactrttattttatttttactaattattttttacacctacaaatcaggatctgctacaatcgcttgatatttgaaaattgggcctaacccactatgccactcttc

SEQ ID NO: 45078 - DNA, 201 bp, Homo sapiens
ctggagtgcagtggtgcagtcatggttcactgcagcctcgatctcctggggctcaagccatcctcccacctcagcctcctgagtagatgggaccacaggcrcatgccaccacacccagctaagttttgtatttttttgtagaggcaaggtttctccatgttgccaaggctgatcttacactcctgggatcaggagatccgc

SEQ ID NO: 45079 - DNA, 201 bp, Homo sapiens
aaacccattcccctactgtgggacatttaggttatttctagtttctgttagaactaatggttcaattagcatctttatgcatacagctttttccttctatyaattgatctcctcagcatacctttgtagagcgtagaactggagttccttgatccaacagctcctactggcctttgccacagagagccacaatgctatctg

SEQ ID NO: 45080 - DNA, 201 bp, Homo sapiens
tcttagaatcttctgaaataatatgcagcattatattccatttgtacctgggaagagggtacttgtctttcatcagagagtcaccaatggaccactggtcyctgctgatttagtgtcacagctcaaaaccatcagtagtcctcgtgatctttcggcattgtggctccctttgtgagaagggcctaagagtgaatctcccaa

SEQ ID NO: 45081 - DNA, 201 bp, Homo sapiens
atgtggcacatgtgcatatgcacatatatgtattgcatatatatgtgtatattcacatatatgtatacagatgatccctaactcatgatggtttgacttaygatttttgaactttacgatgatgtaaaagtgatattcagtagaaactgtgcttagagtacccatatgactattgtttcttcctttcagtatagcattcaa

SEQ ID NO: 45082 - DNA, 201 bp, Homo sapiens
tgtaaatggatactaatgtgaacgaagccaccgtgaatattgatgcactagtctttgtgtggacatatatctgttttatcttgggggataatactctggartggaatgggcagggtggtccgtatagggctatgtataactttttaagaggttggcaaatacttccctaaagtggtcatcccattttacattcttgccaac

SEQ ID NO: 45083 - DNA, 201 bp, Homo sapiens
ttagcaagtacttagtgattgattagcgggtatctctatgtttgagaatgggagctgtgcagaagctcttatctgcgcatcccatctcatggacaccatgmtttccagcccgttccagcaagcacatgagaaagtccactctggcaagacggagaaaatgcttctgctgaaataccaggaaggtgtggaggctgggtgtca

SEQ ID NO: 45084 - DNA, 201 bp, Homo sapiens
ctgggaactagctaaaattagggagttaaaatgatccagcttagctcaggctatagggaggatttctctcccaggtgtttgttttgttttgtttttgagawagggtctcactctgtcacccaggctagagtgcagtggcctcaacctcccaggcccaggtgatcctcccacttcagccccctgagtagctgggactacagg

SEQ ID NO: 45085 - DNA, 201 bp, Homo sapiens
agagaataaaacgttagttaatccctttgtctgtcaatcacagtctcagttctcttgctttcacattgtacttaaacctcctgctgtgcctcgcatcctaygcttaataaaagaacatgcttgaatatcatcacctgaagtttgtattgtttctttaaatgtttgtttcagtttgtttttgtttttcattttttagaaaag

SEQ ID NO: 45086 - DNA, 201 bp, Homo sapiens
tatgtagtcatatatatatatgtgtgtgtgtgtgtgtgtatgtatatatatgtgtgtgtatgtatatatatgtatgtatctgtatatgtataatggctgtmcatgatataattttgagttggaaaaagcaaattgaagaataatacatgtattatcatgtctttaaaaaaaaactatacacatagctgaatgtttttgtgt

SEQ ID NO: 45087 - DNA, 201 bp, Homo sapiens; identical to SEQ ID NO: 8535

SEQ ID NO: 45088 - DNA, 201 bp, Homo sapiens
cagtaccctttgctatgccaagatccagctgaaactgaaccaggtgggggaggcctgctaatgcccaggcagtcgaaatgacgccatctcatcactccttytcttaaaatttttttttgtctttcttcttggatttccagcaacagggagctgccaccaccgtgtactgtgctgctgtcccagaactggagggtctgggag

SEQ ID NO: 45089 - DNA, 201 bp, Homo sapiens
gggttttctacctgatggaccacaattaagagtggttggtttgtcagacagaaggttctacaaacgatttggtatcgaattacattatacatggagaagtygaggggttggatgaatttgttcttgcacgttcagaaggataccatctttttctctgtgtggaagaggcgcctgccacgacgtattgatatgtgtatttat

SEQ ID NO: 45090 - DNA, 201 bp, Homo sapiens
agcaaagtgatttcttgccctctttatagcatccctgacagtattctgtcagtttggatgatatgatgcctcatcactgcacacgtccctagccacagccscaactgttactcaaaaggtgaatgaaagtgatcagctgcactctttgcaacttacattttgaagtgggctgggaggaaatgtacccccttacctgtggtc

SEQ ID NO: 45091 - DNA, 201 bp, Homo sapiens
atatgtagtcatatatatatatgtgtgtgtgtgtgtgtgtatgtatatatatgtgtgtgtatgtatatatatgtatgtatctgtatatgtataatggctgkacatgatataattttgagttggaaaaagcaaattgaagaataatacatgtattatcatgtctttaaaaaaaaactatacacatagctgaatgtttttgtg

SEQ ID NO: 45092 - DNA, 201 bp, Homo sapiens
gttactaaactgtcatcacatctgatcatattaagatgtcactcagaggttgccattggtacggctgaaaattctccaagagaccaaaggtgtggtgtgtrtgggaccaacaagatattgttactgcttaattgtccagcaagggaggaaagtagagtgagtacccatgagcaccaagcatgaatctgagaaggagaattt

SEQ ID NO: 45093 - DNA, 201 bp, Homo sapiens
ttttataacggagttgttaacattatttcctttagatggctctttcatcttttctgcattatgaactgatgccccaaaaggtggtatgaatgaaagtcatstgatggtgattaaagtgctctttaaattttttttttaatcagtttaagaatgctttctcttttattggcagtacctgcttgtttactattgagatttcac

SEQ ID NO: 45094 - DNA, 201 bp, Homo sapiens
atttatcacaatggatcagtaagcattgatgacaactggcaaggtattgcttcagatattttataacggagttgttaacattatttcctttagatggctcyttcatcttttctgcattatgaactgatgccccaaaaggtggtatgaatgaaagtcatctgatggtgattaaagtgctctttaaattttttttttaatcag

SEQ ID NO: 45095 - DNA, 201 bp, Homo sapiens
tacctcagatggctttgttaggttagattccctgaagtggaatggccagggaatttaaaaagggttttgctcttgtcacctgggctggggtgcaatggcgygatcttggctcactgcaacctccgacccccctgggttcaagcgattctcctgcctcaggctcctgagtagctgggattacaggtgcctgccactatgcct

SEQ ID NO: 45096 - DNA, 201 bp, Homo sapiens
ccgcacccggccctgtttttgcatttttagtagagacgggttttcaccaggttggccagcctggtctcaaactgttgaccttaggtgatctgcctacctcsgcctcccaaagtgctgggataacaggcgtgagccactgcgcctgtctacattttctgtctttactggtattatggtgggaacccataaaccactgcgagg

SEQ ID NO: 45097 - DNA, 201 bp, Homo sapiens
tgcgcctgtctacattttctgtctttactggtattatggtgggaacccataaaccactgcgaggcagataccattttaagcaggaaaccttatttttttcygaagcacatttaaaaatattttccagtttatctattaaacatcctcctttgcttctggagatcctctgaaagatttatctctttcgattcatctgtaaag

SEQ ID NO: 45098 - DNA, 201 bp, Homo sapiens
agacatggatatttttccttttataagaaaggtcttgtctttcctcagaaggcattgtgagcaaaataagggaagaaaaagagacgtagataagaaaaacraatcacaatattgaagcaggacccgagtactatagccttcctcatattttggtatctggaaccgaggttgctaattaatgacccaagagctaagccttgt

SEQ ID NO: 45099 - DNA, 201 bp, Homo sapiens
gaatgactgtgttaggaatcattggaggagagggagtcagagggatggatcagtattttctctgcaaacctgatgaaacactccagagcccgcacctacaygcgtgggaactgataagatgggggttgtgtccacttcacttgtatgggatgtcggtgctttgaaaaaattctatcatcaaagagtaggtttcttagttct

SEQ ID NO: 45100 - DNA, 201 bp, Homo sapiens
actcatgtcttttgtcagggagaatggcatggcctttgtatgacacttccttctagccagactcggatttgggggcatcatatttgggatggctgcaccgyaaacaggaaaggccacaggacagctcacaggttctctctgaacagaagcctgtgagcacgtgcctgtcatttaaaagctgcatggcactcttccccctgc

SEQ ID NO: 45101 - DNA, 201 bp, Homo sapiens
gaattctttccagctttccatcctgaacctgctggtctccaggctcgttcctgcaaatatttcacagaggagtaagagccacattcttgctggctttccarttcattctcctctcttcgagtccacctcttaaaacttcttagtgctcttgcaagaaactcatgtcttttgtcagggagaatggcatggcctttgtatgac

SEQ ID NO: 45102 - DNA, 201 bp, Homo sapiens
tgcatgatagaatgcaaactttgaaaaagacatacctttgtaactttctatgctaaggtgttgcataatcaaggttaatttttgtttgtttctagtctatkggcatcaagtgctttaaaatgctcactaacaccgaggcagaattatttacccgggcaattaaagcaacagcacacacgatcatttcctactaactagcaa

SEQ ID NO: 45103 - DNA, 201 bp, Homo sapiens
ggaagagaaaggcagcctaattgtatttcctaaaatacagtagatgagtagtcagcacatgcatatttagataatatttgcatgatagaatgcaaactttraaaaagacatacctttgtaactttctatgctaaggtgttgcataatcaaggttaatttttgtttgtttctagtctatgggcatcaagtgctttaaaatgc

SEQ ID NO: 45104 - DNA, 201 bp, Homo sapiens
ttgacaatgtaatttgtcagaggaaggcagcctgttttataagctcaggtgatttcatttttgttcacctgtttatttcatgacacttgcaggaaaaagargaattttcatttgatcaaatcatttccatgatccatcaaacacacaagttaaaaagggaaatgctctcagtctttaataacagtcttaatcgtgtgtaga

SEQ ID NO: 45105 - DNA, 201 bp, Homo sapiens
ccttccaagaaccacatgaaggttatattattatgtcgactttccagatgaggagactgaggctcagtggcttgtcataggtgtcaaagacaggagtccartgtaaggacttctggcttcagcacaggggattttcctaccatcccatattgccaccccatctgcaaaaatacctggatctatcttcctcctgctgattct

SEQ ID NO: 45106 - DNA, 201 bp, Homo sapiens
cccaggaaatggccaaatgttatcactcatccttccaagaaccacatgaaggttatattattatgtcgactttccagatgaggagactgaggctcagtggyttgtcataggtgtcaaagacaggagtccaatgtaaggacttctggcttcagcacaggggattttcctaccatcccatattgccaccccatctgcaaaaat

SEQ ID NO: 45107 - DNA, 201 bp, Homo sapiens
tttgagttattattttcccatgggcaattaaagccctggcctccactgcagttttcacatcaaacctaagagtctcaggtgccccttggtggagcaacctmactagagacattaatcatactacgggataattgacaaatgcattgtgagtgtctgatttctgtggctcaggatgcttagtagcagtggggtcaagggcac

SEQ ID NO: 45108 - DNA, 201 bp, Homo sapiens
acaaatcttgtttttgtctttttattgaatttaaccactattgacttgcgacttgcggcaatcaccagatcccagatctctgtgtttggagctacacgtcyttctgaatcgaggaggtggggcactgatttttcttttatcactgacttccccgaagtgggaagttccagtgcttaacaagtttcattaagaacacagcta

SEQ ID NO: 45109 - DNA, 201 bp, Homo sapiens
ctgggtaaaataaatatgatataaaacagacacaaataagaatatatagatgatgttaatttcttcagagcttcccggtgttacgtcttcaagaatatgaygacaggggaacagcccagtgtggcagtcatgtgacgacatgagcattggaaccagccacatctcagttggcaacacgtatctgtgtcttactagcttggc

SEQ ID NO: 45110 - DNA, 201 bp, Homo sapiens
gtgacgacatgagcattggaaccagccacatctcagttggcaacacgtatctgtgtcttactagcttggccactgtcacgtcactcagcctctgttttctmatctgtaaaatggggaaaattatagatgcttcagaagatatttgctatcactattaaatgaaaacaagcatgtcatcagtgcttattatttttgttgctt

SEQ ID NO: 45111 - DNA, 201 bp, Homo sapiens
gagcatctttcaattccttgaacttcagtctcctcatctctgaaatggggttattatctacctgcagaggtgctgcagtattaactgaggcaacgttgcamcgtttctagaatgatatttagggctcatattgacccagtaggaagtatagttaccttgggccaggggagctacctgagtggagtcaacttttaggttata

SEQ ID NO: 45112 - DNA, 201 bp, Homo sapiens
tgcgtcactgtttttcttatttggagatgctgttcctctcaagtgggaaaaatttggttatctcaggtggtaaagatgcctttgtttaaaatattcttctsttagtggggacaataatactactaatttctagtactgacgcttctcatgcaatttaatcagtaggaacctgtttgcatgttcatttgaggaagtaccaaa

SEQ ID NO: 45113 - DNA, 201 bp, Homo sapiens
tgttgtaggttgggtaccccaggaagtagattctgcaactgagattggcatgtaggaagattactggggagtgttctaggatccacacctgtaggggaacrtagcaagcaggatggggtggagggaggattgagctgtgctgtgggagatgcgaatgctccagtcaatcccaaggaaactctgaagctggattattcttca

SEQ ID NO: 45114 - DNA, 201 bp, Homo sapiens
actgagttggattgatatatttttcctttggccttcaaaggaaatttgagcattcattcattcatccttttagagaaatattctctaagcacctaccgtgygccaagctttgggttggatacctggaacccctctcagtgagatcacagtctaacagcacacacccaactatgaaatatagatggactgtgaagatgaaga

SEQ ID NO: 45115 - DNA, 201 bp, Homo sapiens
ttatgaagattctgtgtgtgtgtgtctgtgtgtgtgtatgtgtacaaagaaagtttagagcagcgtgtggcacgtaatgcatattatgtaagtgtagctcyaatgtgagttgttacttgtagagaacagctatgtcaaaaccacaccaaaaacgatttggaaaggaaataatttgactggtcattttgtttatccatcaac

SEQ ID NO: 45116 - DNA, 201 bp, Homo sapiens
gctctgccacttagtaattgtgtagatttgcacatgttgctggacctctctttgtctcagttttctgtaaactggggaaaatcttagtaaatctagctaaygtggttgttatgaagattctgtgtgtgtgtgtctgtgtgtgtgtatgtgtacaaagaaagtttagagcagcgtgtggcacgtaatgcatattatgtaagt

SEQ ID NO: 45117 - DNA, 201 bp, Homo sapiens
ggtgagatcccactggtttggaggaaggagaggaaagtccccacttgggcaaaaacaatttaggatacctgaagattgcaaagcccagctcctcacaaagrgggtggcagctggggagaagctgaatcagtagacagacaagattgtggtttaacgagttcagggacaagagaaggccccagtaacctacagaagcaacta

SEQ ID NO: 45118 - DNA, 201 bp, Homo sapiens
caaaaagcggctggaggaaaaagagctttgccaccgggcagtactgctgggtcttgcgtcacagagatgccttctgctcccttcttcagggagacctcagrgtatgaaagtgctgcttacccagcagatgagatttagtccagtcatccatctgcgtggtctctgtggataaagtaagcgtttcattcaacttttaaaaat

SEQ ID NO: 45119 - DNA, 201 bp, Homo sapiens
ttcagagaaagtaaagagtgatggagacagagagagaaagtgtgacctactttttattatcagcaccatttcatctgcaaaacacgacttttctcttcttrttacgctgagcatgaaaataaaatgttttccaaaagacctggctttggctgttgtgaggaaggccagggacttgttcaaaactctgatgagctcgatgag

SEQ ID NO: 45120 - DNA, 201 bp, Homo sapiens
gatttctttcccccttatttctgaaagctcacctctttacagctggcaaggccagcagaactgaacaatagagccggattaagcaagcattcaggtgcccwcttaattcaatcggcgaatttgcatttctcaggctctgtgccatgagagcctgccgcctcaagggaccacctgccttctaccagaaggactttgctcctt

SEQ ID NO: 45121 - DNA, 201 bp, Homo sapiens
ttttgtatttttagtagagacagggtttcactgtcttagccaggatggtctcgatctcctgacctcgtgatctgcccgccttggcctcccaaagtgctggsattacaggcatgagccatcgcgcccggccagagggctattctttgtcttttatttgctttgagtctggtataaccatgtggcacatacccctgtacatgt

SEQ ID NO: 45122 - DNA, 201 bp, Homo sapiens
tgcctataaacataaaattaaaagcctgctgtctgcttagttcaggtattgggtcagcgtcttgtgactatggacaagaggtgtttgactctaggactcasctacctcatctgttaaatgggcaaactgggagggtgtttatctgcatgcaacatctccttccatttgaaaacttttatgaatgtatggaatattattgag

SEQ ID NO: 45123 - DNA, 201 bp, Homo sapiens
ggcagtgtgcactgtggctgggagttgacacagatccttgtctcccagacccccagtttctatcgagctactgtaactttaaaaagatttaacaaagactmcctccactagctaagctgaaataagaatgtctccggagtttaatggatcaagtagcggtgataggttttatggctcttttttactttagggcatagggaa

SEQ ID NO: 45124 - DNA, 201 bp, Homo sapiens
ggctgttgatggcaagaaaagaagggtgatgggttgggcttatattgtttagtggagcaaaacagatgtgaaacatttgtgtcttaaagtgttttggtcargagaaactaaattggttagaaagtgtgcaattttgcaagctttataaaaatataaaccaatgagtctggactctgttccctaaaggggatgaggaatgaa

SEQ ID NO: 45125 - DNA, 201 bp, Homo sapiens
tccctaaaggggatgaggaatgaaaatgaaggtttgcaaagacatcttgccagacccttacatattttaatttaaggtggtattactgtcctcattttcargctgaagaaccaagctctgagagagttaatgattttctccagatcattcacattcatttctgttacacagctgggattataatccatgcctgtctgactc

SEQ ID NO: 45126 - DNA, 201 bp, Homo sapiens
gtagggagtcccaactttttgaatccatccgtgtggcaaatgtagctggacccttgggatgaagacccttcctgcatcctcccaaggagacaagttctggrccataactctagagcaaccccaacccccaggccatggaccaagtgtcaacaatgttgacattgtgaatccctgatctggaggaacatagctttggggcag

SEQ ID NO: 45127 - DNA, 201 bp, Homo sapiens
gtagttctctgtaaaactagttggtgtaaggaaacttggtctttgaccatcaaggaggttgcagtttgtggcatggcacaaagataacactcagcagatayatagctatgggatacatggatggatggatggatgggtggatggatggatggatggatggataggtagatggatggatgcgtgggtgtgtggaatggtggg

SEQ ID NO: 45128 - DNA, 201 bp, Homo sapiens
tttccccaggctggcttgtgtattaccttcgcattgcatcccttggctcccatgagtgagcgtggtgacttggtgcgtaggtggtacgtgaagacagttgstcactacccaagaactcagggccctaaaccatgctgtaaaatgcaagtgctgatatctaattacctccatcaaccttggcagaatctcttcgttggagtt

SEQ ID NO: 45129 - DNA, 201 bp, Homo sapiens
tgaatgttaatatacagcctttataaatttgaggtataatgttcaaaatgctctaatccctaaattttccagtctaggttattatacttttatgactattmattttgatgtaggccttttaaaatcaattcctccctgttattacaatgctgctttatggtatttgtgatatatcatgtgaatatacttgagggtcatgag

SEQ ID NO: 45130 - DNA, 201 bp, Homo sapiens
gcaatttccccaggctggcttgtgtattaccttcgcattgcatcccttggctcccatgagtgagcgtggtgacttggtgcgtaggtggtacgtgaagacasttgctcactacccaagaactcagggccctaaaccatgctgtaaaatgcaagtgctgatatctaattacctccatcaaccttggcagaatctcttcgttgg

SEQ ID NO: 45131 - DNA, 201 bp, Homo sapiens
atatgtcccacaattggcaagtgccataaatatattataggccattatactttctacagtatctttaattgatatgccccatgtctaagaaaaaaagtagyttttcatgatgaaggtgatgaactacttctttccattattctatttcccccttttcttcttcaggctttaaagatatcataataccatttacatttactg

SEQ ID NO: 45132 - DNA, 201 bp, Homo sapiens
ttaactgattgcagcaggttagagcacagcatgaagagctgacaatattgaccgactggccctctcagacaaagtttgccaacacccaggtgagcagatayacttatctgtgagcagacgtgattcaggggagattgttgtccctcctttcctaagaaaatgtggaaagatgagaatgttgccaccagtgctgatatggag

SEQ ID NO: 45133 - DNA, 201 bp, Homo sapiens
ccccaactccttactcatgcttcctctgtaaaatgatcactccccagtttgacaggaattgcccctggaatcccatctggtgttctaattgttaccaaatycaggcaaatcttgcctgtgatacaggtggtgaagctactggatagaactggagcatctaactggtgtgagatggtatctcattgtggttttgatttgcat

SEQ ID NO: 45134 - DNA, 201 bp, Homo sapiens
catgtaccctagaactgaaaatataataaaaaatacatattaaaaaaaaaagaactggagcatcgactttcgttttcatttcaagacccgtcccccatgaycacagaggatgaaaagtctgcttaaattataagctagctaattgcttcttcagttgaagacctaaatgagttttaaagtgaaatgcatatctctaagggc

SEQ ID NO: 45135 - DNA, 201 bp, Homo sapiens
tggggcagcacctttgcttgaacgctggctccagatgaaagaacagattgccgcggagccgcttttccaaggatccctctccccagcatggggcttcatayattattgagagcaaacctactttccaccgccactcctggatgcacttattttgcgagccttattcagaatgtcagcatggatcacttggcaacaaaggcc

SEQ ID NO: 45136 - DNA, 201 bp, Homo sapiens
ggctccgagaagctcacccatcaccatttgctctactgcaaaacaggactcattagcaggagctcataaaatgaaactggcagtgagctcatatggaagargcatcacgggcaactcggcttggctcaccagcccctgagctgcccccgagtgaccgctccagccttctttccttccacctctccctcttggccaacttca

SEQ ID NO: 45137 - DNA, 201 bp, Homo sapiens
taagtctccattccgcttgccaagattaaattgaattattcccgctgccattcagttttactctgcacaaaatacagccaacatttttgcatttctttctyccttcctccttttcttctttctttccttccttccttcctttctcccttcatctatctttgttccgcttttgtttgtttttttttagatcgctgcatgctg

SEQ ID NO: 45138 - DNA, 201 bp, Homo sapiens
gagattcacatatgtagattacattgttatgaaccaacatttataagcaagcttgatctctcagaatgcgtttgtctatctcagattttcaagaatcctcrtacaaattgtccagggtttccacctcgcagttttcttccagggttgctatggcatggaaagtacattgctattttgttatgtaaatgctcaacagactgg

SEQ ID NO: 45139 - DNA, 201 bp, Homo sapiens
gtgatcaaggctcactgcagcttccaactcctgggctcaagcaatcttcgtgtttcagcctcctgagtagctggaattacgggctcatgccaccacacttrgctacttgtttaattttttgcagacatagggcctcactatgttgcccaaactggcctcaaattcctagcttcaagcggtcctcctgccttggtctctcca

SEQ ID NO: 45140 - DNA, 201 bp, Homo sapiens
ttccagtttctcaattgcaaaagtgaggctggtcatggggcttggaaccacgccacggacgcatgaagcctccccgtttacatgccaaatccagagcttakgcatccatgctcagggctctctgtggtaggcaacagctggattatttactttctagaatatctcgagttcttaatctgagcagtttcgaaaccaagccca

SEQ ID NO: 45141 - DNA, 201 bp, Homo sapiens
ggcactggtgacagtgaagactcagatgaggttcttgagtactttcaattaggtttaccactgaccccatcagtgtgcagacgaagggagatgagagatamagatggttaatgggatttttggggtatcttccagcctttgtgagcacagaggtttcgctacattttgaaaattaaaattcatttcattcgcattacagat

SEQ ID NO: 45142 - DNA, 201 bp, Homo sapiens
gaactctgattttgaggaaaaaggatagggtaatggtgttgacacaggcactgttgaatacgtatgtacatattttaatagttttctcattaatcaaatgkaaatgctatcgattttataggatcgttgtgagaagaagtgagaattgaaatgaaaggcatctagtcttccccggtccccatccacttgacccaccatacc

SEQ ID NO: 45143 - DNA, 201 bp, Homo sapiens
ggtggtgtttttactctaacacctctttcagtacatacatacagtaggtgcttagtagatgtttactgaatgaatggataaacatgtacaaaattatgatmccttgtgttaaatatggtagggaagcaacataatgtgccctggagtttcacagaagaaggggctttcttccagcttggggatggaggtgagctgtcattc

SEQ ID NO: 45144 - DNA, 201 bp, Homo sapiens
aagcaggaggctttgaggtctttttttccctcctgattcggagggaaaaaaaatgttgtttgtgttcatttatggaaattagatctatcacatactcttakgcaatttatgaaatgttaagcaatacccctgaatgtcctagtcccaggaaagttgagagttgagtgcaagacggggacacccaggagccagtaaatcaac

SEQ ID NO: 45145 - DNA, 201 bp, Homo sapiens
taaagaaatattcgtaatcaataagaacacaaaatatggaatatattaactgagttataaaaatgtttgtagtatagcacagaatgaaaaacacagcaagktatgtacggtttaaagtgtaatcaattttgaggttgtatacaaggatatacatgataaatacaagtagtagcatttttagtaaaggctgttacaaaatac

SEQ ID NO: 45146 - DNA, 201 bp, Homo sapiens
cctcccttcctgatttcccatcttcttcctccctcttctctcccctctcccccttctcctttccgtccttcctccttcagttccctctttcctctttttcrcccttttatttaacattataaatacgatgggattgtgtctgcgcttttgttggtaattaaataaattatttatacatttaacacaatcttgaattaccag

SEQ ID NO: 45147 - DNA, 201 bp, Homo sapiens
ggcgggggcggtcagaggagagatagagcacttcagattccactcgaatacattagagcattagagcttttctcttcctcagggtgctctctctctctggsttgggaggagatgtggcatttctaggaattcacagtaaaatcagaaataattaggagatttcacagttgtagctcctgtgaagattcaggaatttttttt

SEQ ID NO: 45148 - DNA, 201 bp, Homo sapiens
attttttcctgtgcagcaattttaactttctatattcaaatatactctgaatgcacagtgaatttggcagaataccatttaagtcttgtattttccaaagytagtcaacgtccaactgccaatgttgcctgaacaggaaatatttatacctgaaagcgtccaggtgagagtcaggaaagccatgaaggtgcaactggcata

SEQ ID NO: 45149 - DNA, 201 bp, Homo sapiens
tgtgcagcaattttaactttctatattcaaatatactctgaatgcacagtgaatttggcagaataccatttaagtcttgtattttccaaagctagtcaacrtccaactgccaatgttgcctgaacaggaaatatttatacctgaaagcgtccaggtgagagtcaggaaagccatgaaggtgcaactggcatactgatgtca

SEQ ID NO: 45150 - DNA, 201 bp, Homo sapiens
ctgtttgtaacatgatttaagcactaagctattgaattttggagtgcattaaaaaaaatatcgagtggaaaaaggaatatttcttagggaggaaaaaccckacttttgactttataatattaagttcgttcatatctctcttagattcttatataaattttattgacctaatgttctgtacagtagtccttatttacagtt

SEQ ID NO: 45151 - DNA, 201 bp, Homo sapiens
aaaaaccctacttttgactttataatattaagttcgttcatatctctcttagattcttatataaattttattgacctaatgttctgtacagtagtccttawttacagttttggtttccaaggtttcagttatacattgtcaactgtggtacaaatatattacttacaatacgatattttgagagagagagaccacatttat

SEQ ID NO: 45152 - DNA, 201 bp, Homo sapiens
ttctcaattgcaaaagtgaggctggtcatggggcttggaaccacgccacggacgcatgaagcctccccgtttacatgccaaatccagagcttaggcatccrtgctcagggctctctgtggtaggcaacagctggattatttactttctagaatatctcgagttcttaatctgagcagtttcgaaaccaagcccacattaat

SEQ ID NO: 45153 - DNA, 201 bp, Homo sapiens
gagaaggacccggttggctctgcaaaccgcatttccttggctgaacgccagaggagagaaatgatccggcaagaagacacaccattccccgtcagcccctwcccgacccttgcacccctggatcttctgctgagtatcggattggtctgcgtccaagagctcctcgcttggccagcaggggctgcctggagaaggggagga

SEQ ID NO: 45154 - DNA, 201 bp, Homo sapiens
ttctgctgagtatcggattggtctgcgtccaagagctcctcgcttggccagcaggggctgcctggagaaggggaggacaggcttcgagttttttgggtagbgacttctgtggacgtgaaaagactgcaccagaaatcggaggcagccctccaaacataacttggcctcttcgttctccctgtggacacacaggctgtgttc

SEQ ID NO: 45155 - DNA, 201 bp, Homo sapiens
aaaaataatgataaagattgtgtgatcaagtatagcagccctgtggtgtttcctcagaatggtgtattacagaaaaggaaaaagccatatacatggagaaraaactcccgatatttaatattatcaattgctggttcctgtaaatttgcatttatggatcacattataaaagcaattactcttatggattgttcatgcaga

SEQ ID NO: 45156 - DNA, 201 bp, Homo sapiens
gtaagaggtttgagggaaaaataatactgagttttgagtgtttctgattttaaaaatgtgttgagtagaattaaacgtgttcaccaaaacccattttatcmctttaaattattgggcaattaattgtatttacttagcattgaatgcatgattagaaatggaatttttaaaaaagcaatactcaagtggagtgagttcatt

SEQ ID NO: 45157 - DNA, 201 bp, Homo sapiens
tatccactgccctggtgggggaatcagtgaggctaggaatcactggaaaatgacattccttgagactccttcaatgggtagagtttgctttagcttttcawgtatcttactgtatgatggttgcttttgggttgaattccaccttgggttcaattcaacatgaaagttaaccttttggtgaaggaatgatccacgggaaat

SEQ ID NO: 45158 - DNA, 201 bp, Homo sapiens
ttgtcagttcaggagggtagaggataggggggaaaaggtgctactggcatctagtgggcaaaggccagggatagtgctaaggatcctgcagtgcaaaggascatgcccaccacaaaatatcagcagtgccgaggttgggaagctctgtgccattgtgcaaagattcaaggtggctatgtcacaggactggtacatgtcctt

SEQ ID NO: 45159 - DNA, 201 bp, Homo sapiens
tggatttggcagctggttttgtctggatttgaaagggaggtaatcaggggtgtgctgggagggccagaacgatccacccacgtgttggtgccacccggcartggaaaagcctctggcctcggccttctccggaaggttgtccgcggtgccagtgagagctgcttttcaccttacagcagccccggcctatctctcaggagg

SEQ ID NO: 45160 - DNA, 201 bp, Homo sapiens
tcattatatgcctccaaagactttgtgtttcctgtgtttgacatcgagatagaatttttcataaccctttactagtaataaatttgattgttaagggaccrggttaatcttatttctaataccagcatctgattttaaaaccctgatttaggagcattttctttctgctaccttcctaaaacgcatgggtggaaatgtata

SEQ ID NO: 45161 - DNA, 201 bp, Homo sapiens
gatatccagtatattccatgaaacaaatatcatgaatttattccatgaaacaaatatcgtgaatatattccatgaaacaaaatactgtgaaatcataccastgatttttgaagaaacctaatgaaaacagcatgctcctatatcttttttctgggtgatctttagatatctcgtcttccaaacttttgtgtagcattgtct

SEQ ID NO: 45162 - DNA, 201 bp, Homo sapiens
atgacacaggagacagggaaagagttttgttatcctgatacacacattcttaaatgcctctagctgtgtagacattggtttgtccatattaatagtatttyacgaagtgccagttgtgtgcctgctttgtggcatatgcattggcattcattgctttatttaattcttccaacaacgtgtcagatgtctgttcaaattatt

SEQ ID NO: 45163 - DNA, 201 bp, Homo sapiens
atctctcttagattcttatataaattttattgacctaatgttctgtacagtagtccttatttacagttttggtttccaaggtttcagttatacattgtcamctgtggtacaaatatattacttacaatacgatattttgagagagagagaccacatttatgtaacttttattacaatttattgttataattgttctattat

SEQ ID NO: 45164 - DNA, 201 bp, Homo sapiens
ttgacctaatgttctgtacagtagtccttatttacagttttggtttccaaggtttcagttatacattgtcaactgtggtacaaatatattacttacaataygatattttgagagagagagaccacatttatgtaacttttattacaatttattgttataattgttctattattgttgctcatctcttactgtgcctaattt

SEQ ID NO: 45165 - DNA, 201 bp, Homo sapiens
taatttataagtatactttattgtaggtatgtatgtataggaagaaatgaaatatatgtagggtttggaaccatctgaggctttaggcatctactgggggwcttggagtatatcccctgtgcagaagcggaggctactgtacatacatttgcctgtaagtgagcgcgttcttggattttgttgaatggtgccactgattat

SEQ ID NO: 45166 - DNA, 201 bp, Homo sapiens
taaagtttagacctattttaataaggctgacttgggttgaagataactagagccatgactttcatcttgatggacaatgagtactcactctacttttttaktttatatttttattttagttcatttcatttaagacagcgtctgttacccaggctggagtgcagtgacatgatctcggctcactgcaacctacaccttctg

SEQ ID NO: 45167 - DNA, 201 bp, Homo sapiens
aagaaatgaaatatatgtagggtttggaaccatctgaggctttaggcatctactgggggtcttggagtatatcccctgtgcagaagcggaggctactgtayatacatttgcctgtaagtgagcgcgttcttggattttgttgaatggtgccactgattatgggtcagagcttgttgaaagggtattaatccattatttact

SEQ ID NO: 45168 - DNA, 201 bp, Homo sapiens
tgcagggagatttggggatgttggatgctaaggcccaagccgtctattgtatgccttttgctttggcataaaacaacagatgaccttctgttaggtgtatstctgctcatgcttgagagtggtggtgtttggaaagactcaatagcatatgcacatgaggaagttgaccaaatgattccacagcgcatactcattttttgc

SEQ ID NO: 45169 - DNA, 201 bp, Homo sapiens
gtccctttttcttggaatgtcagcctgaccctgaaggtattctcctaccagcagagccttctttgatgccccgtcttcaacctgccatgttttcccatctstgaggcttctattttagagacttttcctccagaactggcttatatcatcctgtgttgctgcatccgatcacaggtctgtggctgacctgggcagcgtagt

SEQ ID NO: 45170 - DNA, 201 bp, Homo sapiens
cctatctgtgatgacctgtaaatggaatttaagggaggaatcacacgtgttagcacggggttggcattgcgtggctgttttcaattaacttgaccactatsataacatcaaaggtgtgtgtaccattctatgaccattgaatctccatggacatgttttgggaaatggatttgtcccattacactgctttctttagtgcat

SEQ ID NO: 45171 - DNA, 201 bp, Homo sapiens
gaaaaggaacaacaaaaaagtatatctgtgaacttattaaatgactttaatcatatgaaaatcagccatcagccttattagagtggttgattttttttttratctaagagctttcttggttattttctgttcttaatcattgttgtatatccttaatgcgcaggacatgacaccgtataacaagtgttttaaaaatattta

SEQ ID NO: 45172 - DNA, 201 bp, Homo sapiens
aatggtgaataccctcggcgggaggcaggcacctgatgccactgcccccgccccacctgcccccgccccgtttctcagatcacacaggcaggctgaggagygcttaacaccccagcctcccatgaagcatcctgaaaaagcagactttgtcttcctccatcagctttgtttgtcctctgccgagactccagggacatgatt

SEQ ID NO: 45173 - DNA, 201 bp, Homo sapiens
aaacagaaaccactttcagctttcccgttccagggttaagtgcccaagcaggtgttgtttctgttatgtggtttgcagtgagcaaaaccaccccctcttamctgtggcagcaaaggcagggagactttgagacctggggagggctctctgctgtgttaacagaactggctcttggttggggggtggggggcacccattctt

SEQ ID NO: 45174 - DNA, 201 bp, Homo sapiens
gttgtcacattcttctgcctagagtatgccttttccttcaccaaaccaagtggctctttcggaagacttgcctgaatcctagaccccttctctctacaacmttcagtctgagttgggtaccttgcatcctcctttgttcccatactaacccctacaaccatggtcattttgtggttatctgtttaattctctgctggctat

SEQ ID NO: 45175 - DNA, 201 bp, Homo sapiens
gatcttaccctgacagtcacagaaagcactgggagcgtttatgaatgttgtggtatctcacataataaggggaccatgcatgtattttagaaagagccctytggcttcagggaagaacgatggatttgtgagggtcaggactggtagcaggtgggctcctagaatagtcccggcaagagatcatggaggccagagccaggg

SEQ ID NO: 45176 - DNA, 201 bp, Homo sapiens
atcatacccattcccaagatttcagtcatcaaatccattccaatatgactcctgtatccatatgtccagttccaagtatctgtccatggtgttggtcccakgttattcgcacctcatatgtctttggcacagcactcttgacagctcataaagtcacgctgttacccccacaatgtccccccacatatcattgctatccct

SEQ ID NO: 45177 - DNA, 201 bp, Homo sapiens
ccgggaggattttcttttctttttctttttaatcctcctcctcaagggaaacattcttctcacaatagcttcctggtagaaagttctaactaatgactttratcgtgtgaatgtattgcagaaatggacaggacaattctcagcccattcatcttacagacctcaagtgaacaggcacaaaacaacaggctccaccctcct

SEQ ID NO: 45178 - DNA, 201 bp, Homo sapiens
gtctttggcacagcactcttgacagctcataaagtcacgctgttacccccacaatgtccccccacatatcattgctatccctcctcgacacccacacctcytgcatgttcctgagcttcttaggcgtgttgcatcttcctgaccttcccagtccgaagcccaaggagatacttgataaatattcgtctaataaataaatga

SEQ ID NO: 45179 - DNA, 201 bp, Homo sapiens
ttttcttttctttttctttttaatcctcctcctcaagggaaacattcttctcacaatagcttcctggtagaaagttctaactaatgactttaatcgtgtgmatgtattgcagaaatggacaggacaattctcagcccattcatcttacagacctcaagtgaacaggcacaaaacaacaggctccaccctccttcccccctc

SEQ ID NO: 45180 - DNA, 201 bp, Homo sapiens
gcaatgggaacagagctgaggctcctaaggtctagagtcaacatgaaaatacctttgcttctgggccatagctgtgtttcttcttaacaaggcagaagccyagaagagacttcatgtactgtgactgtaataaagagggttgtaagtagagaagctggaatttgaaaggttacgtacaagtcaagctgcctctgtaatgtc

SEQ ID NO: 45181 - DNA, 201 bp, Homo sapiens
tcctcctcctcaagggaaacattcttctcacaatagcttcctggtagaaagttctaactaatgactttaatcgtgtgaatgtattgcagaaatggacaggrcaattctcagcccattcatcttacagacctcaagtgaacaggcacaaaacaacaggctccaccctccttcccccctctatctcatactttacctcaattt

SEQ ID NO: 45182 - DNA, 201 bp, Homo sapiens
gtctcccatttcagagacaggggcatttggctccaggtttttctgactctagacagtagtttgtttttagcacatcaaatgtctgagacttgtgatgtgtyagaaagcacaaaggactttgatcacaagatcaagccccagagggccatgactgcataaaccacaacaactgcgtggctgcctgtcacgtcttcatctgca

SEQ ID NO: 45183 - DNA, 201 bp, Homo sapiens
gccagtgtgtctctttctctggacggccaagtgatgcaggtaccacgcttaggtctgctggtgtttagcttgacttaaaacccagccagggaaatatgttwcactttgctggggtgcaggtggaggaggctattattcttaggcatttaacagtgaagaatgttgggcagggcagagggtcagctgaatggcagggattcc

SEQ ID NO: 45184 - DNA, 201 bp, Homo sapiens
tctatttctttgtgacctgatagtcttgctctccagggtaaaagaagaggatggaaatggctgtggggcgcctgaggtgggccctggcatgatggcaagtkgccgttctgggttcactgggatggctcaaggggagtttggaaaccctcctaacatgtcatctgaaatctgggaccacagttccggctggaacacttgtca

SEQ ID NO: 45185 - DNA, 201 bp, Homo sapiens
cttctatttccagaaccttctaactctatttctttgtgacctgatagtcttgctctccagggtaaaagaagaggatggaaatggctgtggggcgcctgagstgggccctggcatgatggcaagttgccgttctgggttcactgggatggctcaaggggagtttggaaaccctcctaacatgtcatctgaaatctgggacca

SEQ ID NO: 45186 - DNA, 201 bp, Homo sapiens
tgcagtttgctgatccctgttttattaattagttaatattattgattgagatagggtctcactgtgtcacccaggctggagtgcagtggtgcggtcacagstcactacagcttcaacctcctgggatcaagcagtcttcttgccttagccacccgagtagctggatgacaggtgagcaccaccatgcctggctaattttct

SEQ ID NO: 45187 - DNA, 201 bp, Homo sapiens
agcatgtagaaagatcactgcagatgtccttgtcgtgttgaccttattggagaatttcctatctgtgatgacctgtaaatggaatttaagggaggaatcamacgtgttagcacggggttggcattgcgtggctgttttcaattaacttgaccactatcataacatcaaaggtgtgtgtaccattctatgaccattgaatct

SEQ ID NO: 45188 - DNA, 201 bp, Homo sapiens
gtgcggtcacagctcactacagcttcaacctcctgggatcaagcagtcttcttgccttagccacccgagtagctggatgacaggtgagcaccaccatgccyggctaattttctaaattttttgtagagacaaggtctcactgtgttgtccaggctggtctcaaactcctgagctcaagtgatcctcccgcctcgacctctc

SEQ ID NO: 45189 - DNA, 201 bp, Homo sapiens
aaacaaacagatctcaggagaactctttcacaagacagcactagggggatggtgattagaaagcacctcatgatcccgtctacttcctgcagagaacagaytagccccctatgcagcacacacctttgtgaggtccctcctccaacacagggattacaattcaacctgagacgtgggtggggacacagagccaaaccacac

SEQ ID NO: 45190 - DNA, 201 bp, Homo sapiens
tgcggtcacagctcactacagcttcaacctcctgggatcaagcagtcttcttgccttagccacccgagtagctggatgacaggtgagcaccaccatgcctrgctaattttctaaattttttgtagagacaaggtctcactgtgttgtccaggctggtctcaaactcctgagctcaagtgatcctcccgcctcgacctctca

SEQ ID NO: 45191 - DNA, 201 bp, Homo sapiens
ggaccaagttttattccctgtttaaccttggcctgacaacctaataggtgctcagtgaacagttcttgaatttaattctctccctttccccacactgatgkgtatttaagctccagtggtactcgatgtgttgttttctttgttcttttttttgagacagggttttgctgtcacccaggctggagtgcagtggcagagtct

SEQ ID NO: 45192 - DNA, 201 bp, Homo sapiens
gattcctgttttacatattaaaaatttcatctctccaatcttcgaagaatccgtagtccatttttaagtagctcttgtcttccaaaggtatgggatgtgcmtacctaatgctcttcctggatgggagaatattaccaaaaacgtttggtcgactaattttatgacagtttccaactacaatttttttcctctttgctttct

SEQ ID NO: 45193 - DNA, 201 bp, Homo sapiens
atggccgctggaaaagaagccaactcccagggggcacgaggggctaagctgtctcctgggaagtttgagggaggccaagtgttttccagttcatttccaaygcgtatttcttcagggccaagggcccagctgtgcctcattaggggtgagagtttggctgtgacacgacttaatagaaaaaaaaaaaaaaaaaggagaagt

SEQ ID NO: 45194 - DNA, 201 bp, Homo sapiens
tctcccgtctctgcagttcaggagattatattagaaaatattctatacaaaaaatatgcatagtagggcttttctccagctagtagctcagaataagtcaktactactgaaacaggtaccttttgtggaattgattctgaaatctgtttggatctgaaatctttctttcttgcctttgagtaagatacggcagagaaaaac

SEQ ID NO: 45195 - DNA, 201 bp, Homo sapiens
cccgtctctgcagttcaggagattatattagaaaatattctatacaaaaaatatgcatagtagggcttttctccagctagtagctcagaataagtcagtaytactgaaacaggtaccttttgtggaattgattctgaaatctgtttggatctgaaatctttctttcttgcctttgagtaagatacggcagagaaaaacaat

SEQ ID NO: 45196 - DNA, 201 bp, Homo sapiens
gctcagaataagtcagtactactgaaacaggtaccttttgtggaattgattctgaaatctgtttggatctgaaatctttctttcttgcctttgagtaagayacggcagagaaaaacaattacactagctgctggtctgtatttactggttagaatagaatattattaccatcaagaataacattagtggccaggtgcggtg

SEQ ID NO: 45197 - DNA, 201 bp, Homo sapiens
acttagcagttcacattcacatcttgtttattaactacaattctctagatcagaagcctagacacaatgtgactggcttctctgctcagggtctcttgggkacaaaataaaggtgtccgctggaggaacatcctttcctgcatgctctgtggaagaatccactgccaagctcattcaggatgctggcaggattcagatcct

SEQ ID NO: 45198 - DNA, 201 bp, Homo sapiens
actgccaagctcattcaggatgctggcaggattcagatccttgaagttgtaagactagggcccctgtttcctactgacttctgctggtggctgccctcagytcccagaggcaacccacattccttgacttttggccccctgcatctcaaagccagcaacagaaactctcttgtgcatggagtcccctcctgctttgaatct

SEQ ID NO: 45199 - DNA, 201 bp, Homo sapiens
cctacttgaaagtgtcatataaattctgaggtgaagtggaggcattatggatgcattttattttgttttattttatttcatttattctttttttgaagagstatgggtcaagcagatctgcagcccacactcggctcactgatcacgtcccatacaatcttggcagatacttagctgaattccatcgatttagtgataaaa

SEQ ID NO: 45200 - DNA, 201 bp, Homo sapiens
tgcttacttgacttggaccagggtggtgaatgaacataaaaaccgattacaacatttttccatttttatgtttcctctgaaaccagccatgagaggtactsttagcaaatcacgccttattcctaggcagacttcttgggtacactttccaccctccccagcagtaatgcctgaccaactaatggaatcctaactaatgca

SEQ ID NO: 45201 - DNA, 201 bp, Homo sapiens
tactcttagcaaatcacgccttattcctaggcagacttcttgggtacactttccaccctccccagcagtaatgcctgaccaactaatggaatcctaactawtgcagtatgtgacgcctggcagctccagtccgaaccaagggaaaacctgcaaacatgcaatccttcatgcttttgtttttgtttttccttcagcctagct

SEQ ID NO: 45202 - DNA, 201 bp, Homo sapiens
ctattgtgcacttttgcccagttcaacaagaaagaatctttgctatgttagaagagactctggggaatccagagtcttggtcacgggtacatcaaaacgaygctggtgcctaacttctagttccagacaaagaaggagagagagagagatcagtaatttataggctgacattttccttgggtccttataatacttgtttat

SEQ ID NO: 45203 - DNA, 201 bp, Homo sapiens
tagaagagactctggggaatccagagtcttggtcacgggtacatcaaaacgacgctggtgcctaacttctagttccagacaaagaaggagagagagagagrtcagtaatttataggctgacattttccttgggtccttataatacttgtttattacagataatttgcttaagtgtgcacaaggtggaaggtcacgcaagga

SEQ ID NO: 45204 - DNA, 201 bp, Homo sapiens
atccagtgttataggagacaaaccatagcaagcaatggcctctcacccttcccttcacaccctccactctgtccacttgtttgttccttcaataaatactratggagaatgggctctatgccagtgtttctctggatgttggctgcagggatgaacaaaggcaacttctaggagaaatttctgtttttgatgctctcgtgg

SEQ ID NO: 45205 - DNA, 201 bp, Homo sapiens
ttacagcaaatttgtagttatggtggagcaaagggcagttttcactcctcttccctaaaactgtagtttaactaaaaagtggccactgtctcctggtagcrgttggtaagccatccagtctctgcaggcatctacgctccaggtctccagtctgaggagtctcgctcctggggcaggtgcctctgggggtctctgccaggc

SEQ ID NO: 45206 - DNA, 201 bp, Homo sapiens
gttgtaaaagaatacaagtaagtagtcaagtgacaccttagcattctgatgaaaagagctttgacctcacagagcttctggaagggtctcagagacatccstgagggtcccttgactgcactttgacaaccacaggtctacatgatctgtatagccttttccagttttcacatcctatgattccaagagggaaaacaatct

SEQ ID NO: 45207 - DNA, 201 bp, Homo sapiens
tcccgctttgtgctggagcaagttttggctgagtttctgtcacttgcaaccaaatcagtcctatccagtatacctagtgactctctggtctccaaaggctrtgcctgctgggtactgagtgtctccccgaccgaccccatgatggctacagtgcacatcccttccagccaactctattgtgcacacatattcgtagggtga

SEQ ID NO: 45208 - DNA, 201 bp, Homo sapiens
ccacacccggcctcttctcgatagatcttatttggctgacaacgaaagctgttgtgctggtagcatcatccctttgcatgcaaaagataaactgaaatctraagtagccatatccttccggccaggtttttcaagtggttactctgttctgatcattgtcatgacaggaatagtgaaaataacaataaatcatttttcttt

SEQ ID NO: 45209 - DNA, 201 bp, Homo sapiens
gctcctacaccatgagtgcttttgtatggtgactgtctggttacaaggtcatcttttcccctggatgagacgccccttggggaaaggaccaagttttattycctgtttaaccttggcctgacaacctaataggtgctcagtgaacagttcttgaatttaattctctccctttccccacactgatgtgtatttaagctccag

SEQ ID NO: 45210 - DNA, 201 bp, Homo sapiens
ttttggaggacttgaaaggttcctgctacctttggctggggatggagggaacatggaagatgggtctttgtttagaggaagctctttatcctggtacgctrgaagttggcatagtcttagcagttagtccagatgtgaatttcaggattattctgtgagtcttccaagtcctgtctcagcagtgaaataggctcagtgtag

SEQ ID NO: 45211 - DNA, 201 bp, Homo sapiens
tggttcagggtgttgaggcttcgtgctgttaatattggaaggtgggtcatttgtactgggcatctgtcctgtatcttggagatgtttagtaacatccctgrcctctagccattagataccatctctcccagtagggataataaaaacatgtctccagatgttggcaaatgtctggccttctggggagtaaaatggcccctg

SEQ ID NO: 45212 - DNA, 201 bp, Homo sapiens
aggctaggtagagcatattgctccctggcagcaaacatgtacagcatgtttctgtcctgaatactgtaggcaattttaatacaatgctaagtatttgcatwtacaaacatagaaaaggtacagttaaaatatggtattacaatcttctgggatcaccattgcatatgtggttcattgttgatcaaaatgtcattatgcagt

SEQ ID NO: 45213 - DNA, 201 bp, Homo sapiens
atgggagttaggagaagtgaatcttttgttttcgaagcctttgtccttgtgagtctcttaattggggtgtcttgtaatgcaaagtctttaaagatgtgtgytcctgaaactcaggaggctgctctatcccatggttcaaccaaagaaccagggccaaagcagtgctgaaggaacaactgattctcttggccctccttagag

SEQ ID NO: 45214 - DNA, 201 bp, Homo sapiens
ccttgctgaaatggttggtgctaagatgagcacttggcttaggccagaccagtccctagcctgtggagaaggggcaatctcttatctgaaggcctaggagstgcagggatgtttatatgggctgctagcgcttagtttcctgccacagggagacagtaagaaaggtgacgtcaatctgagatgagagagagagcaaaacag

SEQ ID NO: 45215 - DNA, 201 bp, Homo sapiens
agtggccctaggatggctcctcagatagctgctggcagaaacctgcactcagtacatctatacatggtgtaatgattgactcaagataattagcatagccrtcatctcaaacctttattatttgtgatgagaagattcaaaacccgctttttgaactgttctgaaatatgcaataccttgttgttaactgtattcaccttt

SEQ ID NO: 45216 - DNA, 201 bp, Homo sapiens
gggtgtatttcgctgtatatgtgtaccatgtcagcttaccctagaatttgaaacattttcctttgatgattaaattttttttttttttttttgagatggaktcttgctcttttgcccaggctggagtgcactatcgcgatctcggctcattgcaagctccgcctcccgggttcatgccattcttctgcctcagcctcccga

SEQ ID NO: 45217 - DNA, 201 bp, Homo sapiens
cacctttcctttgggagcaatttttgggttgcttttgtttttatttgttgttttcattcctggtagtaatagtaacagtagaaaatggcagcgttatagcyataaacaaagtgctctgtggtttctctctcaccatcccctaaaccctacaaggctaggggaaaatggtaatactcatgaacaactccacttcataaatga

SEQ ID NO: 45218 - DNA, 201 bp, Homo sapiens
acacaggctgctgtggcaacccacagcaggaatagccagtcctgccccagcagggcgtatcaggggtgctaaggtgacttccaagattgaggttggcgagwtcgtgacaggtgtgcaagatggggtgttccaagactggggacaggacaggtgtgcaaggaccagccagctgaggtagaggaaacctagacctatggaaca

SEQ ID NO: 45219 - DNA, 201 bp, Homo sapiens
agcaattataattgaatcttgaagctagagtttcttggctatcctatttcccttttgtttccaccatgaagaagtggagagccgtgtgacgtcagtggtasagctgatgtagaagcgccctctctgttcctggcagtgcctgtcctgctaacctcgtgtctcttgctggggtcttcatcagtaagagacctcacaagatgc

SEQ ID NO: 45220 - DNA, 201 bp, Homo sapiens
cctggcttggtgtgttttgtggcatttggcaggcaaacgttttgaaaagaaatctcctttcaaaaatcacagcactggttgaagcaggagcatctctcccyttaaatgcaaaaggagttaatatgccagtgactacagtgtgcctggaaaggtcactggaggcatttttgtctggggcagcccctggagtcttggcttttg

SEQ ID NO: 45221 - DNA, 201 bp, Homo sapiens
agcccctgggcattatttccccaattccgtatcccatctactaatacaaactaatgagatctattaaggatgagtccacaagtttgaagggagtctcttaytaatgttccgtctttgcatggtgttacaacagcgggaccattttacactgagggtttgcgagaggcatggctcccctgttatgtatttgggacttactgc

SEQ ID NO: 45222 - DNA, 201 bp, Homo sapiens
ttttttcccttttctttttttttctccccatcttgaacatgttgctgtagacaggtgctaggtttccctgaatgactaaagcagagatttggttattttcytcccagaaaaagtagatgcatcagcagagttgagcccctgggcattatttccccaattccgtatcccatctactaatacaaactaatgagatctattaag

SEQ ID NO: 45223 - DNA, 201 bp, Homo sapiens
ttcttccaacttctctgcttttggtctctgtggatttgcctattctgggtataccacataaaaggaatcaaagaatatgtgaccttttgtgtctagctccrttcacttagcatgctgtttccaaggcttgtctaagttgtggcatgtgtcagtactttattcttttttatggctgcatagtattccactgcatggatatac

SEQ ID NO: 45224 - DNA, 201 bp, Homo sapiens
actaggggaaacaaaccctgttttgtagtatttgctgattactgtggtgtaaatactcacaccttggctgatttcaagttgcagcttggaacttggagttrgaaagagatgtgtagtcccataccattttatgtatgtaaagtatttgcactatgccgactaatagacataaataacctcatgagcatagataatagtcac

SEQ ID NO: 45225 - DNA, 201 bp, Homo sapiens
ttggatttagagcccaccctaattcactgtaatcacatcttacctaagtccatctgcaaagaccctatttccaaataaggtcacattctgaggccctgggkggacatgcattttagggaccctttcaggccaccatatatggattccagagtgaccagtagaacatagctcaggccaagagagaaactcaaccttggtgaa

SEQ ID NO: 45226 - DNA, 201 bp, Homo sapiens
actttgggagtccaaggcaagaggatcacttgagcccaggatttcgagaccaacctggacaacgtacagagacctcatctctacaaaaaataaaacagctrggcatagaggcacacctgtggtcccaggtagttgggaggctgaggcgggaggatcctctgcacccaggtagccgaggctccagtgagtcatgatcatgcc

SEQ ID NO: 45227 - DNA, 201 bp, Homo sapiens
tcaaaaaaaaaaaaagagaaagaaaacagattaatacaatgatctgtgagatattgggactgttcttattcccatttcacagatgagccactaactggctyctggcaggacagtgaataaggggcacaacagagacacaaacacatggctaaccaatggtctcatccgtcagccacactgcctgtctcagcatgggccctg

SEQ ID NO: 45228 - DNA, 201 bp, Homo sapiens
tttattgtgtgaaatgagcctggtcatatgactgccctgcctccctggaggcctccctgccctcctccttcccacagacacttatgggaggtactggccarctctgtatggccagtactgccctaagcaagaccaagaagcttagtctcaatttcagagagttattttggcaacatatttgggaaaatgatagttagatgc

SEQ ID NO: 45229 - DNA, 201 bp, Homo sapiens
tccctccctttattttttctagcctttatagaaatgacaaagggtcaggtggtcttaaattccaaatctgggcacatgaatggtctgacctcggaaacttmctatatgctcgaaacgatttaactagcagcaataaaatctctactctttttatgacaaataatctagcatgtctggggagcatatttgattcttcatatt

SEQ ID NO: 45230 - DNA, 201 bp, Homo sapiens
actgtggaagggtcaagtgcagggtcaccaacccgttccatcttcctgtcagttggcgtccacccttggtttcaaagggaacaggcattactgacatgacsggacctttacagttcccagctgctcatttggagtactgcggacccaggacaactaaagccggggtcgcctgccctccaggggttcctgggttgaagtatc

SEQ ID NO: 45231 - DNA, 201 bp, Homo sapiens
cttactctgtgctcttgccccaggcagagtggaagttgccttataaagctgcgacttggccacagtgttttccctttcagcagggaaaccggagttctccstgctgttgggaggttcaagagccactctgtgcagaaatgcccagaaagagttaagtgaggtaagttcgtcagacttctgcagacccatactgtggaaggg

SEQ ID NO: 45232 - DNA, 201 bp, Homo sapiens
gactctgcagatccctactcggagtttttcagccctgttttaagtgccgagctgggttttgcctcatgatccaattgttttattagcgaaatcatcatctrtttcattttgctttggtaatagtgcagtgtctgtctaacaataaattatagagtcaggcaaacaatggtttcgtattagggatataatgaaatatcttat

SEQ ID NO: 45233 - DNA, 201 bp, Homo sapiens
tcctttcttcttcagtgccacctgccttattttactcacccagaaggaagccgggtccctctttgcccctttgggtgtttgtgaaaagcaagttgtaaacwctgaattctataaactgttggagacagattctggagagacactcaggcttagctctagaaagaaacgggtaagacagaggaggttcagggcaactgtgtt

SEQ ID NO: 45234 - DNA, 201 bp, Homo sapiens
aagattcctttcttcttcagtgccacctgccttattttactcacccagaaggaagccgggtccctctttgcccctttgggtgtttgtgaaaagcaagttgyaaacactgaattctataaactgttggagacagattctggagagacactcaggcttagctctagaaagaaacgggtaagacagaggaggttcagggcaact

SEQ ID NO: 45235 - DNA, 201 bp, Homo sapiens
tacctttgtctcagtcaatatttacctctgaggtcaatacgtgtggatattcacctcagctgcagtcaatatccatttcgtattacaatatatgatgtgcrtatgtgaaaataaagaacagcatggtacaaaaaaggtctgctaggcaaagaagctttttgcaaagcggatgtgtttttgttttattttttgtttgtttgt

SEQ ID NO: 45236 - DNA, 201 bp, Homo sapiens
ccactgaccactctctgtacagatgcgctcaagcgaccataaccaccagtgttcctaacaatgcgcctattgacttcttatttcaatagatatccagattkattatccctcaaggtaagcatcgattttacctttgtctcagtcaatatttacctctgaggtcaatacgtgtggatattcacctcagctgcagtcaatatc

SEQ ID NO: 45237 - DNA, 201 bp, Homo sapiens
cctgattgagtaactgctctctgaaggtggaggctggactgcttcactggacagggtggcctggggttattctagtgcagtggtagctggtgacaaaactsaaagaagatgtaactagagaaaaggtactcagtgcagcctctgtgagctaccaccactgcctctagttttccagaaaaccaccactgaccactctctgta

SEQ ID NO: 45238 - DNA, 201 bp, Homo sapiens
ggcttcatatattattgagagcaaacctactttccaccgccactcctggatgcacttattttgcgagccttattcagaatgtcagcatggatcacttggcracaaaggcctaaagggcaagccaggaagcttccatggatacgttatttatggtgtttaattattattgtacagatttattaaatgactctgttacctagg

SEQ ID NO: 45239 - DNA, 201 bp, Homo sapiens
tgaaactacatgttcattgaaaatgatcttttgggtggttgatgttcgattttggctctgtgttgggcctgcccagtgaggtccttttgactccctaaggraccctgttttgggtttcttttgaggttgaagatatttcagactctttccccctcaacttccataggaaccaaactctctttcttcctcccgtttggttgg

SEQ ID NO: 45240 - DNA, 201 bp, Homo sapiens
cccggactcgaatcccagctctgatccatctcagctctgccatattgccaagttccgctgagactccatttactcacctgttgtatcatctgaattatttycatatccataatgtgcaaggatatccttccatgttattagaaatacagatacaccatcattatcagtggccaaatcattcaaatcgctgtttgcttcttc

SEQ ID NO: 45241 - DNA, 201 bp, Homo sapiens
ataaagtttatttttacagtaattttaagttcacagcaaaactgagtgggaagtgtagagtttcatatactccctgtcctcacacatgcacagcctcctcyagctatgcacattttcaatgaaactacatgttcattgaaaatgatcttttgggtggttgatgttcgattttggctctgtgttgggcctgcccagtgaggt

SEQ ID NO: 45242 - DNA, 201 bp, Homo sapiens
tgactgcaaggactcagtaaaacaaagtatttcaaggtcatgctacaaaaagtcccaccaagagcatggtcaggaggtacagtgcacttacccacacggakcagagagggatcagaggaggctggctggggaaatgatcctagggctttcttaaaggacacagcgccatggttatttaagtacagcttttaaggagaacta

SEQ ID NO: 45243 - DNA, 201 bp, Homo sapiens
ctattattttgatgttgttagctttcaaagattaattccacagagatttttgggcatctttttgataatacacattatgcttgacttgggagtttcaggakgcgcaagagactccttttgactgcaaggactcagtaaaacaaagtatttcaaggtcatgctacaaaaagtcccaccaagagcatggtcaggaggtacagt

SEQ ID NO: 45244 - DNA, 201 bp, Homo sapiens
caatgtttctgtctcaactggttgattggaacaacatacaaactgacccttaggaaccttctaccaaaaatatcctgtgaatcttcatacttttgtaatascgtttagttagaagtggtcagactttcttcgtcctcttttcgtgatttcctctgtggtgtctgtggatcgataccggcagctcaggtaaggaacgtgtgc

SEQ ID NO: 45245 - DNA, 201 bp, Homo sapiens
aggagaatcacttgaactcagaaggccaaggttgtagtaagctgagattgcaccactgcactgcagccttggcaacagagcgagactccatctcaaatcartcaaccagtcaatgtgtgcccccttttcctccaactcccaccccaaatccttgctgaatcatacctatccttcacctttataagcatctagtttttaaat

SEQ ID NO: 45246 - DNA, 201 bp, Homo sapiens
atatggtggccactgcatgattttgctcaggactgaattagaggcaggtgaaaggccctcactccctggaatcagctagcgatggctaaggctcctgtgasggtttctacagaggttccacccagagaggagagtcaaatgggagtttctaccgatgctcttgaaaggatcttgttactcagatgtctctaagacaatgat

SEQ ID NO: 45247 - DNA, 201 bp, Homo sapiens
cctcccaccaggccccacctccaacactggggattacaattcaacatgagatttcggcggggacacagatccaaaccttatcaccagcgcttgttatttcytcaggtacattttgatgtccctccccactttactctcccctacaccttgaagcaggtgcaatcattttaggctatgaggaccagcatcgaccttcatcag

SEQ ID NO: 45248 - DNA, 201 bp, Homo sapiens
tgtttgttttgaaccacttattttggcaagacttcttcagacaggagagccctgagagctcttcaaaggctgggcctgatggtgtttgtcagagaggttcragctcttaaatttaaatggcctcccacagggaagcagaagtccttttggatcctccagaggactgagatcctccagatgctgttcatttgccttattcgt

SEQ ID NO: 45249 - DNA, 201 bp, Homo sapiens
ttgccttgtctggtttttcaaagtgctcttttaacaaatgaaagtttaaagcttgagttcaatttgagtaatttgttcccagagaaaaagtaaatgaaaartatttctgggtatttttaatgacacaagtttctgtgctgatatgcgggcaggggttcgggagtgggggcaccagggctcatgagccgagagcccctgctt

SEQ ID NO: 45250 - DNA, 201 bp, Homo sapiens
ctgaggattttcacatgcacatctgttaaatgccatttaaagagaacactaacaagagaaagctagttcatttttcttcctgggacctcagtttcctcatyagcagaatcgggatattagtgcagaccttgcaggctctttatgaggatccatcgggagcctcaggcgcacactcggggagcattggagctcttcccaggc

SEQ ID NO: 45251 - DNA, 201 bp, Homo sapiens
gactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatg

SEQ ID NO: 45252 - DNA, 201 bp, Homo sapiens
cgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgat

SEQ ID NO: 45253 - DNA, 201 bp, Homo sapiens
tagaatcttgagttgatacctccttgggtggcatggagcctatacctttgtagatcttgggaaacaacttctaaagtaatcatagttgtatgtaatcgtarttacaacaatagttattttaggcacataacccaaaggttttcttacaaggaatctatgaaccttaagagtgagggcttctgttaagagtaagggcttccc

SEQ ID NO: 45254 - DNA, 201 bp, Homo sapiens
tgcccttccccactacagtgtaaactccatttggactttctctagttcactgtgaatggtttttgaataacatcaattagcataacctcatgcccagcatsgtccttattgttgagagcacagcagtgacaaaggtgcaactcttgctcttgagcgatcacagtttatttggggaacctggtactacctaataaaaccagg

SEQ ID NO: 45255 - DNA, 201 bp, Homo sapiens
ccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtga

SEQ ID NO: 45256 - DNA, 201 bp, Homo sapiens
cccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtg

SEQ ID NO: 45257 - DNA, 201 bp, Homo sapiens
tgaacccaggaggtggaagttgtagtgagccaagatcgcatcactgcactccagcctgggtgacagagtgagactccatctgaaaaaaaaaaaaaaaaaaagacatttacattttatctttactgtagctatggctgcctatcccaaggatgggaagtctgaagttcaaactggtgatgatccccaccccaagtcacacag

SEQ ID NO: 45258 - DNA, 201 bp, Homo sapiens
agccagctcaaatttcagtgttggatgttcaccgcttctttagggttctaccactcccagtaaatcaagtaataggtttctgttaaaaaccccagtgtgcygatctcagtggcagccatcttgctttgtaagccttctctagctttatgatgctcccagtatataagacatttccagtgtctagtccaaattagtatttct

SEQ ID NO: 45259 - DNA, 201 bp, Homo sapiens
atgctaaggtaggagaatcgcttgaacccaggaggtggaagttgtagtgagccaagatcgcatcactgcactccagcctgggtgacagagtgagactccakctgaaaaaaaaaaaaaaaaaaagacatttacattttatctttactgtagctatggctgcctatcccaaggatgggaagtctgaagttcaaactggtgatg

SEQ ID NO: 45260 - DNA, 201 bp, Homo sapiens
tttacagagtatatgtgttttcagattttgcatgacattttaggataaatgtgatgaaaatgaggaaaattgggaatgaagtttaggtcagaaaagtttcrgtgattattttttcagaatcattgtttcttggtttctagggtccaacatgccattgttcaatggctgtatttcaatggctgtatttcagaggctgtattt

SEQ ID NO: 45261 - DNA, 201 bp, Homo sapiens
gaacagggagcttggctgcaaaacgattattgtatttaacttctgttggcatcattcgcatacttgtatgggagatccagaattggaatttaacacagttktcccaggcccttcatggaatttgaaaacatgactctgaaagcatgtggctgaaatgagactctttcacactgtttaaagatgcatgtgcatatgttggtg

SEQ ID NO: 45262 - DNA, 201 bp, Homo sapiens
atttcaggaatgttcagctgttgcctagcttggaatggaccatcctctggtcccacccatgggtaagtcattggctgcagagcgcagacatttggctcccytcgggacattcctccctcatttaaaacaatgaggcgggcagcagggtactttgtcccttgtgttagctgaagttggaggatgctgtgttgatgggaaaac

SEQ ID NO: 45263 - DNA, 201 bp, Homo sapiens
cacaccccatgttccttctactacaacttctggctctggcttctggactgtcagtcattagcactccctatccctaagatttcaggaatgttcagctgttkcctagcttggaatggaccatcctctggtcccacccatgggtaagtcattggctgcagagcgcagacatttggctcccttcgggacattcctccctcattt

SEQ ID NO: 45264 - DNA, 201 bp, Homo sapiens
tttgagaggctgaggtgggagaatcgcttgagcccaggagtttgagaccagcctgggaaacttagtgagaccctgtctctgcaaaaaataaaaaaattagycaggtgtggtagcacatgtctgtagtcctagctacttgggaggctgaggcaggaggatcataagccaaggagttcaagtttacagtcagctgattgtgcc

SEQ ID NO: 45265 - DNA, 201 bp, Homo sapiens
cttagtgagaccctgtctctgcaaaaaataaaaaaattagccaggtgtggtagcacatgtctgtagtcctagctacttgggaggctgaggcaggaggatcmtaagccaaggagttcaagtttacagtcagctgattgtgccactgcactccagcctaggtgacagagcaagaccctgtctcaaaaaaaaaaaaaaaagaag

SEQ ID NO: 45266 - DNA, 201 bp, Homo sapiens
ggaaatgaagtcatctgctctcagcaatcagcatgacagcctccagccaagtaatctggagtcatgagagctgctaggggagcaacatgaatcatgacggyccctgggaatttcctgataactaacctgggagtttcggggtaagtcctcaggctgcagcatctctgtttatgttctggtcacgtttatttacaattaatg

SEQ ID NO: 45267 - DNA, 201 bp, Homo sapiens
actagggtctgggagtgtggatggaatagtggcagatgacagggcttttaaagccaagcaggggattttaaacttgatgtggtagaaaatggggctgcgtsaggcacagtggctcatgcctgtaatcccagcactttgggaggccgaggtggatggatcacttgaggccaggagtttgagaccggcctggccaacatggtg

SEQ ID NO: 45268 - DNA, 201 bp, Homo sapiens
tgtgctgctgacccacagtggaaaacagattcctgccaggtgagtgttccaagcatctctctccacctcttccatatctccccagagctcctgggcttgtyccagccagcttaagggtgtctctctctagccaaagccctaagtagccagaatcaggagctcaggtctttgagggtttaaaccagtccttatgtgtttgcc

SEQ ID NO: 45269 - DNA, 201 bp, Homo sapiens
aatgaccccaagccctggttcctgacactaggggaaagagatgggggtgacagaatcacagaatccctgctatgttcctccaagtgtgcccagagatgcgtgtgtgtgtgtgtgtgtatacacaaatgtctgcttatcctcaggcaggaagggtggatgcagtcatttacacatggtctgtttttctggaggacaatttta

SEQ ID NO: 45270 - DNA, 201 bp, Homo sapiens
atccagccgcctcagcatcccaaagtgctgggattacaggcgtgagccaccacacctggcaaactactttaaagcagtaagttcctgacttaggtaataastgggtttgggtcagggagggacaaagaaaaatttggccaagactcatgacatacatgcagaagtctgagctgagtggcctgggtaggcctaggaagcagg

SEQ ID NO: 45271 - DNA, 201 bp, Homo sapiens
agttccatgtgagtatccacccctacaacagttggctgcacagacaagttgggaaggcttcaggggacatcccctccctgccctctgctgcagggctgcgccaccccttaccacttccactccccctcgcttaccccacctttgttctctccagcgaactgtgactgtctaaatggaggaacatgtgtgtccaacaagtac

SEQ ID NO: 45272 - DNA, 201 bp, Homo sapiens
tccagtcttctggcaggtctgaaacgacatctttaaaatgtccgttggcagccgggcatggtggctcacgcttgtaatcccagcattttgagaggtcaagkttgagtggatcatttgaggtcaggagttcaagaccagcctggacaacatggtgtaaccctgcctctactaaaaatgcaaaaatcagcctggcatggtggt

SEQ ID NO: 45273 - DNA, 201 bp, Homo sapiens
tcatcttttgtatctttggcgtcacagggagactcagggggacccctcgtctgttccctccaaggccgcatgactttgactggaattgtgagctggggccktggatgtgccctgaaggacaagccaggcgtctacacgagagtctcacacttcttaccctggatccgcagtcacaccaaggaagagaatggcctggccctc

SEQ ID NO: 45274 - DNA, 201 bp, Homo sapiens
ggtcacgtttatttacaattaatgggttctcaaatccaaacaaaactgaccacagtcttctagaggaagtagcaaggttggctctgaagcctatagcatckctgactcagtctgtcccctggaaggctggcagctcagcaagcacagaagtctctccagaagacagtgggtcacctgcctcccaaaagctgaaaggctaac

SEQ ID NO: 45275 - DNA, 201 bp, Homo sapiens
ccagtcttctggcaggtctgaaacgacatctttaaaatgtccgttggcagccgggcatggtggctcacgcttgtaatcccagcattttgagaggtcaagtktgagtggatcatttgaggtcaggagttcaagaccagcctggacaacatggtgtaaccctgcctctactaaaaatgcaaaaatcagcctggcatggtggtg

SEQ ID NO: 45276 - DNA, 201 bp, Homo sapiens
agtttgagtggatcatttgaggtcaggagttcaagaccagcctggacaacatggtgtaaccctgcctctactaaaaatgcaaaaatcagcctggcatggtrgtggatgcctgtagtcccagctacttgggaggctgaggcaggagaattgcttgaacctgggaggcagagatctcagtgagctgagatcacaccactgcac

SEQ ID NO: 45277 - DNA, 201 bp, Homo sapiens
tgtagtcccagctacttgggaggctgaggcaggagaattgcttgaacctgggaggcagagatctcagtgagctgagatcacaccactgcactccaactggrcgacagagcaagactccatctcaaaaaaaaaaaataaaagttagttggaatgttcttctctttctcatattctctcatcctcctgtccccttgtagataa

SEQ ID NO: 45278 - DNA, 201 bp, Homo sapiens
aggccctctgggttggaatgacatcccctatctttctgtgttgccaggaacccagacaaccggaggcgaccctggtgctatgtgcaggtgggcctaaagcygcttgtccaagagtgcatggtgcatgactgcgcagatggtgagcatcactgacctgctgatgacagtggggtggaaggggacaaacttacatgtcccctt

SEQ ID NO: 45279 - DNA, 201 bp, Homo sapiens
cagcgccacacactgcttcatgtacggccctgggtttctcctcttcgactcttctgccccaccccaagcacatccctttctccttcccagcaaagtgttcygcctcatttctccctcatctgcccctgtccatgcagcccatggccttggggacaagtcgtgctttgaggcctctagggagggaaggaagaagtggcagat

SEQ ID NO: 45280 - DNA, 201 bp, Homo sapiens
acaagtcgtgctttgaggcctctagggagggaaggaagaagtggcagatttcatgggactaagctgtttgatgggtatcttcttccacagtgattacccamagaaggaggactacatcgtctacctgggtcgctcaaggcttaactccaacacgcaaggggagatgaagtttgaggtggaaaacctcatcctacacaagga

SEQ ID NO: 45281 - DNA, 201 bp, Homo sapiens
gctcaaggcttaactccaacacgcaaggggagatgaagtttgaggtggaaaacctcatcctacacaaggactacagcgctgacacgcttgctcaccacaaygacattggtgagggggaaccccgcgactactgtggccataatggcttggggagagtgggacccagggagagactggagctgaggttgaagctgcccggtg

SEQ ID NO: 45282 - DNA, 201 bp, Homo sapiens
ggtgggggcaacaaggaccaaaagccctccctacagcttcccagaaaccttgttaccatccccttctcccagagggctggccatagcacaagagaagtgcrgcctctggttgagtcttccctgaggggaggaggcagggaaggccctctgggttggaatgacatcccctatctttctgtgttgccaggaacccagacaacc

SEQ ID NO: 45283 - DNA, 201 bp, Homo sapiens
gatgggtgggaggcaagagcaggcaggagttaggagctggaggtagggtgggtgacatcttcatccctatgtgacaagcataaacacacacacacgctcaygaaacagtggccacacaaatgtgaggtggggttggaaggagaccctgtccagtcttctggcaggtctgaaacgacatctttaaaatgtccgttggcagcc

SEQ ID NO: 45284 - DNA, 201 bp, Homo sapiens
gtagtcccgggccatccccacctctgtgttctcctccggcccccatctcaaaggatggggttgaagtagaagccccagtagatagatagtttgtagtttasttgggtgaaaaaaataaaacaacactccctagatatatgatgcattggctgacattttccccacttgtttggtgatgagaatcctctgggtcacctatta

SEQ ID NO: 45285 - DNA, 201 bp, Homo sapiens
gggacaaagaaaaatttggccaagactcatgacatacatgcagaagtctgagctgagtggcctgggtaggcctaggaagcaggccagagctggtaaggcasaaaaagagtgaggaaggttaggggggtcatagcctgatgctggagggaccagctttagttcccctttcatggtgctactgacgacagtgtaacctcaggg

SEQ ID NO: 45286 - DNA, 201 bp, Homo sapiens
caattgcgactgacttagaaggtcctgaggagtgttttgacctgaaaatgagcccagtgtgatcaagggaagactgcagagttagaggtgggagcactgargcggtggcagatgggtccagggatggatgaagagtgttgtttagggagcgatgggctgcaaaggtaaatagatggtaggggctataggtggagtaaaggc

SEQ ID NO: 45287 - DNA, 201 bp, Homo sapiens
agaacttggagaatggagccttgggatggattccagcctaactacctcagctgggagtttttgcagaaacgacctgtacagctgtatgcagtggctctggmcatccaagcctttttcaacacctggaacaaagcccttggggcatggggcaggggaggtttccaggtgataagcgaccagcagacctccctggatgactga

SEQ ID NO: 45288 - DNA, 201 bp, Homo sapiens
gggagagggaagagtgggttttgggattggggccagtttaccctcaccctggagtccctggagcatgggacctttgatgaagcctcctcccgaatctcttycagggcagcaatgaacttcatcaagttccatgtgagtatccacccctacaacagttggctgcacagacaagttgggaaggcttcaggggacatcccctcc

SEQ ID NO: 45289 - DNA, 201 bp, Homo sapiens
atccaggctgcccggagtccggagcccagagaggagagagacagctggggagcctggtcaccgcgggcatctcccctgcgctgcagtcgcccgcctggcckgccttcccgttcctccgcctcttgccctgacttctccttcctttgcagagccgccgtctagcgccccgacctcgccaccatgagagccctgctggcgcgc

SEQ ID NO: 45290 - DNA, 201 bp, Homo sapiens
gggatgcagcctctgtctgtgctaggatatagaacttggagaatggagccttgggatggattccagcctaactacctcagctgggagtttttgcagaaacracctgtacagctgtatgcagtggctctggccatccaagcctttttcaacacctggaacaaagcccttggggcatggggcaggggaggtttccaggtgata

SEQ ID NO: 45291 - DNA, 201 bp, Homo sapiens
tcccctctgcaggacgtggctgcctccaaaccctcctcagaggctcagcaaaccagagaaaagaagcaccttctgcaggagggtgggcaagatagattgargatggggatggatggtgatcgggaaaagggaggagctgaggattcagaataagaaaggagagggtggaaatgtgtcatgaagttcctcaaaatctgtgaa

SEQ ID NO: 45292 - DNA, 201 bp, Homo sapiens
ctggtgctatgtgcaggtgggcctaaagccgcttgtccaagagtgcatggtgcatgactgcgcagatggtgagcatcactgacctgctgatgacagtgggrtggaaggggacaaacttacatgtccccttattccatcacaggaggactgaggaggtggggggtgcccgagagggatgctttctcctacctgcctccctaa

SEQ ID NO: 45293 - DNA, 201 bp, Homo sapiens
cagcaatcagcatgacagcctccagccaagtaatctggagtcatgagagctgctaggggagcaacatgaatcatgacggcccctgggaatttcctgataaytaacctgggagtttcggggtaagtcctcaggctgcagcatctctgtttatgttctggtcacgtttatttacaattaatgggttctcaaatccaaacaaaa

SEQ ID NO: 45294 - DNA, 201 bp, Homo sapiens
aattgcttgaacctgggaggcagagatctcagtgagctgagatcacaccactgcactccaactgggcgacagagcaagactccatctcaaaaaaaaaaaawaaaagttagttggaatgttcttctctttctcatattctctcatcctcctgtccccttgtagataagtcaaaaacctgctatgaggggaatggtcactttt

SEQ ID NO: 45295 - DNA, 201 bp, Homo sapiens
tttaaggctgcagtaaggtatgattgcatcactgcactctagtctgggtaacagactgacacgctgtctctctttaaaaaaaatcagatttctaggccccrtctaaagaatcagaatttacaaatgggtaacctgaaaatctgtacttcttcaactttcaagccaagtgactcttatcatcagacaagtgtggcaaagata

SEQ ID NO: 45296 - DNA, 201 bp, Homo sapiens; identical to SEQ ID NO: 8569

SEQ ID NO: 45297 - DNA, 201 bp, Homo sapiens
aggctgaggcaggaggatcataagccaaggagttcaagtttacagtcagctgattgtgccactgcactccagcctaggtgacagagcaagaccctgtctcaaaaaaaaaaaaaaaagaagaagaagaagaagaagacctgtaagtgaaaattgctggccaggctcagtggctcacgcctgtaatccagcactttgggaagc

SEQ ID NO: 45298 - DNA, 201 bp, Homo sapiens
ttcataacggtctccaaacctctttgtccaggaggaaatgaagtcatctgctctcagcaatcagcatgacagcctccagccaagtaatctggagtcatgaragctgctaggggagcaacatgaatcatgacggcccctgggaatttcctgataactaacctgggagtttcggggtaagtcctcaggctgcagcatctctgt

SEQ ID NO: 45299 - DNA, 201 bp, Homo sapiens
aggatcataagccaaggagttcaagtttacagtcagctgattgtgccactgcactccagcctaggtgacagagcaagaccctgtctcaaaaaaaaaaaaaraagaagaagaagaagaagaagacctgtaagtgaaaattgctggccaggctcagtggctcacgcctgtaatccagcactttgggaagccgaggtgtgtgga

SEQ ID NO: 45300 - DNA, 201 bp, Homo sapiens
tgaggaccttttaaaatatgcacacctacactccacctgtagagattgtgattcaggtcagggctggctccaggtctcgtggttttagaaaagctccctcrgtgttactaacatgcaccactgattgacagcctttggggacaattggtcagaatatatgaagtgcccagaaaaattcaagatatggtcagcatgagttct

SEQ ID NO: 45301 - DNA, 201 bp, Homo sapiens
aacccgggaggcagaggttgcagtgagccgagatcgcaccactgcactccagcctgggcgacagagggaagacttcgcctcaaataaataaaaaaataaakaaagaaagaaaattgcttatccagaatgccagcttgactctgtggcattcaggaaacaaaaaacataatttcccatcatctgtgtgtgggactgatgctg

SEQ ID NO: 45302 - DNA, 201 bp, Homo sapiens
cgggaggcagaggttgcagtgagccgagatcgcaccactgcactccagcctgggcgacagagggaagacttcgcctcaaataaataaaaaaataaagaaakaaagaaaattgcttatccagaatgccagcttgactctgtggcattcaggaaacaaaaaacataatttcccatcatctgtgtgtgggactgatgctggaat

SEQ ID NO: 45303 - DNA, 201 bp, Homo sapiens
ggggagaattcaccaccatcgagaaccagccctggtttgcggccatctacaggaggcaccgggggggctctgtcacctacgtgtgtggaggcagcctcatsagcccttgctgggtgatcagcgccacacactgcttcatgtacggccctgggtttctcctcttcgactcttctgccccaccccaagcacatccctttctcc

SEQ ID NO: 45304 - DNA, 201 bp, Homo sapiens
catactcactcccattgggtccaccttccttccaagaaggaaacatttaagccctccctttgaattagatgaagtaagaggagttgctgaggtgttttttraaaatcaattctgggctaggtgcaatggctcacacctgtaatcctaatactgtgggaggcctagacgggaggattgcttgagcccaggagctcgaggctg

SEQ ID NO: 45305 - DNA, 201 bp, Homo sapiens
ctgtgagatcactggctttggaaaagagaattctagtaagtgacaattgcgactgacttagaaggtcctgaggagtgttttgacctgaaaatgagcccagygtgatcaagggaagactgcagagttagaggtgggagcactgaggcggtggcagatgggtccagggatggatgaagagtgttgtttagggagcgatgggct

SEQ ID NO: 45306 - DNA, 201 bp, Homo sapiens; identical to SEQ ID NO: 8568

SEQ ID NO: 45307 - DNA, 201 bp, Homo sapiens
gagtgcgctcttgctttgactgatgctgcccaaggacctctgatcagcaccaggggagaggaggggctgctcagggagctggggtcctccggattccatcyacagcagggccagactctccccaggaaatgggacagggtggcagcggaggcttgagaaccacgggggttggcactggctggcaagggaggaagaggccgc

SEQ ID NO: 45308 - DNA, 201 bp, Homo sapiens
tttgaacccgggaggcagaggttgcagtgagccgagatcgcaccactgcactccagcctgggcgacagagggaagacttcgcctcaaataaataaaaaaawaaagaaagaaagaaaattgcttatccagaatgccagcttgactctgtggcattcaggaaacaaaaaacataatttcccatcatctgtgtgtgggactgat

SEQ ID NO: 45309 - DNA, 201 bp, Homo sapiens
tggaccgtgcttccctagagggcaagaactccaagtatttggctttttcttttttttgaggcagggtctcactctgtcacccaggctggagtgcagtggcrcaatcttagctcactgcagcttctgcctcccaggttcaagcgattctcctgcctcagcctcccaagtagctgggattacaagcatgcactaccactaccc

SEQ ID NO: 45310 - DNA, 201 bp, Homo sapiens
atctttttggaatgggctatacagagatgtgctttttaaaatgttaagagtgtaaaaggacaaacagtgaaaaataaatcttcctcttattttgtcctccmgtctcccaattcctctactcagaggtgagaacagaacttccacaccctccagaacctccacagttagaactgtctacatgtttccattgtctttactttt

SEQ ID NO: 45311 - DNA, 201 bp, Homo sapiens
tgggaaggccctgtttatatgaattagaaaaagacacaccttcctttgtgggatgcagcctctgtctgtgctaggatatagaacttggagaatggagcctygggatggattccagcctaactacctcagctgggagtttttgcagaaacgacctgtacagctgtatgcagtggctctggccatccaagcctttttcaacac

SEQ ID NO: 45312 - DNA, 201 bp, Homo sapiens
tcctttagcataatactggcacctaataaaagcataaaaacggtggttattattacaaagctaagtaaattattgtagcatcagatcagatgggaaccctytgccctctcccacctcagaactgcactattttgcgggagtggaaacctgctaggaagctgcccaagccgagtggctgttcagtttctgccttcccctcag

SEQ ID NO: 45313 - DNA, 201 bp, Homo sapiens
ccagtttcacagttccagattctcactccagagactgcctcctattagtgcctccatgatcaagcactgtgctttttctgtttttgcttttgttttttttkttttttttttttttgagatggagtatcgctctgtcgcccaggctggagtgcagtggtgtgatctcggctcactgcaacctccgcctcccaggttcaagcg

SEQ ID NO: 45314 - DNA, 201 bp, Homo sapiens
gcccggagtccggagcccagagaggagagagacagctggggagcctggtcaccgcgggcatctcccctgcgctgcagtcgcccgcctggcctgccttcccrttcctccgcctcttgccctgacttctccttcctttgcagagccgccgtctagcgccccgacctcgccaccatgagagccctgctggcgcgcctgcttctc

SEQ ID NO: 45315 - DNA, 201 bp, Homo sapiens; identical to SEQ ID NO: 8566

SEQ ID NO: 45316 - DNA, 201 bp, Homo sapiens
ctacttcctcggcacttggaggggacagatggggaccgcctaaccagtagtgatctttctcctctgaccctctgtcctcccccagccttgctgaagatccrttccaaggagggcaggtgtgcgcagccatcccggactatacagaccatctgcctgccctcgatgtataacgatccccagtttggcacaagctgtgagatc

SEQ ID NO: 45317 - DNA, 201 bp, Homo sapiens
agcccatggccttggggacaagtcgtgctttgaggcctctagggagggaaggaagaagtggcagatttcatgggactaagctgtttgatgggtatcttctyccacagtgattacccaaagaaggaggactacatcgtctacctgggtcgctcaaggcttaactccaacacgcaaggggagatgaagtttgaggtggaaaac

SEQ ID NO: 45318 - DNA, 201 bp, Homo sapiens
ctttgatgaagcctcctcccgaatctcttccagggcagcaatgaacttcatcaagttccatgtgagtatccacccctacaacagttggctgcacagacaarttgggaaggcttcaggggacatcccctccctgccctctgctgcagggctgcgccaccccttaccacttccactccccctcgcttaccccacctttgttct

SEQ ID NO: 45319 - DNA, 201 bp, Homo sapiens
gcagctcagcaagcacagaagtctctccagaagacagtgggtcacctgcctcccaaaagctgaaaggctaacttgtactttccccagcaggcagctggcaycctgagccctcggctggggcagagcaaaggagccttcctccttcctaccttcctggcactctccctgccttccttctgtcactctcaggtggacccagac

SEQ ID NO: 45320 - DNA, 201 bp, Homo sapiens
agatctcaccccaggctagcaggcatcagccgcttctccagcaaccagtttcacagttccagattctcactccagagactgcctcctattagtgcctccaygatcaagcactgtgctttttctgtttttgcttttgttttttttgttttttttttttttgagatggagtatcgctctgtcgcccaggctggagtgcagtgg

SEQ ID NO: 45321 - DNA, 201 bp, Homo sapiens
ccccgacctcgccaccatgagagccctgctggcgcgcctgcttctctgcgtcctggtcgtgagcgactccaaagtgagtgcgctcttgctttgactgatgmtgcccaaggacctctgatcagcaccaggggagaggaggggctgctcagggagctggggtcctccggattccatccacagcagggccagactctccccagg

SEQ ID NO: 45322 - DNA, 201 bp, Homo sapiens
gttaccatccccttctcccagagggctggccatagcacaagagaagtgcggcctctggttgagtcttccctgaggggaggaggcagggaaggccctctggrttggaatgacatcccctatctttctgtgttgccaggaacccagacaaccggaggcgaccctggtgctatgtgcaggtgggcctaaagccgcttgtccaag

SEQ ID NO: 45323 - DNA, 201 bp, Homo sapiens
ttgccctgacttctccttcctttgcagagccgccgtctagcgccccgacctcgccaccatgagagccctgctggcgcgcctgcttctctgcgtcctggtcktgagcgactccaaagtgagtgcgctcttgctttgactgatgctgcccaaggacctctgatcagcaccaggggagaggaggggctgctcagggagctgggg

SEQ ID NO: 45324 - DNA, 201 bp, Homo sapiens
cgggctccctgggctccccggcggctgcacggagtcaaggcgccccgtcccgggcgtcccccgcgggtgccgatccaggctgcccggagtccggagcccakagaggagagagacagctggggagcctggtcaccgcgggcatctcccctgcgctgcagtcgcccgcctggcctgccttcccgttcctccgcctcttgccct

SEQ ID NO: 45325 - DNA, 201 bp, Homo sapiens
ctgacaccatgggccggccctgcctgccctggaactctgccactgtccttcagcaaacgtaccatgcccacagatctgatgctcttcagctgggcctgggraaacataattactgcaggtgaggtgggggcaacaaggaccaaaagccctccctacagcttcccagaaaccttgttaccatccccttctcccagagggctg

SEQ ID NO: 45326 - DNA, 201 bp, Homo sapiens
ggtcaccgcgggcatctcccctgcgctgcagtcgcccgcctggcctgccttcccgttcctccgcctcttgccctgacttctccttcctttgcagagccgcygtctagcgccccgacctcgccaccatgagagccctgctggcgcgcctgcttctctgcgtcctggtcgtgagcgactccaaagtgagtgcgctcttgcttt

SEQ ID NO: 45327 - DNA, 201 bp, Homo sapiens
actgtctacatgtttccattgtctttacttttattcttgcctgcacaaataaatgaattgctcattatggaaacttcccaaaagacccgttaacacttcartaggaagcaccaacagtttatgccctaggactttgttcccacaatcctgtaacatcatatcacgacacctaacccaatccttatcaagccctgtcaaaaa

SEQ ID NO: 45328 - DNA, 201 bp, Homo sapiens
gagggaagacttcgcctcaaataaataaaaaaataaagaaagaaagaaaattgcttatccagaatgccagcttgactctgtggcattcaggaaacaaaaamcataatttcccatcatctgtgtgtgggactgatgctggaattttctcagtgtgttaacagagcttgtgaccagccattgctatgcctatgattagggggc

SEQ ID NO: 45329 - DNA, 201 bp, Homo sapiens
gcgggcatctcccctgcgctgcagtcgcccgcctggcctgccttcccgttcctccgcctcttgccctgacttctccttcctttgcagagccgccgtctagmgccccgacctcgccaccatgagagccctgctggcgcgcctgcttctctgcgtcctggtcgtgagcgactccaaagtgagtgcgctcttgctttgactgat

SEQ ID NO: 45330 - DNA, 201 bp, Homo sapiens
agcctcctcccgaatctcttccagggcagcaatgaacttcatcaagttccatgtgagtatccacccctacaacagttggctgcacagacaagttgggaagrcttcaggggacatcccctccctgccctctgctgcagggctgcgccaccccttaccacttccactccccctcgcttaccccacctttgttctctccagcga

SEQ ID NO: 45331 - DNA, 201 bp, Homo sapiens
cctgccctggaactctgccactgtccttcagcaaacgtaccatgcccacagatctgatgctcttcagctgggcctggggaaacataattactgcaggtgargtgggggcaacaaggaccaaaagccctccctacagcttcccagaaaccttgttaccatccccttctcccagagggctggccatagcacaagagaagtgcg

SEQ ID NO: 45332 - DNA, 201 bp, Homo sapiens
atggtttttagtagattcacagaattgtgagacatcacaatcaattttagaacacttcatcacctcacaaagaaatcctgtacccactcacaatcactccktttttctccccaaccccctcagccctaggcaatcactaatttactactttctgtcctctctgtgggtttgccaattctgggcatttcatatcaatagaat

SEQ ID NO: 45333 - DNA, 201 bp, Homo sapiens
tctatccggagcagctgaaaatgactgttgtgaagctgatttcccaccgggagtgtcagcagccccactactacggctctgaagtcaccaccaaaatgctrtgtgctgctgacccacagtggaaaacagattcctgccaggtgagtgttccaagcatctctctccacctcttccatatctccccagagctcctgggcttgt

SEQ ID NO: 45334 - DNA, 201 bp, Homo sapiens
cagtgtttcttaatcgagtcatctgaggaccttttaaaatatgcacacctacactccacctgtagagattgtgattcaggtcagggctggctccaggtctygtggttttagaaaagctccctcagtgttactaacatgcaccactgattgacagcctttggggacaattggtcagaatatatgaagtgcccagaaaaattc

SEQ ID NO: 45335 - DNA, 201 bp, Homo sapiens
agccaaggagttcaagtttacagtcagctgattgtgccactgcactccagcctaggtgacagagcaagaccctgtctcaaaaaaaaaaaaaaaagaagaaraagaagaagaagacctgtaagtgaaaattgctggccaggctcagtggctcacgcctgtaatccagcactttgggaagccgaggtgtgtggatcacctgag

SEQ ID NO: 45336 - DNA, 201 bp, Homo sapiens
aaatgaccccaagccctggttcctgacactaggggaaagagatgggggtgacagaatcacagaatccctgctatgttcctccaagtgtgcccagagatgcgtgtgtgtgtgtgtgtgtatacacaaatgtctgcttatcctcaggcaggaagggtggatgcagtcatttacacatggtctgtttttctggaggacaatttt

SEQ ID NO: 45337 - DNA, 201 bp, Homo sapiens
tacaaacatataaacaactaaccaagcataatgaggtgaatgctcactagagatgcccataaaggtgttacagaggttcagagaacagaaattattctatrgggaatcacaaacacctctgagtggcagcatttgaaggttaggaggctttctaggcacagggaaccacgaacaaagtgtagaagcatccaaggacatggt

SEQ ID NO: 45338 - DNA, 201 bp, Homo sapiens
tcaaagggagcaagagagagcccctaaggcagaaaccagttttttgagaccgaatatcggcagtgatagcctatcacttctgctatactctatgcactagmagaagcaagacactactaatgcagcccaaactcaaggggattgcttaaggctataatacatgaggagatggagatcactgggggctgcttagatgctgcc

SEQ ID NO: 45339 - DNA, 201 bp, Homo sapiens
cttaattaaaactcacaagaattgtaggttagtactactattttcccagttttacagaggagcttagggaagttaagtaaattgcctatgatctcaaagtkaagtggcaaagccaaaatccaagctcaagtctggagtgctgaactacttattttatcttatgctgagtccttgtttcctttcccatccttatgatccaca

SEQ ID NO: 45340 - DNA, 201 bp, Homo sapiens
ttacttacactgccttccaaagcatagttttgctgaaggaatgaatgaatgaatgaatgactttattacaccagaacaatttactgtctgttctatagtgwgggtgaaataagctgatctttaacccaacttccagtggctcgattcatatacaacgagccagtaagaacctttaaaagaaaacagtgtctttcagagata

SEQ ID NO: 45341 - DNA, 201 bp, Homo sapiens
cataggaccagggctctctcttgctgggagtcacctgtcactgaccaaggctgtgctctctggttcgttcatggagtttcagataatatggaaagggaacyttagagttgtcagcacatggaggctgtatggtgatccaagggaaaatggaccgactcttaccctaagtccccagggttgtatgtcataacatctccatgg

SEQ ID NO: 45342 - DNA, 201 bp, Homo sapiens
tagatttattattatagagaggtcacaatggccaagcacatggaatacaaagatttctaagacactggtcctgcacatcagcagcttgtaccctattaggrttgatagacaaatagatcaacaattacagagccctgggtaagtgctggcgtctacacaggagacaggagacagtggggccaaaagacctgtgggaaaaag

SEQ ID NO: 45343 - DNA, 201 bp, Homo sapiens
taacacttattctttgtgtataataacatggacaattgtagtgccttctccctctcagcactgtggctttgcatccactcaggtttttgggatttccttasacattttttcatataaactcaggaagttcccaagggaacacactccaagaattagatgaaaaactctgcagaaaaatccacctcacatgaaaatctctgt

SEQ ID NO: 45344 - DNA, 201 bp, Homo sapiens
ggcattcaaggccagcctgggcaacatagcgagacctaatctctactaaaaatttaaaaaattagctgggtgtggtggtgtgcacccgtagacccagctayttgggaggctgaagtgggaggatcacttgagcccagggggttgaggctacagtgagccatgatcaatcacaccactatgctccagcctgggtgacagagg

SEQ ID NO: 45345 - DNA, 201 bp, Homo sapiens
gaggtcacaatggccaagcacatggaatacaaagatttctaagacactggtcctgcacatcagcagcttgtaccctattagggttgatagacaaatagatmaacaattacagagccctgggtaagtgctggcgtctacacaggagacaggagacagtggggccaaaagacctgtgggaaaaagcagttgtgttccctgagc

SEQ ID NO: 45346 - DNA, 201 bp, Homo sapiens; identical to SEQ ID NO: 8612

SEQ ID NO: 45347 - DNA, 201 bp, Homo sapiens
cacccccagggtcgtgatcactgccaccagcatcattacatgccacacacatcaaaattaaacaaacatgaaaactggacgaaaaagcattccactgtttrttataaagttggatatggtttttctaactagtctgtcattctgagagatgggaaaacttagaagaatttttcctgcggtgaaaatgactttttttttttt

SEQ ID NO: 45348 - DNA, 201 bp, Homo sapiens
ttgcttgagctcaggcattcaaggccagcctgggcaacatagcgagacctaatctctactaaaaatttaaaaaattagctgggtgtggtggtgtgcacccrtagacccagctatttgggaggctgaagtgggaggatcacttgagcccagggggttgaggctacagtgagccatgatcaatcacaccactatgctccagcc

SEQ ID NO: 45349 - DNA, 201 bp, Homo sapiens
cagacacatagcacagggtggtcccttaaagcaaaaatggatccttggagttctgaatgtggagcaggggtggaattgggaacttctccaggaaatcctgyagtgtttgaggaagtagcatttccctctctgtgttccttgagacacatttggctgaagaagtcagagtcttaccttctccacggggtcttaaaaagagct

SEQ ID NO: 45350 - DNA, 201 bp, Homo sapiens
tattaagacaggcatgtgttaaggacaatgattttaaagggggaaccaagattttaaaggggggggaaccaagagactgagaagtgaatgacgaaaatagrgtcgtgttctcttgtgcggactttttcctgcccacactctctcggcgctggtttggccccaactgctatctctgactggtctcatgtttgatggggtcag

SEQ ID NO: 45351 - DNA, 201 bp, Homo sapiens
caaccaaacatggtcctaccgcatccaccagaacatcacttaccaggtgtgcaggcacgcccccagacacccgtccttccccaccacccagcagctgaacrtggaccgggtctttgccttgtataatgacgaagaaagagtgcttagatttgctgtgaccaatcaaattggcccggtcaaaggtaaggtttccttttttgt

SEQ ID NO: 45352 - DNA, 201 bp, Homo sapiens
gcaggttctgctgccagtgcaaccctccaggtgccaaagaccatcccctgggtgcacctccaggttgcagagggtctgtgaccaggagccgccgccccccsatgcctgtgaagacacctatatgaggagattccatggtagggcccctctcccttcaccagaagtggagagagcctgttagtgtcatgccagcagttgtaa

SEQ ID NO: 45353 - DNA, 201 bp, Homo sapiens
agatttctaagacactggtcctgcacatcagcagcttgtaccctattagggttgatagacaaatagatcaacaattacagagccctgggtaagtgctggcrtctacacaggagacaggagacagtggggccaaaagacctgtgggaaaaagcagttgtgttccctgagcagagccataaaggtctcttggaactaacatcc

SEQ ID NO: 45354 - DNA, 201 bp, Homo sapiens
gggaggattgcttgagctcaggcattcaaggccagcctgggcaacatagcgagacctaatctctactaaaaatttaaaaaattagctgggtgtggtggtgkgcacccgtagacccagctatttgggaggctgaagtgggaggatcacttgagcccagggggttgaggctacagtgagccatgatcaatcacaccactatgc

SEQ ID NO: 45355 - DNA, 201 bp, Homo sapiens
ttatcctttgtattacacacaatctaattacactcttagttatttaaaaatgtacaattaagttattattgactataataacctgttatcacaggttatartcaccctgttgtgctatcaaatggtaggtcttattcattccttctatttttttttttttggtacccgttaactgtgtccaccttcccctgacccctacta

SEQ ID NO: 45356 - DNA, 201 bp, Homo sapiens
tctggtcgttttgttgtcaagtcaaaaagttacccaagcacctgccgtgtacctgtctctgactcggtgctagtggaagttttggctggcatttgctaagygcagcctgctgctctaaagtgagaacttggcattagattgcattatcacagttagtcctcagaattgccctgtggggagttcgagaccagcctgggcaac

SEQ ID NO: 45357 - DNA, 201 bp, Homo sapiens
gggacaggtgtagattacacctgtgagtgcgcatctgggtaccagggagatggacggaactgtgtgggtaagagccatgttctcgtgtctccttcttgtarcccttgtttttcctctgccctccccagccttatgtctgtagaagacaagtatctgtcacctttacaacctccattgtcaatgattttagcagctgttaat

SEQ ID NO: 45358 - DNA, 201 bp, Homo sapiens
gggttgtgatttccttccctgggaagagcgtgggaatattaaaaagcagatctatggagtcatgtattaaagggttaagaagggactgcacaccctgcttygggctctgagagcttgagatcactggagtaaagtgcaggaggcttcaggaaccagccatagagtagaacagaggcacagctataacccttgtggggcatg

SEQ ID NO: 45359 - DNA, 201 bp, Homo sapiens
atgatgggagccacatgtgtgacacaacagcacggtgccatccagggacaggtgtagattacacctgtgagtgcgcatctgggtaccagggagatggacgkaactgtgtgggtaagagccatgttctcgtgtctccttcttgtagcccttgtttttcctctgccctccccagccttatgtctgtagaagacaagtatctgt

SEQ ID NO: 45360 - DNA, 201 bp, Homo sapiens
gatccttctgagaatctccagaatttacagtatgagtttcctctaaatacattttaaggccaagtatcaaagattttcacaaagggatttgaggtaaagaygcattcctgaatggccttctcatttgtgggttgtgatttccttccctgggaagagcgtgggaatattaaaaagcagatctatggagtcatgtattaaagg

SEQ ID NO: 45361 - DNA, 201 bp, Homo sapiens
aaacacagacatgcagtcagttccgaggactcctctatctccgtgacatttgcttaccaatagccagattgtgcttttatttcccctctactcatgcagargattcagaccccactccggtgaatccttgctatgatgggagccacatgtgtgacacaacagcacggtgccatccagggacaggtgtagattacacctgtg

SEQ ID NO: 45362 - DNA, 201 bp, Homo sapiens
tttctcagacatgtttgtccttttggattgttgtgacttggccaggtgcaaaagcagattgtcttgagttgggaccttcccaggaggagcaagtgtgagtkgaggaagctgggttacagatggcccattacccagagccatcattactcaggggcctgagggaagatactgacattattctttcttgggtttcctggcgtt

SEQ ID NO: 45363 - DNA, 201 bp, Homo sapiens
tggtaggtctaaggtgggccctcagaatttgcatttttaacagaaatctcaggtgatcctgatgcagtggtctctggaatccaccgggagaaatgcagctytccgtgtgaaggactgcatggtgctgtgctgagggtgtaagttgttattcaccccttggtgaatttccttgatgcctcatgctgttgtcagaactgaacc

SEQ ID NO: 45364 - DNA, 201 bp, Homo sapiens
gtattatctgcaggctattgcatggagaggtactaatttcaggagggaagaaaatattttctgactaatgtggcattgtgtaaggattcgagggagtacaytggtgtcggcttcgagtttgaatcctggctgccaagcttgctgggtgacctgaagtaacttatgtaacccataagcctctgatttctcaggaattacttg

SEQ ID NO: 45365 - DNA, 201 bp, Homo sapiens
ttgtctatagggtaggcaataggaagccatgctggagtttaaaactgaagtgcagaaaatccaccctagcttcagatatggataatttagtaaggtcttcmggtgtgtcacaaaacacagacatgcagtcagttccgaggactcctctatctccgtgacatttgcttaccaatagccagattgtgcttttatttcccctct

SEQ ID NO: 45366 - DNA, 201 bp, Homo sapiens
gggtcatgttagggctctgaaattgactacttttccatattgggaatttaagtattgtcattttttaatttgccctatttttgtcattttcaattgtcccyattttatttctggttctctgcttttaggattctttccaaagcctacaaactaaaaatatgccaaacccatcaggtgcttcccccagtgtattggttatct

SEQ ID NO: 45367 - DNA, 201 bp, Homo sapiens
ggcgaaagcaggcggtggttaattatcatggacatggggtctatgtcagtcttctagtccttgttgagacttgtcatgccagctgtttcttccccatcagrcatggaaagatgtgaatgggaaactgactccagattgtttgttccagggactgctcatctgacctctgataggaagaaagaggtcagaggtgactgcttt

SEQ ID NO: 45368 - DNA, 201 bp, Homo sapiens
cagcagagatggtgcttttaaaatatttagttccttagctctctggtttaaagcaaagaagttgaaattaatttcagcctagatatgatgagtgttaatcrgaatattaatttagattaggtgctgcatgctttgatcacttctacaatgattctctccctccttttttcttctacttgtcctgcaagactttgattacct

SEQ ID NO: 45369 - DNA, 201 bp, Homo sapiens
agtgaccctcctgcctcagcctactgagtagctagaagcacaggcatgtggcaccatgcctggctaagttttttagaaaagggttttgtagaggcagggtstcactatgttgcctagactggtctcaaactcctgggcttaagtcatcctcctactttggccttgcaaagtgctgggattataagtgtgagccaccatgcc

SEQ ID NO: 45370 - DNA, 201 bp, Homo sapiens
aaataatagagcaaaagcacttttaaacagatgttttgggcgtttttattccctggatgcaaacctactgaaagcaagtaaaggtactagttgtctatagkgtaggcaataggaagccatgctggagtttaaaactgaagtgcagaaaatccaccctagcttcagatatggataatttagtaaggtcttccggtgtgtcac

SEQ ID NO: 45371 - DNA, 201 bp, Homo sapiens
aggtagcaagaatggggaaagatacaactattcccttaaatcaccaacacaaaacctttccagaaacccccagactttcatgagatgtctggaagttagawcaggactataccaaatggccacctttggctgcaagagagactgagaaagtaataatcttacttctatagtgatgggggccagggagaaggaggttggaag

SEQ ID NO: 45372 - DNA, 201 bp, Homo sapiens
tcaacgggccacaagcatgatttgtggactgtgcatgagctatttgtggcttttttaaggtacaaagtgagaggaacatgaagtttttcactcaaaaatgmccccctagccactgaatacattcaatttgctttaggaagcactgaagtaagctatcctttctctaagttgtagaacgtagaatggatatcttaaacagat

SEQ ID NO: 45373 - DNA, 201 bp, Homo sapiens
ctttacttacactgccttccaaagcatagttttgctgaaggaatgaatgaatgaatgaatgactttattacaccagaacaatttactgtctgttctatagkgtgggtgaaataagctgatctttaacccaacttccagtggctcgattcatatacaacgagccagtaagaacctttaaaagaaaacagtgtctttcagaga

SEQ ID NO: 45374 - DNA, 201 bp, Homo sapiens
aaattttactttacaaacaagagcaaagagatttggctaagcctttacttacactgccttccaaagcatagttttgctgaaggaatgaatgaatgaatgawtgactttattacaccagaacaatttactgtctgttctatagtgtgggtgaaataagctgatctttaacccaacttccagtggctcgattcatatacaacg

SEQ ID NO: 45375 - DNA, 201 bp, Homo sapiens
gggagaggagacggttcgtatcactcaaactgctgagggacttgacccagagaactacctgagcattaagaccaacattcaaggccaggtgccttacgtcycagcaaatttcacagcccacatctctccctacaaggagctgtaccactactccgactccagtatgtataaccagtcttcacatctgtaaaatggggatta

SEQ ID NO: 45376 - DNA, 201 bp, Homo sapiens
agattgtgcttttatttcccctctactcatgcagaggattcagaccccactccggtgaatccttgctatgatgggagccacatgtgtgacacaacagcacrgtgccatccagggacaggtgtagattacacctgtgagtgcgcatctgggtaccagggagatggacggaactgtgtgggtaagagccatgttctcgtgtct

SEQ ID NO: 45377 - DNA, 201 bp, Homo sapiens
tagcccctgtgtctttttctcatctgtgaaatgaggataaccctgatgctcgtatgaaagggtagatggaagaggaaagagagtgatgctgtgagacagtwaggaggccttttgaccaactagtgcctaacacagtgcctgcccatagtggtcatttaataaatggatgaatgaatgaatgaatgaatgatgcaaatgaga

SEQ ID NO: 45378 - DNA, 201 bp, Homo sapiens
atggggactctttattttttaatttttgagggtacatagtaggtgtatatatttatggggtacatgggatgttttggtacaggcatgcaatacgtaataaycacatcttggagaatggggtatccatccccccaagcatttatcctttgtattacacacaatctaattacactcttagttatttaaaaatgtacaattaag

SEQ ID NO: 45379 - DNA, 201 bp, Homo sapiens
aagtccagtatgatccctttagttaccatgtaagtctgcttttatttggttttatataccagtgaaaactgaacctgatcttaatagcctttcaggttttytgtttttttgagacagggtctcactctgccacacaggctggggtgcagtggttgcaaccaaagcccactgtaacctggaactgctgggctcaagtgaccc

SEQ ID NO: 45380 - DNA, 201 bp, Homo sapiens
tcaggactataccaaatggccacctttggctgcaagagagactgagaaagtaataatcttacttctatagtgatgggggccagggagaaggaggttggaartaagggttgaagaaatgaacctatcatttctgccacaaaagctagcaggtgacagttggtgaggacctgagataggccaacggtaatcgagaaagggcaa

SEQ ID NO: 45381 - DNA, 201 bp, Homo sapiens
atttcctagtgccccggagaaagcaccctcctgtccatccacaacccccgccacaccctacccccttggctatttcctttatgaactatggcatttgctcyagtttccccatttctttgcagcacagatggccctcttcttttaatgggcagaataagtaggaaatggaagaaacagctgccagagcactgaatttatcct

SEQ ID NO: 45382 - DNA, 201 bp, Homo sapiens
tctataaaattgaatatgatcacctctatttgcagattgtattgaagaatgtgaaacacttggcacagggaaggggcatcaccaattcatgaaagtatgtygtagtcatttgggtgtcagtatttggtagagttttaagcatacatttttaaaatgtgttatgtttccagacaagtagaggaaggatgaaacattcctaca

SEQ ID NO: 45383 - DNA, 201 bp, Homo sapiens
tctgctactgcgtggaaatcatgcttgtaccatacccatcatagttaaaccctgccaagggcatagggcattttaatagcttgaatccctgttgttttgcsctcctctgtccccttctccccatgccttttctttgaggtaggtgcgtgtgttctttaagacccttccctcaaaacaatcttggtagcgagaccagctatt

SEQ ID NO: 45384 - DNA, 201 bp, Homo sapiens
atccagccctacccagatggagggccagtgccttcggaaatggatgttcccccagctcatcctgaagaagaaattgttcttcgaagttaccctgcttcagrtcacactacacccttaagtcgagggacgtatgaggtgggactggaagacaacataggttccaacaccgagggtgagtgcattagaaaactgggtgctaag

SEQ ID NO: 45385 - DNA, 201 bp, Homo sapiens
ttgctccttaactttttcagtgcaaaaacaaattttttaggttttggcatttgtatttatttgaatttttttacattgactcaccattctttgtggattarggaattaatcagttcaagtgaataaacaatgaaatgtctttaatattctgtagagtaatgataattcagatgcttattgactgcagtgtgtggtatggtt

SEQ ID NO: 45386 - DNA, 201 bp, Homo sapiens
gtcctcattgaaggctcagtataagacaagaacctgattctctcctgttgttatttctccattttaatagaagattctgtacaaagtggggtgggagacaygggtcagaaagagtgaaatgatagagaatccaggaggaggtggtaaaatgggtggtactgccagtgtctgcctacagatgccatgatgctggtgtctgtg

SEQ ID NO: 45387 - DNA, 201 bp, Homo sapiens
gaagctctgctgcatggttttctcgaacaatttatgctgaactaacccaaagccgtggctcagttcagcccttttatttttttctttcactaaatagatayttttggtggtggtattgaaagttgaagctatggcttgaatattcgtcttcttcaaaactcatgttgaaacttacattccactgtggcagtattgagaggt

SEQ ID NO: 45388 - DNA, 201 bp, Homo sapiens
ctgctactgcgtggaaatcatgcttgtaccatacccatcatagttaaaccctgccaagggcatagggcattttaatagcttgaatccctgttgttttgccmtcctctgtccccttctccccatgccttttctttgaggtaggtgcgtgtgttctttaagacccttccctcaaaacaatcttggtagcgagaccagctatta

SEQ ID NO: 45389 - DNA, 201 bp, Homo sapiens
attttcaaattgtactgaaaaatattgttactatagaaatccacatgaacatgatgagtacccacccaaatgaaggaaaatcttttgttcttatacaattyagtgaagtttttattatcttattaggcatggactgttattcctcattgactgacttttgaggaaattccattgcttgggagaatgtgagcatagtgtttt

SEQ ID NO: 45390 - DNA, 201 bp, Homo sapiens
ctcagccaaggcatcccagctcacagcaggctatgacagggcactggaagagccataacgtgggcagtagggcaggcacgggggagaatgccagacacccygaaggacttgggagcgagtccagtctatgaggtcagctgcagcagtcagcacttgggatctagattaggagtcactctgggcaagtctccccccatagca

SEQ ID NO: 45391 - DNA, 201 bp, Homo sapiens
cactgtactccagcctggcgacagagtgagactccatctcaaaaaaaaaaaaaaaagaaagaaaatgcactctttaattcagtgggatgagggtaaaagtrataggagaaactgcgtgtgtgtgtgtgtgtgtgtgtgtgtgtgtgtgtgtagcaattgctctggagtgttataaactttaattgaggactgcttaggtga

SEQ ID NO: 45392 - DNA, 201 bp, Homo sapiens
tgacctcggttcactgcaacctctgcctcctgggttcaagcttttcttctgccttagcctccagagtagctgggattacaggcacacaccatcacacctgrctattttttttgtatttatagtggggtttcaccatgttggccaggctggtcttgaactcctaacctcaggtgatccgcccaccttgatttcccaaagtgc

SEQ ID NO: 45393 - DNA, 201 bp, Homo sapiens
agggagaaggaggttggaagtaagggttgaagaaatgaacctatcatttctgccacaaaagctagcaggtgacagttggtgaggacctgagataggccaayggtaatcgagaaagggcaaatattgttgccatggactaaaatggaaaactcagaaatactgagtattgaatctagttatgctagatgaagacttaggtat

SEQ ID NO: 45394 - DNA, 201 bp, Homo sapiens
tactcaggaggctgaggcaggagaatcacttgaaccagggagttggaggttgcagtgagccgagatcacgccactgtactccagcctggcgacagagtgasactccatctcaaaaaaaaaaaaaaaagaaagaaaatgcactctttaattcagtgggatgagggtaaaagtgataggagaaactgcgtgtgtgtgtgtgtg

SEQ ID NO: 45395 - DNA, 201 bp, Homo sapiens
cttcctcaaatttgtctcacaactgtgagctcaaaggtcataaattatatagttcataatgtttgtcatactcttcctctgcaaatttaaatacgaattcrcacgtgtatattttgaaatcatacttttctatcttctggaagacaagacagtagttaataagtatttatgatgtttagggccagtgataggcattttatt

SEQ ID NO: 45396 - DNA, 201 bp, Homo sapiens
tttttaaaacagttaaagaattcttagaatattcacttaaaaatttatcttcctgtggtgtttacttgaatggcatgaaatttttactatttctgattatstgcaacatgcattcatatctgatttttaaaaattctacatctgccaaccatttgtcccattgaagcatcatactagtgagaaaacattgagtttttagac

SEQ ID NO: 45397 - DNA, 201 bp, Homo sapiens
acttcccagggcgaggatgcagaactggggtgtctttcccagtgagtaattggagcctctgtccctcggtgacttctcaaccagcagtgccaccccccacyagttgtttgagctttaagctttaagtgtgagtcagctgttttttgttgttgttggttggttggttgttttgtggggtcataaaacacgatccaaaaatgc

SEQ ID NO: 45398 - DNA, 201 bp, Homo sapiens
atcatcttgttggaattcatgtgaaacagcgcagctgtccacacctgatgtgggtgtggtgcgacttcccagggcgaggatgcagaactggggtgtctttyccagtgagtaattggagcctctgtccctcggtgacttctcaaccagcagtgccaccccccaccagttgtttgagctttaagctttaagtgtgagtcagct

SEQ ID NO: 45399 - DNA, 201 bp, Homo sapiens
gttttctttagaattttatgattttccctcccaccccagtcaaataataatatcaaagcatggtttacttggtgccaagtactgttctaagcaccttacaygaattaactcatttaatccccacaatgacctctacccaatggtggggtgggggtggggttatttgttatcccattttacagatgatgagactgaggtata

SEQ ID NO: 45400 - DNA, 201 bp, Homo sapiens
gctcagagcccacccagaggcccccgaccatctgtgagcgctggagggaaaacctgctggagcactacggtggcaccccccgggatgaccagtacgtgccmcagtgcgatgacctgggccacttcatccccctgcagtgccacggaaagagcgacttctgctggtgtgtggacaaagatggcagagaggtgcagggcaccc

SEQ ID NO: 45401 - DNA, 201 bp, Homo sapiens
ggcagaaaacagaatccaaatcagataaaaccatgaaatctactttatgtttcatattcttctgtgtattttagtcattcaaccataattttaatatcaayagttaatatttagaaaataaagacatttttctatgtgcacagtttctgtcaagaatcaagaacatgaagctgaccttaagcattaccaggtaatcatcat

SEQ ID NO: 45402 - DNA, 201 bp, Homo sapiens
aaaagaaacacccaaaagttttttctttcccctcttggtacacagcagtatcttcctaagaactgctcagtttttccagagggaactatcatcttgttggrattcatgtgaaacagcgcagctgtccacacctgatgtgggtgtggtgcgacttcccagggcgaggatgcagaactggggtgtctttcccagtgagtaatt

SEQ ID NO: 45403 - DNA, 201 bp, Homo sapiens
gacacctctggcttcagtgttgctgtagcagaaatcaagataaacattttccctgtctgtataattgctaaggtcatcaaatgtgacatacaggatttgtycactgtctcagtacttgttacaatcagggagaatttttatatcttgagaaactcttgccatgtttaagtggagtttctacgaaatgaaattcccagatgc

SEQ ID NO: 45404 - DNA, 201 bp, Homo sapiens
gttatgagtttgcagatgaccggcatacttgcatctgtgagttccaaaatcattttcctgtgtggccaaaatggtgctctttaatcttgctctttaatctrtcagtgttttgacttctgctattcagaggctctgctatatggttttcttaagaagacagtttacatcaaaataacccaaagctggctggatgtggtggct

SEQ ID NO: 45405 - DNA, 201 bp, Homo sapiens
tcctctcaggatgtgtttaggttgaaccatataaaagtgctgatatttagccctttttgacccacaaaaatagtggtttcatgaagttcaacctaacatgwacttactggtttgctttcattttactgcactcaaacccacgggtgcagtctcatcttagttcaccaactctgcaatgggacccagccgggagcagtaagc

SEQ ID NO: 45406 - DNA, 201 bp, Homo sapiens
tcttaagcacagctgtccaaagcctcctatttcagggagaattcagccactttatgcagacaggaaaacaaaactgttcgttttagcatcttctctattgkaactatttttttgtactcagattgcatcagattcaaaactagtgacatcctcttatgctctgtttccccaaccagatcatgagctctttaaggttagggg

SEQ ID NO: 45407 - DNA, 201 bp, Homo sapiens
aaggcttaaatgacttacatggcatgtccttagaacagtgcatggaacataaaatgagctctattatgttattactcttattgttaccatgaaatatatcrtgtaagtgagcagaatggctgctatacataagaatatctatatccctacatagtattttcaaataataaaatcaatagcaacattgtccatggggtgggt

SEQ ID NO: 45408 - DNA, 201 bp, Homo sapiens
cctgaggaagacctgttagcccctgtgtctttttctcatctgtgaaatgaggataaccctgatgctcgtatgaaagggtagatggaagaggaaagagagtkatgctgtgagacagtaaggaggccttttgaccaactagtgcctaacacagtgcctgcccatagtggtcatttaataaatggatgaatgaatgaatgaatg

SEQ ID NO: 45409 - DNA, 201 bp, Homo sapiens
agccttaaaaaatgatgagttcatgtcctttgtagggacatggatgaaattggaaaccatcattctcagtaaactatcgcaagaacaaaaaaccaaacacygcatattctcactcataggtgggaattgaacaatgagatcacatggacacaggaaggggaatatcacactctggggactgtggtggggttgggggagggg

SEQ ID NO: 45410 - DNA, 201 bp, Homo sapiens
ctgttgggttttcttaattttctttagcaggattggcagatgtacatgttcctatttccattttacatggcagactcagaagtacacagaagtgccagagktgatagattcattctacctgagcatctgacactccttccaatacctctgtgccattggcttagactagataacttcatgaagttccttcagtgagggttg

SEQ ID NO: 45411 - DNA, 201 bp, Homo sapiens
cagggagcaaagctcataccgcaaccccgccacccgcccgcgccctgccagcctgttggggccacagcgcgcaggccagcagccgcactcgccgctgcggrgttccctttgcgctgagctcatctcctgcaacgccgctgccccagaccttgcgggccatttggtcccgggggtggggctccttgggggccgcggggcagc

SEQ ID NO: 45412 - DNA, 201 bp, Homo sapiens
aaatgtgatgttcttctctgtgcccgagtttgtctgtctagcagaatggaaaggtaatgatacttaccagtaaataatatttctaagagtcacattatttrtgaagtaagttgtgttttaaaaataccttcccagttccttactaaattgtaaaagtagtgtgatttagtgagagagagacagtttcagaagcctaaacat

SEQ ID NO: 45413 - DNA, 201 bp, Homo sapiens
agaagacaagtatctgtcacctttacaacctccattgtcaatgattttagcagctgttaatctgaatatagttatttaaaaattaaagcatagctgtttakgtttgaaaagatggtttggagtggagtggattttgcaccggggctgtgaaaagaaaacatctgttgcagttcctggatgttttgagttaagttttgtaat

SEQ ID NO: 45414 - DNA, 201 bp, Homo sapiens
agtaattagggacactttcttctcaattttaggtaggataatatatcctgtccaagtttgcaagtcaacttttgagctgagattttttttttttttttttyttttaatgcctagcagggtggtaagctcttgatgtccatgtgaacacactaatctttgctggaatgtgccatggtgaaattttgatgctggaaagtactg

SEQ ID NO: 45415 - DNA, 201 bp, Homo sapiens
agaaatgtccttcaatataatcttctatttcacttttcattatttaaaatttcaaaaatatacagaaaagtggagagaataactagatgaacacccaaatrcccatcacctagatttatacattgtaaacattttgccatattcatttttttgtttgtttacatttttttcttttctttttttttttttttttttgagacg

SEQ ID NO: 45416 - DNA, 201 bp, Homo sapiens
atgaactatgatatttatcagctgccggatgcagtctactatagacatcctggtaatggcaaaaaacgcctgtgaaaaagctggttaatacgcattttggrggaagaaatctagaagtgtttgaaacttagacaaaaaaaatccagtttttgttttaaaagaatttacggggatgtatgaagtatagaagcatgcaattgt

SEQ ID NO: 45417 - DNA, 201 bp, Homo sapiens
ttttaaggctacaaaacgttatgtcatatatgtataaagacagcttattaatgaacatttcatgtatttctgatttttcttgttataaatatcattgcagkaaacagcataataaacattgctcacattctcgtttctccctaaaacaaattcttaaaagtggaattgctgagaaagggtgtatgatttaaaagttgtaca

SEQ ID NO: 45418 - DNA, 201 bp, Homo sapiens
tgatcactacttcaagtgataacaagtgttaatggtccttctagaatttaggtatatacaaaacttttaaaaccaaaatggttcttttgctatgtaagtgktgttttcacattaatcacttcttataggggtcttttagtcagatgtctgtctatactaccattttaaggctacaaaacgttatgtcatatatgtataaag

SEQ ID NO: 45419 - DNA, 201 bp, Homo sapiens
gaaaggatcagagaaagcaaactggcaggtaccaagttgcttgttttctttagaattttatgattttccctcccaccccagtcaaataataatatcaaagsatggtttacttggtgccaagtactgttctaagcaccttacacgaattaactcatttaatccccacaatgacctctacccaatggtggggtgggggtgggg

SEQ ID NO: 45420 - DNA, 201 bp, Homo sapiens
acgttagtgggtgcagcgcaccagcatggcacatgtatacatatgtaactaacctgcacaatgtgcacatgtaccctaaaacttagagtataataaaaaawaaataaataaataaataaataaataaataaataaaaaagaaatgggaaaaaaaaaaaaaaaaaagaaaggcaggattctgtttggataggggatgttctt

SEQ ID NO: 45421 - DNA, 201 bp, Homo sapiens
aggctgccgcttagtctggactctggagcaaactcagttccttactctccctcctctggttccaccctctcttctacttgggagctcatagatttattatyccatagatttattattatagagaggtcacaatggccaagcacatggaatacaaagatttctaagacactggtcctgcacatcagcagcttgtaccctatt

SEQ ID NO: 45422 - DNA, 201 bp, Homo sapiens
gtaaaagcaactgttagtgaaataatttcccaggctatggagtcccattcagattctggaaccatttaggaaaaagatgtgtctctgggtatatttttccyagagacataccaaatgagagtaagaaaggatcagagaaagcaaactggcaggtaccaagttgcttgttttctttagaattttatgattttccctcccacc

SEQ ID NO: 45423 - DNA, 201 bp, Homo sapiens
aacttgctcttaaataccaacatccatttgccacactgtggagcaaatatgcttccattctcatgattaaaataacaggaagtatcatcattcttgaagtmttggtatttataacaacaatataaccacaaaaaatatgtaactgtggagactcttgataaggtctattggcaaggcatctggtagcatccttggcttgat

SEQ ID NO: 45424 - DNA, 201 bp, Homo sapiens
tcctttcccatccttatgatccacattgggcatctttagggctccatctaggctgccgcttagtctggactctggagcaaactcagttccttactctccckcctctggttccaccctctcttctacttgggagctcatagatttattattccatagatttattattatagagaggtcacaatggccaagcacatggaatac

SEQ ID NO: 45425 - DNA, 201 bp, Homo sapiens
tgtaactaacctgcacaatgtgcacatgtaccctaaaacttagagtataataaaaaataaataaataaataaataaataaataaataaataaaaaagaaakgggaaaaaaaaaaaaaaaaaagaaaggcaggattctgtttggataggggatgttctttcaattacccacattgaagtttcttccaatattttaaagagct

SEQ ID NO: 45426 - DNA, 201 bp, Homo sapiens
aaagtgacttgtaatgagaatcccgaggtgctttggttttaagaaacttggttgggaatgtaggcattaggtgcccagagattggattgtaaggtagcaartgaacacatgaaaatgtgagttgattttagaggaacatgtaaattagaaagggaaagattgctgtagtagatttctcaaagagagatttaaacctactgg

SEQ ID NO: 45427 - DNA, 201 bp, Homo sapiens
aactaacctgcacaatgtgcacatgtaccctaaaacttagagtataataaaaaataaataaataaataaataaataaataaataaataaaaaagaaatggraaaaaaaaaaaaaaaaaagaaaggcaggattctgtttggataggggatgttctttcaattacccacattgaagtttcttccaatattttaaagagctctg

SEQ ID NO: 45428 - DNA, 201 bp, Homo sapiens
tagactcttttctaggatgcgaaagtgacttgtaatgagaatcccgaggtgctttggttttaagaaacttggttgggaatgtaggcattaggtgcccagakattggattgtaaggtagcaagtgaacacatgaaaatgtgagttgattttagaggaacatgtaaattagaaagggaaagattgctgtagtagatttctcaa

SEQ ID NO: 45429 - DNA, 201 bp, Homo sapiens
tcagggagctaggcttatgctgacatagttcatcaggtttaaaaagtgctggaattatttattggtcctttgttttggcaaagattctgttactccagccracaacattgtggtgaactgaggataaacccatagccctccttattttcagccaataatacgggaatcaataatacgggaatattccactacaagaatgca

SEQ ID NO: 45430 - DNA, 201 bp, Homo sapiens
taaataatattgcttatgaaattatattgttaacttgaagaggaaattttaaagaaggttatgtttaaaaacaatttggaggaatcctgaaaaaggggaarttctttgcacgttatgatgctttgcttgcattctgtttctttcttcttttatttgttttttacaggatgtttctctctctctctctctcttttttttttt

SEQ ID NO: 45431 - DNA, 201 bp, Homo sapiens
tgtcagtattgattggggataacaaatgcaccacactaatgcacaatgttgataataggggaaactgcacattttgggtggggggatatgggagctctgtrctttctgctccatttttctctaaatgtaaaaccatcctaaaaagcaaggtcttaattattaaaaaatgtttcaagcaagccagaggatgagcttgtgaag

SEQ ID NO: 45432 - DNA, 201 bp, Homo sapiens
agaggaacggacctccaaggatgtctgcatgcttcagggagctaggcttatgctgacatagttcatcaggtttaaaaagtgctggaattatttattggtcytttgttttggcaaagattctgttactccagccaacaacattgtggtgaactgaggataaacccatagccctccttattttcagccaataatacgggaatc

SEQ ID NO: 45433 - DNA, 201 bp, Homo sapiens
ataaataatattgcttatgaaattatattgttaacttgaagaggaaattttaaagaaggttatgtttaaaaacaatttggaggaatcctgaaaaaggggamattctttgcacgttatgatgctttgcttgcattctgtttctttcttcttttatttgttttttacaggatgtttctctctctctctctctctttttttttt

SEQ ID NO: 45434 - DNA, 201 bp, Homo sapiens
gactgactcaggaacctggtctaggctcaagttaactcggcaaccacaaccccagtgcggtgcctctttcctgtcagccaagagatccagaggaacggacstccaaggatgtctgcatgcttcagggagctaggcttatgctgacatagttcatcaggtttaaaaagtgctggaattatttattggtcctttgttttggca

SEQ ID NO: 45435 - DNA, 201 bp, Homo sapiens
ccaaaaggtggaagcaacatacatgcccatcagttgatggacaccaaaaaatatattcatatactggaatattattcaaccataaaaaggaatgaagtacrgatacatgctgcaacatggatgaactctgaaaaccttaagtgaaggtagtcagtgacaaaggacagcatactgaatggttacaattatgtgaaatatcca

SEQ ID NO: 45436 - DNA, 201 bp, Homo sapiens
tatattcatagtggcagtattcataatagccaaaaggtggaagcaacatacatgcccatcagttgatggacaccaaaaaatatattcatatactggaataytattcaaccataaaaaggaatgaagtacggatacatgctgcaacatggatgaactctgaaaaccttaagtgaaggtagtcagtgacaaaggacagcatac

SEQ ID NO: 45437 - DNA, 201 bp, Homo sapiens
ggtagatggaagaggaaagagagtgatgctgtgagacagtaaggaggccttttgaccaactagtgcctaacacagtgcctgcccatagtggtcatttaatraatggatgaatgaatgaatgaatgaatgatgcaaatgagagatgctgagtgcctagggttataaactagggcagtgactgcaggatggacaagttaattt

SEQ ID NO: 45438 - DNA, 201 bp, Homo sapiens
gaaaaaggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcc

SEQ ID NO: 45439 - DNA, 201 bp, Homo sapiens
aaaaaggggaaattctttgcacgttatgatgctttgcttgcattctgtttctttcttcttttatttgttttttacaggatgtttctctctctctctctctytttttttttttttttcctcacagctgaacactttccaggcagttttggcatctgatgggtctgatagctacgccctctttctttatcctgccaacggcct

SEQ ID NO: 45440 - DNA, 201 bp, Homo sapiens; identical to SEQ ID NO: 8603

SEQ ID NO: 45441 - DNA, 201 bp, Homo sapiens
ttgcagagatgggaatgaggagggaggaaaggagggagagagacagagacaaaggttgattaaggcagtggggtgagagagttgccagtgagggcttcagytgcctgggaccatgggactgcctgtgttgtgagtagaaaggaatgaggtttactgataggggtcttagttattcttaagcctgctgaggcagtgctatac

SEQ ID NO: 45442 - DNA, 201 bp, Homo sapiens
cctcagttgggatttctggcccagtcatgtaacaagatgatgaacttcactagtaaacacctccagctctttagatagagcctaaagtatttttcaaattrgaagagatggatttataattcactgatgcatgtcctacttgactggctaaagagctccttctgtaacaaattacctcttctatatttccagaaaatacta

SEQ ID NO: 45443 - DNA, 201 bp, Homo sapiens
atccaacagttcctgctggttttgctcagtacttgggcagtgagaaggatgttgaagcacgaaagcatgaactcgaaggatttttaacacattttccaaayaggttctttactagcttaatagagtgtaggattgcactgagattaagctacctctcattacctgagtgataaaggggctctacgacttcttgaacgtttt

SEQ ID NO: 45444 - DNA, 201 bp, Homo sapiens
gtctcaggaattcctgcttcctgtcattgcttggggttcctgttaccattagaagtacttttagcatgcgtattgtgaatagctttaatttcctgcattcrgctgaatgttaatttttacaggtttagttttacagccagttttacagcctattccaggtccaaggtattggatggtcaccagttttgcccagctgggcat

SEQ ID NO: 45445 - DNA, 201 bp, Homo sapiens
tggagtctcgttctgtcatccaggctggagtgcagtggcatgacctcggttcactgcaacctctgcctcctgggttcaagcttttcttctgccttagcctccagagtagctgggattacaggcacacaccatcacacctggctattttttttgtatttatagtggggtttcaccatgttggccaggctggtcttgaactcc

SEQ ID NO: 45446 - DNA, 201 bp, Homo sapiens
cttgcagatgaattgatatctgctttcttgcctttataggcgaaatgatggtatccagggaggccaaccactcacctgggtggagactctatgggttgcawtgagttcagaatttttgggggaggactcctaggaactgatatatgctgactaaactccccagagacagaagataagcagaatacttaccttctaattata

SEQ ID NO: 45447 - DNA, 201 bp, Homo sapiens
agtctcgttctgtcatccaggctggagtgcagtggcatgacctcggttcactgcaacctctgcctcctgggttcaagcttttcttctgccttagcctccaragtagctgggattacaggcacacaccatcacacctggctattttttttgtatttatagtggggtttcaccatgttggccaggctggtcttgaactcctaa

SEQ ID NO: 45448 - DNA, 201 bp, Homo sapiens
tggtatctcttgtagagatggggtttcatcatgttgcccaggcttgtctcaaactcctgagctcaatcgatctacccccctcagcctcccaaagtgctggkattacaggcgtcagccaccacacccggcctagcttctctcttctttgataacgaaagcatgatctccattatgtgcctggccaggtttcctgttccaaga

SEQ ID NO: 45449 - DNA, 201 bp, Homo sapiens
taaagtatttttcaaattggaagagatggatttataattcactgatgcatgtcctacttgactggctaaagagctccttctgtaacaaattacctcttctrtatttccagaaaatactacagacctaaaaatggatcaaaagaactatcccaattcatcccattgataaagatggatgagagtaaagaaaatgcactcttt

SEQ ID NO: 45450 - DNA, 201 bp, Homo sapiens
tggccgggcggggtggctcacgcctgtaatcccagcactttgggaggccgaggcaggtggatcacgaggtcaggagatcaggaccatcctggctaacatgrtgaaaccctgtctctactaaaaaatacaaaaaattagtcaggcgtggtggtgggtgcctgtagtcccagctactcaggaggctgaggcaagagaatggcg

SEQ ID NO: 45451 - DNA, 201 bp, Homo sapiens
ccaacatggcacatgtacacatatgtaacaaacctgcacgttgtaaacatgtaccctaaaacttaaagtataataataatagaattctgatggttaaaagmcaaaacaaaacaaaaaacacagtgccaaaacaattcaatggagaaagaatagtcttttaaactattgttaactatggtgctgggaccactgagtgaccac

SEQ ID NO: 45452 - DNA, 201 bp, Homo sapiens
tgtcatgccagcagttgtaaaaggccacccccagggtcgtgatcactgccaccagcatcattacatgccacacacatcaaaattaaacaaacatgaaaactggacgaaaaagcattccactgtttgttataaagttggatatggtttttctaactagtctgtcattctgagagatgggaaaacttagaagaatttttcctg

SEQ ID NO: 45453 - DNA, 201 bp, Homo sapiens
gtcatgccagcagttgtaaaaggccacccccagggtcgtgatcactgccaccagcatcattacatgccacacacatcaaaattaaacaaacatgaaaactggacgaaaaagcattccactgtttgttataaagttggatatggtttttctaactagtctgtcattctgagagatgggaaaacttagaagaatttttcctgc

SEQ ID NO: 45454 - DNA, 201 bp, Homo sapiens
gggatcctgggggagctgggaaccagtgactcgtttgtcaggtttggcagcccatctgagggcttctctttggagacagagcctgtgcggctcttgcaaargcttgtatctaggaatgtgaggacctttcctgtttggaagccagtcaaggagttttttgagagggggagcccttcaagacttcatgaagtgggctcttta

SEQ ID NO: 45455 - DNA, 201 bp, Homo sapiens
ccactcaccctgatcctctctgtgctgctcctctccctgtggaggcccctctctcctctctgggatcctgggggagctgggaaccagtgactcgtttgtcrggtttggcagcccatctgagggcttctctttggagacagagcctgtgcggctcttgcaaaagcttgtatctaggaatgtgaggacctttcctgtttggaa

SEQ ID NO: 45456 - DNA, 201 bp, Homo sapiens
aatgatcctagagctctagaggacatgtggtcctgaggaagatgacaaagagaactttgtgacccctataagagtcaccctaattcttcatttccattttmattttcattttgataagcctctataggcaagccccttgaagaaaaggatgtcactattctgatttttgtccagatagctgcagttaattaaatgaattga

SEQ ID NO: 45457 - DNA, 201 bp, Homo sapiens
ggtgggtggatcacctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaact

SEQ ID NO: 45458 - DNA, 201 bp, Homo sapiens
aagagtcaccctaattcttcatttccattttcattttcattttgataagcctctataggcaagccccttgaagaaaaggatgtcactattctgatttttgkccagatagctgcagttaattaaatgaattgaaaaaattagaaactcttagaggggtgtatgttgcatgcatcagcctggctctgatgagtgtcacttcaa

SEQ ID NO: 45459 - DNA, 201 bp, Homo sapiens
tttaattgaaatgaatttgttggctggttgaatgaatgaatgaataaaataaagtgctaaatgcccagagttcacagcaaaaagtcagactctcctcttcwcagctctgtttactactctcttccccccttccccatccccttcaattcttcacagtctctacaacctccttatcttatggaatttctctaaatttagaac

SEQ ID NO: 45460 - DNA, 201 bp, Homo sapiens
gtgggtggatcacctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaactg

SEQ ID NO: 45461 - DNA, 201 bp, Homo sapiens
caacacctccaggcctctgcccaaatgtctttttctcccgaggtcttccctgaccatactatttcaaagagccaggtgcgcctgccctctctcaccctctkgtctgaccctgccatattcctctgcacttcagtgattctgatgccccctcaatttgatgggatttagagccagaagattgtttcatctctgtaggcctca

SEQ ID NO: 45462 - DNA, 201 bp, Homo sapiens
aaattaaatacttgccacccataatgagtgctcatctcaagaacagtatatagaagatgttgaataaattttaattgaaatgaatttgttggctggttgamtgaatgaatgaataaaataaagtgctaaatgcccagagttcacagcaaaaagtcagactctcctcttcacagctctgtttactactctcttccccccttc

SEQ ID NO: 45463 - DNA, 201 bp, Homo sapiens
cctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaactgattgaacccagg

SEQ ID NO: 45464 - DNA, 201 bp, Homo sapiens
tctaaggtgggccctcagaatttgcatttttaacagaaatctcaggtgatcctgatgcagtggtctctggaatccaccgggagaaatgcagctctccgtgygaaggactgcatggtgctgtgctgagggtgtaagttgttattcaccccttggtgaatttccttgatgcctcatgctgttgtcagaactgaaccccacaaa

SEQ ID NO: 45465 - DNA, 201 bp, Homo sapiens
ggcttctctttggagacagagcctgtgcggctcttgcaaaagcttgtatctaggaatgtgaggacctttcctgtttggaagccagtcaaggagttttttgrgagggggagcccttcaagacttcatgaagtgggctctttagcaattagatgtagaattttgtagaactgaccaagaactttacaagtgatcatttagtgt

SEQ ID NO: 45466 - DNA, 201 bp, Homo sapiens
cccctagccactgaatacattcaatttgctttaggaagcactgaagtaagctatcctttctctaagttgtagaacgtagaatggatatcttaaacagatayatgcaaagtttaaaatcacggccataccagaagaaatgttcattaacaacttatttaggatttatagaaacgtacctcttttgtttgatttgccttagca

SEQ ID NO: 45467 - DNA, 201 bp, Homo sapiens
cccaggttagcttaacagtaactagttagcccattgtaattacagtttaagtctcataatagcctttcatgggagcctgctcattgttataacttcttttyctgtaatagaaaaatgtagtacagcttccaatctatttataaacctttgcacagttgcacttgtaagttgctggctgcatcgccctgcctctttttactt

SEQ ID NO: 45468 - DNA, 201 bp, Homo sapiens
tgtcccctctgaaaatcatgttgaaacttaatcctcaatgtgacagtattgagaggtggggcctttgaaaggtgactgggtcatgagggctctgccctcakgaatggattaatttattcattcatggattactggattatcatggagtgggcctggttgctttataagaagaggaattgagacctgagctagcacattagc

SEQ ID NO: 45469 - DNA, 201 bp, Homo sapiens
tgggacttgagttcttgttttaatagttctttggagatagactttggcaaacagtaatctaatttgcttgaaggactgagttctacatggcgttcttaaaktttggcttactaactttatattgcaaagttactggaaactggaagattcaaagcaatggcatctttgccattaaaaacaattgcagttggtgcccttttt

SEQ ID NO: 45470 - DNA, 201 bp, Homo sapiens
  misc_feature (1)...(201): n = A,T,C or G, or insertion/deletion polymorphism (see Tables 1-2)
ctaaaacactattagaactaaagaacaagttcgcaatgttataagatatgcaagatcagtacaccaaattgtatttctctatagtagcaatgagcaaactnaagattaagaaattgtttcaaaaagagataaatttttaaaaagaagtgcagtacttgtacattgcatcccacaaaacatttttggaaaaaaatttaagac

SEQ ID NO: 45471 - DNA, 201 bp, Homo sapiens
tgaggaagtagcatttccctctctgtgttccttgagacacatttggctgaagaagtcagagtcttaccttctccacggggtcttaaaaagagctttgtctyccatgggtcatgagctacagtgacaacttaacggcattcgcttcccccaattctggtgagtcgtgcagttgagctagagctagttgggtttgagctctga

SEQ ID NO: 45472 - DNA, 201 bp, Homo sapiens
cctgctctatactcagggccagcagattggctacttacccctcaatggcaccaggcttcagaaggatgcagctaagaccctgctgtctctgcatgtaaagyggatttctcctgtagggggcagggctgcgtggctttcccagtgggagccacctcacaggccctgttgcagtgaggtggactggtgcagggaagtcctgga

SEQ ID NO: 45473 - DNA, 201 bp, Homo sapiens
taataggacaggtaattttacagttgctaatctatgactgtaatggaagtaaaatatcctatttccccattctatcactgtgtcactatcactatgtcacyatcatttttggcaaagcagctgaaggacctcattttccccctttgttttaaaaggaaccaaaaaactggagtgtacactacctgatggaactggacggcg

SEQ ID NO: 45474 - DNA, 201 bp, Homo sapiens
cagggtctcactctgccacacaggctggggtgcagtggttgcaaccaaagcccactgtaacctggaactgctgggctcaagtgaccctcctgcctcagccwactgagtagctagaagcacaggcatgtggcaccatgcctggctaagttttttagaaaagggttttgtagaggcagggtctcactatgttgcctagactgg

SEQ ID NO: 45475 - DNA, 201 bp, Homo sapiens
ctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaactgattgaacccagga

SEQ ID NO: 45476 - DNA, 201 bp, Homo sapiens
tcctggctaacatggtgaaaccctgtctctactaaaaaatacaaaaaattagtcaggcgtggtggtgggtgcctgtagtcccagctactcaggaggctgasgcaagagaatggcgtgaacctgggaggtggagcttgcagtgagctgtgatcgtgccactgcactccagcctgggcgacagagcgagactccgtttcaaaa

SEQ ID NO: 45477 - DNA, 201 bp, Homo sapiens
aggcggaggttgcagtgagccaagattgtgccatcgcattccagcctgtgcaacagagtgagactccgtctcaaaaaataaaaataaatggaagcaaatastagtagaaacaaaactctaaaaccattctcatcgggtacaatggcttacacctgtaatcccagctactctggaggctgaggtgggaggatcacctgagcc

SEQ ID NO: 45478 - DNA, 201 bp, Homo sapiens
agtaagggcttccttctatggaattagacctgaatctaaaataccatactctaggggctgaaaccatatgattcatctcaattttaacttacggaaatgcytcttcactatagaaggatggtacatgccccctgtaagaggtgaggttgcttgcccatgtcactgatctctatcttgtaaggatgctgtgacttatatctt

SEQ ID NO: 45479 - DNA, 201 bp, Homo sapiens
atccagactccctggccagtggggaaggagagagaggctttttgcctaagtcagttcccttccctccctgcgcgaaagggtagcgtccttgggcttgagcractgtcacctttttgtccctctcctctcccaggtgggcaccaacggcatcatctccactcaggacttccccagggaaacgcagtatgtggactatgattt

SEQ ID NO: 45480 - DNA, 201 bp, Homo sapiens
gggagcaggtaggcgcttacgaggaggtcaagcgcggggcgctgccctcgggagaggtaagtgaccagggatatttgactgctgaggaaattgaaggatgrgcttaaattctggggcagcgacccagggactggctcggagttgtttctgagcctactcttgcgctgaacctgaccttggaggcagcagggctggagtggc

SEQ ID NO: 45481 - DNA, 201 bp, Homo sapiens
tacgtaagttcagccccctcctggcacttttcccgcagcttcttccctggggtcggtctcacggaaaccctgcctccagaggggaggaaacagaccccackcctggagccccccagcacccttgcggtggtacccggccagagagcgatgccgctgcctgccccgctgctgtaggggagcaagaatgacctggaggggaga

SEQ ID NO: 45482 - DNA, 201 bp, Homo sapiens
gcgttgtgcagcgggtaagcgcacggccgagcgagcatggagggggaccgggtggccgggcggccggtgctgtcgtcgttaccagtgctactgctgctgchgttgctaatgttgcgggccgcggcgctgcacccagacgagctcttcccacacggggagtcgtggggggaccagctcctgcaggaaggcgacgacgaaagc

SEQ ID NO: 45483 - DNA, 201 bp, Homo sapiens
cttctacgaagcccgattcagcaacctctacgtaagttcagccccctcctggcacttttcccgcagcttcttccctggggtcggtctcacggaaaccctgyctccagaggggaggaaacagaccccacgcctggagccccccagcacccttgcggtggtacccggccagagagcgatgccgctgcctgccccgctgctgta

SEQ ID NO: 45484 - DNA, 201 bp, Homo sapiens
actataattctcagttttggtgggtctggaatctgcacctggcttagctgggtcctctgcttcagggtctcttgcaaggctgcaatcaaatgtcagccagygctgagataccatctcaagacccaactggggaaggatccgtttccaagctcactgacatggttgttggcagaattcagttccttgctgactgttggccag

SEQ ID NO: 45485 - DNA, 201 bp, Homo sapiens
agcctttcatgggagcctgctcattgttataacttctttttctgtaatagaaaaatgtagtacagcttccaatctatttataaacctttgcacagttgcamttgtaagttgctggctgcatcgccctgcctctttttacttagataaaagctatgactccacctagtttaactctccatatctagactgtctctcctccat

SEQ ID NO: 45486 - DNA, 201 bp, Homo sapiens
tatcagttgtctattgctgcataacaaattatcccaaaatgtaatagcttaaagcaacacacagcttcttcagcttctgaagctgaagctgtaattctcasttttggttggtctggaatcccaccaaaactataattataatctaaccaaaactataattctcagttttggtgggtctggaatctgcacctggcttagctg

SEQ ID NO: 45487 - DNA, 201 bp, Homo sapiens
aaacgtgtttagaatgggaaagggcctgctggggaacatgaaccttaaaaggcagactttcccctgctcctggtgttgctgtgtgcatctgcctccatccrcccaggcccaccgagctgatgtgctaagaacagctttgcaattcctgggagctttataccagatccgaatagcacgggcctccctcctcctcaccagatg

SEQ ID NO: 45488 - DNA, 201 bp, Homo sapiens
aattgggttcaaatctcagctttggtacttaccagccatgtgataataactgatttttttaaaatcccatctgagctttagtttccttaacacaacgactrcctgttatcagttgtctattgctgcataacaaattatcccaaaatgtaatagcttaaagcaacacacagcttcttcagcttctgaagctgaagctgtaat

SEQ ID NO: 45489 - DNA, 201 bp, Homo sapiens
tatggtaaaatcagtgtggttataggaggaggcaaggatgaagcttgaaaggaagtagtttattacacttacaggtctggagtgggttcaccacatgccayacaggggtacaatcagcagggtgcccaattgaacagattgtgcagtagagagagagtgggacctgtgggttgaatcctttattgggatctgggatgggtt

SEQ ID NO: 45490 - DNA, 201 bp, Homo sapiens
atgtgtgataggaggtatgatcacggcaagcacagggcacatggaagcaaggagaaagggcttctaaatcagactgtggattccaggaaagcttcctccayctgaaaggaaaagacagaggcacaaaatataacaaaacatttacttgagccaaagtgaggacagttgcccggaagacttagacccaagtaaccctggata

SEQ ID NO: 45491 - DNA, 201 bp, Homo sapiens
gagagatgtgtgataggaggtatgatcacggcaagcacagggcacatggaagcaaggagaaagggcttctaaatcagactgtggattccaggaaagcttcstccatctgaaaggaaaagacagaggcacaaaatataacaaaacatttacttgagccaaagtgaggacagttgcccggaagacttagacccaagtaaccct

SEQ ID NO: 45492 - DNA, 201 bp, Homo sapiens
tattggaactatttttttgtactcagattgcatcagattcaaaactagtgacatcctcttatgctctgtttccccaaccagatcatgagctctttaaggtyaggggccacattttgtactcctttatttcttgcagagttgtgtttgtcatggtgtactttcaggaaattgttgttgaatggatgaatgaatgaaagaatg

SEQ ID NO: 45493 - DNA, 201 bp, Homo sapiens
aaacatttcttacacttcaagtgagccaggcaggcattgcggcagacactgaagaaggcaaaatccctgccctccaggtgtggtggtggtggtggtggtgrtggtggtaagggaagcatgtggagatcaggattatgggagagatgtgtgataggaggtatgatcacggcaagcacagggcacatggaagcaaggagaaag

SEQ ID NO: 45494 - DNA, 201 bp, Homo sapiens
ctactcacaagagaaaaaagaaagccctgtagactatcaacaattaaataaattggtaagataaaatggttttcctattactgtatgagacggtccccaayttaggatggttagacttgtaattttttgaccttacaatgagttcagtgggatgtaaccctagtgcaagatgaggaaaatctgaacttacagtggttccaa

SEQ ID NO: 45495 - DNA, 201 bp, Homo sapiens
accttgggtagggtctgagaacctgcattccctggtctgttgctgttggtctgtggatcatgccatgaggagtgaggctcatcctttgcaggcctaaactstggatgcccttatcttcttctcttttcagtgatcaccccacctgccaacccctgtgaggatggcagtcatacctgtgctcctgctgggcaggcccggtgt

SEQ ID NO: 45496 - DNA, 201 bp, Homo sapiens
atacattttagtttccctttgaagctttagggtagtcatcttgctaaaccaagaaattaagatttagttaaaggcccagaaaatatcactcctttttacatttttttccccttagggactcattttacagacctttctttttgttcagaaatttagattttcagatcatatctacaccaggcaggaatgtcctggccacac

SEQ ID NO: 45497 - DNA, 201 bp, Homo sapiens
ttgagcccaagagttccaggctacagtgagccatgattgtaccactgcatagcctgagcaacagagagaaatattgtctgaaaaaaaaagttgtcctgtagggtaggtacaatcatccttcccattttacagagatggaaactgagcttggaaatacttagtgacttgtctagcaagggcaaagactgcaacaaagtcatg

SEQ ID NO: 45498 - DNA, 201 bp, Homo sapiens
cacctcaccaggctgttgtgaggaataaatgaggcagtatgtagagagcactgttggcatggctggcccttagtaacacttattctttgtgtataataacwtggacaattgtagtgccttctccctctcagcactgtggctttgcatccactcaggtttttgggatttccttacacattttttcatataaactcaggaagt

SEQ ID NO: 45499 - DNA, 201 bp, Homo sapiens
agatttaaacctactggggagaatggtctttacctttaaatgtccaggtcagccctgtgttgggtgtaggcatctgatctgtaaaagcaactgttagtgaaataatttcccaggctatggagtcccattcagattctggaaccatttaggaaaaagatgtgtctctgggtatatttttcccagagacataccaaatgagag

SEQ ID NO: 45500 - DNA, 201 bp, Homo sapiens
tccactgtttgttataaagttggatatggtttttctaactagtctgtcattctgagagatgggaaaacttagaagaatttttcctgcggtgaaaatgactttttttttttttgaggtagcagtaaaaattgttagtagttgctccagctgtcctgaagcagccctgtgcacgaagcctcctgtgtccctctgtgttggccc

SEQ ID NO: 45501 - DNA, 201 bp, Homo sapiens
ttttagtcgagacagggtttcgccattttggtctccaactcctgaccctgggtgatccacctgccttggcctcccaaagtgctgggattataggtatgagycactgcgcccggccccttattccttcttggtgcttgacctgaaaactggggagagctgccatcttgtaggcaatgaaactttggccatgtctctggagtc

SEQ ID NO: 45502 - DNA, 201 bp, Homo sapiens
gatttaaacctactggggagaatggtctttacctttaaatgtccaggtcagccctgtgttgggtgtaggcatctgatctgtaaaagcaactgttagtgaaataatttcccaggctatggagtcccattcagattctggaaccatttaggaaaaagatgtgtctctgggtatatttttcccagagacataccaaatgagagt

SEQ ID NO: 45503 - DNA, 201 bp, Homo sapiens
tgttagtagttgctccagctgtcctgaagcagccctgtgcacgaagcctcctgtgtccctctgtgttggcccagtgaacccagtcgacaccatggaacctcccctgtgtctggcccagggccttctgtgaagaagggcaggccggccaagggctgcagacaggtgcttaagtgtttctgggaaaatgaagattgaaagatg

SEQ ID NO: 45504 - DNA, 201 bp, Homo sapiens
gaatggtcattttcctaaagacccatgcataaatcaggctaggctaatcatgaaagtaacttgaagaataaatattgaaatatatgtgtatgtgtgcatawttaaaggcattccatagggtacatgtgtctcagtgaccaaagaacagaggctgtattttgtgggtgctatgcattgttaaagcacatgctcttttactcc

SEQ ID NO: 45505 - DNA, 201 bp, Homo sapiens
atttaaacctactggggagaatggtctttacctttaaatgtccaggtcagccctgtgttgggtgtaggcatctgatctgtaaaagcaactgttagtgaaataatttcccaggctatggagtcccattcagattctggaaccatttaggaaaaagatgtgtctctgggtatatttttcccagagacataccaaatgagagta

SEQ ID NO: 45506 - DNA, 201 bp, Homo sapiens
aggctaatcatgaaagtaacttgaagaataaatattgaaatatatgtgtatgtgtgcatatttaaaggcattccatagggtacatgtgtctcagtgaccamagaacagaggctgtattttgtgggtgctatgcattgttaaagcacatgctcttttactccatcaaactaacaataagggggtgtgggagtttttctccag

SEQ ID NO: 45507 - DNA, 201 bp, Homo sapiens
tgggtgctatgcattgttaaagcacatgctcttttactccatcaaactaacaataagggggtgtgggagtttttctccagccatagtttgttaaaaaaacyggctccctggagaggctgcacttggatttgggttctcagtctggtctgagtcactagccaggaggcttttatccaagtagagttaaatcctctgcagctt

SEQ ID NO: 45508 - DNA, 201 bp, Homo sapiens
ccctgtctctacaaaataaaacatataaatatatatatatatatgtatatatatatacatatatatatacacaaaaaaatttagccaggtgtggtggcatktgtctgtagtcccagctactcaggaggctgaaacaggagaactgattgaacccaggaggcggaggttgcagtgagccaagattgtgccatcgcattccag

SEQ ID NO: 45509 - DNA, 201 bp, Homo sapiens
tccaatagtgtctgccacaccaaccctctctctacttaaaaatgtcacagcagaattgcatctgcagtgattcatatcaaaagcttgaacagtcttttcayattgcacattttaatttaaatactttctcacttcatggttctccttaggcctaacctactttcaattaagcctgagtctgtgaagacatactaacttgtt

SEQ ID NO: 45510 - DNA, 201 bp, Homo sapiens
atttctagaaatgagtggtcagtaggatcagaaactaaaaggcccagtaagataaaaacaaaaactacctatagggtttggtaatatgattttgctgttgktctttccctgagcagttcagtgatggggttgggaagattatttttgcagtggaaagaaggaggcaggaagtataaattcctttccagtagagtttttgaa

SEQ ID NO: 45511 - DNA, 201 bp, Homo sapiens; identical to SEQ ID NO: 8625

SEQ ID NO: 45512 - DNA, 201 bp, Homo sapiens
agcagtaggccatggtcatgccatacatttagacatcggaagcagagcatgagaaattcacaggagatactacaacaaaatggctggaaaagtcaagggaktagagaatttctagaaatgagtggtcagtaggatcagaaactaaaaggcccagtaagataaaaacaaaaactacctatagggtttggtaatatgattttg

SEQ ID NO: 45513 - DNA, 201 bp, Homo sapiens
atcagggtcttcccatccccgcgactcgcccctttctgcctggtaaccaagcgggatgcctcatcctactccccaaacggagcggatcacacacagtagtrtttcatggtctttcctgctgcggttttcccgggggaaggtacttccagagggtggccaagtcttccctagcggccggccttcgggagggggacagaactt

SEQ ID NO: 45514 - DNA, 201 bp, Homo sapiens
ttttagaaatgtattttaaaaatgttttgggaagccaagttcagtgaatggggccctgtgctcagaagagccccatgcttggtttaacgctttgctttgamccatgggctccacattttcattttgcactggggattgcaaattatggaactaatcctgtcagtgacatacattttaaatcagtattgagtaattagggac

SEQ ID NO: 45515 - DNA, 201 bp, Homo sapiens
ctttcccctcttggtacacagcagtatcttcctaagaactgctcagtttttccagagggaactatcatcttgttggaattcatgtgaaacagcgcagctgyccacacctgatgtgggtgtggtgcgacttcccagggcgaggatgcagaactggggtgtctttcccagtgagtaattggagcctctgtccctcggtgactt

SEQ ID NO: 45516 - DNA, 201 bp, Homo sapiens
atagcgagacctaatctctactaaaaatttaaaaaattagctgggtgtggtggtgtgcacccgtagacccagctatttgggaggctgaagtgggaggatcrcttgagcccagggggttgaggctacagtgagccatgatcaatcacaccactatgctccagcctgggtgacagagggagaccctacctctaaataaataag

SEQ ID NO: 45517 - DNA, 201 bp, Homo sapiens
agacctatagcagattgcctttttacttggtgttcagaagtacattaagaagaaatgcgacttctggcaatgcaggggtgaggaagaggtgttctacttawtttagagatgaggaagctgaaagacacagtttgcacagtttccacaaagcccccgagggagggctgaggttgagtcctagagcttggcgctttctgcagc

SEQ ID NO: 45518 - DNA, 201 bp, Homo sapiens
gtttccacaaagcccccgagggagggctgaggttgagtcctagagcttggcgctttctgcagcccctcattccttgagctctgggagaaagtcctgatggsccttaagccatgagcacactggtgagtgtgtgagtccctcctgtagctgcttccttacacttagttgtgaatttctgagctggagaaacctgagattttg

SEQ ID NO: 45519 - DNA, 201 bp, Homo sapiens
tctaaatgtttttttccctttcttaaactaatagacagtgatacagttttcttcacagccatctattttaccatgatccatcctgggtttttttttttttwtttttctgccttgagttttatatcacttttctgtttaagttaagcttgtcactttcttgtttaaataaagttgagtcatgcctaattttctatttttatc

SEQ ID NO: 45520 - DNA, 201 bp, Homo sapiens
gttggttaggaaatcattaaagtgacttgctaaagagtgagttttggaagttgtcagtggaataattatacctgggtacacccatctctagccaggatgaygtccaagcctaactggatttgctgtcttttaggggcacctcaccgagtgaatgggaaagtgagtggccacctccacgtgggccatacacccgtgcacttc

SEQ ID NO: 45521 - DNA, 201 bp, Homo sapiens
agtagttgctccagctgtcctgaagcagccctgtgcacgaagcctcctgtgtccctctgtgttggcccagtgaacccagtcgacaccatggaacctcccctgtgtctggcccagggccttctgtgaagaagggcaggccggccaagggctgcagacaggtgcttaagtgtttctgggaaaatgaagattgaaagatggctc

SEQ ID NO: 45522 - DNA, 201 bp, Homo sapiens
acctgcattccctggtctgttgctgttggtctgtggatcatgccatgaggagtgaggctcatcctttgcaggcctaaactctggatgcccttatcttcttytcttttcagtgatcaccccacctgccaacccctgtgaggatggcagtcatacctgtgctcctgctgggcaggcccggtgtgttcaccatggaggcagcac

SEQ ID NO: 45523 - DNA, 201 bp, Homo sapiens
gagggagggctgaggttgagtcctagagcttggcgctttctgcagcccctcattccttgagctctgggagaaagtcctgatggcccttaagccatgagcayactggtgagtgtgtgagtccctcctgtagctgcttccttacacttagttgtgaatttctgagctggagaaacctgagattttgacacatccaagttacat

SEQ ID NO: 45524 - DNA, 201 bp, Homo sapiens
ctttgactctaacagccttgtggctgccaaaatagtgagaaaaaagcgtcctttgagttagaaaggggagccaagggtgatttcctctggactagatgggsgagcatatatggcttccttggcggagacgttcctgtagcactcgggagcttctaaccttggttccttggagccagcgcaggctggaggaatttagggaaa

SEQ ID NO: 45525 - DNA, 201 bp, Homo sapiens
catttccttttactctaaatgtttttttccctttcttaaactaatagacagtgatacagttttcttcacagccatctattttaccatgatccatcctgggtttttttttttttatttttctgccttgagttttatatcacttttctgtttaagttaagcttgtcactttcttgtttaaataaagttgagtcatgcctaatt

SEQ ID NO: 45526 - DNA, 201 bp, Homo sapiens
ggctaagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgaggacatgaccttgtccttagttataacctattgaggactgactcaggaac

SEQ ID NO: 45527 - DNA, 201 bp, Homo sapiens
gctaagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgaggacatgaccttgtccttagttataacctattgaggactgactcaggaacc

SEQ ID NO: 45528 - DNA, 201 bp, Homo sapiens
taagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgaggacatgaccttgtccttagttataacctattgaggactgactcaggaacctg

SEQ ID NO: 45529 - DNA, 201 bp, Homo sapiens
ttttgcatagcgttgtgatttttctcttaagtgggtaggtgaaaagtttagcaaaaagaagattggatctaatttttaatccctgtgtttcaagagatagwgtaaatttcctttgccaaataaatcttggcaggcagattctgttcggaatctcttgatcattaataatgtttttttaaaatatgggcctcatgaagtgag

SEQ ID NO: 45530 - DNA, 201 bp, Homo sapiens
aagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgaggacatgaccttgtccttagttataacctattgaggactgactcaggaacctgg

SEQ ID NO: 45531 - DNA, 201 bp, Homo sapiens
tggatgaggacatgaccttgtccttagttataacctattgaggactgactcaggaacctggtctaggctcaagttaactcggcaaccacaaccccagtgcrgtgcctctttcctgtcagccaagagatccagaggaacggacctccaaggatgtctgcatgcttcagggagctaggcttatgctgacatagttcatcaggt

SEQ ID NO: 45532 - DNA, 201 bp, Homo sapiens
gtccttagttataacctattgaggactgactcaggaacctggtctaggctcaagttaactcggcaaccacaaccccagtgcggtgcctctttcctgtcagycaagagatccagaggaacggacctccaaggatgtctgcatgcttcagggagctaggcttatgctgacatagttcatcaggtttaaaaagtgctggaatta

SEQ ID NO: 45533 - DNA, 201 bp, Homo sapiens
acaaaatcagtttttctttctatgcttttttccctaaatttaccacaacagtaaccacagcatatacatatatgtacatgcatacacacacacacacacamacaaacacacacaaacacacacaagagaaagacattttcaaattgtactgaaaaatattgttactatagaaatccacatgaacatgatgagtacccaccc

SEQ ID NO: 45534 - DNA, 201 bp, Homo sapiens
tccttagttataacctattgaggactgactcaggaacctggtctaggctcaagttaactcggcaaccacaaccccagtgcggtgcctctttcctgtcagcsaagagatccagaggaacggacctccaaggatgtctgcatgcttcagggagctaggcttatgctgacatagttcatcaggtttaaaaagtgctggaattat

SEQ ID NO: 45535 - DNA, 201 bp, Homo sapiens
aattcagccactgtattgaaactgttgagcccagagttagctcctcagtgaggtgaatctgtaagtgatacgcggttctgtgctttgttattggagctgarggctccttaagcctcagcaggctcaataaagaagtgttgcttcagcaatatgacaagattaaggtacaaggactagactcttttctaggatgcgaaagtg

SEQ ID NO: 45536 - DNA, 201 bp, Homo sapiens
gagtctcgttctgtcatccaggctggagtgcagtggcatgacctcggttcactgcaacctctgcctcctgggttcaagcttttcttctgccttagcctccmgagtagctgggattacaggcacacaccatcacacctggctattttttttgtatttatagtggggtttcaccatgttggccaggctggtcttgaactccta

SEQ ID NO: 45537 - DNA, 201 bp, Homo sapiens
caaaaccctgtctcaacaacagcaacaaaaaaagtccctgctacctagggttgttgtgcaaattaagagttgttggccgggcggggtggctcacgcctgtwatcccagcactttgggaggccgaggcaggtggatcacgaggtcaggagatcaggaccatcctggctaacatggtgaaaccctgtctctactaaaaaatac

SEQ ID NO: 45538 - DNA, 201 bp, Homo sapiens
catttcttacctgtgctgtttttcaacatgctgtaatagtcatctcgataatcttccctgcttgcttctaccattaaacccagtttataaagtatgactcraattatacttgaagtctgtgctgattaaccccagacatgtgatgacccctaatctagtgctcatgatctccgtacttggatcccattgaaggggtcgtgg

SEQ ID NO: 45539 - DNA, 201 bp, Homo sapiens
gtccctggccagagtggtggctcatacctgtaatcccagcattttgggaggcctaggtgggaagatcacttgagcccaggagttcgagaccgagaccaacytgggcaacgcagggagacccctccccccaacccaccctaccaaaaaataaagtaggcaggtgtgatgcatgcttgtggctgcggctactcaaaaggctga

SEQ ID NO: 45540 - DNA, 201 bp, Homo sapiens
gttttatataccagtgaaaactgaacctgatcttaatagcctttcaggttttttgtttttttgagacagggtctcactctgccacacaggctggggtgcaktggttgcaaccaaagcccactgtaacctggaactgctgggctcaagtgaccctcctgcctcagcctactgagtagctagaagcacaggcatgtggcacca

SEQ ID NO: 45541 - DNA, 201 bp, Homo sapiens
agagcatagggcgttaatagctaaagggtacagggttaattttgggggtgatgaaaatgttctgaaattgattgtggtgacggttggataacactgaatakactaaattgtttaattatgtactttaaacggatgaattgtatggtatgtgaattacttctcaactgaaggccaggcatactggcttatgcctgtaatccc

SEQ ID NO: 45542 - DNA, 201 bp, Homo sapiens
ttggaagtcgtcacttctgtgaaatgtagaagatggattggtttaaaatttagggtgtagagtcaaaccaatgtgagtttcagttccagctctaccatgtrgcagcattgcatcttaggctacttaacctttgtgagcctctgatcacatgatttagtgcccacctcaccaggctgttgtgaggaataaatgaggcagtat

SEQ ID NO: 45543 - DNA, 201 bp, Homo sapiens
acatggacaattgtagtgccttctccctctcagcactgtggctttgcatccactcaggtttttgggatttccttacacattttttcatataaactcaggargttcccaagggaacacactccaagaattagatgaaaaactctgcagaaaaatccacctcacatgaaaatctctgtatttaatatttttaaaaaattacca

SEQ ID NO: 45544 - DNA, 201 bp, Homo sapiens
ggctttgcatccactcaggtttttgggatttccttacacattttttcatataaactcaggaagttcccaagggaacacactccaagaattagatgaaaaamtctgcagaaaaatccacctcacatgaaaatctctgtatttaatatttttaaaaaattaccactgtgtttgttgcagctgtgacctctacaagttccagag

SEQ ID NO: 45545 - DNA, 201 bp, Homo sapiens
gctttgcatccactcaggtttttgggatttccttacacattttttcatataaactcaggaagttcccaagggaacacactccaagaattagatgaaaaacwctgcagaaaaatccacctcacatgaaaatctctgtatttaatatttttaaaaaattaccactgtgtttgttgcagctgtgacctctacaagttccagaga

SEQ ID NO: 45546 - DNA, 201 bp, Homo sapiens
aatagagcaaaagcacttttaaacagatgttttgggcgtttttattccctggatgcaaacctactgaaagcaagtaaaggtactagttgtctatagggtaggcaataggaagccatgctggagtttaaaactgaagtgcagaaaatccaccctagcttcagatatggataatttagtaaggtcttccggtgtgtcacaaaa

SEQ ID NO: 45547 - DNA, 201 bp, Homo sapiens
tttcttaagaagacagtttacatcaaaataacccaaagctggctggatgtggtggctcacgcctgtaatcatcgctttggaaggctgaggcaggtggatckcttgagttcagaagttcgagaccagcctgggcaacatagcaaaaccccgtctctacaaacaatacaaaacattagccaggtgtggtggcacacgcctgta

SEQ ID NO: 45548 - DNA, 201 bp, Homo sapiens
agagagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggcta

SEQ ID NO: 45549 - DNA, 201 bp, Homo sapiens
gagagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggctac

SEQ ID NO: 45550 - DNA, 201 bp, Homo sapiens
agagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggctaca

SEQ ID NO: 45551 - DNA, 201 bp, Homo sapiens
tggtatcttttgagatgacaccaaaattaaaatttggagcattaaaaataaaactaaattttactttacaaacaagagcaaagagatttggctaagccttwacttacactgccttccaaagcatagttttgctgaaggaatgaatgaatgaatgaatgactttattacaccagaacaatttactgtctgttctatagtgtg

SEQ ID NO: 45552 - DNA, 201 bp, Homo sapiens
aaacagccaaactcttttggcgtgtactttgggatcataaattctacttaaaaggaagttgtttccttcctctgatatttgcctattttggtggagacaargaaattaaatacttgccacccataatgagtgctcatctcaagaacagtatatagaagatgttgaataaattttaattgaaatgaatttgttggctggttg

SEQ ID NO: 45553 - DNA, 201 bp, Homo sapiens
gagtgctcatctcaagaacagtatatagaagatgttgaataaattttaattgaaatgaatttgttggctggttgaatgaatgaatgaataaaataaagtgstaaatgcccagagttcacagcaaaaagtcagactctcctcttcacagctctgtttactactctcttccccccttccccatccccttcaattcttcacagt

SEQ ID NO: 45554 - DNA, 201 bp, Homo sapiens
tcagccacatcccacagccagcagcccaggccctcctccccctcacaccaattggaggcctgtttggctggctctttgctttagaaaaacctggctctgakaacggcttcagcctcgcaggtgagtagggcctctgagaaggccggtagtcagcattgctttggcagtggtgctccttggggcactgtctttaggccttta

SEQ ID NO: 45555 - DNA, 201 bp, Homo sapiens
gatagacatgaggcagaacagcctttgtttatatttggcagtagttgtggcttcctagtattgagaagctctaaaaacatttcttgctttttgtttttggraaagtcaagctttgctgatgaacaatcaacaactggaacaataacaaataaactaggcacctgttactttgtgaattgaatgaatgaaaaaagcaaagca

SEQ ID NO: 45556 - DNA, 201 bp, Homo sapiens
tccaggaggaggtggtaaaatgggtggtactgccagtgtctgcctacagatgccatgatgctggtgtctgtgagtagtgagaactggtgagcaggatgggmctcagaggatgctaagctggctatcaagacagggcctcaggcacagaagtatgaggcagaagcctgagttattacaacttagatggatctccctttgtag

SEQ ID NO: 45557 - DNA, 201 bp, Homo sapiens
aagtgtgttacatctatatttctttatcctattagcaaaacctcaaaaccttactttgaaattaaacattgaaaggaaaaattaacattagaaaagagctrgaacaactgtgggagtagacttagaacaaagggaagagcccattccttccttgctgtttccttcagtgaaatgtgatgttcttctctgtgcccgagtttg

SEQ ID NO: 45558 - DNA, 201 bp, Homo sapiens
aaatacaaaaaattagtcaggcgtggtggtgggtgcctgtagtcccagctactcaggaggctgaggcaagagaatggcgtgaacctgggaggtggagcttkcagtgagctgtgatcgtgccactgcactccagcctgggcgacagagcgagactccgtttcaaaaaaaaaaaaaaaaaaaggttgttaaatgtaaagcttg

SEQ ID NO: 45559 - DNA, 201 bp, Homo sapiens
gaggatgctaagctggctatcaagacagggcctcaggcacagaagtatgaggcagaagcctgagttattacaacttagatggatctccctttgtagcagaratggctcaatgtagaacctgacaggcttagctggggctctggaaatcttttgagtctaagattagagttaattctagggactgaggttgagctagaacct

SEQ ID NO: 45560 - DNA, 201 bp, Homo sapiens
tctttgcacagctcttacacatccaccccactaagtaatttacttgtttattgactgctgctggggagaatgtaagcttcaggatgtgaatttttgtctcytttgctccctgccatgtcctcagtttctagactaggtacaggtctatagtgaatgctcagtaaatacttgttgaattagtgaatgaatgaacaaaaattg

SEQ ID NO: 45561 - DNA, 201 bp, Homo sapiens
gaagtacattaagaagaaatgcgacttctggcaatgcaggggtgaggaagaggtgttctacttattttagagatgaggaagctgaaagacacagtttgcayagtttccacaaagcccccgagggagggctgaggttgagtcctagagcttggcgctttctgcagcccctcattccttgagctctgggagaaagtcctgatg

SEQ ID NO: 45562 - DNA, 201 bp, Homo sapiens
gcatagggcgttaatagctaaagggtacagggttaattttgggggtgatgaaaatgttctgaaattgattgtggtgacggttggataacactgaatatackaaattgtttaattatgtactttaaacggatgaattgtatggtatgtgaattacttctcaactgaaggccaggcatactggcttatgcctgtaatcccagc

SEQ ID NO: 45563 - DNA, 201 bp, Homo sapiens
cagcctgtgcaacagagtgagactccgtctcaaaaaataaaaataaatggaagcaaatagtagtagaaacaaaactctaaaaccattctcatcgggtacartggcttacacctgtaatcccagctactctggaggctgaggtgggaggatcacctgagcccaggagtttgaggccagagttggccacataacaagaccccg

SEQ ID NO: 45564 - DNA, 201 bp, Homo sapiens
ctgttatcagttgtctattgctgcataacaaattatcccaaaatgtaatagcttaaagcaacacacagcttcttcagcttctgaagctgaagctgtaattmtcagttttggttggtctggaatcccaccaaaactataattataatctaaccaaaactataattctcagttttggtgggtctggaatctgcacctggctta

SEQ ID NO: 45565 - DNA, 201 bp, Homo sapiens
tcatgaagttcaacctaacatgtacttactggtttgctttcattttactgcactcaaacccacgggtgcagtctcatcttagttcaccaactctgcaatgrgacccagccgggagcagtaagcaattcttcttgccagcagacaaagcagattaattcccttgggttgaatgttatgccggtctcttaaacatcaaaaact

SEQ ID NO: 45566 - DNA, 201 bp, Homo sapiens
cagagcatgagaaattcacaggagatactacaacaaaatggctggaaaagtcaagggagtagagaatttctagaaatgagtggtcagtaggatcagaaacwaaaaggcccagtaagataaaaacaaaaactacctatagggtttggtaatatgattttgctgttggtctttccctgagcagttcagtgatggggttgggaa

SEQ ID NO: 45567 - DNA, 201 bp, Homo sapiens
catcattcccgggcttattgcaccctttacctgaacaatatggggtttctaaaaccaaaaaaaaaaaaaaaaaaaaaaaaagaggggatggctgttgggaraggttccaatagtgtctgccacaccaaccctctctctacttaaaaatgtcacagcagaattgcatctgcagtgattcatatcaaaagcttgaacagtctt

SEQ ID NO: 45568 - DNA, 201 bp, Homo sapiens
ccctgtatctaaataatcttacttttcaagcaatgctgtgatgtaccctgaggatccaatccaagaagggtaaaaactgctacagacgtcctctataaccyccagcctgaaaggggcctctgcctcttcagccagtctggcaggtcatggaaattctactcttgcaaagagagctgtggatacaagcaaagtatttcttca

SEQ ID NO: 45569 - DNA, 201 bp, Homo sapiens
gccattctcctgcctcagcctcccgagtagctgggactacaggcgcccaccaccacgcctggctaattttttgtatttttagtagagatggggtttcaccrtgttagccaggatggtctcagtctcctgacctcgtgatccgcctgcctcggcctcccaaagtgctgggattacaggtgtgagctgccgggcccagccaaa

SEQ ID NO: 45570 - DNA, 201 bp, Homo sapiens
tcaattcagccactgtattgaaactgttgagcccagagttagctcctcagtgaggtgaatctgtaagtgatacgcggttctgtgctttgttattggagctragggctccttaagcctcagcaggctcaataaagaagtgttgcttcagcaatatgacaagattaaggtacaaggactagactcttttctaggatgcgaaag

SEQ ID NO: 45571 - DNA, 201 bp, Homo sapiens
aaatgtacaattaagttattattgactataataacctgttatcacaggttatagtcaccctgttgtgctatcaaatggtaggtcttattcattccttctatttttttttttttggtacccgttaactgtgtccaccttcccctgacccctactacccttcccagcctctggtaaccatcctgttactctctatgttgcata

SEQ ID NO: 45572 - DNA, 201 bp, Homo sapiens
tacttttcaagcaatgctgtgatgtaccctgaggatccaatccaagaagggtaaaaactgctacagacgtcctctataacctccagcctgaaaggggcctytgcctcttcagccagtctggcaggtcatggaaattctactcttgcaaagagagctgtggatacaagcaaagtatttcttcagtatttactttgactggtg

SEQ ID NO: 45573 - DNA, 201 bp, Homo sapiens
atctgtcttcccatgctgatgtgtctctaccatgggctgcaccgtattgatgcaacacattctcattttctaggtttcacactgatcacaccatcccacattttttttttttctattcacacattttaaagaaacttggttattactatggatggaactactgctttgttttattttcagccaagccttaatcggacctac

SEQ ID NO: 45574 - DNA, 201 bp, Homo sapiens
cccggaagacttagacccaagtaaccctggatatgagcttcatgccgcctttattacaagcaggttttttacaggcagaaaagggggacagggagtaggcygatatgaaattgtttgtaaggaattcacattggtttacagaaacaacattgctcactgattggctatgcactgttaagctataggctatgagtgatagtg

SEQ ID NO: 45575 - DNA, 201 bp, Homo sapiens
ggctatgagtgatagtgtccagtgtgacattattaggttaatgtatagttacttgtggcaatagcaagcagtttcaaggatgaatacatagctcaaaaggrggcagtagtgttactggaaagagttcctgatccagaccctaagagagggctcctggatctggtgcaagaaagaatttggagtgagtctacaaagtaaagt

SEQ ID NO: 45576 - DNA, 201 bp, Homo sapiens
tgcctggctaagttttttagaaaagggttttgtagaggcagggtctcactatgttgcctagactggtctcaaactcctgggcttaagtcatcctcctactwtggccttgcaaagtgctgggattataagtgtgagccaccatgcccagctgtctttccgttttaaaataagttgttcaccttctaggaaggtgggtgaatg

SEQ ID NO: 45577 - DNA, 201 bp, Homo sapiens
tgaactcctggcttcaaactatcctcctacctcagcctcccaaagtgctgggattacaggcatgagccaccatgctcagccaaaatagatttctctagggragatttcagtcgttaagtaatcgctacctagtgagtagatggatccttggtaaggctactcctgaagagtaaatactgggaaagtcattcctgtttagtc

SEQ ID NO: 45578 - DNA, 201 bp, Homo sapiens
agccttaaaatcaggattatttactataaaagattaaaaacaaacaaaaacttacaaccctgcaaacgtataattacaaacatatttgtgaacatacaaawacatttttaacttttcggtagcaacaaatctcttagtttttaaaactgctactcacaagagaaaaaagaaagccctgtagactatcaacaattaaataaa

SEQ ID NO: 45579 - DNA, 201 bp, Homo sapiens
ttaaaaacaaacaaaaacttacaaccctgcaaacgtataattacaaacatatttgtgaacatacaaaaacatttttaacttttcggtagcaacaaatctcktagtttttaaaactgctactcacaagagaaaaaagaaagccctgtagactatcaacaattaaataaattggtaagataaaatggttttcctattactgta

SEQ ID NO: 45580 - DNA, 201 bp, Homo sapiens
tgagataggaggattgcttgagcgcaggaggcagaggttgcagtgaactgacagcatgctagtgcattccagcctaggtaatagagtgagactctgtctcaaaaaaaaaaaacaaaaaaaacaacaaaatctctcaaagctatggctcagtttcagccctgtttattttcactgtttttccctaaatagatatttttggtg

SEQ ID NO: 45581 - DNA, 201 bp, Homo sapiens
aagtgctgatgacattgggaaaagattcagtttttacccagtaaaatattaaaaacttattttgcttaaggccatgtcctctaattactgaaggggctgatttttttttttttttaaatcatcagtcataatagcacctattgaagggcttactgtatgccaattactgattaggacactttacaagcacttatagtatta

SEQ ID NO: 45582 - DNA, 201 bp, Homo sapiens
tgccattggcttagactagataacttcatgaagttccttcagtgagggttgcagcaaagcggtggaaagcatgagctatggaaccagactgctagactttyattccagctccatccacctcttctgactgtgtaaccctgggcaggttatttggcctctctgtgatgcagcagaagtggagatagtattttcctcaccatg

SEQ ID NO: 45583 - DNA, 201 bp, Homo sapiens
atttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggcca

SEQ ID NO: 45584 - DNA, 201 bp, Homo sapiens
ttcagtgagggttgcagcaaagcggtggaaagcatgagctatggaaccagactgctagacttttattccagctccatccacctcttctgactgtgtaaccstgggcaggttatttggcctctctgtgatgcagcagaagtggagatagtattttcctcaccatgtagttagaaggatgtaatcaggcatcctcctatctgt

SEQ ID NO: 45585 - DNA, 201 bp, Homo sapiens
cggtggaaagcatgagctatggaaccagactgctagacttttattccagctccatccacctcttctgactgtgtaaccctgggcaggttatttggcctctytgtgatgcagcagaagtggagatagtattttcctcaccatgtagttagaaggatgtaatcaggcatcctcctatctgtttagaacaatgcctcacacata

SEQ ID NO: 45586 - DNA, 201 bp, Homo sapiens
ttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagt

SEQ ID NO: 45587 - DNA, 201 bp, Homo sapiens
cttcaaactatcctcctacctcagcctcccaaagtgctgggattacaggcatgagccaccatgctcagccaaaatagatttctctaggggagatttcagtygttaagtaatcgctacctagtgagtagatggatccttggtaaggctactcctgaagagtaaatactgggaaagtcattcctgtttagtcttagaaatctt

SEQ ID NO: 45588 - DNA, 201 bp, Homo sapiens
tagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagtt

SEQ ID NO: 45589 - DNA, 201 bp, Homo sapiens
gagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagttta

SEQ ID NO: 45590 - DNA, 201 bp, Homo sapiens
tggcgacagagtgagactccatctcaaaaaaaaaaaaaaaagaaagaaaatgcactctttaattcagtgggatgagggtaaaagtgataggagaaactgcktgtgtgtgtgtgtgtgtgtgtgtgtgtgtgtgtgtagcaattgctctggagtgttataaactttaattgaggactgcttaggtgatgggtttttgtgctt

SEQ ID NO: 45591 - DNA, 201 bp, Homo sapiens
tccacaaagcccccgagggagggctgaggttgagtcctagagcttggcgctttctgcagcccctcattccttgagctctgggagaaagtcctgatggcccytaagccatgagcacactggtgagtgtgtgagtccctcctgtagctgcttccttacacttagttgtgaatttctgagctggagaaacctgagattttgaca

SEQ ID NO: 45592 - DNA, 201 bp, Homo sapiens
caaaaaaaaaaaaaaaagaaagaaaatgcactctttaattcagtgggatgagggtaaaagtgataggagaaactgcgtgtgtgtgtgtgtgtgtgtgtgtgtgtgtgtgtgtagcaattgctctggagtgttataaactttaattgaggactgcttaggtgatgggtttttgtgcttagtattttaacagcaaattcatac

SEQ ID NO: 45593 - DNA, 201 bp, Homo sapiens
tcagtgagccgagatggcaccactgctctccagcttgggtgacagagcaaaaccctgtctcaacaacagcaacaaaaaaagtccctgctacctagggttgytgtgcaaattaagagttgttggccgggcggggtggctcacgcctgtaatcccagcactttgggaggccgaggcaggtggatcacgaggtcaggagatcag

SEQ ID NO: 45594 - DNA, 201 bp, Homo sapiens
gatggttagacataagacatttgttagcttctctattatgtcttcctctcaggatgtgtttaggttgaaccatataaaagtgctgatatttagcccttttkgacccacaaaaatagtggtttcatgaagttcaacctaacatgtacttactggtttgctttcattttactgcactcaaacccacgggtgcagtctcatctt

SEQ ID NO: 45595 - DNA, 201 bp, Homo sapiens
aatgggagacagtattttaaatcatgtgatatttgttctagagtatacgaagtactcttacaactcaataaaaaaacaagctaactaaaagatgggcaaargctctgcaaggacctctctccaaaaagatatacagatacccaatgggcatgtgtaaagatgctcagcatcattagtcatcagggaaatgcaaatcaaaac

SEQ ID NO: 45596 - DNA, 201 bp, Homo sapiens
ggaggctgaggtgggaggatcacctgagcccaggagtttgaggccagagttggccacataacaagaccccgtctcaaagtaagcagtggttctcaaatttyaatgaccattagcctcacctgtgaagactgattttaaaatgttctaggcatatcatgtcacagaaagacatgcaggaaacttaaaagcatgttgctctgt

SEQ ID NO: 45597 - DNA, 201 bp, Homo sapiens
ctgaaaaccttaagtgaaggtagtcagtgacaaaggacagcatactgaatggttacaattatgtgaaatatccaaaataggcaaatccacatacatagaargcatattcatggttgcccagggctaagagataatgagagcatagggcgttaatagctaaagggtacagggttaattttgggggtgatgaaaatgttctga

SEQ ID NO: 45598 - DNA, 201 bp, Homo sapiens
tgggaatggaactagaggcttgataagaagggaggcctgcctaaaataacatgttagcacactcagccccctcaccatgtgatgtcctgcaccacctcagscctctactgagagtcccaaccagcaggaaggccatcaccagatttcaacccttgaccttagacttctcagcctttagaactataagaaataaattccttt

SEQ ID NO: 45599 - DNA, 201 bp, Homo sapiens
tttggtggggtatgccaggcattttgtacagaatcttcctaaaatggagaaatgatggggatgatcacgttcttgtcttacattgggtcctaatggatgargacatgaccttgtccttagttataacctattgaggactgactcaggaacctggtctaggctcaagttaactcggcaaccacaaccccagtgcggtgcctc

SEQ ID NO: 45600 - DNA, 201 bp, Homo sapiens
taatcgctacctagtgagtagatggatccttggtaaggctactcctgaagagtaaatactgggaaagtcattcctgtttagtcttagaaatctttaaaaarcaagatttttaaaattaattggatttacctataaaaattgggaattttagtaagagatcaacagatttagaaccaggaagttggagtctgagtctttgct

SEQ ID NO: 45601 - DNA, 201 bp, Homo sapiens
ctgagtctttgctgtgccacttcctgactttgtgagcttgggcaatttttcccatgtctcactcgatttccttatctgtgaaaattacacataatggggamaacaactcaccacatagaatcatcccaagaatcacaggaaataatagagcaaaagcacttttaaacagatgttttgggcgtttttattccctggatgcaa

SEQ ID NO: 45602 - DNA, 201 bp, Homo sapiens; identical to SEQ ID NO: 8599

SEQ ID NO: 45603 - DNA, 201 bp, Homo sapiens
taagagatcaacagatttagaaccaggaagttggagtctgagtctttgctgtgccacttcctgactttgtgagcttgggcaatttttcccatgtctcactygatttccttatctgtgaaaattacacataatggggacaacaactcaccacatagaatcatcccaagaatcacaggaaataatagagcaaaagcactttta

SEQ ID NO: 45604 - DNA, 201 bp, Homo sapiens
ggaggattgcttgagcgcaggaggcagaggttgcagtgaactgacagcatgctagtgcattccagcctaggtaatagagtgagactctgtctcaaaaaaamaaaacaaaaaaaacaacaaaatctctcaaagctatggctcagtttcagccctgtttattttcactgtttttccctaaatagatatttttggtgttgagtt

SEQ ID NO: 45605 - DNA, 201 bp, Homo sapiens
taacagttattgcagatgttattaaatagtctggttgccaaacagttaatatactgatgcttgtacttggcaaacgtactaagatgttttccatattatgytattgtttgaatgcctcttaaaataactcaaaagggacaaatgtgcagcaggactagaattttatagcattttgttgtagttgatttatactttatcccc

SEQ ID NO: 45606 - DNA, 201 bp, Homo sapiens
attgcttgagcgcaggaggcagaggttgcagtgaactgacagcatgctagtgcattccagcctaggtaatagagtgagactctgtctcaaaaaaaaaaaamaaaaaaaacaacaaaatctctcaaagctatggctcagtttcagccctgtttattttcactgtttttccctaaatagatatttttggtgttgagttattga

SEQ ID NO: 45607 - DNA, 201 bp, Homo sapiens
ctttttctctttctttctttctttctttcccttccttccgttctttctttcttttctttctttctctttctttctctttctttctttctttctttctttckttctttctttctttctctttctttctttctttctttcttttctttctttctttctctttctttctttctttctttctttctttctttctttcgagataag

SEQ ID NO: 45608 - DNA, 201 bp, Homo sapiens
caggtgcttcccccagtgtattggttatctattgctgtataataaattaccctaaaatgtagcagcttcaagcaatagacatttaatatcagtggtccagrgacctgggaatggctcagctgggtcctgtgctttaggatctctcacaaggccacagtcaaagtgtctggtgggtcagtggtctcatctgaaggcttaact

SEQ ID NO: 45609 - DNA, 201 bp, Homo sapiens
gtctgggaaattttaagctcttgataataaaaatggtaataaaatctcctccagctcctgaggcttcgcagaggggatgtttatggtggatggggttcccyttctcctgcgcagctggtttcgaggttgtgcggtttccagtcctgcggagcagctcaggttaccgcctccgtggccgcgggggagggcatctccgacggc

SEQ ID NO: 45610 - DNA, 201 bp, Homo sapiens
gctgggggttggcatatatgccttaaccacaaaggagaaaggtgatttatgcaaacatacagtacataataaaaattctactttcctaaactttattaaaraaaaaagcaataagcaatggtggtaaatctctagaacatacccaattttctgggcttcctcccccgagaatgtgacattttgatttccaaacatgccaga

SEQ ID NO: 45611 - DNA, 201 bp, Homo sapiens
atgtgcagcaatcgcagaatttgagcagcttcattaagaactgcatctgttttatgagaaaagaacactgcttcaatacataatttttacatttaaggccatttatttatttcctcccaagtattcagtctgtaaaaaaaatagtttgaatttaaacaaaatcacttacctcctgtgtcaaaaccaagaatatgtttgtct

SEQ ID NO: 45612 - DNA, 201 bp, Homo sapiens
tgtgcagcaatcgcagaatttgagcagcttcattaagaactgcatctgttttatgagaaaagaacactgcttcaatacataatttttacatttaaggccatttatttatttcctcccaagtattcagtctgtaaaaaaaatagtttgaatttaaacaaaatcacttacctcctgtgtcaaaaccaagaatatgtttgtcta

SEQ ID NO: 45613 - DNA, 201 bp, Homo sapiens
ccatccctgctcaacagcatgctcctggagtctccagccaactccacctcctggggatgtggaggcagaggtgtgtgcagccgcttggcctcctggtggcmatgcttgggattggcatatttcctagtgccccggagaaagcaccctcctgtccatccacaacccccgccacaccctacccccttggctatttcctttatg

SEQ ID NO: 45614 - DNA, 201 bp, Homo sapiens
gactctttattttttaatttttgagggtacatagtaggtgtatatatttatggggtacatgggatgttttggtacaggcatgcaatacgtaataatcacawcttggagaatggggtatccatccccccaagcatttatcctttgtattacacacaatctaattacactcttagttatttaaaaatgtacaattaagttatt

SEQ ID NO: 45615 - DNA, 201 bp, Homo sapiens
acttgccatttaatatctatagggaaaggcctcttaatatctgagaatgtattttctcatctttcacatggaactaaaaatgctttttctatattatgtgrtcaatgtgtgcgaagcgtgatgtgttctgtgaaagtactacctgcgcacaggatgctgcctccatcacagctgctgttgtgcagcacagcaatccggatt

SEQ ID NO: 45616 - DNA, 201 bp, Homo sapiens
agcacggtgccatccagggacaggtgtagattacacctgtgagtgcgcatctgggtaccagggagatggacggaactgtgtgggtaagagccatgttctcstgtctccttcttgtagcccttgtttttcctctgccctccccagccttatgtctgtagaagacaagtatctgtcacctttacaacctccattgtcaatgat

SEQ ID NO: 45617 - DNA, 201 bp, Homo sapiens
aataaaactaaattttactttacaaacaagagcaaagagatttggctaagcctttacttacactgccttccaaagcatagttttgctgaaggaatgaatgwatgaatgaatgactttattacaccagaacaatttactgtctgttctatagtgtgggtgaaataagctgatctttaacccaacttccagtggctcgattca

SEQ ID NO: 45618 - DNA, 201 bp, Homo sapiens
caaatagtagttataaatgcttataagtacactagactgtaagaactccactaaattgttataggctggtatcttttgagatgacaccaaaattaaaattkggagcattaaaaataaaactaaattttactttacaaacaagagcaaagagatttggctaagcctttacttacactgccttccaaagcatagttttgctga

SEQ ID NO: 45619 - DNA, 201 bp, Homo sapiens
agaatggaaaggtaatgatacttaccagtaaataatatttctaagagtcacattatttgtgaagtaagttgtgttttaaaaataccttcccagttccttactaaattgtaaaagtagtgtgatttagtgagagagagacagtttcagaagcctaaacataacagctttttgagaatcaagcactgttcacagatctttagg

SEQ ID NO: 45620 - DNA, 201 bp, Homo sapiens
ttgagcgcaggaggcagaggttgcagtgaactgacagcatgctagtgcattccagcctaggtaatagagtgagactctgtctcaaaaaaaaaaaacaaaamaaacaacaaaatctctcaaagctatggctcagtttcagccctgtttattttcactgtttttccctaaatagatatttttggtgttgagttattgaaggat

SEQ ID NO: 45621 - DNA, 201 bp, Homo sapiens
gagttcctgatccagaccctaagagagggctcctggatctggtgcaagaaagaatttggagtgagtctacaaagtaaagtgaaagtgactttattagatargtaaagaaacaaaagaataggcagagcagtggcgtcggctgcttgactgattatacttatggttatttattgattataagctaaatggggtggattatta

SEQ ID NO: 45622 - DNA, 201 bp, Homo sapiens
gaattaaaacttttgtctggtccttttctggggtgggggaggtttagggtagaagagatttgtaaattccatctctcttttacttttctaattaaaatccmcctgcagacattaccatttgctagttggcttcagaatgtttcattaagaaaactagaaataccatttgacccagccatcccattactgggtatataccca

SEQ ID NO: 45623 - DNA, 201 bp, Homo sapiens
gtgcagcaatcgcagaatttgagcagcttcattaagaactgcatctgttttatgagaaaagaacactgcttcaatacataatttttacatttaaggccatttatttatttcctcccaagtattcagtctgtaaaaaaaatagtttgaatttaaacaaaatcacttacctcctgtgtcaaaaccaagaatatgtttgtctaa

SEQ ID NO: 45624 - DNA, 201 bp, Homo sapiens
ctgtactccagcctggcgacagagtgagactccatctcaaaaaaaaaaaaaaaagaaagaaaatgcactctttaattcagtgggatgagggtaaaagtgayaggagaaactgcgtgtgtgtgtgtgtgtgtgtgtgtgtgtgtgtgtgtagcaattgctctggagtgttataaactttaattgaggactgcttaggtgatg

SEQ ID NO: 45625 - DNA, 201 bp, Homo sapiens
aagcatgatctccattatgtgcctggccaggtttcctgttccaagaatgtaggtagatgttgggtatggtatggtaaaatcagtgtggttataggaggagrcaaggatgaagcttgaaaggaagtagtttattacacttacaggtctggagtgggttcaccacatgccacacaggggtacaatcagcagggtgcccaattg

SEQ ID NO: 45626 - DNA, 201 bp, Homo sapiens
tgcagcaatcgcagaatttgagcagcttcattaagaactgcatctgttttatgagaaaagaacactgcttcaatacataatttttacatttaaggccatttatttatttcctcccaagtattcagtctgtaaaaaaaatagtttgaatttaaacaaaatcacttacctcctgtgtcaaaaccaagaatatgtttgtctaaa

SEQ ID NO: 45627 - DNA, 201 bp, Homo sapiens
cctcagtctccctatctcagtaactggcagctccacccttttggtttcccacatcaggactgaacatcatcccacatccagtctaccagcaaaccctctcrgttccaccttcagaatatcccagacctgggcccttcttatcccctgtaccagcacttcttaccaccaagggaccagctcctgtctgatttactgtagtcg

SEQ ID NO: 45628 - DNA, 201 bp, Homo sapiens
ggtgactatggtgatgccaaacttcacagaaacaaattctaaaatgaggacagtctgtacttcctgctgattatataaaatcactgccaagaaaaacacastacccgtactttcaatctttcaatgttacaacctgttactattcaaatgctttagtcactgctcaattcttgccttatctagtaatgtaaatctacgtag

SEQ ID NO: 45629 - DNA, 201 bp, Homo sapiens
caaggcttaaatgacttacatggcatgtccttagaacagtgcatggaacataaaatgagctctattatgttattactcttattgttaccatgaaatatatygtgtaagtgagcagaatggctgctatacataagaatatctatatccctacatagtattttcaaataataaaatcaatagcaacattgtccatggggtggg

SEQ ID NO: 45630 - DNA, 201 bp, Homo sapiens
gagtcacaggcagtaacataagacagatgagtgcaaggttgcccgctatggttgaatatttgtcccctctgaaaatcatgttgaaacttaatcctcaatgwgacagtattgagaggtggggcctttgaaaggtgactgggtcatgagggctctgccctcaggaatggattaatttattcattcatggattactggattatc

SEQ ID NO: 45631 - DNA, 201 bp, Homo sapiens
agaacatcacttaccaggtgtgcaggcacgcccccagacacccgtccttccccaccacccagcagctgaacgtggaccgggtctttgccttgtataatgaygaagaaagagtgcttagatttgctgtgaccaatcaaattggcccggtcaaaggtaaggtttccttttttgttgttgggtaaaaatgacatccttttaagt

SEQ ID NO: 45632 - DNA, 201 bp, Homo sapiens
atagtttgaatttaaacaaaatcacttacctcctgtgtcaaaaccaagaatatgtttgtctaaagcaacaggtaagccctttaaaaaaagaaagacaaaaygagagtatttatggttaagaatagcatcctttcctcaactgaaactgaaaagcacctagctattctggtgtcttaactcttttagctgcatgggcaaggg

SEQ ID NO: 45633 - DNA, 201 bp, Homo sapiens
ttccgaggactcctctatctccgtgacatttgcttaccaatagccagattgtgcttttatttcccctctactcatgcagaggattcagaccccactccggkgaatccttgctatgatgggagccacatgtgtgacacaacagcacggtgccatccagggacaggtgtagattacacctgtgagtgcgcatctgggtaccag

SEQ ID NO: 45634 - DNA, 201 bp, Homo sapiens
aaaaggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctg

SEQ ID NO: 45635 - DNA, 201 bp, Homo sapiens; identical to SEQ ID NO: 8615

SEQ ID NO: 45636 - DNA, 201 bp, Homo sapiens
aaaggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctgc

SEQ ID NO: 45637 - DNA, 201 bp, Homo sapiens
gctgtgctttttgtggggaaagaggagtgttttgtttttgtcattttagggatggggttagagacagctgagttatatagatctctgtaatgtggggaatrttttgtttatctggaatttaagtcaggttgaaagggctaaaaagaatggatattgagaatgaggtatcaagagagattgttctgagcaaaaacatgaccc

SEQ ID NO: 45638 - DNA, 201 bp, Homo sapiens
tcctgcccctacagtgtcatggcagcactggtttctgctggtgcgtggaccctgatggtcatgaagttcctggtacccagactccacctggctccaccccrcctcactgtggaccatcaccaggtgagcttaggcctggggctcaagaagcagaatggcactggtggtaggtagatcataattcctgcccagaccacgcag

SEQ ID NO: 45639 - DNA, 201 bp, Homo sapiens
aaggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctgca

SEQ ID NO: 45640 - DNA, 201 bp, Homo sapiens
aggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctgcag

SEQ ID NO: 45641 - DNA, 201 bp, Homo sapiens
gggaaattctttgcacgttatgatgctttgcttgcattctgtttctttcttcttttatttgttttttacaggatgtttctctctctctctctctctttttytttttttttcctcacagctgaacactttccaggcagttttggcatctgatgggtctgatagctacgccctctttctttatcctgccaacggcctgcagtt

SEQ ID NO: 45642 - DNA, 201 bp, Homo sapiens
cgcccaggctggagtgtagtggtgtgatcttgtgctcattgcaacctctgcctcctgggttcaagcaattctcctgcctcagcctcccagtagctgggatwacaggcgcccaccaccacacccggctaatttttgtatttttcgtagagactgggtttcatcatgttggccaggctggtctaaaactcctgacctcaggtg

SEQ ID NO: 45643 - DNA, 201 bp, Homo sapiens
acataactctctgagtataaatgtccatgaaactaggattaggagtactttaaaatagaaatcattaaataaatcttaaatcacaaaaggttttccaaacwtaccctgtggtatgtgatcagattgaaactcagtttcacgtgagtcacacacacacagttagggtaaaacgacacactggggatgagagaatggtgggaa

SEQ ID NO: 45644 - DNA, 201 bp, Homo sapiens
gatcttgtgctcattgcaacctctgcctcctgggttcaagcaattctcctgcctcagcctcccagtagctgggattacaggcgcccaccaccacacccggstaatttttgtatttttcgtagagactgggtttcatcatgttggccaggctggtctaaaactcctgacctcaggtgatcctcctgcctcagcctcccaaag

SEQ ID NO: 45645 - DNA, 201 bp, Homo sapiens
gcgcccaccaccacacccggctaatttttgtatttttcgtagagactgggtttcatcatgttggccaggctggtctaaaactcctgacctcaggtgatccwcctgcctcagcctcccaaagtgcagggattatgggtgtaagccaccatacccggcctgtttaaatgttttaaagtaagtcacaaacatcatgccagttca

SEQ ID NO: 45646 - DNA, 201 bp, Homo sapiens
ctttaaaacagctaacacatgtaagtctgaagaaaccaatgggtacgaaagcacaagtgagcaaaattaaagagcagaattgtactgagtggctttatatrttcatctagtaccagaggctccacttttttttcctttgccaacaggccaccaagctacccctgaaaactaccatatgcctcaaatagtagttataaatgc

SEQ ID NO: 45647 - DNA, 201 bp, Homo sapiens
cttccaccaatcttagggcatctgccagggctgaggaagcaacccatcattcccgggcttattgcaccctttacctgaacaatatggggtttctaaaaccaaaaaaaaaaaaaaaaaaaaaaaaagaggggatggctgttgggagaggttccaatagtgtctgccacaccaaccctctctctacttaaaaatgtcacagca

SEQ ID NO: 45648 - DNA, 201 bp, Homo sapiens
ttaaaaacactgatttccaagcgcctcctctaccttctgaaccagaaactgcatttttaagccacctcactccttcaacacctccaggcctctgcccaaaygtctttttctcccgaggtcttccctgaccatactatttcaaagagccaggtgcgcctgccctctctcaccctcttgtctgaccctgccatattcctctgc

SEQ ID NO: 45649 - DNA, 201 bp, Homo sapiens
taattcttctcttacctgtagatcctgatgtgaagcccttgggttttaaatacaatgtggggaaggtcagaacaagagagtgaaagctcaaatgcattcakgtaacaaagatttactgaggatctaagaggtgtcaggacctgttctaggaaaagacaaggtctgttctttcatggcacttatattttattaggaggaaac

SEQ ID NO: 45650 - DNA, 201 bp, Homo sapiens
actttacatcatgtggtcgagtataatcaaaaaacgggtaataacaagtgttggcgagaacatggaaaattcggaaccctcatacgttgctggtgtgattrtaaaatgatgtggctactgtgaaaaacaaaatagtggtttctcaaagtgaaacacaaagttaccatttaatggagcaattctactcctttctatataccc

SEQ ID NO: 45651 - DNA, 201 bp, Homo sapiens
ttcatggattggaagacttaatactgttaagatgtgaatacttcccaaattgatctattaattcaacataatccctatcagaatctcagctggctctttgmagaaattggcaagctgattctagaatttatatggaaattcaaagaacacagaatagccaaaacaatcttggaaaagaataaagtcagacttgtatttctc

SEQ ID NO: 45652 - DNA, 201 bp, Homo sapiens
tcatcagggaaatgcaaatcaaaaccacaatgagatactactttacatcatgtggtcgagtataatcaaaaaacgggtaataacaagtgttggcgagaacrtggaaaattcggaaccctcatacgttgctggtgtgattataaaatgatgtggctactgtgaaaaacaaaatagtggtttctcaaagtgaaacacaaagtt

SEQ ID NO: 45653 - DNA, 201 bp, Homo sapiens
ccacaccaggagaaaaaaaccatcttcctcaattcagccactgtattgaaactgttgagcccagagttagctcctcagtgaggtgaatctgtaagtgataygcggttctgtgctttgttattggagctgagggctccttaagcctcagcaggctcaataaagaagtgttgcttcagcaatatgacaagattaaggtacaag

SEQ ID NO: 45654 - DNA, 201 bp, Homo sapiens; identical to SEQ ID NO: 8600

SEQ ID NO: 45655 - DNA, 201 bp, Homo sapiens
atgtgtaaagatgctcagcatcattagtcatcagggaaatgcaaatcaaaaccacaatgagatactactttacatcatgtggtcgagtataatcaaaaaaygggtaataacaagtgttggcgagaacatggaaaattcggaaccctcatacgttgctggtgtgattataaaatgatgtggctactgtgaaaaacaaaatag

SEQ ID NO: 45656 - DNA, 201 bp, Homo sapiens
gttctaagcaccttacacgaattaactcatttaatccccacaatgacctctacccaatggtggggtgggggtggggttatttgttatcccattttacagaygatgagactgaggtatagaaatgaagtaatttgcctggtcatagtaagtgacctgggtgagctgggactcaaactcaggcactggctccagtacgcacac

SEQ ID NO: 45657 - DNA, 201 bp, Homo sapiens
cctgacaggcttagctggggctctggaaatcttttgagtctaagattagagttaattctagggactgaggttgagctagaacctcaaataatgatgaacaktggccccactgagaaggcagaaggagtgcagtcagtagagactgggtagacctgccaatggggaattgcctttcaaatatgttctgttgggttttcttaa

SEQ ID NO: 45658 - DNA, 201 bp, Homo sapiens
aaaagatgggcaaaggctctgcaaggacctctctccaaaaagatatacagatacccaatgggcatgtgtaaagatgctcagcatcattagtcatcagggaratgcaaatcaaaaccacaatgagatactactttacatcatgtggtcgagtataatcaaaaaacgggtaataacaagtgttggcgagaacatggaaaattc

SEQ ID NO: 45659 - DNA, 201 bp, Homo sapiens
taaaacttaaagtataataataatagaattctgatggttaaaagacaaaacaaaacaaaaaacacagtgccaaaacaattcaatggagaaagaatagtctyttaaactattgttaactatggtgctgggaccactgagtgaccacatacaaaagaatgaagttgaaccttttacctcacagcatatccaactcaaaatggg

SEQ ID NO: 45660 - DNA, 201 bp, Homo sapiens
caacttttgagctgagattttttttttttttttttcttttaatgcctagcagggtggtaagctcttgatgtccatgtgaacacactaatctttgctggaaygtgccatggtgaaattttgatgctggaaagtactgaataagaaggctaagcattagtatttataaatcaaaacatgttgacaattacttcctgctttggt

SEQ ID NO: 45661 - DNA, 201 bp, Homo sapiens
accaaattgtatttctctatagtagcaatgagcaaactgaagattaagaaattgtttcaaaaagagataaatttttaaaaagaagtgcagtacttgtacaytgcatcccacaaaacatttttggaaaaaaatttaagacccagttaaatgggaagatgttccacattcatggattggaagacttaatactgttaagatgtg

SEQ ID NO: 45662 - DNA, 201 bp, Homo sapiens
attttaagacatggtcctgttctgtcacctaggctggagtgcagtggcacaatcatggctcactgcaagcttaagctcctgggctcaagtcatcctcctgyctcaccctctggagtagctgggactacaagcatgggccaccatgctcggctaattttctttcttttcttttccttttctttcttttctttttctttcttt

SEQ ID NO: 45663 - DNA, 201 bp, Homo sapiens
tcaggaagttcccaagggaacacactccaagaattagatgaaaaactctgcagaaaaatccacctcacatgaaaatctctgtatttaatatttttaaaaarttaccactgtgtttgttgcagctgtgacctctacaagttccagagactactctctgacttttggtgcaatcaaccaaacatggtcctaccgcatccacca

SEQ ID NO: 45664 - DNA, 201 bp, Homo sapiens; identical to SEQ ID NO: 8619

SEQ ID NO: 45665 - DNA, 201 bp, Homo sapiens
gcagatcacttctaccacacagactggaggaggtgagccccacaaattctggacaagcctgaaaaggccaactgttccagaggacacaccacttgttttamcaaaagtcagtacctgacttgactcattaagccctctgaggcttttgtttcatcacctcctcattggcagataagatccttcaaggatgtttttcatcct

SEQ ID NO: 45666 - DNA, 201 bp, Homo sapiens
cctccagctcctgaggcttcgcagaggggatgtttatggtggatggggttccccttctcctgcgcagctggtttcgaggttgtgcggtttccagtcctgcrgagcagctcaggttaccgcctccgtggccgcgggggagggcatctccgacggccgcagcaatgggcaagagatcagggtcttcccatccccgcgactcgc

SEQ ID NO: 45667 - DNA, 201 bp, Homo sapiens
ctatagaacagttccaaggcaatttacataattgtcggaataaagaacaagcctttgaaatagctaaatttcactaaaaacatttttgtcttttggcatgyaatctggattgagaaaatccaagttaacattcagattcagtatagaaaattttaataacttaggaatacaacagtcttgttaaaactgacatttaataat

SEQ ID NO: 45668 - DNA, 201 bp, Homo sapiens
gacctaatctctactaaaaatttaaaaaattagctgggtgtggtggtgtgcacccgtagacccagctatttgggaggctgaagtgggaggatcacttgagyccagggggttgaggctacagtgagccatgatcaatcacaccactatgctccagcctgggtgacagagggagaccctacctctaaataaataagtaattaa

SEQ ID NO: 45669 - DNA, 201 bp, Homo sapiens
ggatatagtattagggatgtgatagcactcagcatttgtctttgaatttttggcaggatctgtaggatttagtgcagtaaaataaatgagggacagtcccscatgtgacagtgtcctacaggcagtgggagatgaagaactacactaaggaatggaggttagtgttcacagcaaacactggaggccagacccaatgatcct

SEQ ID NO: 45670 - DNA, 201 bp, Homo sapiens
ggctactctgaatcaaatgatcaggcgaggcctcagctgacacttaaactggaagtgaagtgggattcctccagcagcacatttagaaaccagggttgacrctcacagtagggctgacctacatcaagtgacattagccaaagctcagacacctctggcttcagtgttgctgtagcagaaatcaagataaacattttccct

SEQ ID NO: 45671 - DNA, 201 bp, Homo sapiens
ttacacacaatctaattacactcttagttatttaaaaatgtacaattaagttattattgactataataacctgttatcacaggttatagtcaccctgttgwgctatcaaatggtaggtcttattcattccttctatttttttttttttggtacccgttaactgtgtccaccttcccctgacccctactacccttcccagcc

SEQ ID NO: 45672 - DNA, 201 bp, Homo sapiens
aattcactgatgcatgtcctacttgactggctaaagagctccttctgtaacaaattacctcttctatatttccagaaaatactacagacctaaaaatggawcaaaagaactatcccaattcatcccattgataaagatggatgagagtaaagaaaatgcactctttagccaggcatggtggctcacgcctgtaatcccagc

SEQ ID NO: 45673 - DNA, 201 bp, Homo sapiens
catttcttcttagatgaaaatgaatgtgcaactggctttcatcgctgtggccccaactctgtatgtatcaacttgcctggaagctacaggtgtgagtgccrgagtggttatgagtttgcagatgaccggcatacttgcatctgtgagttccaaaatcattttcctgtgtggccaaaatggtgctctttaatcttgctcttt

SEQ ID NO: 45674 - DNA, 201 bp, Homo sapiens
ctgcctggtaaccaagcgggatgcctcatcctactccccaaacggagcggatcacacacagtagtgtttcatggtctttcctgctgcggttttcccggggraaggtacttccagagggtggccaagtcttccctagcggccggccttcgggagggggacagaacttaggagtcagccctctgccttcgtacaaaggctcgc

SEQ ID NO: 45675 - DNA, 201 bp, Homo sapiens
gcagggtggtaagctcttgatgtccatgtgaacacactaatctttgctggaatgtgccatggtgaaattttgatgctggaaagtactgaataagaaggctwagcattagtatttataaatcaaaacatgttgacaattacttcctgctttggtggggtatgccaggcattttgtacagaatcttcctaaaatggagaaatg

SEQ ID NO: 45676 - DNA, 201 bp, Homo sapiens
tggtcagtgtccggatcactgacctgagcttgactcctagactcagatggtgagagacaaccctttcccttctctggaatccttcagatttactgaagtgmgaggtgttggaagtcgtcacttctgtgaaatgtagaagatggattggtttaaaatttagggtgtagagtcaaaccaatgtgagtttcagttccagctcta

SEQ ID NO: 45677 - DNA, 201 bp, Homo sapiens
ttttgaaaggcagtgatttcgtctaaatgttctcccagctgttctgagaaacaggatgattccattcagaacatttgtgtcctcttaccccaatttgttgmagcatatttgtcaggctttttaaattatgcacagatctgtcaaatgcaaaaatggtacttggggcacctggggatgattttacttcatggggaaggggtg

SEQ ID NO: 45678 - DNA, 201 bp, Homo sapiens
gggcagatgcaggtaatactactgatggaatgcaaatagataacctctcatcacagtgaatgtgagcactaacagattttactacaaaatgaaatcccatmacttagatctcctttctttggtctgtaaacttttaagtactagtaaatttaagtactagtaaatgagtcttaaaatgaactttctggggtttgggtggag

SEQ ID NO: 45679 - DNA, 201 bp, Homo sapiens
cagtggtgctccttggggcactgtctttaggcctttacgcagtgacagaggaatcacttgtttaatgtactagagccacatgtgtgtagttttctggccasaggttgttgggaatggtttgacctcacatcactgatttttgaaaggcagtgatttcgtctaaatgttctcccagctgttctgagaaacaggatgattcca

SEQ ID NO: 45680 - DNA, 201 bp, Homo sapiens
gacaatgctcccggcatgccttctgcacggactatgccactggcttctgctgccactgccaatccaagttttatggaaatgggaagcactgtctgcctgarggtaattgactggggccaggaactcctgtgtgtctattcctgctgcttacctgtttccagctaccactgtgagctctgctttatggaccaaacatctcca

SEQ ID NO: 45681 - DNA, 201 bp, Homo sapiens
taatagcgtgaatcactttttaaaaagctaaatctttgcacatgttcttagttgacattccaggaagtgcaattggtaggtcagagaggatgcacttttgrtaaagttcttgataacttctgcctaattgccttccaggtaccagtttacaagtttcttagtttataggagtctgccgtcaatgtgctttacagtctctac

SEQ ID NO: 45682 - DNA, 201 bp, Homo sapiens
gccctttttgacccacaaaaatagtggtttcatgaagttcaacctaacatgtacttactggtttgctttcattttactgcactcaaacccacgggtgcagyctcatcttagttcaccaactctgcaatgggacccagccgggagcagtaagcaattcttcttgccagcagacaaagcagattaattcccttgggttgaatg

SEQ ID NO: 45683 - DNA, 201 bp, Homo sapiens
ttcaatttgctttaggaagcactgaagtaagctatcctttctctaagttgtagaacgtagaatggatatcttaaacagatacatgcaaagtttaaaatcayggccataccagaagaaatgttcattaacaacttatttaggatttatagaaacgtacctcttttgtttgatttgccttagcaactgcatcctgtgtcaggc

SEQ ID NO: 45684 - DNA, 201 bp, Homo sapiens
aactctggatgcccttatcttcttctcttttcagtgatcaccccacctgccaacccctgtgaggatggcagtcatacctgtgctcctgctgggcaggcccrgtgtgttcaccatggaggcagcacgttcagctgtgcctgcctgcctggttatgccggcgatgggcaccagtgcactggtgagtaactgcaggtcagcctc

SEQ ID NO: 45685 - DNA, 201 bp, Homo sapiens
atgccttttctttgaggtaggtgcgtgtgttctttaagacccttccctcaaaacaatcttggtagcgagaccagctattatcttttttaagttcagtgttmcctaaaagaaggatggttagacataagacatttgttagcttctctattatgtcttcctctcaggatgtgtttaggttgaaccatataaaagtgctgatat

SEQ ID NO: 45686 - DNA, 201 bp, Homo sapiens
tagttttgctgaaggaatgaatgaatgaatgaatgactttattacaccagaacaatttactgtctgttctatagtgtgggtgaaataagctgatctttaayccaacttccagtggctcgattcatatacaacgagccagtaagaacctttaaaagaaaacagtgtctttcagagatactgccctggcattagtaacctttt

SEQ ID NO: 45687 - DNA, 201 bp, Homo sapiens
ctttttacttagataaaagctatgactccacctagtttaactctccatatctagactgtctctcctccatcttctctctccttgtttcataattcagcctyagaataagaattgggttgcagaataaggcttcacaaaataactgaaataagatacaatccaagcctgttatttccttaatttgtgggcagaacagcttgt

SEQ ID NO: 45688 - DNA, 201 bp, Homo sapiens
tctgattatctgcaacatgcattcatatctgatttttaaaaattctacatctgccaaccatttgtcccattgaagcatcatactagtgagaaaacattgartttttagaccctccacttctgggacccttgaattaagcagaatttttctcttctcatttcttcttagatgaaaatgaatgtgcaactggctttcatcgct

SEQ ID NO: 45689 - DNA, 201 bp, Homo sapiens
agaggtgtgtgcagccgcttggcctcctggtggccatgcttgggattggcatatttcctagtgccccggagaaagcaccctcctgtccatccacaaccccygccacaccctacccccttggctatttcctttatgaactatggcatttgctccagtttccccatttctttgcagcacagatggccctcttcttttaatggg

SEQ ID NO: 45690 - DNA, 201 bp, Homo sapiens
tccgtacttggatcccattgaaggggtcgtggagagtagcagttaagattctccagctagatgtcctaggttcggttcccacctttgccactcactgcctrtgcgacttcaggtgctttagtctactgtgcctcagctttatctgcaaacgggttaaaaaattgtccctggccagagtggtggctcatacctgtaatccca

SEQ ID NO: 45691 - DNA, 201 bp, Homo sapiens; identical to SEQ ID NO: 8618

SEQ ID NO: 45692 - DNA, 201 bp, Homo sapiens
aatatgagttatgttaccattttagtcacttttttcctcctacctagaaaatattttaaaaatactaaggattttggttaaaaggttgcctcagtaattayagacatagcttacaaagggcaagtatttacccagatgttataatttataagctaaggcttgaaatcacacaaattataaaaataattatgtttaatgccc

SEQ ID NO: 45693 - DNA, 201 bp, Homo sapiens
tttgttggctggttgaatgaatgaatgaataaaataaagtgctaaatgcccagagttcacagcaaaaagtcagactctcctcttcacagctctgtttactrctctcttccccccttccccatccccttcaattcttcacagtctctacaacctccttatcttatggaatttctctaaatttagaaccaggattctctccta

SEQ ID NO: 45694 - DNA, 201 bp, Homo sapiens
tgccagattcacgccattctcctgcctcagcctcccgagtagctgggactacaggcgcccaccaccacgcctggctaattttttgtatttttagtagagayggggtttcaccgtgttagccaggatggtctcagtctcctgacctcgtgatccgcctgcctcggcctcccaaagtgctgggattacaggtgtgagctgccg

SEQ ID NO: 45695 - DNA, 201 bp, Homo sapiens
aaatttaaatcggctccatgagaaatgtgaaacttggaaattcttgaatggtttagctattgtaaaaatttttaagactgattcctttacattgaaatatragttatgttaccattttagtcacttttttcctcctacctagaaaatattttaaaaatactaaggattttggttaaaaggttgcctcagtaattatagaca

SEQ ID NO: 45696 - DNA, 201 bp, Homo sapiens
caaagaccatcccctgggtgcacctccaggttgcagagggtctgtgaccaggagccgccgccccccgatgcctgtgaagacacctatatgaggagattccvtggtagggcccctctcccttcaccagaagtggagagagcctgttagtgtcatgccagcagttgtaaaaggccacccccagggtcgtgatcactgccacca

SEQ ID NO: 45697 - DNA, 201 bp, Homo sapiens
tttgtactgcttgcctgaccatgagtgcctggcatatttttaacagttaaaagaattagccattgttgaattgacaaacttaagtgaagttattcttatgyggggagagggtcactataacttacctataaacatctgttataatgctaaggacattctttggaaagcattgtagcagggtagcttccttcagtaataaca

SEQ ID NO: 45698 - DNA, 201 bp, Homo sapiens
tgtatagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaac

SEQ ID NO: 45699 - DNA, 201 bp, Homo sapiens
ctaatgcagcccaaactcaaggggattgcttaaggctataatacatgaggagatggagatcactgggggctgcttagatgctgcctaccacaggctacatrgctattcttttacaatcttgatttttaacttacagcaacttgtactggacagactggaatagagaagctcctaaaattgaaacgtcatctttagatggag

SEQ ID NO: 45700 - DNA, 201 bp, Homo sapiens
gtatagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaaca

SEQ ID NO: 45701 - DNA, 201 bp, Homo sapiens
atatgtaacaaaagtacttgtttctctattaacctggttcttggggacttggagacacttgggctttgctttcccctgctgacccccctgcccacccgacygttggagggcttcaggtttgccctccatatcctgcaaacactccagtcctgactttgctttatttccaggtctgataagccctgaaggacttgccataga

SEQ ID NO: 45702 - DNA, 201 bp, Homo sapiens
tatagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaacat

SEQ ID NO: 45703 - DNA, 201 bp, Homo sapiens
atagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaacatg

SEQ ID NO: 45704 - DNA, 201 bp, Homo sapiens
tggcaaatttagatttccattttgtaagtattatttcaaaaccctagataatatttttttcttatttcttctaaaagtggaaagtaaagaaaatacctggktaatgggggtgtggttctagatagtaagattctaattagtcaagacagaatgtgcttcttagctgaaaaatatttgggcctcatctggctcctttgcatc

SEQ ID NO: 45705 - DNA, 201 bp, Homo sapiens
aattcaaagaacacagaatagccaaaacaatcttggaaaagaataaagtcagacttgtatttctcaaactcgaaatctagagtaatcaagacagtgtggtsctggcgtaaggatacatgtaaagatcaaaggaacagaagtgggaacccagaaatactcacattaaaagtcaattgctttttcaacaacagtgccgggagt

SEQ ID NO: 45706 - DNA, 201 bp, Homo sapiens
gataggtgaacgagttttagggcccctggacctactgcagcgcggagctgggacagtcgcaaaagttgcgcttgtttccctgaatccagactccctggccrgtggggaaggagagagaggctttttgcctaagtcagttcccttccctccctgcgcgaaagggtagcgtccttgggcttgagcgactgtcacctttttgtc

SEQ ID NO: 45707 - DNA, 201 bp, Homo sapiens
cactgtggaccatcaccaggtgagcttaggcctggggctcaagaagcagaatggcactggtggtaggtagatcataattcctgcccagaccacgcaggcasggggccagtcaccatccttcatagcctctttcctcctgagaagacttgaataatagtgcgtacaaatatgcatgtttgtgtcataaggacatagagatat

SEQ ID NO: 45708 - DNA, 201 bp, Homo sapiens
ctgagcctactcttgcgctgaacctgaccttggaggcagcagggctggagtggcttgggagtgaggaaagacgttgtctctaggcatcttctgaggccctrgcaggtggtcactcccttgaggaaaaaaatgcttagcggatatgagagcgggagtgcagatgtgggagcccctttgaacataaggcaatttactgtttgg

SEQ ID NO: 45709 - DNA, 201 bp, Homo sapiens
tctcgataatcttccctgcttgcttctaccattaaacccagtttataaagtatgactcgaattatacttgaagtctgtgctgattaaccccagacatgtgrtgacccctaatctagtgctcatgatctccgtacttggatcccattgaaggggtcgtggagagtagcagttaagattctccagctagatgtcctaggttcg

SEQ ID NO: 45710 - DNA, 201 bp, Homo sapiens
tagtagttgctccagctgtcctgaagcagccctgtgcacgaagcctcctgtgtccctctgtgttggcccagtgaacccagtcgacaccatggaacctcccstgtgtctggcccagggccttctgtgaagaagggcaggccggccaagggctgcagacaggtgcttaagtgtttctgggaaaatgaagattgaaagatggct

SEQ ID NO: 45711 - DNA, 201 bp, Homo sapiens
ggctacttacccctcaatggcaccaggcttcagaaggatgcagctaagaccctgctgtctctgcatgtaaagtggatttctcctgtagggggcagggctgygtggctttcccagtgggagccacctcacaggccctgttgcagtgaggtggactggtgcagggaagtcctggagggtttctgagctgcagcccatcggcat

SEQ ID NO: 45712 - DNA, 201 bp, Homo sapiens
gtcacctttttgtccctctcctctcccaggtgggcaccaacggcatcatctccactcaggacttccccagggaaacgcagtatgtggactatgatttcccyaccgacttcccggccatcgccccttttctggcggacatcgacacgagccacggcagaggccgagtcctgtaccgagaggacacctcccccgcagtgctgg

SEQ ID NO: 45713 - DNA, 201 bp, Homo sapiens
attgttataacttctttttctgtaatagaaaaatgtagtacagcttccaatctatttataaacctttgcacagttgcacttgtaagttgctggctgcatcrccctgcctctttttacttagataaaagctatgactccacctagtttaactctccatatctagactgtctctcctccatcttctctctccttgtttcataa

SEQ ID NO: 45714 - DNA, 201 bp, Homo sapiens; identical to SEQ ID NO: 8608

SEQ ID NO: 45715 - DNA, 201 bp, Homo sapiens
gcacttatattttattaggaggaaacaagactggtataaacaatattagtctgtgatgtgatatgtagaaaattcagatagtgttgtgagaactagggctrctctgaatcaaatgatcaggcgaggcctcagctgacacttaaactggaagtgaagtgggattcctccagcagcacatttagaaaccagggttgacgctca

SEQ ID NO: 45716 - DNA, 201 bp, Homo sapiens
cattgttataacttctttttctgtaatagaaaaatgtagtacagcttccaatctatttataaacctttgcacagttgcacttgtaagttgctggctgcatygccctgcctctttttacttagataaaagctatgactccacctagtttaactctccatatctagactgtctctcctccatcttctctctccttgtttcata

SEQ ID NO: 45717 - DNA, 201 bp, Homo sapiens
tgtaacctggaactgctgggctcaagtgaccctcctgcctcagcctactgagtagctagaagcacaggcatgtggcaccatgcctggctaagttttttagraaagggttttgtagaggcagggtctcactatgttgcctagactggtctcaaactcctgggcttaagtcatcctcctactttggccttgcaaagtgctggg

SEQ ID NO: 45718 - DNA, 201 bp, Homo sapiens
gacacttgggctttgctttcccctgctgacccccctgcccacccgactgttggagggcttcaggtttgccctccatatcctgcaaacactccagtcctgamtttgctttatttccaggtctgataagccctgaaggacttgccatagaccacatccgcagaacaatgtactggacggacagtgtcctggataagatagaga

SEQ ID NO: 45719 - DNA, 201 bp, Homo sapiens
ggtctgctggtctagaagctagaggtagtggaatatgtaacaaaagtacttgtttctctattaacctggttcttggggacttggagacacttgggctttgytttcccctgctgacccccctgcccacccgactgttggagggcttcaggtttgccctccatatcctgcaaacactccagtcctgactttgctttatttcca

SEQ ID NO: 45720 - DNA, 201 bp, Homo sapiens
gcttgttgtatcccaagccttctatcaacaccaattggtgtgagaatcactggcggggtggctaaagtgtagattgctaggatgcacccagagagtggaaytggtaggtctaaggtgggccctcagaatttgcatttttaacagaaatctcaggtgatcctgatgcagtggtctctggaatccaccgggagaaatgcagct

SEQ ID NO: 45721 - DNA, 201 bp, Homo sapiens
taaatttgttaacgacattgatgagcaacacctagctcagaaatccaaggcttgttgtatcccaagccttctatcaacaccaattggtgtgagaatcactkgcggggtggctaaagtgtagattgctaggatgcacccagagagtggaattggtaggtctaaggtgggccctcagaatttgcatttttaacagaaatctca

SEQ ID NO: 45722 - DNA, 201 bp, Homo sapiens
tttgatgcacaaagggctccataatcgtgggaattgattacgactgccgggagaggatggtgtactggacagatgttgctggacggacaatcagccgtgcyggtctggaactgggagcagagcctgagacgatcgtgaattcaggtcagcagcttcactcagcagtctgcatttcatttgattctacaaagtcacttgtct

SEQ ID NO: 45723 - DNA, 201 bp, Homo sapiens
ggaaactgagcttggaaatacttagtgacttgtctagcaagggcaaagactgcaacaaagtcatgaagaaattagagaaagctgtagggtgacagagagtsaaaggcactgtccaggagtgtcactgctgttggggaagtctttgtgaggaaggaggggcttgagccaggcctggggtcaaagtctgagagggagaatgtg

SEQ ID NO: 45724 - DNA, 201 bp, Homo sapiens
gggcgtctctgggtggagcgaagcggccgaggggaccacgacaatgtccctttgcttttcggaccgatggccaggcctccagagccaggagcgcccgggaycccagggcagggagcaaagctcataccgcaaccccgccacccgcccgcgccctgccagcctgttggggccacagcgcgcaggccagcagccgcactcgcc

SEQ ID NO: 45725 - DNA, 201 bp, Homo sapiens
attcttgtggatggatgcccaaatgggccgtaagcactgagctcagcttctcaggtggccagaaatgagcacgagaaatttcctaacattctgcccacccyaggagctgccaattggtcagattaaatttgttaacgacattgatgagcaacacctagctcagaaatccaaggcttgttgtatcccaagccttctatcaac

SEQ ID NO: 45726 - DNA, 201 bp, Homo sapiens
gaccacgacaatgtccctttgcttttcggaccgatggccaggcctccagagccaggagcgcccgggaccccagggcagggagcaaagctcataccgcaacyccgccacccgcccgcgccctgccagcctgttggggccacagcgcgcaggccagcagccgcactcgccgctgcggggttccctttgcgctgagctcatctc

SEQ ID NO: 45727 - DNA, 201 bp, Homo sapiens
tatgttattactcttattgttaccatgaaatatatcgtgtaagtgagcagaatggctgctatacataagaatatctatatccctacatagtattttcaaayaataaaatcaatagcaacattgtccatggggtgggtagggatggtataattatatacagtttttaaccatcctactttctgcaacatggaaaaatagtga

SEQ ID NO: 45728 - DNA, 201 bp, Homo sapiens
gggctatctggctgctgtgcgtctgtattaccttcactaaagaatcttcacgttgtattcttgtggatggatgcccaaatgggccgtaagcactgagctcrgcttctcaggtggccagaaatgagcacgagaaatttcctaacattctgcccaccccaggagctgccaattggtcagattaaatttgttaacgacattgat

SEQ ID NO: 45729 - DNA, 201 bp, Homo sapiens
ctcttaccctaagtccccagggttgtatgtcataacatctccatggaaatcctggaaatcaaagtgacaggacaactagtcacaaggtgtgatctctgcgrtttgttggggactccaagtggaagtcagttaatgactgtctcaccgttgcagcccttccctttcactttggttctgtccctttgacccacttctttccta

SEQ ID NO: 45730 - DNA, 201 bp, Homo sapiens
gccctggataaatagctgcacgtgggctcagcaccgttctagctccaggtctcccccttcttcagggaagggctatctggctgctgtgcgtctgtattacyttcactaaagaatcttcacgttgtattcttgtggatggatgcccaaatgggccgtaagcactgagctcagcttctcaggtggccagaaatgagcacgaga

SEQ ID NO: 45731 - DNA, 201 bp, Homo sapiens
ggctgcgtggctttcccagtgggagccacctcacaggccctgttgcagtgaggtggactggtgcagggaagtcctggagggtttctgagctgcagcccatyggcatgggcccgatgccaccaccataggaccagggctctctcttgctgggagtcacctgtcactgaccaaggctgtgctctctggttcgttcatggagtt

SEQ ID NO: 45732 - DNA, 201 bp, Homo sapiens
gagtaggaagaagtgcatgaaaatacactcaaagccatgatagggacatgcaaatgaccaccgaaaagaaaaagtgccacttttcctcgggtgtgtttatygcacatctcatctagctgggatccagatcttgattcccagccttcaagaagttcagcctctttgaatttcactgcaattcccatagaaatttgagcagtc

SEQ ID NO: 45733 - DNA, 201 bp, Homo sapiens
cttacccctcaatggcaccaggcttcagaaggatgcagctaagaccctgctgtctctgcatgtaaagtggatttctcctgtagggggcagggctgcgtggytttcccagtgggagccacctcacaggccctgttgcagtgaggtggactggtgcagggaagtcctggagggtttctgagctgcagcccatcggcatgggcc

SEQ ID NO: 45734 - DNA, 201 bp, Homo sapiens
ctaactagagtaggaagaagtgcatgaaaatacactcaaagccatgatagggacatgcaaatgaccaccgaaaagaaaaagtgccacttttcctcgggtgkgtttatcgcacatctcatctagctgggatccagatcttgattcccagccttcaagaagttcagcctctttgaatttcactgcaattcccatagaaatttg

SEQ ID NO: 45735 - DNA, 201 bp, Homo sapiens
gcagcctgggaggaaactgctttgcaaccaaagccagcaggacttcaaccatggagtgagctgtgagggaggggacaagaggagaggatgctggagaaagrgggggaaagggcaacacggcaggaagctagagcctgcaggaaaagattcagctttgagataatcccaggcgcagggtggctaaagcaattctggaaactg

SEQ ID NO: 45736 - DNA, 201 bp, Homo sapiens
tcatcagtcataatagcacctattgaagggcttactgtatgccaattactgattaggacactttacaagcacttatagtattaatttttatagcaaccatrtgaggcaggtacactattggcctcattttgcaaatgagacaaacgcatagaggttaaatgcccaaagccacatggctactaagtggctgagcctagattt

SEQ ID NO: 45737 - DNA, 201 bp, Homo sapiens
tgctggaacctgatcataatgctcccagctttgttctttagagtcactggagggttttgaacggagtgacatgaaatgcctttatgtttaaaatgggccaytctggctgctgctaattgaatttacactggttttggagagagtgagggcatagaagggtggaagcaggaaaaccagtgggaaggctgttgcagaaattgc

SEQ ID NO: 45738 - DNA, 201 bp, Homo sapiens
agccagttagttttctctaaactgacaatcccagccctctgtaacccagcccaacatctcagaggaggcacagacatctggtttctgttagcccatacaayctgagaacatgcctgctaccatctagagcattccccagctgggtggggcatggtgatcaagtgctcacagtcgattccaacagcaggcagataaggcaac

SEQ ID NO: 45739 - DNA, 201 bp, Homo sapiens
cttaatcggacctacaccctttgtttatcctccttttactctgaaagacttcctgtctcttaaagtagcttatctcatcccttgggcgttagttttaaccrttcaattctcagagctgctttttttctgctggggatgggaggggtgggtgacttgctattgtcggcatatgcggatttcattaaataaaaggaatgtaag

SEQ ID NO: 45740 - DNA, 201 bp, Homo sapiens
gctggtctagaagctagaggtagtggaatatgtaacaaaagtacttgtttctctattaacctggttcttggggacttggagacacttgggctttgctttcscctgctgacccccctgcccacccgactgttggagggcttcaggtttgccctccatatcctgcaaacactccagtcctgactttgctttatttccaggtct

SEQ ID NO: 45741 - DNA, 201 bp, Homo sapiens
gtgatccaagggaaaatggaccgactcttaccctaagtccccagggttgtatgtcataacatctccatggaaatcctggaaatcaaagtgacaggacaacyagtcacaaggtgtgatctctgcggtttgttggggactccaagtggaagtcagttaatgactgtctcaccgttgcagcccttccctttcactttggttctg

SEQ ID NO: 45742 - DNA, 201 bp, Homo sapiens
ttgcaaagtgctgggattataagtgtgagccaccatgcccagctgtctttccgttttaaaataagttgttcaccttctaggaaggtgggtgaatggacacktttgttacatttgttacaatgactgtttcctttttatttagactaagcaacctggggatccctggagtgtgggctttccatatcggcagcacttccccgt

SEQ ID NO: 45743 - DNA, 201 bp, Homo sapiens
gtgagtgaagtcatagtgttctttgcttctttcttctgtttctgacctctgcagatgtagatgaatgctcagaaaacagatgtcaccctgcagctacctgytacaatactcctggttccttctcctgccgttgtcaacccggatattatggggatggatttcagtgcatacctggtaagtttcagagggccagattaggca

SEQ ID NO: 45744 - DNA, 201 bp, Homo sapiens
tcaaaagtccagtatgatccctttagttaccatgtaagtctgcttttatttggttttatataccagtgaaaactgaacctgatcttaatagcctttcaggktttttgtttttttgagacagggtctcactctgccacacaggctggggtgcagtggttgcaaccaaagcccactgtaacctggaactgctgggctcaagtg

SEQ ID NO: 45745 - DNA, 201 bp, Homo sapiens
aatgaggaggaagctgaataccttccgggtgaaccagaggaggcattgaatggccacagcagcattgatgtttccttccaatccaaagtggatacaaagcmtttagagggtaggatctcccctccagattctgatctgtcctcccccttgcatccaacacctacttattggccattctatcctgaaacagaatcttccacc

SEQ ID NO: 45746 - DNA, 201 bp, Homo sapiens; identical to SEQ ID NO: 8607

SEQ ID NO: 45747 - DNA, 201 bp, Homo sapiens
tgccagcctgttggggccacagcgcgcaggccagcagccgcactcgccgctgcggggttccctttgcgctgagctcatctcctgcaacgccgctgccccaraccttgcgggccatttggtcccgggggtggggctccttgggggccgcggggcagcccggatgagaggatgacccgggagctccctgggggcggagtggaa

SEQ ID NO: 45748 - DNA, 201 bp, Homo sapiens
tgtgttatgtttccagacaagtagaggaaggatgaaacattcctacattccttgtttattttcaaatagccagattttagataaaccatttggattatggrgcagattgataatttgatgatctggcattctgtggcatacagctttgaaacataatgttaaataaaaggtagttcacatcaaaagtccagtatgatccct

SEQ ID NO: 45749 - DNA, 201 bp, Homo sapiens
tctgtaggcctcaattttctcatttataaaatggagatatcttctaactagagtaggaagaagtgcatgaaaatacactcaaagccatgatagggacatgmaaatgaccaccgaaaagaaaaagtgccacttttcctcgggtgtgtttatcgcacatctcatctagctgggatccagatcttgattcccagccttcaagaa

SEQ ID NO: 45750 - DNA, 201 bp, Homo sapiens
ttctatcttctggaagacaagacagtagttaataagtatttatgatgtttagggccagtgataggcattttatttatttatttttttgagatggagtctcrttctgtcatccaggctggagtgcagtggcatgacctcggttcactgcaacctctgcctcctgggttcaagcttttcttctgccttagcctccagagtagc

SEQ ID NO: 45751 - DNA, 201 bp, Homo sapiens
ggaggaaaaaaaagggtggctgtctcgaatggcatcgacacagtggaaaatcatctgattccattgttgaacttcacactccaggcacttgctcatccctragaaagaatagtacggcattcaagtttacatttacttctgttaatgaacgacacttatttggttccagaaaagcttagaggcagccagtgtttaggaaga

SEQ ID NO: 45752 - DNA, 201 bp, Homo sapiens
gatgccccctcaatttgatgggatttagagccagaagattgtttcatctctgtaggcctcaattttctcatttataaaatggagatatcttctaactagartaggaagaagtgcatgaaaatacactcaaagccatgatagggacatgcaaatgaccaccgaaaagaaaaagtgccacttttcctcgggtgtgtttatcgc

SEQ ID NO: 45753 - DNA, 201 bp, Homo sapiens
  misc_feature (1)...(201): n = A,T,C or G, or insertion/deletion polymorphism (see Tables 1-2)
cttccctcttccccatctgctcagagcccacccagaggcccccgaccatctgtgagcgctggagggaaaacctgctggagcactacggtggcaccccccgngatgaccagtacgtgccccagtgcgatgacctgggccacttcatccccctgcagtgccacggaaagagcgacttctgctggtgtgtggacaaagatggca

SEQ ID NO: 45754 - DNA, 201 bp, Homo sapiens
tttttaagccacctcactccttcaacacctccaggcctctgcccaaatgtctttttctcccgaggtcttccctgaccatactatttcaaagagccaggtgygcctgccctctctcaccctcttgtctgaccctgccatattcctctgcacttcagtgattctgatgccccctcaatttgatgggatttagagccagaagat

SEQ ID NO: 45755 - DNA, 201 bp, Homo sapiens
gtctcatcttagttcaccaactctgcaatgggacccagccgggagcagtaagcaattcttcttgccagcagacaaagcagattaattcccttgggttgaaygttatgccggtctcttaaacatcaaaaactgtttgttatgatctaaactgcttctatggagcagatgttgtgtccccgatgcagcagtgacattggaatc

SEQ ID NO: 45756 - DNA, 201 bp, Homo sapiens
acactgatttccaagcgcctcctctaccttctgaaccagaaactgcatttttaagccacctcactccttcaacacctccaggcctctgcccaaatgtcttyttctcccgaggtcttccctgaccatactatttcaaagagccaggtgcgcctgccctctctcaccctcttgtctgaccctgccatattcctctgcacttca

SEQ ID NO: 45757 - DNA, 201 bp, Homo sapiens
gggagcctgggggaactcgaggccaggggttaggtttatcatccaacagttcctgctggttttgctcagtacttgggcagtgagaaggatgttgaagcacraaagcatgaactcgaaggatttttaacacattttccaaacaggttctttactagcttaatagagtgtaggattgcactgagattaagctacctctcatta

SEQ ID NO: 45758 - DNA, 201 bp, Homo sapiens
gccttctgcacggactatgccactggcttctgctgccactgccaatccaagttttatggaaatgggaagcactgtctgcctgaaggtaattgactggggcyaggaactcctgtgtgtctattcctgctgcttacctgtttccagctaccactgtgagctctgctttatggaccaaacatctccactacttaaatcagagtg

SEQ ID NO: 45759 - DNA, 201 bp, Homo sapiens
ttgaaaacttactacttgccaagcatcatgctaaacactttccagatgttatcttaattaaaactcacaagaattgtaggttagtactactattttcccarttttacagaggagcttagggaagttaagtaaattgcctatgatctcaaagttaagtggcaaagccaaaatccaagctcaagtctggagtgctgaactact

SEQ ID NO: 45760 - DNA, 201 bp, Homo sapiens
aacactgatttccaagcgcctcctctaccttctgaaccagaaactgcatttttaagccacctcactccttcaacacctccaggcctctgcccaaatgtctytttctcccgaggtcttccctgaccatactatttcaaagagccaggtgcgcctgccctctctcaccctcttgtctgaccctgccatattcctctgcacttc

SEQ ID NO: 45761 - DNA, 201 bp, Homo sapiens
ttttttaatttttatttatttatttatttttttaggcagggtcttactttatcacccaggctggagggcagtggtgtgattacagctcactgcagcctcarccttccaggctcaagtgatcctcacatctcagcccccccaagtagcatgcccagctaattttggtatctcttgtagagatggggtttcatcatgttgccc

SEQ ID NO: 45762 - DNA, 201 bp, Homo sapiens
ccttctgcacggactatgccactggcttctgctgccactgccaatccaagttttatggaaatgggaagcactgtctgcctgaaggtaattgactggggccrggaactcctgtgtgtctattcctgctgcttacctgtttccagctaccactgtgagctctgctttatggaccaaacatctccactacttaaatcagagtgc

SEQ ID NO: 45763 - DNA, 201 bp, Homo sapiens
agttcattcaaacctggccagcctccaccctcctgctgtgccctgaggtgtcagcaaacttctttatggtctgactctccgtggcaggagcttcctggcakagtgtgggtcccagaggaggccatggactagaaactgtatttctcaaagtgtgggcactcatccaccttcctctcactcagctgggagcctggttaaaaa

SEQ ID NO: 45764 - DNA, 201 bp, Homo sapiens
tttaaaggcattccatagggtacatgtgtctcagtgaccaaagaacagaggctgtattttgtgggtgctatgcattgttaaagcacatgctcttttactcyatcaaactaacaataagggggtgtgggagtttttctccagccatagtttgttaaaaaaaccggctccctggagaggctgcacttggatttgggttctcag

SEQ ID NO: 45765 - DNA, 201 bp, Homo sapiens
aggcaggactgtttcatagatggataattggttggttaggaaatcattaaagtgacttgctaaagagtgagttttggaagttgtcagtggaataattatayctgggtacacccatctctagccaggatgatgtccaagcctaactggatttgctgtcttttaggggcacctcaccgagtgaatgggaaagtgagtggccac

SEQ ID NO: 45766 - DNA, 201 bp, Homo sapiens
tttagcaactatcaaacctcagttaacaaatccatgacaaaatgagttcattcaaacctggccagcctccaccctcctgctgtgccctgaggtgtcagcaracttctttatggtctgactctccgtggcaggagcttcctggcatagtgtgggtcccagaggaggccatggactagaaactgtatttctcaaagtgtgggc

SEQ ID NO: 45767 - DNA, 201 bp, Homo sapiens
aaatatttagttccttagctctctggtttaaagcaaagaagttgaaattaatttcagcctagatatgatgagtgttaatcggaatattaatttagattagrtgctgcatgctttgatcacttctacaatgattctctccctccttttttcttctacttgtcctgcaagactttgattaccttctggggtcatgttagggct

SEQ ID NO: 45768 - DNA, 201 bp, Homo sapiens
gacattttgtgtagaaaatctcaggaattcactaaaacactattagaactaaagaacaagttcgcaatgttataagatatgcaagatcagtacaccaaatygtatttctctatagtagcaatgagcaaactgaagattaagaaattgtttcaaaaagagataaatttttaaaaagaagtgcagtacttgtacattgcatcc

SEQ ID NO: 45769 - DNA, 201 bp, Homo sapiens
tccagctgtcctgaagcagccctgtgcacgaagcctcctgtgtccctctgtgttggcccagtgaacccagtcgacaccatggaacctcccctgtgtctggsccagggccttctgtgaagaagggcaggccggccaagggctgcagacaggtgcttaagtgtttctgggaaaatgaagattgaaagatggctcagaacaagt

SEQ ID NO: 45770 - DNA, 201 bp, Homo sapiens
agtaccagctctaagaaatgtgaatccactgagaaaaatcttgtctgtagaatttatttaaacatctggctgctcagatcagcagagatggtgcttttaaratatttagttccttagctctctggtttaaagcaaagaagttgaaattaatttcagcctagatatgatgagtgttaatcggaatattaatttagattaggt

SEQ ID NO: 45771 - DNA, 201 bp, Homo sapiens
tagggtaaaacgacacactggggatgagagaatggtgggaaacgtgtttagaatgggaaagggcctgctggggaacatgaaccttaaaaggcagactttcycctgctcctggtgttgctgtgtgcatctgcctccatccgcccaggcccaccgagctgatgtgctaagaacagctttgcaattcctgggagctttatacca

SEQ ID NO: 45772 - DNA, 201 bp, Homo sapiens
cattctgtccttgactcacaatcaaaggtttttcttcttccctcttccccatctgctcagagcccacccagaggcccccgaccatctgtgagcgctggagrgaaaacctgctggagcactacggtggcaccccccgggatgaccagtacgtgccccagtgcgatgacctgggccacttcatccccctgcagtgccacggaa

SEQ ID NO: 45773 - DNA, 201 bp, Homo sapiens
tcagtactagaatttctagccagggtgattaggcaagaacacaaaataaaagccatctaaattggaaaaggacaaagtaaaattagtctcagatgacattytgtgtagaaaatctcaggaattcactaaaacactattagaactaaagaacaagttcgcaatgttataagatatgcaagatcagtacaccaaattgtattt

SEQ ID NO: 45774 - DNA, 201 bp, Homo sapiens
gttccttggagccagcgcaggctggaggaatttagggaaagttgcataccttcctgttaggcggtctccaccttaattcaacacttatggttgtgctcttmtgctttaagtgatattttaagcaatctctaaacacatatgtaatttctaatttttctcctctttcaaaagagagaactccacatatataaaaagacacat

SEQ ID NO: 45775 - DNA, 201 bp, Homo sapiens
ggttttgaacggagtgacatgaaatgcctttatgtttaaaatgggccattctggctgctgctaattgaatttacactggttttggagagagtgagggcatrgaagggtggaagcaggaaaaccagtgggaaggctgttgcagaaattgcagggagaggatgaggctttttgaccagggtgagggggtgcagtagtgagaag

SEQ ID NO: 45776 - DNA, 201 bp, Homo sapiens
cctgccaaagtcaggaaatagagcatagtatgtgaagctggtttatagcaatacccaactgtgcgtgccaatcaggaatatacctgtgaacaaggcagacyggaattaggagggagagtgatgctgacaagtatttgttacaagtgtgatgagagcagggcactgtgagtctagtttgaagattcagaaaagatgtcccca

SEQ ID NO: 45777 - DNA, 201 bp, Homo sapiens
aaatgcagactatgaatcattaaaaagactcactaaacagaagtagggtaatgtgggaaaaacaatggaccacagggttatagtgcttaaaatcctggctytgtcattttctgtgtcatcttagacattatcctcattgagtctcagtttcttcatatgatatatatttttaaaaagatattagcagctgtctctaggatt

SEQ ID NO: 45778 - DNA, 201 bp, Homo sapiens
agatccttgcccttgagttggaaacagaggcagaaaagagttttagggcagggaacagtgtccctgccaaagtcaggaaatagagcatagtatgtgaagcyggtttatagcaatacccaactgtgcgtgccaatcaggaatatacctgtgaacaaggcagactggaattaggagggagagtgatgctgacaagtatttgtt

SEQ ID NO: 45779 - DNA, 201 bp, Homo sapiens
taaatagatatttttggtgttgagttattgaaggatgcccacctcagttgggatttctggcccagtcatgtaacaagatgatgaacttcactagtaaacayctccagctctttagatagagcctaaagtatttttcaaattggaagagatggatttataattcactgatgcatgtcctacttgactggctaaagagctcct

SEQ ID NO: 45780 - DNA, 201 bp, Homo sapiens
agagattttggggttatatatttttgaccaaattcaccattactcatttggcattttcgaccatcttaacaaatgcagactatgaatcattaaaaagactmactaaacagaagtagggtaatgtgggaaaaacaatggaccacagggttatagtgcttaaaatcctggctttgtcattttctgtgtcatcttagacattat

SEQ ID NO: 45781 - DNA, 201 bp, Homo sapiens
ggtttccttttttgttgttgggtaaaaatgacatccttttaagtagagttagaatgattcacagaggttactaagggttacctagcgccatgctgtgttaygtgctaggtataaggatgaatagagcagatccttgcccttgagttggaaacagaggcagaaaagagttttagggcagggaacagtgtccctgccaaagtc

SEQ ID NO: 45782 - DNA, 201 bp, Homo sapiens
cccggtcaaaggtaaggtttccttttttgttgttgggtaaaaatgacatccttttaagtagagttagaatgattcacagaggttactaagggttacctagygccatgctgtgttacgtgctaggtataaggatgaatagagcagatccttgcccttgagttggaaacagaggcagaaaagagttttagggcagggaacagt

SEQ ID NO: 45783 - DNA, 201 bp, Homo sapiens
ccagtgatggacgggtttgtgctttttaaagtggtgagttgtgctggctcagatgaacatgccagattcatactctgttgtgagacaagcctagcgcttcycttggttggggagatatgcttgtgatgtgtgggagaggagagcccacagggaaagaaaatgactaaacacctgtgtctgttgtcatttctggttcatggc

SEQ ID NO: 45784 - DNA, 201 bp, Homo sapiens
aaattttaaagaaggttatgtttaaaaacaatttggaggaatcctgaaaaaggggaaattctttgcacgttatgatgctttgcttgcattctgtttctttyttcttttatttgttttttacaggatgtttctctctctctctctctctttttttttttttttcctcacagctgaacactttccaggcagttttggcatctg

SEQ ID NO: 45785 - DNA, 201 bp, Homo sapiens
taataaataatattgcttatgaaattatattgttaacttgaagaggaaattttaaagaaggttatgtttaaaaacaatttggaggaatcctgaaaaagggkaaattctttgcacgttatgatgctttgcttgcattctgtttctttcttcttttatttgttttttacaggatgtttctctctctctctctctctttttttt

SEQ ID NO: 45786 - DNA, 201 bp, Homo sapiens
tgcaccagcatcattctctgttgcctcagcatgtccagcactctcgggatgtccagcacctaggttgagagaaacggtaatgaagataatgtgttcccctrgggagacagaaaggatgggaggacacgagtgtcctggcagaaacctggttgggagatggacagtctcttttccaccttagcgtcttctagaaataagcca

SEQ ID NO: 45787 - DNA, 201 bp, Homo sapiens
aaaaaccaattttctattttgttccatattttgaaagatttgttttcccttttagatgcagaccaacaacgaagagagaaactcaaaaaggaattagcacratgtgaaaaagagttcaaattaactaaaactgcaatgcgagccaattataaaaataattccaagtcactttttaataccttacaaaaggtaagatagtat

SEQ ID NO: 45788 - DNA, 201 bp, Homo sapiens
atcccagcactttgggaggccaagacaggcagatcacttgaggtcaggagttcaagaccctctggccaacatggtgaaaccccgactctactaaaaaatayaaaaaattagccagatgtggtgttgcacacctgtaatcccagctactcaggaggctgaggcaggagaatcacttgaatccaggaggtggaggttgcagtg

SEQ ID NO: 45789 - DNA, 201 bp, Homo sapiens
gcctgagcaacacagcgaaaccccgtctctactaaaatacaaaagaaattagctgggtgtggtggcatgcacctgtagtcccaattactcggcaggctgargcaggaggattgcttgaatccgggaggcggaggttgcagtgagtcaagatcacaccaccgcactccgcctgagcgatggagcgagatttcgtctctacaa

SEQ ID NO: 45790 - DNA, 201 bp, Homo sapiens
ttcttttaaacagtttgaatgaggaccaaggagtttaatgtcatggaatttctttgcgattacacttgttataagatagttttagtacttcaaaaagaatstagtaaactggtatgtagatcttgttttcaggtttaagttagaaatttgcttcttggaatataatttttgtatgtagggttttgggatttggtagtcatt

SEQ ID NO: 45791 - DNA, 201 bp, Homo sapiens
ccaagaagacacagccttttgcagggaacattagtaacatcttgaggccaccacagtccaaggaaatgtgcgcaaaaagagctattaagtcactatgtccytctcttccccagcctcatttccacccaaaaaggccaggtgatcataagcgccatcacctcattgtgttccaggcaggcgatcatgatctccgacaaaatc

SEQ ID NO: 45792 - DNA, 201 bp, Homo sapiens
cccaagtaggtgggactacaggcgcaagccaccacgcacagctaattttgccacagcctttttacatagagacagggttttaccatgttgcccaggcttgkctcaaactcctgagctcaagtgatccacctgactcagtcccccaaagtgctgggattataggcgtgagccactgcacccagtgaccatattgctttctat

SEQ ID NO: 45793 - DNA, 201 bp, Homo sapiens
tttacataaatcttgaaatcacagaaacagtgcacaacaaacctcgtaaactaagaataacctaagaaagtgagtgttcagggtaccaccagactctttgytccattggcacataattgatgaacccttttctgatttcagaactttacagtgatctgctgttcatgttttgggattctaccagtgtgttacatatattct

SEQ ID NO: 45794 - DNA, 201 bp, Homo sapiens
gggggagggatagcattgggagatatacctaatgctagatgacgagttagtgggtgcagcgcaccagcgtggcacatgtatacatatgtaactaacctgcmcaatgtgcacatgtaccctaaaacttaaagtataataataaaatttttaaaaaaagataaaaaaaaatcagtgttataaattttaagtttagtgttttct

SEQ ID NO: 45795 - DNA, 201 bp, Homo sapiens
catgcgatgtttaactttctgttgctggcttatttcaccagcatccatccatgttccatccatgttgccacaaatgacatgattttatttgtttttatggvtgaatagtatttcatggtgtatatatacattttctttatccattcatctgtgaacactaatctctcttacaaccagctttgggatatcaatcgtataata

SEQ ID NO: 45796 - DNA, 201 bp, Homo sapiens
tgcaattgtggacaaatctgagggagaaattgactttaatacaataatagaagacttcaataatccactttcaatagtggatacatattataagacccagrcagaaatcatttaaaccgctgacttgaacaacataatagaccaaaggaatttaacagatatatacagacctttataccctattgaagaatacgcactcct

SEQ ID NO: 45797 - DNA, 201 bp, Homo sapiens
ctgggtgtggtggttcactcctgtaattgcaatactttgggggaccaaggtggagagatcacttgaggccaggagtggccagcctgggcaacatagtaagwccatgcctctacaaaataaaaaaactaaaaattaaccaggcatggtgacacatacctgtagtcctagctacattggaggctgaggcagtaggatcacttg

SEQ ID NO: 45798 - DNA, 201 bp, Homo sapiens
tagttaataagtaattttcagaaatttggaacagtacgcaagccatactatttctgaagttctacagaagttcaaacacaatgattcctttcttgtcatcygtttgtccctatttataatattaaagcataactcaaaagtatatggttactatccctttagtaacccataaaatgttggaaggtgtttagatgttcttta

SEQ ID NO: 45799 - DNA, 201 bp, Homo sapiens
agttcaaaagaggaatgcttccagcttttgctcattcagtatgatgttggctgtggacttgtaatagatggctcttattattttgaggtatgttcttttgwtgcctaatttgttgagggtttttttttttaatcatgaaggattgctagattttattgaagctttttgctacatctgttgagatgatcataaggtttttgt

SEQ ID NO: 45800 - DNA, 201 bp, Homo sapiens
taatagatggctcttattattttgaggtatgttcttttgatgcctaatttgttgagggtttttttttttaatcatgaaggattgctagattttattgaagstttttgctacatctgttgagatgatcataaggtttttgtttttaattctgtttatatggtgaatcgcatttattgatttgcatatgttgaaccagccttt

SEQ ID NO: 45801 - DNA, 201 bp, Homo sapiens
ccattcagactgcgccacttacgtcccagtgccacgctgcgtggatcaagtgtcaacgggaaagtatgagttaggcaagcgctttttttttaagctgtaawcgcttcacatgactggccccgtaagaaattgtgggagcttagatgagcctggagcttttcaggaactggatgaggactctgtacacaaatgtgtactggc

SEQ ID NO: 45802 - DNA, 201 bp, Homo sapiens
gcttcttttaatgatactataatgctgaatttatttatgaaaaagaaacaatacaggttgaggtgggaaaagccccaaggaaacggagtaagtcactggcrgtcacaggacttgaattccctggggacagtgctgtggggtcccctgctcgccatcccagcacctcagtctgagtatagataatactgcatttttgtaaag

SEQ ID NO: 45803 - DNA, 201 bp, Homo sapiens
caatgcactgaagaccaggaacacacagagggagtgttctcctttgccaataaacccagaaagattacactccttcacacaccacttgtttaacaaacatkagtaggaagacattcctttcaaggccaaagccctgataaagtcttccagatagaaggttttgaaacactattggttacaaagttctgttgtaatgaaagg

SEQ ID NO: 45804 - DNA, 201 bp, Homo sapiens
taatctattctgacaagctttgttctctggtcttagattttagttctcctagctcgatacttcttttttctatatttagtcatccatatatcttctagacyttctatgtgtcctccttgttatagcttttaacagcccacctgatagcaaactagccgtcttaccctcttaaaacatctctgtttgggggataaagcattt

SEQ ID NO: 45805 - DNA, 201 bp, Homo sapiens
tttccctttctcctgaatggatattaattttatgaaatgcttttttgcatctcttggaatgatgatattatgatataatttttctcttttaatctgtgggkttttttttttttatatatatatatatagtctcactctgttgcccaggctggagtgcagtggcatgatcttggctcactacaacctccacttcctgggttg

SEQ ID NO: 45806 - DNA, 201 bp, Homo sapiens
gagagaaactcaaaaaggaattagcacaatgtgaaaaagagttcaaattaactaaaactgcaatgcgagccaattataaaaataattccaagtcacttttkaataccttacaaaaggtaagatagtatttttattttttaaaagcaaatgtttctaaggtacttctttagtggtacaatctgactttgtttactatagttt

SEQ ID NO: 45807 - DNA, 201 bp, Homo sapiens
agctattaagtcactatgtccctctcttccccagcctcatttccacccaaaaaggccaggtgatcataagcgccatcacctcattgtgttccaggcaggcratcatgatctccgacaaaatcaccacgccagtccttcctaccccagcactgcagtggaccaacaacggagggttggggctttggggatcacttgtgctat

SEQ ID NO: 45808 - DNA, 201 bp, Homo sapiens
cttgctttatgaatctgggtgctcctgtattgggtgcatatatatttaggatagttagctcttcttgttgaattgatccctttaccgttatgtaatggccytctttgtctcttttgatcattgttagtttaaagtctgttttattagagactaggattgccacccctgccttttttgttttccatttgcttggtaggtctt

SEQ ID NO: 45809 - DNA, 201 bp, Homo sapiens
ttcattgagcagtggtttgtagttctccttgaagaggttcttcacatcccttgtaagttggattcctaggtattttattctctttgaagcaactgtgaatrggagttcactcatgatgtggctctctgttcgtctgtgatttgtgtataagaatgcttgtgattttttgcacattgattttgtatccagagactttgctga

SEQ ID NO: 45810 - DNA, 201 bp, Homo sapiens
ggcttagcgccacccccttgatgctgtccttgtgatagtgagtgggttcttgcaagatctggttgtttaaaagtgtatgcccccacagccttcccctctcrttcttgccatatgaaatgcacattccctcttcgccttccaccacgagcaaaagcttcctgtggtctcccctgaagcagatgctggcattgtgcttcctgt

SEQ ID NO: 45811 - DNA, 201 bp, Homo sapiens
cccctgtgaaaagaagtttcaatgcactgaagaccaggaacacacagagggagtgttctcctttgccaataaacccagaaagattacactccttcacacamcacttgtttaacaaacattagtaggaagacattcctttcaaggccaaagccctgataaagtcttccagatagaaggttttgaaacactattggttacaaa

SEQ ID NO: 45812 - DNA, 201 bp, Homo sapiens
gagagcataaggaatacatttaagaaataattagaaagtagaatctcggccgggcgtggtggctcatggctgtaatcccagcactttgggaggctgaggcrggcggatcacaaggtcaggagttcgagaccagcctggccaatatggtgaaaccctgtctctgctaaaaatacaaaaattagctgggcatggtggcatgca

SEQ ID NO: 45813 - DNA, 201 bp, Homo sapiens
gggcgtggtggtgcgcgcctgtagtcccagctactcaggagggtgaggcaggagaatcgcttgaaccccgcaaggcggaggttgcagtgagctgagatcgygccaccacactccatcttgggcgacagagtgagactctgtctcagaaaaaaaaaaaaaaagaaaaagaaaaaagaaaaaacaagatagatacccaaatag

SEQ ID NO: 45814 - DNA, 201 bp, Homo sapiens
cgcagtggctcacaccagtaatcccagcactttgggaggctaaggtgggcggatcacaaggtcaggagttcaacaccagcctggccaatatggtgaaaccycatctctactaaaaatacaaaaattagctgggcgtggtggtgcgcgcctgtagtcccagctactcaggagggtgaggcaggagaatcgcttgaaccccgc

SEQ ID NO: 45815 - DNA, 201 bp, Homo sapiens
gctaaaaagaggtcttcagatttagaaggacaaagttctaaagccaggcaacacaaggtcaaggctgtagggagccatgatcataccactgcactccaccwgtctgggcgacagagcaagactctatctcaaaaaaggcaaaagaaaaaaaaaaaagccgggcaaataagtgcgccctgagtcctggtaacagtgttgggg

SEQ ID NO: 45816 - DNA, 201 bp, Homo sapiens
gtaaagaaatacaaatgaatagaaaaaatgcctagtagtgaatattctaaaatgttaacaatagttgtaaaaagtagaatacagatttcttgggttttaawaaaaaattgtgaaataattcagaactactaactctgaggttggttcataacttcactgatgctagcaaatgataacaaaggaaattagttgttttttaag

SEQ ID NO: 45817 - DNA, 201 bp, Homo sapiens
actccactctcacatcatcataaggaagaacatcttggaatcgatttctttctgcattttcagggagtcgtgctgttgagcactccccatcaactagccgkttcttaagaattctttcatattctgtgaataccattccttgttctaatcgttgttccagaattttacactataaaacagaatatgtgtaataacatgaat

SEQ ID NO: 45818 - DNA, 201 bp, Homo sapiens
ccactctcacatcatcataaggaagaacatcttggaatcgatttctttctgcattttcagggagtcgtgctgttgagcactccccatcaactagccgtttyttaagaattctttcatattctgtgaataccattccttgttctaatcgttgttccagaattttacactataaaacagaatatgtgtaataacatgaataca

SEQ ID NO: 45819 - DNA, 201 bp, Homo sapiens
agaacatcttggaatcgatttctttctgcattttcagggagtcgtgctgttgagcactccccatcaactagccgtttcttaagaattctttcatattctgkgaataccattccttgttctaatcgttgttccagaattttacactataaaacagaatatgtgtaataacatgaatacagccacacgtcgtggctacctttt

SEQ ID NO: 45820 - DNA, 201 bp, Homo sapiens
aaacagacatgaatacaattcttaccattcttgtaacttaactgaaactgcatgtgctgttgattacttgaggcgttcctctcaccttaatatgtgatgcrttgatgtaaccagtgttgttttctttagttgggaccaactccactctcacatcatcataaggaagaacatcttggaatcgatttctttctgcattttcag

SEQ ID NO: 45821 - DNA, 201 bp, Homo sapiens
ctcttttccagtcctccactgccggggctgggcccggccgcgggaaggaccgaaggggatacagcgtgtccctgcggcggctgcaagaggactaagcatgratggcagccggagaggtaaagggcagctgtcaggggctaccgccgcctcgcccctcgctccaggcggcgctcccagcctcgggtccgggcagctgagtgc

SEQ ID NO: 45822 - DNA, 201 bp, Homo sapiens
cccccagggaatatttcacaatgtctggagacatttatgactgtcaggattggaggtggagtgggtggggtctgcttctgagaagctacttgcttctagtraacggaggacagggatgctacaaaacagttcatagggacagcacccccacaacagagaattatacaaccagcccaaaatgtcaatggacatttgggctga

SEQ ID NO: 45823 - DNA, 201 bp, Homo sapiens
ctcattggcattatcagtgcaagattaaagcttcacatcacaatgtcatatatcaatatctctggttgaatttcagaacattttataagaatgagttaaakaatcagtgccttgtttatctcatgatttttatattagttttaaatatataatgattatgttttaatttttagctttttgcactgactcctcttctctcag

SEQ ID NO: 45824 - DNA, 201 bp, Homo sapiens
tacttcttttttctatatttagtcatccatatatcttctagactttctatgtgtcctccttgttatagcttttaacagcccacctgatagcaaactagccrtcttaccctcttaaaacatctctgtttgggggataaagcatttatattttgcatattaaattacatttaatgctgtaactcagacttcctgttttggaga

SEQ ID NO: 45825 - DNA, 201 bp, Homo sapiens
gatttccacatttggtatttgtcatttataaatactgacaatattattaaactattacctttctctttcagctgcagtagactgctcggttccagtaagcrtgagtaccagcataaagtgtaagtaatttttggacattattacctttttaaaaaaaaattaaggtaaatatacataacataaaatttactgtcttaacca

SEQ ID NO: 45826 - DNA, 201 bp, Homo sapiens
gtaccgggtatcccgcaggcggggctgcggaacgcacgtcccctgcgccgtgacgtcacaatagcgactcactggacccagcccttagcaacggcctggcracggtttccctgctgctgcagcccccgtcggctcctcttttccagtcctccactgccggggctgggcccggccgcgggaaggaccgaaggggatacagcg

SEQ ID NO: 45827 - DNA, 201 bp, Homo sapiens
attatcttttgtcatgctcttactgtaatcacgttttagacattcttttgtaaggcaagccttctaaatggtggtatagtacagcaccagactgaaaaacsgttagtcttgtttgtaatctttgtttcctactaactaactaggtaatcttcagcatgtcactgtacgtccctgggcctcagttatttataaaatgggggc

SEQ ID NO: 45828 - DNA, 201 bp, Homo sapiens
aacgagccaggtgtggtagtgcatgcctgtggtcccatctacttgggaggatgaggcaggaggattgcttgagcccaggaggttgaggctgcagtgaaccrtgagaacctatctcaaaaaaaccaaaccaaaaccaaaacagaaacaaaattctaggtgaaaatgaagttaaaattttaaaaagccacaacaacaagagtt

SEQ ID NO: 45829 - DNA, 201 bp, Homo sapiens
aggataaagaacaatatgtaaagtttgctaactttcttttaaagaatatatatatagagctggtataggtatggtggttttaagtatgaggctgccttggrtcacatggaagctgcatcctttatcagcagtgtaaccttgaagatgtaactcatatctctgtgcctcagttttcacttcgattaaatgataataataatg

SEQ ID NO: 45830 - DNA, 201 bp, Homo sapiens
gttttcaggtttaagttagaaatttgcttcttggaatataatttttgtatgtagggttttgggatttggtagtcattgaatttctgaaattccgttgattragtattaacaatggtaactaattaagcaagcagctaaacatccttagttagaagattgagagctgtcaaaaaaaaaatagttctgtaaatgtaatgacag

SEQ ID NO: 45831 - DNA, 201 bp, Homo sapiens
gtcctaaaatcaagctattgctggagccacattcctcttggaggctgtaggggagaatctgtttccttgcatttaccagcttgcagaggctgcctgcgttscgtcacttgtggcatcttcctccattttctagccaattgtggaggatctttaaatctctttactaaagaccctggtgattactttgtgtccacctggata

SEQ ID NO: 45832 - DNA, 201 bp, Homo sapiens
gattttgggtgtatatttagaagtggaattgctaaatcatatattctatttttaattttttgagaaactaccatactattttcttttcttttcttttttcttttttttttttttttgagacagggtctcactctattgccctggggctaaagtgcagtggaacgatctcacctcactgtaacctccacctcctgggctcaa

SEQ ID NO: 45833 - DNA, 201 bp, Homo sapiens
cgctttatgatcttaagaaattttgcatataaactaacattaaacccttgctatgtactaggaactatttccaaattatctcatttaatgtacaaaaataycttgataggcattagccttatttcatagtgaagaaactaaagcaaaagatcacaaataacttgccaagatcacagcggcagaacaggatttgaatctagg

SEQ ID NO: 45834 - DNA, 201 bp, Homo sapiens
attttgggtgtatatttagaagtggaattgctaaatcatatattctatttttaattttttgagaaactaccatactattttcttttcttttcttttttcttttttttttttttttgagacagggtctcactctattgccctggggctaaagtgcagtggaacgatctcacctcactgtaacctccacctcctgggctcaag

SEQ ID NO: 45835 - DNA, 201 bp, Homo sapiens
atgtgatgaggaaaaactagcaattcagtggctcccagaatttatgagctaaaaagaggtcttcagatttagaaggacaaagttctaaagccaggcaacasaaggtcaaggctgtagggagccatgatcataccactgcactccacctgtctgggcgacagagcaagactctatctcaaaaaaggcaaaagaaaaaaaaaa

SEQ ID NO: 45836 - DNA, 201 bp, Homo sapiens
taaagaaatttgttgaattcattttctctagatctgtggtcaattttgtgacccctaatagatggaattctcctggggaacagtaagtaaatctaggggayggataatgagttccaacagctatgaacaaatgtttccattttatgtcatacgatatataaaagactaaagcagtaggaaatattcgaaactacctccagg

SEQ ID NO: 45837 - DNA, 201 bp, Homo sapiens; identical to SEQ ID NO: 8687

SEQ ID NO: 45838 - DNA, 201 bp, Homo sapiens
tttttttatttaacccagaaatcatttagaactatttcttaatctctgtatctgctttttccttagtatctgtttgttacagatttctagcctaattgtaytgtgattaggaaacatctatattatatccatttcttgaaatttattgagcacttgttttatgtcccagtaggtggacaattttttaaaaatgtcctgtca

SEQ ID NO: 45839 - DNA, 201 bp, Homo sapiens; identical to SEQ ID NO: 8688

SEQ ID NO: 45840 - DNA, 201 bp, Homo sapiens
tttgaaaaccctgtttaaaaatttctgaagaataccatttgaaacctttgtttttgatttcaattaagaaatgtatactttatgggaggccgaggcaggcrgatcacgaggtcaggagatcgagaccaacctggctaacagggtgaaaccccgtctctactaaaaaacaaaaaattagctgggtgtggtggtgggcacctg

SEQ ID NO: 45841 - DNA, 201 bp, Homo sapiens
agggtcttgaagagaggagtagcagggctacttttacttttaaaagcatccctttggcttcatagttgggaatagtctgaagcagaatgactagttagaaracagtaaataatccagatgagaaataatggtgactgggaccagagtggttgcagtggagagagattgaaataatcagattctggaaacatttcaaatgtg

SEQ ID NO: 45842 - DNA, 201 bp, Homo sapiens
gcatgtgctgttgattacttgaggcgttcctctcaccttaatatgtgatgcgttgatgtaaccagtgttgttttctttagttgggaccaactccactctcrcatcatcataaggaagaacatcttggaatcgatttctttctgcattttcagggagtcgtgctgttgagcactccccatcaactagccgtttcttaagaat

SEQ ID NO: 45843 - DNA, 201 bp, Homo sapiens
cagtagagatggggtctcgccatgttggccaggttggtctcaaactcctgacctcaagtgatctgcccacctcggcctcccaaaaagtgctaggattacargcatgagccactatgctgagcctcttttaatctgttaatgtaatgaattacaaacaattgactttaatgttaaaccaactttgcattcctgttgtaaaca

SEQ ID NO: 45844 - DNA, 201 bp, Homo sapiens
tttttgtatttttagtagagacggggttccaccatgttagccaggatggtctcgatctcctgacctcgtgatctgcctgcctcggcctcccaaagtgctgkgataatcattgtctttttaatggggcatttaatatgtttttatttctggcttcttatttcataccttctatttgactcaatgtggtagacaaaatttgaa

SEQ ID NO: 45845 - DNA, 201 bp, Homo sapiens
tccaaacgttttgagagaaaaaataaatttttctgcttagtaaatttctcaaccttaaaacaagatgctggcctagggctaggagaggacttcttagttgwagctcctgcttctctggacaactttcctcttccttcttgcaaatgctttgcagagggacttgcacctctgctgctggacctggtcaggagcaagaggaaa

SEQ ID NO: 45846 - DNA, 201 bp, Homo sapiens
gtgggcggatcacaaggtcaggagttcaacaccagcctggccaatatggtgaaacctcatctctactaaaaatacaaaaattagctgggcgtggtggtgcrcgcctgtagtcccagctactcaggagggtgaggcaggagaatcgcttgaaccccgcaaggcggaggttgcagtgagctgagatcgtgccaccacactcca

SEQ ID NO: 45847 - DNA, 201 bp, Homo sapiens; identical to SEQ ID NO: 8684

SEQ ID NO: 45848 - DNA, 201 bp, Homo sapiens
ttttgggtgtatatttagaagtggaattgctaaatcatatattctatttttaattttttgagaaactaccatactattttcttttcttttcttttttcttttttttttttttttgagacagggtctcactctattgccctggggctaaagtgcagtggaacgatctcacctcactgtaacctccacctcctgggctcaagc

SEQ ID NO: 45849 - DNA, 201 bp, Homo sapiens
aggggaacatcacactctggggactgttgtggggtggggggaggggggagggatagcattgggagatatacctaatgctagatgacgagttagtgggtgcrgcgcaccagcgtggcacatgtatacatatgtaactaacctgcacaatgtgcacatgtaccctaaaacttaaagtataataataaaatttttaaaaaaaga

SEQ ID NO: 45850 - DNA, 201 bp, Homo sapiens
agtttagtgttttctaagtttctaagttttctaagttaatatttgaatttatgtagagtttgagaacatttctacattaaaaaagtaaatatcagccaggygcagtggctcatgcctgtaatcccagcactttgggaggctgaggcgggcggatcacgaggtcaggagatcgagactatcctggctaacacggtgaaaccc

SEQ ID NO: 45851 - DNA, 201 bp, Homo sapiens
gcataggcaacttacagaatgggaggaaatatttgcaaaccatgtatctgataagaggttaatatcccaactgtgtaagtaataagtacaactcaatagcaaaaaaaaaaaaaaaaaaaaaaaaaacccaaaaccttgctataaaaatgcatgaaggacctgagtagacattctcaaaggaagacatacaagtggccaata

SEQ ID NO: 45852 - DNA, 201 bp, Homo sapiens
cataggcaacttacagaatgggaggaaatatttgcaaaccatgtatctgataagaggttaatatcccaactgtgtaagtaataagtacaactcaatagcaaaaaaaaaaaaaaaaaaaaaaaaaacccaaaaccttgctataaaaatgcatgaaggacctgagtagacattctcaaaggaagacatacaagtggccaataa

SEQ ID NO: 45853 - DNA, 201 bp, Homo sapiens
ataggcaacttacagaatgggaggaaatatttgcaaaccatgtatctgataagaggttaatatcccaactgtgtaagtaataagtacaactcaatagcaaaaaaaaaaaaaaaaaaaaaaaaaacccaaaaccttgctataaaaatgcatgaaggacctgagtagacattctcaaaggaagacatacaagtggccaataag

SEQ ID NO: 45854 - DNA, 201 bp, Homo sapiens
aatctaggaaagatcacaaacagtaggaatggttaactcatctctgcttgtatatcttagttgaagagatagaaggtaggggagaaagtaactaccagctrtaggtcatagctacaaacacagtgtctgtctcaggccttgtgcttgacactttgtattctcccttttctattctttttatgtttgcaacaaaccttcgtg

SEQ ID NO: 45855 - DNA, 201 bp, Homo sapiens
ctgtgggtttgtcataaatagctcttattattttgagatacattctatcaacacctagtttattgagggtttttagcatgaagcgctgttgaattttgtcraaggccttttctgcatctgttgaggtaatcctgtggtttttgtcattggttctgtttatgtgatgaattatgtttattgatttgcatatgttgaagcagc

SEQ ID NO: 45856 - DNA, 201 bp, Homo sapiens; identical to SEQ ID NO: 8631

SEQ ID NO: 45857 - DNA, 201 bp, Homo sapiens
agtccgatgtttgagggcaggaagcatccagcacaggaggaagatgtaggctgtgagagtaggccagcctcaacccttcacgtttttctgcctgctttatrttcgctcgcagctgattagatggtgcccacccagattaagggtgggtctgccttccccaacccactgactcaaatgttaatcttctttgtcagcaccctc

SEQ ID NO: 45858 - DNA, 201 bp, Homo sapiens
ggatagtccctcatggcttcccttggctaggggaaggagttcccctaccccttgcgcttcctgggtgaggcaacaccacaccctgcttcagctcaccctcygtgggctgcacatatacagtatttcatcctgtatatgtaccacattttctttatccaattcaccattaatggacacccaggttggttccatatctttgct

SEQ ID NO: 45859 - DNA, 201 bp, Homo sapiens
tttgaatatagataagtacagtgatatcagatgagtctgcagatatttaatcaaataaaatcaaataattcaaaattatgtattttataagaatagatggrtctcattctttttgagtttattttttctagccagtaaaccttgttaccacagtgcttatattttgaaggattaacaattatttattttaaattattacag

SEQ ID NO: 45860 - DNA, 201 bp, Homo sapiens
tctggagaatattcagttttttcaacctgtttgttggtctgaaccagtgttgcactggtattatttcagtaaaactacaaaaccttaccaaaatcctttcrggacacttaactctaagattaaattacatttcaataaatattaatcactgtaagtaacaaaatatttgtctcattcaatggtccattaatttcaagtgat

SEQ ID NO: 45861 - DNA, 201 bp, Homo sapiens
atccagacacaggcatacagactaaacacttcctgcttaggctgaaatttaatgattctaacgtgcagaaaacagtgatgtgctggtaatatttaacaacwggctcttggaaggaagttttgatcggtgtttgcccatatccatggtgtaaatactcccatcacagccaatttcaaactgttaatgtcacatcaattggct

SEQ ID NO: 45862 - DNA, 201 bp, Homo sapiens
gcctaggtatcaccagcggaggctgcagaacagcaaagattgctgcctgtttttccttcaggaagcttcgtcccagaggggcacccgccatatgccagccrgagctctcctgtatgaggtgtctgtcaacccctgctgggaggcatgggggtcagggacccacctgaggaggcagtctgtcccttagcagagctcaagcac

SEQ ID NO: 45863 - DNA, 201 bp, Homo sapiens
ttgaacccaaatggtcaatagctcattggcattatcagtgcaagattaaagcttcacatcacaatgtcatatatcaatatctctggttgaatttcagaacwttttataagaatgagttaaataatcagtgccttgtttatctcatgatttttatattagttttaaatatataatgattatgttttaatttttagctttttg

SEQ ID NO: 45864 - DNA, 201 bp, Homo sapiens
acttttttatttgttggctgcttttatgtcttcttttgataagtgtctatgtccttttctcactttttaatggggttatttgtttttcttcttgctttttyttttttttttaagttcctcatagattcttgtattagggttctctagagggacagaactaatgaaatatatatataaaggggagtttattaagtattaact

SEQ ID NO: 45865 - DNA, 201 bp, Homo sapiens
tattttattttgtgtgtgtgtaactattgtaaatgagattgtgttcttgatttggctctcagcttgaatatcattggtgtatagaaatgctactgattttkgcacattgattttgtgtcctaaaactttactggaatcgtttattagttcaagaagccttttggcagcatctttagggttttctaattatagaatcatatc

SEQ ID NO: 45866 - DNA, 201 bp, Homo sapiens
ttggctctcagcttgaatatcattggtgtatagaaatgctactgatttttgcacattgattttgtgtcctaaaactttactggaatcgtttattagttcargaagccttttggcagcatctttagggttttctaattatagaatcatatcatcaggaaagagataatttgactactacttttccaatttggatgtgtttta

SEQ ID NO: 45867 - DNA, 201 bp, Homo sapiens
cagcatctttagggttttctaattatagaatcatatcatcaggaaagagataatttgactactacttttccaatttggatgtgttttatttctttctcttrcctaattactctggctaggactccagtagtatgttgaataagagtggtgatagtgggcatccttatgctgttccagttcaaaagaggaatgcttccagct

SEQ ID NO: 45868 - DNA, 201 bp, Homo sapiens
tttccaatttggatgtgttttatttctttctcttacctaattactctggctaggactccagtagtatgttgaataagagtggtgatagtgggcatccttaygctgttccagttcaaaagaggaatgcttccagcttttgctcattcagtatgatgttggctgtggacttgtaatagatggctcttattattttgaggtatg

SEQ ID NO: 45869 - DNA, 201 bp, Homo sapiens
tccagcttttgctcattcagtatgatgttggctgtggacttgtaatagatggctcttattattttgaggtatgttcttttgatgcctaatttgttgagggtttttttttttaatcatgaaggattgctagattttattgaagctttttgctacatctgttgagatgatcataaggtttttgtttttaattctgtttatatg

SEQ ID NO: 45870 - DNA, 201 bp, Homo sapiens
ttacccaaaagtcattcaggagcaagttggtttaatttccatgtaaaattatgtggttttgaggagtactcttggtattgatttctacctttttttccacygtggtccaaaaatatgtttggcgtggtttcaatttttttacatttattgaaacttgctttgtcttcgagcatgtggttgatcttagagtatgttccacat

SEQ ID NO: 45871 - DNA, 201 bp, Homo sapiens
caagttggtttaatttccatgtaaaattatgtggttttgaggagtactcttggtattgatttctacctttttttccactgtggtccaaaaatatgtttggygtggtttcaatttttttacatttattgaaacttgctttgtcttcgagcatgtggttgatcttagagtatgttccacatgcagatgagaagaatgtttatt

SEQ ID NO: 45872 - DNA, 201 bp, Homo sapiens
atggaagaacttagaacaggaaaggattagtcttcagctttacagagaaaaagaaaaatctgaaaaacatttttcaacctttgtagtttcagtgttacgtrgctagtttatatttagatgattttctgattttgagacattaacatttttgtttatcatttgtaggtttttagaacgactgttcgagcgacatataaaaca

SEQ ID NO: 45873 - DNA, 201 bp, Homo sapiens
ggttaagcatttgtaaccttcatatctctgtgaataactgctaagagttgctttcttatgcccttaggcttggccagtttgtcatatcttgttggcattctttttttttttttttttttttggtaactacacaaatctcactatattgtttgtattatttaaatagttaatccatttagaatttctataaattaaatgtgt

SEQ ID NO: 45874 - DNA, 201 bp, Homo sapiens
ttccctttctcctgaatggatattaattttatgaaatgcttttttgcatctcttggaatgatgatattatgatataatttttctcttttaatctgtggggttttttttttttatatatatatatatagtctcactctgttgcccaggctggagtgcagtggcatgatcttggctcactacaacctccacttcctgggttga

SEQ ID NO: 45875 - DNA, 201 bp, Homo sapiens
tggaaggaagttttgatcggtgtttgcccatatccatggtgtaaatactcccatcacagccaatttcaaactgttaatgtcacatcaattggctcacaagrttcctgaacatttaagtcggctcttgctagtcaatatgaactagctctggcacttctctgcctgaaaatgactcaaaatatcccacactgggacacgctg

SEQ ID NO: 45876 - DNA, 201 bp, Homo sapiens
ctgagtcctggtaacagtgttgggggcagagtggtttcgcacatggagagtagacatgactttggctctgtctgatagacgctttttatctagcactggtrtgtggatttcccagcttgcagtacagtttgtcacaaatgtttaaaactagggtgtttatctaaaacaatacaataaaaataaattttaaaatatctgaat

SEQ ID NO: 45877 - DNA, 201 bp, Homo sapiens
tgcctacttctgattttctgattagttttagctataaatagaatgtccatgcagactatttcttcaacattccccaggtgtagctcactgactttgtatgrttggacataattaccatgtctcactaaataccaaaattatacaaaaacatagtgtgctaagtgctatcagtatctagctatttccctcaagggctctggg

SEQ ID NO: 45878 - DNA, 201 bp, Homo sapiens
ttcatctttttttcgtttcagaaaggaaattgattgctctattacttatatttggaattaaatgttaatatcttagtttaaatacttgactagaacttcarataaaatattaacatcttcaggaacatatcagttaattttgtaaacccttgaggctatcatttttttaatgtataatctcaaaatccccaattacatgaa

SEQ ID NO: 45879 - DNA, 201 bp, Homo sapiens
tccaaaagttcacggactgctttgaaatttaattatttggaactggttaaatgttaccctgacctcagctaacatttgtgtttcacttttctccgggaccsaggggacgtggatgccagatgagtccacctcctctccctgctcttcccgcagggacagagcctgccaggtgctggtgactcggatcctgacaggaggtcg

SEQ ID NO: 45880 - DNA, 201 bp, Homo sapiens
tatggtgaaacctcatctctactaaaaatacaaaaattagctgggcgtggtggtgcgcgcctgtagtcccagctactcaggagggtgaggcaggagaatcrcttgaaccccgcaaggcggaggttgcagtgagctgagatcgtgccaccacactccatcttgggcgacagagtgagactctgtctcagaaaaaaaaaaaaa

SEQ ID NO: 45881 - DNA, 201 bp, Homo sapiens
aggtaatatattaagtataagtttaattttataagaaactacagttttccagagtgaatataccatttacatttccattacttctgcacccttaccaaccsttggcgttgacagtccttttttaaccattctagtgaatatgaaatagtatcacttcatagttttagtttgcatttccctgatttctagtgatgttgcctt

SEQ ID NO: 45882 - DNA, 201 bp, Homo sapiens
ttcctcccataggccctggaaaccaacattcttttctatcactatgaatttgactactgtcaccattgtacttactatctctatgaatctattttaggtascttatataagtggaatcatatcgtgtttgttctgttgtgactggcttatttcacctagcatgatgttctcaaggttcacccatattgtaatgagtcagaa

SEQ ID NO: 45883 - DNA, 201 bp, Homo sapiens
ggaggctgaggcaggagaatcactcgaacccaggaggcagaggttgcagtgagccgagatcatgccactgcactgtagcctgggcaatagagcaagactcygtctcaaaaataaaaaataaaatgagtactttctgtgctcaaaactaccaactaagctaaactatttcatcaaaagaccccactaatcaggaaaactgat

SEQ ID NO: 45884 - DNA, 201 bp, Homo sapiens
ctgcacccactgtcctgcccccactgtccgacaagccccgtgagatgaacccggtacctcagttggaaatgcagaaatcacctgtcttctgcgtcactcgygctgggagctgtagactggagctgttcctatttggctatcttggaaccgcaaacagtatgtttttcttacattttttcctttacctttttgtttgactta

SEQ ID NO: 45885 - DNA, 201 bp, Homo sapiens
aaggaaggagtagagattaaaaagagggcaagaataaggtgttagtagcagaccactagggaagtacacacaatcccctcaggctctggcttctccctcargcctttgctagggagatctcacctgctaaggccatggagagttcattgttaactaccctgtctttgaaatttctgatgtttcaacacatataacttatta

SEQ ID NO: 45886 - DNA, 201 bp, Homo sapiens
atctctgtgaataactgctaagagttgctttcttatgcccttaggcttggccagtttgtcatatcttgttggcattctttttttttttttttttttttggkaactacacaaatctcactatattgtttgtattatttaaatagttaatccatttagaatttctataaattaaatgtgttagttaatatctagaggcacatg

SEQ ID NO: 45887 - DNA, 201 bp, Homo sapiens
tttgagggcaggaagcatccagcacaggaggaagatgtaggctgtgagagtaggccagcctcaacccttcacgtttttctgcctgctttatgttcgctcgmagctgattagatggtgcccacccagattaagggtgggtctgccttccccaacccactgactcaaatgttaatcttctttgtcagcaccctcacagatata

SEQ ID NO: 45888 - DNA, 201 bp, Homo sapiens
atagtttagggtcagcaaatttttcctgtaaagatccagatagttaatattttaaaaggctgttcaggcctctgtcacaactactctgccattggaaggcrgacatagacagtacataaataaatgagtatagccgtgttctgctgaaactttattaactgaagacattgggtcagatttggcctgaaggttatagtttgc

SEQ ID NO: 45889 - DNA, 201 bp, Homo sapiens
tactatctgtgtttttagactttacaaataacctgtagaaatggttttcctaaagtaaagccaaaaagaaatggagcaagtcaaaatgcctcccttttcawagtattacccccaccccaatgaaaagaagttgagaaatatatatgaaattattatggaataaatatttattaattatatttaaattatcaattacctaaa

SEQ ID NO: 45890 - DNA, 201 bp, Homo sapiens
tccagcacctaggttgagagaaacggtaatgaagataatgtgttcccctagggagacagaaaggatgggaggacacgagtgtcctggcagaaacctggttrggagatggacagtctcttttccaccttagcgtcttctagaaataagccatgattgcctacttctgattttctgattagttttagctataaatagaatgtc

SEQ ID NO: 45891 - DNA, 201 bp, Homo sapiens
tacagctatttagactgtgaagaataatctgttggtggcacttatcatacatgatatagccagtatacagaaggtctgcctatttacaaatggttatagckctctctgaatggccaggtggatcctgccaaatctgggaagtcatttgttactaacatctttcctagatgattggttggctggctggacaaatggaaggat

SEQ ID NO: 45892 - DNA, 201 bp, Homo sapiens
gaggaggtttgtctttccttataacttcattagaaaaattataatgtaaaaataattgtatggtttttttcataccttcaaacaatacattaaaagcaagkgctttttttttcccttgaacttttttgagggtggtggtgggagaagtgaaaggaaaagtattaatcctgtgagattttcagcactgcagtcaaaatttaa

SEQ ID NO: 45893 - DNA, 201 bp, Homo sapiens
ggtcaggagttcgagaccagcctggccaatatggtgaaaccctgtctctgctaaaaatacaaaaattagctgggcatggtggcatgcacctgtactcctasctactcaggaggctgaggcagaagaatcgcttgagtccaggaggcggggttgcagtgagccaagattgtgccactgcactccagcctgggcgacagagcg

SEQ ID NO: 45894 - DNA, 201 bp, Homo sapiens
atgtgggtttccacacgctgctctgtccatctgagtgggaactgcaaattagtcctgcctcctatctaccatcttccctccagtataccccctgctgctastatttttaaacaaaccatgccactctcttctttaaaacacctgtgagagtttgcacttgctaacacaataaagtccaggacctttggcattttctatgtt

SEQ ID NO: 45895 - DNA, 201 bp, Homo sapiens
gccaatatggtgaaaccctgtctctgctaaaaatacaaaaattagctgggcatggtggcatgcacctgtactcctagctactcaggaggctgaggcagaasaatcgcttgagtccaggaggcggggttgcagtgagccaagattgtgccactgcactccagcctgggcgacagagcgagactccatctcaaaaaaaaaaaa

SEQ ID NO: 45896 - DNA, 201 bp, Homo sapiens
tacatggcaactaaacaacacattcttgaacaagtattgagtcaaagaagaaataaaaacagaattttgatatcttgaggcaaaggaaaacaaaaccacartataccaaaacttacagaatgcagcaaaattagtactaagagagtggtttatagtgatgaatacttacattaaaagaggggatctcaaacaactcaactg

SEQ ID NO: 45897 - DNA, 201 bp, Homo sapiens
ttgtcatatcttgttggcattctttttttttttttttttttttggtaactacacaaatctcactatattgtttgtattatttaaatagttaatccatttaraatttctataaattaaatgtgttagttaatatctagaggcacatgtgaaataaataatttttaaaatgtgttagtaactctttatataggaaaataaatg

SEQ ID NO: 45898 - DNA, 201 bp, Homo sapiens; identical to SEQ ID NO: 8629

SEQ ID NO: 45899 - DNA, 201 bp, Homo sapiens
gtggtgcgcgcctgtagtcccagctactcaggagggtgaggcaggagaatcgcttgaaccccgcaaggcggaggttgcagtgagctgagatcgtgccaccrcactccatcttgggcgacagagtgagactctgtctcagaaaaaaaaaaaaaaagaaaaagaaaaaagaaaaaacaagatagatacccaaatagtatgtat

SEQ ID NO: 45900 - DNA, 201 bp, Homo sapiens
cattacatgtgtgatgggcctcttgaagatagtagaaggttgggtcttgttttttgtttttttttaaataaaatattattttattttttaaataaaaaaawtaaaaagtggttcttgccactctgtgccttttaactgggtacatttagaccacttacattcaaggttaatattgatatgtgaggtttgatcctgtcatgg

SEQ ID NO: 45901 - DNA, 201 bp, Homo sapiens
cctttgcatcctcatagcttagctcccacttatgagtgagaacatacaatgtttggttttccattcctgagttacttcacttagaataatggtctccaatwccatctaggttgctgcaaatgccattatttcattcctttttatggctgagtagtattcaattgtgtgtgtgtgtgtgtatatatatacacacatcacatt

SEQ ID NO: 45902 - DNA, 201 bp, Homo sapiens
ctctttatcttttggaatagtgtccataggattggtaccaattcttctttgaatgtctgatagaattcagctgtgaattcatctggtcctggaatttttgkttttttgttagtaattttttttttttttttttgagatagagtctcgctctgtcacctaggctggagtgcagtggtgcgatctcagctcactgctgcaacc

SEQ ID NO: 45903 - DNA, 201 bp, Homo sapiens
ccaaactgctgggattgcaggcgtgagccactgctcccggccgtgattgttttttacttatgctatttcactggagatttttccattcatatcctatatcttttttttttttttctttgaaaaggagtcttgctctgtcacccaggctggagtgcagtgccacaatctcggctcactgcaacctctgcctccctaggttca

SEQ ID NO: 45904 - DNA, 201 bp, Homo sapiens
tggctgtgggtttgtcataaatagctcttattattttgagatacatcccatcaatacctaatttattgagagtttttagcatgaagggctgttgaattttmtcaaaggccttttctgcatctattgagataatcatgtggtttttgtctttggttctctttatatgctggattacatttattgatttgcatatgttgaacc

SEQ ID NO: 45905 - DNA, 201 bp, Homo sapiens
cagtggcatgatcttggctcactacaacctccacttcctgggttgaaacaattctcctccctcagcctccccagtagctaggatcacaggcacccaccacractccagctaatttttgtgttttcagtagagatggggtctcgccatgttggccaggttggtctcaaactcctgacctcaagtgatctgcccacctcggcc

SEQ ID NO: 45906 - DNA, 201 bp, Homo sapiens
cagtataccccctgctgctactatttttaaacaaaccatgccactctcttctttaaaacacctgtgagagtttgcacttgctaacacaataaagtccaggmcctttggcattttctatgttatattttccttcccagttcatgtcctgccatcctctccgaagcaccctgtgtcaatcacacctactcgcttgttcttcac

SEQ ID NO: 45907 - DNA, 201 bp, Homo sapiens
atggaaagtttgcaaaaccagattagctattgcatagcttaaggaaactgtgtgtcctgaattttgcttgaacatttatgtatctaagattcattgagcaytgagctctactttgtgttatgtaacctaggaccctattatgtatactacttgctttctctgtcataataatatgccaagcatagacatttttaataaatt

SEQ ID NO: 45908 - DNA, 201 bp, Homo sapiens
atttgactcaattaatgtaattagtctcatcttttcttaatcctaggaaaaaatgcgccacctgctgcatgtcctgaaagtagacttaggctgcacatcgraggaaaactcggtaaagcaaaatgatgttgatatgttgaatgtatttgattttgaaaaggctgggaattcagaaccaaatgaattaaaaaatgaaagtga

SEQ ID NO: 45909 - DNA, 201 bp, Homo sapiens
cccctcttcagcctgtgcttcgcacgtttccttcagcgtgccgccattcagactgcgccacttacgtcccagtgccacgctgcgtggatcaagtgtcaacrggaaagtatgagttaggcaagcgctttttttttaagctgtaaacgcttcacatgactggccccgtaagaaattgtgggagcttagatgagcctggagctt

SEQ ID NO: 45910 - DNA, 201 bp, Homo sapiens
gtcccctgcgccgtgacgtcacaatagcgactcactggacccagcccttagcaacggcctggcgacggtttccctgctgctgcagcccccgtcggctcctyttttccagtcctccactgccggggctgggcccggccgcgggaaggaccgaaggggatacagcgtgtccctgcggcggctgcaagaggactaagcatggat

SEQ ID NO: 45911 - DNA, 201 bp, Homo sapiens
taaaagtcagagcaacctctgtccttcccagatatggtccaccgtgcctatttaaaggacacttgagcaccaaaagtaatggtaagtgaggtgcttaaaayggcagctttgttagaagattgtctgagtgtttcctttactggcaaattatatgacatgatggaaaaattgtttcatttgacgaatatttgaacttcatat

SEQ ID NO: 45912 - DNA, 201 bp, Homo sapiens; identical to SEQ ID NO: 8627

SEQ ID NO: 45913 - DNA, 201 bp, Homo sapiens
gccgggcaaataagtgcgccctgagtcctggtaacagtgttgggggcagagtggtttcgcacatggagagtagacatgactttggctctgtctgatagacrctttttatctagcactggtatgtggatttcccagcttgcagtacagtttgtcacaaatgtttaaaactagggtgtttatctaaaacaatacaataaaaat

SEQ ID NO: 45914 - DNA, 201 bp, Homo sapiens
cccatatttcttggaggctttgttcatttccttttactcttttttctctaaacttctcttcttgcttcatttcattcatttgatcttcaatcactgatacsctttcttccagttgatcgaatcggctactgaagcttgtgcattcatcacgtagttctcttgccatgtttttcagctccatcaggtcatttaaggacttct

SEQ ID NO: 45915 - DNA, 201 bp, Homo sapiens
acccagttcgagcttcctggctgctttgtttacctactcaagcctcagcaatggtggatgcccctcccccagcctcgctgccatcttgcagatagatctcrgaccgctgtgctagcagtgagtgagtatctgtgggcgtgggaccctccgagccaggtgtgggatataatctcctggtgtgccgtttgctaagaccattgg

SEQ ID NO: 45916 - DNA, 201 bp, Homo sapiens
gctcagtatttgggtgggaattacctgattttccaggtgccatctgttaccacttcccttggctaggaaagggaattccctgaccccttgcacttcccggstgaggcgatgcctcaccctgctttggcttacgctcggtgggctgcacccactgtcctgcccccactgtccgacaagccccgtgagatgaacccggtacct

SEQ ID NO: 45917 - DNA, 201 bp, Homo sapiens
cagttctttaataataaatatctgatgtttagatttccccactgtctcctttttgagtttgttagagttggtattagaaggccagcagtctccttcaactyagtgccagggttcaggatggggaagtttccttgcaagtcatctagttgaggagtagccattgagagaatcccagattctcaagcatgatctcttaagagc

SEQ ID NO: 45918 - DNA, 201 bp, Homo sapiens
aaggacttcaaatgttttctaaaactctctctacccaagtagacatgcaaactttgatctgaatttcctgacatttccttatttttctgtttttgttttgtttttttttgagacagagtcttgctctgtcacccaagctggagtgcagaggcgagatctcggctcactgcaacctctgcctcctgggttcaagcaattctc

SEQ ID NO: 45919 - DNA, 201 bp, Homo sapiens
atcctgattaatgaagctggctagtttggcaagatgcattctaactcttaaagtgattgattactgtggagatgtgtgatgacagattggcacctactaargaaacctctcttgcctggtacattattaaaaataatccaatggggaaataggactaatttaattacatgcctttatgcagtaagatccacagttgaaaaa

SEQ ID NO: 45920 - DNA, 201 bp, Homo sapiens
actgtgacaaggccatcttaatcggggccagagatgacactctccccctgtaactcagcctggctctgtctattgggatgtgcctaaatgggatgggtgagggggcactaaacagctaacactggccagggaattaaggagctaaaatgcaagtacctcttgaataccacagcaatctctgtgcacaaatttggactgtac

SEQ ID NO: 45921 - DNA, 201 bp, Homo sapiens
agaacgactgttcgagcgacatataaaacaaaataaacatttggaggaggtttgtctttccttataacttcattagaaaaattataatgtaaaaataattktatggtttttttcataccttcaaacaatacattaaaagcaagtgctttttttttcccttgaacttttttgagggtggtggtgggagaagtgaaaggaaaa

SEQ ID NO: 45922 - DNA, 201 bp, Homo sapiens
aaggagggaggatcacttgagcctaggagttcaggaccagcctgagaaacacagtgagaccccgtctctgcaaaaaattaaaaaacgagccaggtgtggtrgtgcatgcctgtggtcccatctacttgggaggatgaggcaggaggattgcttgagcccaggaggttgaggctgcagtgaaccatgagaacctatctcaaa

SEQ ID NO: 45923 - DNA, 201 bp, Homo sapiens
gcttcagacaaagttgggtaccagacaatatggtctccagaagtttctcccattctgctgccctctccagatcacgcacccccccgttctacttgaaaacmaaatctacttgtcatcctaaagtctacttttctaagaggagctggtatcaccttccctgagtcaagtcactgtgttgcttatcccaagggtgtttgcctt

SEQ ID NO: 45924 - DNA, 201 bp, Homo sapiens
attccccttagtaatatgagatagaagtacattggtaatggtagagatagatatttctaattaggtactaatgtttcttacagttttcagaataagtaagraataatttttatgctatatattgccttccttttacagtgaagaagaactgttgtatctgagtttcattgaagatgtaacagatgaaattttgaaacttgg

SEQ ID NO: 45925 - DNA, 201 bp, Homo sapiens
gtttttctagtattacataaacaatttatctggcagtaggttttagttgttttagaaagtaaaaacaatttaagattagtatttttttctttgaatatagrtaagtacagtgatatcagatgagtctgcagatatttaatcaaataaaatcaaataattcaaaattatgtattttataagaatagatgggtctcattcttt

SEQ ID NO: 45926 - DNA, 201 bp, Homo sapiens
ggtctcgatctcctgacctcgtgatctgcctgcctcggcctcccaaagtgctgtgataatcattgtctttttaatggggcatttaatatgtttttatttcyggcttcttatttcataccttctatttgactcaatgtggtagacaaaatttgaagacaacacccccacagtgacccacacccttaagcaatcccctcctct

SEQ ID NO: 45927 - DNA, 201 bp, Homo sapiens
cttcagtgtttcattttgtttattaaataaccattaccgataacatttctttacaggcaatcataatggcttatgcatttctttctccttcctctgatctyagtttgtgctgttcttctaagtgtaaataattcctgtgcttattaattaattgccctataggatatttttagactgtacttagaaatttcttctttgaga

SEQ ID NO: 45928 - DNA, 201 bp, Homo sapiens
atgaatgagacccttactattagaacatggcccagcagattcatctctaattatacctttttaactatttacaataatataattgaatatttgtgtgcccrttatgtacaaagtttcatgcctagatactgtggaggataaaaacaataacccattttgtttttataagctatattttaattttatatttaaaaaaataca

SEQ ID NO: 45929 - DNA, 201 bp, Homo sapiens
ttttgcagggaacattagtaacatcttgaggccaccacagtccaaggaaatgtgcgcaaaaagagctattaagtcactatgtccctctcttccccagcctyatttccacccaaaaaggccaggtgatcataagcgccatcacctcattgtgttccaggcaggcgatcatgatctccgacaaaatcaccacgccagtccttc

SEQ ID NO: 45930 - DNA, 201 bp, Homo sapiens
gatgtaggcatttaatactatgaactttcctcttagctctgtctttgctgtattccagaggttcagatattttgatagtttgtgtcactactatcattcakttcaaagaattttttaatttccatcttgatttcattgttgacccagtgatcattcaggagcaggttattgtacttccatttatttggcatggttttgagg

SEQ ID NO: 45931 - DNA, 201 bp, Homo sapiens
ccattcactcctcgcactttaaaaacagaagcaaaatctttcctgtcacagtatcgctattatacacctgccaaaagaaaaaaggattttacagatcaacrgatagaagctgaaacccagactgaattaaggtatgacacatcagcaaccaacagtaaatccttcaggaaattaaatgaaaattaatgaattaatattcct

SEQ ID NO: 45932 - DNA, 201 bp, Homo sapiens
ctaactcttaaagtgattgattactgtggagatgtgtgatgacagattggcacctactaaggaaacctctcttgcctggtacattattaaaaataatccartggggaaataggactaatttaattacatgcctttatgcagtaagatccacagttgaaaaatagaggcagtagctttaattgcactgtaatgttcacacac

SEQ ID NO: 45933 - DNA, 201 bp, Homo sapiens
ctcattgtgttccaggcaggcgatcatgatctccgacaaaatcaccacgccagtccttcctaccccagcactgcagtggaccaacaacggagggttggggytttggggatcacttgtgctatttgtatggcgtcgaacagactggatctcttcaagatatgctgtggaaaatcaatgaaatagaaaagtactcaaggatca

SEQ ID NO: 45934 - DNA, 201 bp, Homo sapiens
cctaagcccttccagtcttcaccctgtaactcttgagtcattcactacttagtcaatgctcccatactactcgtttgcttcactggtgtagcacttactgygtgcttttaagattaagtgaatatgtgggtgtgagctttatttctgaataaatctagaaaagaggcgggagcagtggctcacacctgtgatcccaacact

SEQ ID NO: 45935 - DNA, 201 bp, Homo sapiens
cactgaaaaggaaaagctgtgcagagaaaaagagcacttgaataatacatttcctattaggagcaaaggcctatgggcctctttatccaactggatttctrggtgctgtgatatttttatattttaaagctttcaaggtacatttttaaggtaggttttaaaataaatttttgtaattataccttagaagtataagtctat

SEQ ID NO: 45936 - DNA, 201 bp, Homo sapiens
cataggcttgtattatgcacagagtctctggaaggatgcatttaaacagtaacatagtatatttctgggaagggagactaaaggtcagggtagagaaatcrcttctttttcaaactccatatgccattttagctgttgaatttttttaaccacattgcgtgtattacttctcaaaaactgtttttaatgtttaaaaaagct

SEQ ID NO: 45937 - DNA, 201 bp, Homo sapiens
actaagaatggtgttcatatttttaaatggtagcaaaaaatttaaaaaaaagtattttgtgacctgaaattcaaatgtagttatccatagacaaacaatcwttttcaatcttttacatattgtctgtggcagcttttacactaaaaagcagagttgaccagttgtaacagactgtatcaccctgcaaatcctgaagcattt

SEQ ID NO: 45938 - DNA, 201 bp, Homo sapiens
ttttcaatcttttacatattgtctgtggcagcttttacactaaaaagcagagttgaccagttgtaacagactgtatcaccctgcaaatcctgaagcatttrctacctggccctttgtagaaaaaatttgccaacccttgatatagaaaaagtccattacctcaaagagttccccctagtcctttgccgtcagtcccctcct

SEQ ID NO: 45939 - DNA, 201 bp, Homo sapiens
cgtactgtataatttttatctactggatatctctgttcaatcacttaaaatttgctgtgttatattctgctttcgtaatgtatttttaagcaaaaataaakattttttttattgcatccccaggcatctaattgtgtgacatatgatgccaaagaaaaaatagctcctttacctttagaagggcatgactcaacatgggat

SEQ ID NO: 45940 - DNA, 201 bp, Homo sapiens
tgtttttctcacttttcctgcaatatctaaagcctcaaggacctttcagttgtcagtgacccagggaattctgtcagctggctgagatgttgtctcttgtkgtgagtgcaaacatttagtcagacctgtctgaagccctctcctacccttgtagctcatgaatgagacccttactattagaacatggcccagcagattcat

SEQ ID NO: 45941 - DNA, 201 bp, Homo sapiens
tgctgctgcagcccccgtcggctcctcttttccagtcctccactgccggggctgggcccggccgcgggaaggaccgaaggggatacagcgtgtccctgcgrcggctgcaagaggactaagcatggatggcagccggagaggtaaagggcagctgtcaggggctaccgccgcctcgcccctcgctccaggcggcgctcccag

SEQ ID NO: 45942 - DNA, 201 bp, Homo sapiens
tgtcagacgtggcagccagcccggtgggggtggggggggtcgaaccgcagccccccagagggaggctgccaggaagcaggtagctggaggggccagggggyagacccaaagaggtgggcacaggagctggggtcatccccagacttgagggtggctttctgtggctgaggatctgtgggacgaggacagaggggtgatgag

SEQ ID NO: 45943 - DNA, 201 bp, Homo sapiens
cacatttccaacagccacccactctccctcacctccgaccagtacaaggcctacctgcaggacttggtggagggcatggatttccagggccctggggagasctgagccctcgctcctcatggtgtgcctccaacccccctgttccccaccacctcaaccaataaactggttcctgctatgatcacttgtgcgtgtctggtg

SEQ ID NO: 45944 - DNA, 201 bp, Homo sapiens; identical to SEQ ID NO: 8722

SEQ ID NO: 45945 - DNA, 201 bp, Homo sapiens; identical to SEQ ID NO: 8706

SEQ ID NO: 45946 - DNA, 201 bp, Homo sapiens
tcaccttatctgtgtccccacggccctcagagctgctgctgccctctctcttgtcagacgtggcagccagcccggtgggggtggggggggtcgaaccgcasccccccagagggaggctgccaggaagcaggtagctggaggggccagggggcagacccaaagaggtgggcacaggagctggggtcatccccagacttgagg

SEQ ID NO: 45947 - DNA, 201 bp, Homo sapiens
gggaaggaggcgggggcccggggcatgctcggcttgggcgagagctgtcatcccggctacagaacagctccaccaggcgggcgaaagagtcggaggacagkcggaccagcttgctgcgcagggcggggtccgaggccagctgtagggtggaagaggcagggtccgcgtcagcagcgcccccggggccagccaatagagggc

SEQ ID NO: 45948 - DNA, 201 bp, Homo sapiens
aattagctgccactgtcatcatcatcgtaactaatgatggtgaacagaccaatagcaggaaagctacatcccttagggtttcgctgtgcagtggcactttytgccatgatggaaatgacagtcacctgcactgtccggtgcagcagccactagccacaggggccaagcactcaggtgaggcgagtgcaaccaggacgtgat

SEQ ID NO: 45949 - DNA, 201 bp, Homo sapiens
ggaggctgaggtgggcagatgacaagttcaggagttcgagaccagcctggtcaacatagtgaaaccccatctctactaaagatacaaaaaaatagtcgggygtggtggcacgtgcctgtaatcccagctactcgggaggctgaggcaggagaattgcttgaacccaggaggcggagattgcagtgagctgagatcgcacca

SEQ ID NO: 45950 - DNA, 201 bp, Homo sapiens
caaggccgaggggactcagagggggctgctcctcgccccagggagcagggaagacatcttcgaaggcggctcaggaagtctgttggctcttcttgggcagrgcttctggagaggaggacttcagagactgaccccaccagagatcccctgcaagcagtctctttccccaactccctccctcccccgctgaggacctctctc

SEQ ID NO: 45951 - DNA, 201 bp, Homo sapiens
gccatgattcccattttataatggggtaaactgaggcccagtgagaaaacttggttaaaaatgccaaaacccttgtacttttcactttatgagatcctcakactggacttagaatgtcagagctggggccaggcgcagtggctcacgcctgtaatcccatcactttgggaggctgaggcaggcagatcacctgaggttggg

SEQ ID NO: 45952 - DNA, 201 bp, Homo sapiens; identical to SEQ ID NO: 8702

SEQ ID NO: 45953 - DNA, 201 bp, Homo sapiens
ctgcctcagcctcatgagtagctgggactacaggcgcacgccgccatacctggctaattttttgtattttagtagaaatggggtttcaccgtgttgcccakgctgacctcaggcaatccacccacctcagcctcccaaagtgctaggattacaggcgtgagcaaccaagcctggccatgattcccattttataatggggta

SEQ ID NO: 45954 - DNA, 201 bp, Homo sapiens; identical to SEQ ID NO: 8705

SEQ ID NO: 45955 - DNA, 201 bp, Homo sapiens; identical to SEQ ID NO: 8703

SEQ ID NO: 45956 - DNA, 201 bp, Homo sapiens
tgggctcaagtgatcctcccggctcctctgcctcctgagtagctgggagtaaacgtgtgagctaccatgctttgctaattattattaattttaaaaatttktatttatttattttttgagacagagccccgctcttgttgcccaggctggagtgcagtggtgcaatctcggctcactacaacctctgcctcccaggttcaa

SEQ ID NO: 45957 - DNA, 201 bp, Homo sapiens
ttcccccaactaccttggcaggtggcaatgattcccattttatttattatttatttatgtattgattttgggaaacggagtctcgcaattctcctgcctcrgcctcatgagtagctgggactacaggcgcacgccgccatacctggctaattttttgtattttagtagaaatggggtttcaccgtgttgcccaggctgacc

SEQ ID NO: 45958 - DNA, 201 bp, Homo sapiens
attctcctgcctcagcctcatgagtagctgggactacaggcgcacgccgccatacctggctaattttttgtattttagtagaaatggggtttcaccgtgtkgcccaggctgacctcaggcaatccacccacctcagcctcccaaagtgctaggattacaggcgtgagcaaccaagcctggccatgattcccattttataat

SEQ ID NO: 45959 - DNA, 201 bp, Homo sapiens
actgcaacctccacctcctgggctcaagcgattctcctgcctcagccttctgagtagctgggattacagaagcgcaccaccacacctgtccgatttttgtwtttttagtagagatggggtttcaccatgttggccaggctggtctcgaactcctgacctcaagtcatccacccaactcggcctcccaaagtgctgggatta

SEQ ID NO: 45960 - DNA, 201 bp, Homo sapiens
tcactgcaacctccacctcctgggctcaagcgattctcctgcctcagccttctgagtagctgggattacagaagcgcaccaccacacctgtccgatttttktatttttagtagagatggggtttcaccatgttggccaggctggtctcgaactcctgacctcaagtcatccacccaactcggcctcccaaagtgctgggat

SEQ ID NO: 45961 - DNA, 201 bp, Homo sapiens
ccttgcagagttagaacttgccagggaaagagggtggtgttaggactcgggagacagggttagggccccaggagcaggatctaagtcgtcctcccccaccrtcctgacaccactgttgccccaggcctgggccgaggccactggtgcatatgttcccgggagggataagccagacctgccaacctggaagaggaatttccg

SEQ ID NO: 45962 - DNA, 201 bp, Homo sapiens
gtctctagagagacgctgctccccaacacccatctcggatgggcaaagcggggcaaagggcagagcacagaccagggcagagcaagggccactgtagaccagggggtcctcaccgtccgagtcctgcagcgcaaggcacaagctacggacaagtgaccgactaaactgcagccccgcctctgcggctcacacaggatgttt

SEQ ID NO: 45963 - DNA, 201 bp, Homo sapiens
cccaagggttcctggcactcctactcccctcaccacttttctcaacaggagttggggacttttcccagccagacacctctccggacaccaatggtggaggyagtacttctgatacccaggtgagaatgtgcccaactttcatgcccctcagtctccgacctgtctccatgggccttgtcctctccctctagacgatccccc

SEQ ID NO: 45964 - DNA, 201 bp, Homo sapiens
ctcaggggtaatgtttcatgaaatctttaatgaaattggggagaggggcacaaacagaagggaggggcactggggacaggcttgggggcaagggaggtggrcacggggcagggcagggcagggggctctcctcttccctgcagcaaccctcccccagtcatcccactgacgggggagggaggtggggaggtggagccataa

SEQ ID NO: 45965 - DNA, 201 bp, Homo sapiens
cgttctctccccggcctgtgtctgcccctctctccgggtgcccaccttgtggacggccttcctcaggatgtccttgtactcctccttggtgatgtccttcytctgatagtatggcttgatggccagcttcacctcctccaccgcccgctcctgcgtgtgcagcttcttcagatactggtggggtggcgacagcgggggaag

SEQ ID NO: 45966 - DNA, 201 bp, Homo sapiens
gccctgactcctaccttggtggacagtggctgggtgttttccctgactcctgtccccacttcccctgcaggttgtgcccacgtgcctcagggccttggtaraaatggcccgggtagggggtgcctcctccctggagaatactgtggacctgcacatttccaacagccacccactctccctcacctccgaccagtacaaggc

SEQ ID NO: 45967 - DNA, 201 bp, Homo sapiens
tggctcttcttgggcagggcttctggagaggaggacttcagagactgaccccaccagagatcccctgcaagcagtctctttccccaactccctccctcccscgctgaggacctctctccaaaaccccaaagacagagaatagagccagatataaagagaggagacagactgagaccaggagcaagagttaggagggagcct

SEQ ID NO: 45968 - DNA, 201 bp, Homo sapiens
gttcaggatcgttctagatgctaaggttctaggccacccctcatccatattagccaatcaagccagactccagggtctctgccaaactacccccgggatastggcctggaacgtgagtccctaagccatgccaggcccttgcctcaacagccaatcagggccaatctctactgtaactgagttaatctagccatgcccctg

SEQ ID NO: 45969 - DNA, 201 bp, Homo sapiens
tccggggccccaccgccgcctcctccactcaacttgcggtctcctccactgaactcgtacaaactttattagttcaactttcccgcgcctgcgcactgggmcgggtcgataaccggcccagcgtagaaagggcggaacgctgggtgcacgctcaatttgcatgtgacgctcccagcatgcctctggccggaaacccaaaaa

SEQ ID NO: 45970 - DNA, 201 bp, Homo sapiens
ctgctctgtgcctcagtttccctctcaggacagttgatgagatcaccccagcttcacggggctgctgaaaagagaagccaactcaatggggaacacagatmctgctctgggagcaattccaaggcaggcacatggcacccaggagccgagctgggaagatgctgatcaggtggggtccggcccctgcctccctgtgagcag

SEQ ID NO: 45971 - DNA, 201 bp, Homo sapiens
caaggctgaggctacagtgagctgtgactgtgccactgcatgccagcttgggtgacaaagcgagaccctgtctcaaaaaccaaccaaccaaggccgggcayggtggctcacacctgtaatccctgcactttgggaggccgaggctggcagatcacctgaggtcaggagtcaagaccagcctggccaacgtggtgaaatgcc

SEQ ID NO: 45972 - DNA, 201 bp, Homo sapiens
gggggtcgaaccgcagccccccagagggaggctgccaggaagcaggtagctggaggggccagggggcagacccaaagaggtgggcacaggagctggggtcrtccccagacttgagggtggctttctgtggctgaggatctgtgggacgaggacagaggggtgatgagtaaagggaggtggaggggaagaggggacgtgcac

SEQ ID NO: 45973 - DNA, 201 bp, Homo sapiens
ggctcgtgccaacgctggtgggtggggctagaacgggaggggcggggctagccggatccgctgactgatggtggggcgcaagcagggttggagctgcaggsttacgggaataaaaccgggaaagccggttagtacgcaaaggaaatgcatcctgggggtttggggctttctagaggccggggctcttggttgtaggataga

SEQ ID NO: 45974 - DNA, 201 bp, Homo sapiens
gcgagtgcaaccaggacgtgattcgttttaattggttacaatttaaactgaaataaccttacatgactaatggctgcaattggacaatgcagcctcagacrggactgaatgccaaccagcttctccagattcactgagcatccttgggagcatgggccccctactctgggcctgttatgaatgctgaggcttgggggcttg

SEQ ID NO: 45975 - DNA, 201 bp, Homo sapiens
gcaattctcctgcctcagcctcatgagtagctgggactacaggcgcacgccgccatacctggctaattttttgtattttagtagaaatggggtttcaccgkgttgcccaggctgacctcaggcaatccacccacctcagcctcccaaagtgctaggattacaggcgtgagcaaccaagcctggccatgattcccattttat

SEQ ID NO: 45976 - DNA, 201 bp, Homo sapiens
gctccccaacacccatctcggatgggcaaagcggggcaaagggcagagcacagaccagggcagagcaagggccactgtagaccagggggtcctcaccgtcygagtcctgcagcgcaaggcacaagctacggacaagtgaccgactaaactgcagccccgcctctgcggctcacacaggatgtttaatggggtttatacagc

SEQ ID NO: 45977 - DNA, 201 bp, Homo sapiens
cccaataaccaggccaaagtccctctgtccccctagacgatgggtgccccagggccagcggaacaggcccaggtggccttgagaaaatcctgtcaccctcmtcacctcccagactgacctcctccccgtctcccatccgcgtccatctgtctgcacacatctgtccctccagctcgttctctccccggcctgtgtctgccc

SEQ ID NO: 45978 - DNA, 201 bp, Homo sapiens
gcatatgttcccgggagggataagccagacctgccaacctggaagaggaatttccgctctgccctcaaccgcaaagaagggttgcgtttagcagaggaccrgagcaaggaccctcacgacccacataaaatctacgagtttgtgaactcaggtctgccagcttggggttcgtgtgggaggctggggccccaagggttcctg

SEQ ID NO: 45979 - DNA, 201 bp, Homo sapiens
acacaagacattactgttagtatccccttccctcactcactacagacatcaccaattgatcacagcacttcctctcccaagctgtgaaccccttttcaagytagcactcccagcagccattactagtctgtccaggttcacacctatgaggaaacttgtgggtcaccttgatcaagtccagtgacctcctccccaattcct

SEQ ID NO: 45980 - DNA, 201 bp, Homo sapiens
caccagacacgcacaagtgatcatagcaggaaccagtttattggttgaggtggtggggaacaggggggttggaggcacaccatgaggagcgagggctcagstctccccagggccctggaaatccatgccctccaccaagtcctgcaggtaggccttgtactggtcggaggtgagggagagtgggtggctgttggaaatgtg

SEQ ID NO: 45981 - DNA, 201 bp, Homo sapiens; identical to SEQ ID NO: 8729

SEQ ID NO: 45982 - DNA, 201 bp, Homo sapiens
gtactagctctggggaagtacccgtgtgccacacctctattctggaatcctctcagacatgagactggtttgcagaggtggcagatgccctgtgggcataycctgccagccccgctcccttctgctattcatggcaccctaggataggggtgtgtgtgtcaggaagtgtcacctaatctggaggagattaggtgatgagag

SEQ ID NO: 45983 - DNA, 201 bp, Homo sapiens
tccgtggctttggggttcccatggtccggcctgcgcgtatagggcatttcctgggcgcgaccggcctcccccggacccacctggcctggagtttccgcacycagacctccttctcacgggccacggcacaggtccttcacccatattttcgggggtacaaacaggaaacctcctcttcccatcctcccatcctcccgagag

SEQ ID NO: 45984 - DNA, 201 bp, Homo sapiens
gccctctattggctggccccgggggcgctgctgacgcggaccctgcctcttccaccctacagctggcctcggaccccgccctgcgcagcaagctggtccgmctgtcctccgactctttcgcccgcctggtggagctgttctgtagccgggatgacagctctcgcccaagccgagcatgccccgggcccccgcctccttccc

SEQ ID NO: 45985 - DNA, 201 bp, Homo sapiens
atcacgtcctggttgcactcgcctcacctgagtgcttggcccctgtggctagtggctgctgcaccggacagtgcaggtgactgtcatttccatcatggcaraaagtgccactgcacagcgaaaccctaagggatgtagctttcctgctattggtctgttcaccatcattagttacgatgatgatgacagtggcagctaatt

SEQ ID NO: 45986 - DNA, 201 bp, Homo sapiens
gagagaggtcctcagcgggggagggagggagttggggaaagagactgcttgcaggggatctctggtggggtcagtctctgaagtcctcctctccagaagcyctgcccaagaagagccaacagacttcctgagccgccttcgaagatgtcttccctgctccctggggcgaggagcagccccctctgagtcccctcggccttg

SEQ ID NO: 45987 - DNA, 201 bp, Homo sapiens
tggtgcgatctcagctcactgcaatctccgcctcctgggttcaagcaattctcctgcctcagcctcccgagtagctgggattacaggcacgtgccaccacrcccgactatttttttgtatctttagtagagatggggtttcactatgttgaccaggctggtctcgaactcctgaacttgtcatctgcccacctcagcctcc

SEQ ID NO: 45988 - DNA, 201 bp, Homo sapiens
cccaacctcaggtgatctgcctgcctcagcctcccaaagtgatgggattacaggcgtgagccactgcgcctggccccagctctgacattctaagtccagtmtgaggatctcataaagtgaaaagtacaagggttttggcatttttaaccaagttttctcactgggcctcagtttaccccattataaaatgggaatcatggc

SEQ ID NO: 45989 - DNA, 201 bp, Homo sapiens; identical to SEQ ID NO: 8727

SEQ ID NO: 45990 - DNA, 201 bp, Homo sapiens
taccccattataaaatgggaatcatggccaggcttggttgctcacgcctgtaatcctagcactttgggaggctgaggtgggtggattgcctgaggtcagcmtgggcaacacggtgaaaccccatttctactaaaatacaaaaaattagccaggtatggcggcgtgcgcctgtagtcccagctactcatgaggctgaggcag

SEQ ID NO: 45991 - DNA, 201 bp, Homo sapiens; identical to SEQ ID NO: 8730

SEQ ID NO: 45992 - DNA, 201 bp, Homo sapiens
ggtcagcctgggcaacacggtgaaaccccatttctactaaaatacaaaaaattagccaggtatggcggcgtgcgcctgtagtcccagctactcatgaggcygaggcaggagaattgcgagactccgtttcccaaaatcaatacataaataaataataaataaaatgggaatcattgccacctgccaaggtagttgggggaa

SEQ ID NO: 45993 - DNA, 201 bp, Homo sapiens
ttgaacctgggaggcagaggttgtagtgagccgagattgcaccactgcactccagcctgggcaacaagagcggggctctgtctcaaaaaataaataaatamaaatttttaaaattaataataattagcaaagcatggtagctcacacgtttactcccagctactcaggaggcagaggagccgggaggatcacttgagccca

SEQ ID NO: 45994 - DNA, 201 bp, Homo sapiens; identical to SEQ ID NO: 8728

SEQ ID NO: 45995 - DNA, 201 bp, Homo sapiens
attataaaatgggaatcatggccaggcttggttgctcacgcctgtaatcctagcactttgggaggctgaggtgggtggattgcctgaggtcagcctgggcmacacggtgaaaccccatttctactaaaatacaaaaaattagccaggtatggcggcgtgcgcctgtagtcccagctactcatgaggctgaggcaggagaat

SEQ ID NO: 45996 - DNA, 201 bp, Homo sapiens
taatcccagcactttgggaggccgagttgggtggatgacttgaggtcaggagttcgagaccagcctggccaacatggtgaaaccccatctctactaaaaawacaaaaatcggacaggtgtggtggtgcgcttctgtaatcccagctactcagaaggctgaggcaggagaatcgcttgagcccaggaggtggaggttgcagt

SEQ ID NO: 45997 - DNA, 201 bp, Homo sapiens
atcccagcactttgggaggccgagttgggtggatgacttgaggtcaggagttcgagaccagcctggccaacatggtgaaaccccatctctactaaaaatamaaaaatcggacaggtgtggtggtgcgcttctgtaatcccagctactcagaaggctgaggcaggagaatcgcttgagcccaggaggtggaggttgcagtga

SEQ ID NO: 45998 - DNA, 201 bp, Homo sapiens
agtggacgaggagtgataattcctttgagccaatcgttggtgcctgaagccccgccttcttccctacccgtgggccaattgccgtgttctccttgaggccrgccgcttggcgagggtgggccaaaggctgcgtgacgtcgcttccggataaaccaatggcagcgattaggaggcgggtcgttttggtgatggacaggtgtt

SEQ ID NO: 45999 - DNA, 201 bp, Homo sapiens
cggaaattcctcttccaggttggcaggtctggcttatccctcccgggaacatatgcaccagtggcctcggcccaggcctggggcaacagtggtgtcaggayggtgggggaggacgacttagatcctgctcctggggccctaaccctgtctcccgagtcctaacaccaccctctttccctggcaagttctaactctgcaagg

SEQ ID NO: 46000 - DNA, 201 bp, Homo sapiens
gggggatcgtctagagggagaggacaaggcccatggagacaggtcggagactgaggggcatgaaagttgggcacattctcacctgggtatcagaagtactrcctccaccattggtgtccggagaggtgtctggctgggaaaagtccccaactcctgttgagaaaagtggtgaggggagtaggagtgccaggaacccttggg

SEQ ID NO: 46001 - DNA, 201 bp, Homo sapiens
cgcccctttagcgcggggctccccgggaagctttgaggcggtgctgggtgtaaaggggagggcattcctggtggattttgcccaatcaccagtcgcgcttsttgcaatagacgggcagttttccccatcccgggtcgacttgagggggcgggattctggacgccagagttggcaaacccctgacctatgatggacgtattc

SEQ ID NO: 46002 - DNA, 201 bp, Homo sapiens
gccttgtactggtcggaggtgagggagagtgggtggctgttggaaatgtgcaggtccacagtattctccagggaggaggcaccccctacccgggccatttytaccaaggccctgaggcacgtgggcacaacctgcaggggaagtggggacaggagtcagggaaaacacccagccactgtccaccaaggtaggagtcagggc

SEQ ID NO: 46003 - DNA, 201 bp, Homo sapiens
aggctccctcctaactcttgctcctggtctcagtctgtctcctctctttatatctggctctattctctgtctttggggttttggagagaggtcctcagcgsgggagggagggagttggggaaagagactgcttgcaggggatctctggtggggtcagtctctgaagtcctcctctccagaagccctgcccaagaagagcca

SEQ ID NO: 46004 - DNA, 201 bp, Homo sapiens
caggggcatggctagattaactcagttacagtagagattggccctgattggctgttgaggcaagggcctggcatggcttagggactcacgttccaggccastatcccgggggtagtttggcagagaccctggagtctggcttgattggctaatatggatgaggggtggcctagaaccttagcatctagaacgatcctgaac

SEQ ID NO: 46005 - DNA, 201 bp, Homo sapiens; identical to SEQ ID NO: 8725

SEQ ID NO: 46006 - DNA, 201 bp, Homo sapiens
aactcttcactctctctggatctctgtctaatcccactccagtgtcctgaccctcctcgagctcaacctttcctcctcctgctaggaccctgccccctcayccctgtgcccttctgtctgggtctctgtccccttgtctgggtgtctgtcaccctccgctctctggttcctcgccttcccgtctctaatctcacagggctg

SEQ ID NO: 46007 - DNA, 201 bp, Homo sapiens
tctatcctacaaccaagagccccggcctctagaaagccccaaacccccaggatgcatttcctttgcgtactaaccggctttcccggttttattcccgtaascctgcagctccaaccctgcttgcgccccaccatcagtcagcggatccggctagccccgcccctcccgttctagccccacccaccagcgttggcacgagcc

SEQ ID NO: 46008 - DNA, 201 bp, Homo sapiens
tcaaatcccaagactctcttccccatctctgactctgtcccccaactcttcactctctctggatctctgtctaatcccactccagtgtcctgaccctcctygagctcaacctttcctcctcctgctaggaccctgccccctcatccctgtgcccttctgtctgggtctctgtccccttgtctgggtgtctgtcaccctccg

SEQ ID NO: 46009 - DNA, 201 bp, Homo sapiens
caagcccccaagcctcagcattcataacaggcccagagtagggggcccatgctcccaaggatgctcagtgaatctggagaagctggttggcattcagtccygtctgaggctgcattgtccaattgcagccattagtcatgtaaggttatttcagtttaaattgtaaccaattaaaacgaatcacgtcctggttgcactcgc

SEQ ID NO: 46010 - DNA, 201 bp, Homo sapiens
ccagcatgcagagtgttggaatctggatttgtacacaaagccacgactctgaattgttcaaatcccaagactctcttccccatctctgactctgtcccccractcttcactctctctggatctctgtctaatcccactccagtgtcctgaccctcctcgagctcaacctttcctcctcctgctaggaccctgccccctcat

SEQ ID NO: 46011 - DNA, 201 bp, Homo sapiens
aaagttagagtctcggtctgtcgctcgagctggagtgcaatggcttcatcctggctcactgcaacctccacctcctgagctcaagcgattctcctgcctcrgcctcccaagtagctgggattacaggcgtgtgccaccagtcctggctaatttttttatttttatttttatttattttattattttttgagatggagtctc

SEQ ID NO: 46012 - DNA, 201 bp, Homo sapiens
cctggaagtcttcagggcctgggatgggtgtctgaatgggggcgatggcctgactccccaagccactttttttttttttttttttgagacggagtcttacyctgtcacccaggctggagtgcaatggcttgatctcggctcattgcaacctccgcctcccgggttcaagcgattctcctgcttcagcctcctgagtagctg

SEQ ID NO: 46013 - DNA, 201 bp, Homo sapiens
agtcttcctattccactcagggctgtggggtggtggttgccctacctgtttttgccaaaaataaattgtttaaaacttttcttattaaaaacgttacaaartattcaattgtctgttcttacacttgggaactaaagttttaaggagaggagatttggttcagagatttctgtggcttacgcaaattgaggaaagaaccag

SEQ ID NO: 46014 - DNA, 201 bp, Homo sapiens
ataaaatgggaatcatggccaggcttggttgctcacgcctgtaatcctagcactttgggaggctgaggtgggtggattgcctgaggtcagcctgggcaacmcggtgaaaccccatttctactaaaatacaaaaaattagccaggtatggcggcgtgcgcctgtagtcccagctactcatgaggctgaggcaggagaattgc

SEQ ID NO: 46015 - DNA, 201 bp, Homo sapiens
gcccccacgtggccgctgcgcggtgggtggggagggggtgtgccgagtccagtggcccggcggctccacgtgcgggacaaaggccccgcccccggccgggraggggcgcccaggggggcggggagggggtccgaccctcctgacgcccccagccctcctccccggggacctgggcacacgccgtggggtgtgatcgacctg

SEQ ID NO: 46016 - DNA, 201 bp, Homo sapiens
ccccacgtggccgctgcgcggtgggtggggagggggtgtgccgagtccagtggcccggcggctccacgtgcgggacaaaggccccgcccccggccgggaakgggcgcccaggggggcggggagggggtccgaccctcctgacgcccccagccctcctccccggggacctgggcacacgccgtggggtgtgatcgacctggg

SEQ ID NO: 46017 - DNA, 201 bp, Homo sapiens
ggtgggtggggagggggtgtgccgagtccagtggcccggcggctccacgtgcgggacaaaggccccgcccccggccgggaaggggcgcccaggggggcggkgagggggtccgaccctcctgacgcccccagccctcctccccggggacctgggcacacgccgtggggtgtgatcgacctggggccctccacgatgtgggga

SEQ ID NO: 46018 - DNA, 201 bp, Homo sapiens
tccagtgtcctgaccctcctcgagctcaacctttcctcctcctgctaggaccctgccccctcatccctgtgcccttctgtctgggtctctgtccccttgtstgggtgtctgtcaccctccgctctctggttcctcgccttcccgtctctaatctcacagggctgatgtggacgctgctgtatggggggaacacctgccctg

SEQ ID NO: 46019 - DNA, 201 bp, Homo sapiens
caggaacccttggggccccagcctcccacacgaaccccaagctggcagacctgagttcacaaactcgtagattttatgtgggtcgtgagggtccttgctcyggtcctctgctaaacgcaacccttctttgcggttgagggcagagcggaaattcctcttccaggttggcaggtctggcttatccctcccgggaacatatgc

SEQ ID NO: 46020 - DNA, 201 bp, Homo sapiens
aggaattggggaggaggtcactggacttgatcaaggtgacccacaagtttcctcataggtgtgaacctggacagactagtaatggctgctgggagtgctarcttgaaaaggggttcacagcttgggagaggaagtgctgtgatcaattggtgatgtctgtagtgagtgagggaaggggatactaacagtaatgtcttgtgt

SEQ ID NO: 46021 - DNA, 201 bp, Homo sapiens
tacacttagcatactatccagagctggtaaggccctgtggcttaccccctccattgctcatctccctccattgcaggtcttgatcactccgacccagccargctgacttgcttgctcttccttgaacaagtcaaggtccacacttcaggtcgtttgcacctggtgttccccgtgcttggaaagctctccccttccccgacg

SEQ ID NO: 46022 - DNA, 201 bp, Homo sapiens
ttgcaggtcttgatcactccgacccagccaggctgacttgcttgctcttccttgaacaagtcaaggtccacacttcaggtcgtttgcacctggtgttcccygtgcttggaaagctctccccttccccgacgtccacatgtcttgctctctaaatttacattcaggtctcagctttaatgtccctctttatagatgtcttct

SEQ ID NO: 46023 - DNA, 201 bp, Homo sapiens
gagacttgtgtctggaatataatgaataaactggttaggctacaaaaaatttatgtaaacaatttgcagtaagaccagaaagcaaatttgaagtgttattrtactatagaggacttcgaatgccaggctcaaggaatgaaagtttttctttatggtagagggaatatctttggagaatttatgaatagcacagagatatga

SEQ ID NO: 46024 - DNA, 201 bp, Homo sapiens
ctggagtacagtggtgtgatcactgctcactgctgtcttgacctcctgggctcaagagatcctcccgcctcaccttcctgggtagctgggacaacaggcaygggccaccagccctgctaatttttttgtagagatgaggtcttgctttattgctcaggctggtcttgaactcctgggctcaagtgatccactagcctcggc

SEQ ID NO: 46025 - DNA, 201 bp, Homo sapiens
ttttgggaagctgaggcgggtggatcacctgaggtcaggagtttgagaccagcctggccaacatggagaaaccctgtctctactaaaaatataaaaattakcctggtgtggtggtgggtgcctgtaatccctgctacttgggaggctgaggcaggagaatcacttgaacctgggaggcagaggttgcagtgagccgagatc

SEQ ID NO: 46026 - DNA, 201 bp, Homo sapiens
ctactaaaagtacaaaaattagctgggcatggtagtgcatctctgtaatcccagctacttcttgcaaggctgagacatgagaatggcttgaacccgggggkctgaggctacagtgagccaaggtcaagccactgcactccagcctgggcgatagaggaagaccctgtcttaaaaaaaaacaaaaaaacaaaagaacttttg

SEQ ID NO: 46027 - DNA, 201 bp, Homo sapiens
gtagcctcgaactcctgggctcaagtgatcctcccacttcagccttctgagcagtggggactactggtgcacaccaccatgcccggctaatttaaaaaatttggttttgttttgttttgtttttagagacggggtcttgctgtgttgcttacggtagtctcaatttcctagcctcaagcaatcctcccgcctcagcctcct

SEQ ID NO: 46028 - DNA, 201 bp, Homo sapiens
tttccttagagtattatcactgctggaggaattttgtcaactacccacctggggatgaagctcactggccacaatacccacctctgtggatgatgttgtaygcactggagctgcactgcataattctagtaagtcactttagggacacaaatgttgatgcaaaaagaagcatccttcttcaaagttctttcctgagaaaat

SEQ ID NO: 46029 - DNA, 201 bp, Homo sapiens
tagcctcgaactcctgggctcaagtgatcctcccacttcagccttctgagcagtggggactactggtgcacaccaccatgcccggctaatttaaaaaatttggttttgttttgttttgtttttagagacggggtcttgctgtgttgcttacggtagtctcaatttcctagcctcaagcaatcctcccgcctcagcctcctg

SEQ ID NO: 46030 - DNA, 201 bp, Homo sapiens
gctttctcatcactaaagatgcaaatccccacgataatgtccctctcagtcggccccctgtttgtacagacagctcagattcccataactgcctgagatgygggaatgagtcatcctctgcccaagcaggtggcagtgggcacacctgaagcaacaaagtccaggaacaatcagcacaacttatgactccagaggaggaag

SEQ ID NO: 46031 - DNA, 201 bp, Homo sapiens
cctcccgggttcacgccattctcctgctgcagcctcccgagtagctggaactataggtgcctgccaccacaccaggctaatttttttttttttttttttgkatttttagtacagacgggatttcaccatgttagccaggatggtctcgatctcctgaccttgtgatccacccgcctccgcctcccaaagtgctgggattag

SEQ ID NO: 46032 - DNA, 201 bp, Homo sapiens
ggctggtctcgaactcctgaccctcaggtgatccacccacctaggcctcccaaagtgctgggattacaggtgtgagccactgtccctggcccaaatacccyctctttctttctttctttcttctttctttctttctttctttctttctttctttctttctttccttccttccttccttccttccttccttccttccttcct

SEQ ID NO: 46033 - DNA, 201 bp, Homo sapiens
aaagtgctgggattacaggtgtgagccactgtccctggcccaaataccctctctttctttctttctttcttctttctttctttctttctttctttctttctttctttctttccttccttccttccttccttccttccttccttccttccttccttcccttccttccttccttccttcctttctttttttgagacagagtct

SEQ ID NO: 46034 - DNA, 201 bp, Homo sapiens
ttacaggtgtgagccactgtccctggcccaaataccctctctttctttctttctttcttctttctttctttctttctttctttctttctttctttctttcyttccttccttccttccttccttccttccttccttccttccttcccttccttccttccttccttcctttctttttttgagacagagtcttgctctgtcacc

SEQ ID NO: 46035 - DNA, 201 bp, Homo sapiens
aggtgtgagccactgtccctggcccaaataccctctctttctttctttctttcttctttctttctttctttctttctttctttctttctttctttccttcyttccttccttccttccttccttccttccttccttccttcccttccttccttccttccttcctttctttttttgagacagagtcttgctctgtcacccaag

SEQ ID NO: 46036 - DNA, 201 bp, Homo sapiens
gtgagccactgtccctggcccaaataccctctctttctttctttctttcttctttctttctttctttctttctttctttctttctttctttccttccttcyttccttccttccttccttccttccttccttccttcccttccttccttccttccttcctttctttttttgagacagagtcttgctctgtcacccaagctgg

SEQ ID NO: 46037 - DNA, 201 bp, Homo sapiens
tctttctttctttcttctttctttctttctttctttctttctttctttctttctttccttccttccttccttccttccttccttccttccttccttccttcccttccttccttccttccttcctttctttttttgagacagagtcttgctctgtcacccaagctggagggcagtggcatgatctctgctcactgcaacctc

SEQ ID NO: 46038 - DNA, 201 bp, Homo sapiens
ccgtctctactaaaaatacaaaaaattagccgggcgaggtggcgggcgcctgtagtcctagctactcgggaggctgaggcaggagaatggcgtgaaccccrggaggcggagcctgcagtgagccgagattgcgccactgcactccagcctgggcgacagcgagactccgtctcaaaaaaaaaaaaaaaaaaaaaaaaaaaa

SEQ ID NO: 46039 - DNA, 201 bp, Homo sapiens
cggagcctgcagtgagccgagattgcgccactgcactccagcctgggcgacagcgagactccgtctcaaaaaaaaaaaaaaaaaaaaaaaaaaaaagaatmctggccaggtgcagtggctcatgcctgtaatctcagcacttttggaggccatggagggtggatcacttgaggtcaggagattgagaccaccctgaccaac

SEQ ID NO: 46040 - DNA, 201 bp, Homo sapiens
gcactccagcctgggcgacagcgagactccgtctcaaaaaaaaaaaaaaaaaaaaaaaaaaaaagaatactggccaggtgcagtggctcatgcctgtaatytcagcacttttggaggccatggagggtggatcacttgaggtcaggagattgagaccaccctgaccaacgtggtgaaatcccatctctactaaaagtacaa

SEQ ID NO: 46041 - DNA, 201 bp, Homo sapiens
aaaaaaaaaaaaaaaagaatactggccaggtgcagtggctcatgcctgtaatctcagcacttttggaggccatggagggtggatcacttgaggtcaggagwttgagaccaccctgaccaacgtggtgaaatcccatctctactaaaagtacaaaaaaaaattatctgggcatgatgctgcacacctgtattcccagctcct

SEQ ID NO: 46042 - DNA, 201 bp, Homo sapiens
atataagtaccagaagaaaatataggagaatagctttgtgccttttgagtagacaatgatttcatagacaaaaagcactaaccataaaaagtaatccaatygatataaactgaactttactaaaacttcattaaacttctgctcttcaaaagacaccattaaggaaaataaaaagcaaaccagagactaagggaaatatat

SEQ ID NO: 46043 - DNA, 201 bp, Homo sapiens
gacagtccccagtttaatgatggcatgacttagaatttttcagttttacaatggtgtacaggtgatatgcattcagtagaaattgtatttcaagtacccayacagccattcgatttttcctgttaagtgcagtattcaataaattgaatgaaatgttaagcacttcatttaaaaatagtcttgtgttggatgattttgcct

SEQ ID NO: 46044 - DNA, 201 bp, Homo sapiens
aatgcataaaaagtaacacacacaaacaggtacacacacagcctagggtaaagcatgctctgttttaaaggaagtgtcttccagagcctgtgactcttctytgttcaaaaatagcacctgcgagttaaggtttggccaggagcgtgggatgaatttcttgcctgcatctccccaaatcacccttagaggttcaggccttgt

SEQ ID NO: 46045 - DNA, 201 bp, Homo sapiens
cctgggctcaagtgattatcccacctcagctttcctagtagctgggactacaggcatgcaccactacagctggttaaacttctgtatctttttgtagagayggaaatttccccattttacccaggctggccttgatatcttaggcttaagcgaccatcttgccttggcctcccaaagtgctgggattacaggtgtgagtca

SEQ ID NO: 46046 - DNA, 201 bp, Homo sapiens
ggagtaggaggatcgcttgagcccaggaggtcaaggctgcagtgagctatgattgcaccactgcactgcagccggggtaacagactgagaccctgtctcaaaaaaaaaaaaaaaaaaggaactgtggatatagctttctttattgttccttttctcttttgccattttccattctttctttcatttttgccttttccagtt

SEQ ID NO: 46047 - DNA, 201 bp, Homo sapiens
tgaggcagaaaaatcgcttgaacctgggaggtggaggttgtggtgagctgagattgcaccactgcactccagtctgggcaacagtgtgagactccatcttaaaaaaataaaataaaataaaataaaataaaataaagaagaggggagcaggaaaagatttctaagatctctctaaatatggcatgacagtgtgggctgctt

SEQ ID NO: 46048 - DNA, 201 bp, Homo sapiens
gaggcagaaaaatcgcttgaacctgggaggtggaggttgtggtgagctgagattgcaccactgcactccagtctgggcaacagtgtgagactccatcttaaaaaaataaaataaaataaaataaaataaaataaagaagaggggagcaggaaaagatttctaagatctctctaaatatggcatgacagtgtgggctgcttt

SEQ ID NO: 46049 - DNA, 201 bp, Homo sapiens
aggcagaaaaatcgcttgaacctgggaggtggaggttgtggtgagctgagattgcaccactgcactccagtctgggcaacagtgtgagactccatcttaaaaaaataaaataaaataaaataaaataaaataaagaagaggggagcaggaaaagatttctaagatctctctaaatatggcatgacagtgtgggctgctttt

SEQ ID NO: 46050 - DNA, 201 bp, Homo sapiens
ggcagaaaaatcgcttgaacctgggaggtggaggttgtggtgagctgagattgcaccactgcactccagtctgggcaacagtgtgagactccatcttaaaaaaataaaataaaataaaataaaataaaataaagaagaggggagcaggaaaagatttctaagatctctctaaatatggcatgacagtgtgggctgcttttt

SEQ ID NO: 46051 - DNA, 201 bp, Homo sapiens
aggacatggcagttggcttcctacagattaatttaccttttgaaaaatttcctgtagagatggagttttgctgtgttgcccaggctggtctcaaagtcctrgactcaagtgatccaccagcctcggcctaccaaagtgctgggattaccagtgtgagccaccatacctggcccagagcgagtgatcgaagagagaccaagg

SEQ ID NO: 46052 - DNA, 201 bp, Homo sapiens
gaaaaatcgcttgaacctgggaggtggaggttgtggtgagctgagattgcaccactgcactccagtctgggcaacagtgtgagactccatcttaaaaaaataaaataaaataaaataaaataaaataaagaagaggggagcaggaaaagatttctaagatctctctaaatatggcatgacagtgtgggctgctttttgtat

SEQ ID NO: 46053 - DNA, 201 bp, Homo sapiens
ggaggttgtggtgagctgagattgcaccactgcactccagtctgggcaacagtgtgagactccatcttaaaaaaataaaataaaataaaataaaataaaataaagaagaggggagcaggaaaagatttctaagatctctctaaatatggcatgacagtgtgggctgctttttgtatttcaggagaagaatcgaaccctggg

SEQ ID NO: 46054 - DNA, 201 bp, Homo sapiens
ctagagcccatgttgcaaggggctttaagaggtaattagctcaagcagagagtgagatgtgattgctgtcacattttttttttaagtttttttatttttatttttttttttttgagacagagtctcactctgtcgcccacgctggagtgcagtggcacaatgtccggctcactgcaagctccgcctcccaggttcaggcca

SEQ ID NO: 46055 - DNA, 201 bp, Homo sapiens
gtggtgcgtgcctgtagtcccagctacttgggaggctgaggtgggagaattgtttgagcctaggaggttgaggctgcagtgagctgtgattgcaccactgygctccagcctgggtgaatgcagtgagtccagaaccagaccctgtctgggaaaaaaaaaaaagaagaaatagttaaatcgtcttccaactgacatttttaa

SEQ ID NO: 46056 - DNA, 201 bp, Homo sapiens
gagaccagcctgaccaacatgatgaaaccccatctctactaaaaatgcaaaaatcagccaggcatggtggcacacgcctgtaatcccagctactcgggagrctgtgacaagagaatcacctgaacccgggaggaggaggttgcagtgagccaagatggggccattgtactccaacctgggcaacaagagcaaaattttgtc

SEQ ID NO: 46057 - DNA, 201 bp, Homo sapiens
ccccatctctactaaaaatgcaaaaatcagccaggcatggtggcacacgcctgtaatcccagctactcgggagactgtgacaagagaatcacctgaacccrggaggaggaggttgcagtgagccaagatggggccattgtactccaacctgggcaacaagagcaaaattttgtctccagggtgggtgggaggtgggcgagg

SEQ ID NO: 46058 - DNA, 201 bp, Homo sapiens
agcgtgggatgaatttcttgcctgcatctccccaaatcacccttagaggttcaggccttgtcagcgcccattttattgccaggaacatccccaagcctctragtcctgagaggcgcaggtctctaaaattcagtactctcccttgaatcatccccatactctctaatggcttcttacacttagcatactatccagagctgg

SEQ ID NO: 46059 - DNA, 201 bp, Homo sapiens
cgacagaagaatatacaaatcgtagcatacctatgcaatggaatactattcagcaatgaaaattaaccaccaatacacctaatcatgtagaccgattttayagaaaagctgaagaacagcctggccaacatggtgaaaccccgtctctactaaaaatacaaaaagttgtatagtgagaccctgtctcaaaaaaaaaaaaag

SEQ ID NO: 46060 - DNA, 201 bp, Homo sapiens
aggaaaagctgagcaaaagaacacacaaaagtgtgcacaatgcatgattccatttgtatgaagttctataatagtcaaaactaaactatagagacagaaaragcagtatttgcctgggactaggagtaggaggatagctgctaacacacagaattggggggggctggccaggcatggtggctcacacctgtaatcccagca

SEQ ID NO: 46061 - DNA, 201 bp, Homo sapiens
aagtactgggattacaggtgtaagccaccatgccaggccagaagggcagactttggatcgacaaagaagaggagattccaggttgattgaatcctattgadaaacagaatttaaaagcttttatagagacttgtgtctggaatataatgaataaactggttaggctacaaaaaatttatgtaaacaatttgcagtaagacc

SEQ ID NO: 46062 - DNA, 201 bp, Homo sapiens
tatgaagttctataatagtcaaaactaaactatagagacagaaagagcagtatttgcctgggactaggagtaggaggatagctgctaacacacagaattgkggggggctggccaggcatggtggctcacacctgtaatcccagcactttgggaggccaaggtgggtggatcacttgaggtcaggagttcgagaccagcctg

SEQ ID NO: 46063 - DNA, 201 bp, Homo sapiens
agtactgggattacaggtgtaagccaccatgccaggccagaagggcagactttggatcgacaaagaagaggagattccaggttgattgaatcctattgagraacagaatttaaaagcttttatagagacttgtgtctggaatataatgaataaactggttaggctacaaaaaatttatgtaaacaatttgcagtaagacca

SEQ ID NO: 46064 - DNA, 201 bp, Homo sapiens
agttctataatagtcaaaactaaactatagagacagaaagagcagtatttgcctgggactaggagtaggaggatagctgctaacacacagaattggggggkgctggccaggcatggtggctcacacctgtaatcccagcactttgggaggccaaggtgggtggatcacttgaggtcaggagttcgagaccagcctggccaa

SEQ ID NO: 46065 - DNA, 201 bp, Homo sapiens
tgtccctctttatagatgtcttctctgactgccatctctgatatggtcgatatggtgcccccaccaccttttgtctccttccagtacttttcttcttcctytttttttgagatggagtctctctcgctctgtcgcccaggctagagtgcaatggtgtgatcttggcttactgtaacctccacctcccaggttcaagtgatt

SEQ ID NO: 46066 - DNA, 201 bp, Homo sapiens
ccagcttctacaggctttcctcattccttgaatcgtggctccctttgagccagcaagcagaattctgctctcatcctcatatctccatttcgcatcctgaytctgactcttctacctccctcttataaggaccctgtgattagactgtgcccacctgcataatccaggattgtcttctcatctcaagatttttaattaacg

SEQ ID NO: 46067 - DNA, 201 bp, Homo sapiens
gattgtcttctcatctcaagatttttaattaacgacaaagacccttttggcacttaagttcatatgtttaacagattccagggatcaggacatggatatcrttgatggctattatcttaccttttttttttttttctttttttttttagacgtagtctcactctgttgcccaggctgcagtgcaatggtgagatctcggct

SEQ ID NO: 46068 - DNA, 201 bp, Homo sapiens
attgtcttctcatctcaagatttttaattaacgacaaagacccttttggcacttaagttcatatgtttaacagattccagggatcaggacatggatatcgytgatggctattatcttaccttttttttttttttctttttttttttagacgtagtctcactctgttgcccaggctgcagtgcaatggtgagatctcggcta

SEQ ID NO: 46069 - DNA, 201 bp, Homo sapiens
attccgcattgtgggtgccacggtgtatagttccatcgcaaatagtggtgtaactataacatttcccacaagagtggcatagtaaataattttcgtttaartctttacttgcctagatataacatttccctttggggatctacaaagttacaaatgcaatcccatgtataattaaatctcgctgcaaatatgccttaaaag

SEQ ID NO: 46070 - DNA, 201 bp, Homo sapiens
ccgagatagtgaacatagtacccaatgggaagtttttcagctctttcccctctccctccctcagtccttttggacttttccagtgtctattgttcccgtcttttttttttttttttttttgagacggagtctcgctctatcacccaggctggagtgcagtggcgcaaatttggctcactgcaagctccgcctcccgggttc

SEQ ID NO: 46071 - DNA, 201 bp, Homo sapiens
aaagacccttttggcacttaagttcatatgtttaacagattccagggatcaggacatggatatcgttgatggctattatcttaccttttttttttttttcyttttttttttagacgtagtctcactctgttgcccaggctgcagtgcaatggtgagatctcggctaactgcaaacttccctcctgggttcgagcaattctc

SEQ ID NO: 46072 - DNA, 201 bp, Homo sapiens
ttttgagacggagtctcgctctatcacccaggctggagtgcagtggcgcaaatttggctcactgcaagctccgcctcccgggttcacgccattctcctgcygcagcctcccgagtagctggaactataggtgcctgccaccacaccaggctaatttttttttttttttttttgtatttttagtacagacgggatttcacca

SEQ ID NO: 46073 - DNA, 201 bp, Homo sapiens
cttgagattcaaagttcaggagttctagatttgagacactagagggagacttaggccttgaaaaagtgacctcaattctaggagtaagtgctgagactcasaggaatttttggcttgaacttgacccagggttcaggcaacagagagcaatggcatagggaagtatggcatttactttttcaagggggataaaaaagcaga

SEQ ID NO: 46074 - DNA, 201 bp, Homo sapiens
atcctagcattttgggaagctgaggcgggtggatcacctgaggtcaggagtttgagaccagcctggccaacatggagaaaccctgtctctactaaaaatayaaaaattagcctggtgtggtggtgggtgcctgtaatccctgctacttgggaggctgaggcaggagaatcacttgaacctgggaggcagaggttgcagtga

SEQ ID NO: 46075 - DNA, 201 bp, Homo sapiens
tgagctgtgattgcaccactgcgctccagcctgggtgaatgcagtgagtccagaaccagaccctgtctgggaaaaaaaaaaaagaagaaatagttaaatcrtcttccaactgacatttttaaatgtttgtggtgataatattattaattaaaatattcatcctaaggattaaatataatccttttttattccagagtcttc

SEQ ID NO: 46076 - DNA, 201 bp, Homo sapiens
gaggctgaggcaggggaatcgcttgaacctgggaggcagaggttgcagtgagccaagattgtgccattgcactccagcctgggcgacaagagcaaaactcygtctcaaagaaaaaaaaaaagaatgatgcatccttgatgcagagtaggagataatgaaaaataaataaataaaacaaaacaaaacaaaaaagaatgatgg

SEQ ID NO: 46077 - DNA, 201 bp, Homo sapiens
agatggtttattattagtaaatatttacatctccaagtgactttaaccaaatcagtgtttgtttcaccatgataaaaaattaagtagccaggcgctgtggytcacacctgtaatcccagcactttgggagtccaaggagggtggatcacttgaggcccagggtttgagaccagcctggccaacatggtgaaaccctatctg

SEQ ID NO: 46078 - DNA, 201 bp, Homo sapiens
aatttatgaatagcacagagatatgactaaaatagtgctttagacacatttacttgacatgtgatgggttttggactggaagcaaggagaccagttagaaractattgcaatagtgtgagtgtgatggggcagaaggtaatatagatatcagtttggagttgaagtaacaatttattttctcctttatgttcttcatctgt

SEQ ID NO: 46079 - DNA, 201 bp, Homo sapiens
gtagacacagcatatgtctcaccgtccctttctgaacttctcactgctgcttcagctctttcagagaaagtgtcttcccatcatcaaatgcctttttcctmtgatgtggcctctgtttatgtaaggctccctcggagtagattactggttcaagggccccaatttgcactaagatctgagaagagctcattccaacgtgcc

SEQ ID NO: 46080 - DNA, 201 bp, Homo sapiens
gcatgatccaccgtacccggccgtctttttttaaatttttaaattttttttattttttaaagacaacgtcttgctctgtcgcccaggctggagtgcaatgrcgatcatggctcactgtagcctcgaactcctgggctcaagtgatcctcccacttcagccttctgagcagtggggactactggtgcacaccaccatgcccg

SEQ ID NO: 46081 - DNA, 201 bp, Homo sapiens
tcgatctcctgaccttgtgatccacccgcctccgcctcccaaagtgctgggattagaggtgtgagccaccatgcctggctgttcctgtctttatgtccatrtgtacccaaggtttagctcccacttataagtgagaacatgcaatatttggttttctgtttctgtgttaatttgcttaggataatggtctccagctgcatc

SEQ ID NO: 46082 - DNA, 201 bp, Homo sapiens
ctctactaaaaatgcaaaaatcagccaggcatggtggcacacgcctgtaatcccagctactcgggagactgtgacaagagaatcacctgaacccgggaggmggaggttgcagtgagccaagatggggccattgtactccaacctgggcaacaagagcaaaattttgtctccagggtgggtgggaggtgggcgaggtaggga

SEQ ID NO: 46083 - DNA, 201 bp, Homo sapiens
taaaaatgcaaaaatcagccaggcatggtggcacacgcctgtaatcccagctactcgggagactgtgacaagagaatcacctgaacccgggaggaggaggytgcagtgagccaagatggggccattgtactccaacctgggcaacaagagcaaaattttgtctccagggtgggtgggaggtgggcgaggtagggagggaag

SEQ ID NO: 46084 - DNA, 201 bp, Homo sapiens
aatcagccaggcatggtggcacacgcctgtaatcccagctactcgggagactgtgacaagagaatcacctgaacccgggaggaggaggttgcagtgagccragatggggccattgtactccaacctgggcaacaagagcaaaattttgtctccagggtgggtgggaggtgggcgaggtagggagggaagacaaaaaatttg

SEQ ID NO: 46085 - DNA, 201 bp, Homo sapiens
ctttcttccacggagtgacactgattagtttgtaggccaggtgaggcatgatttcataaccatggagtaatctgaccagggtcatgcaggggagcagcagrcctgcggtatataaattctcaaatacacatcttccatttatttccttatttctttctttaaaaaaaaaaaatttggcctaggcatggtgaatcatgcctg

SEQ ID NO: 46086 - DNA, 201 bp, Homo sapiens
ggctgggtgcagtggctcatgcttgtaatcctagcactttgggaggcagaggggagtggatggcttgagcccagaagttggagaccagcctgggcaacatsgcgaaaccacatctcaacaaaaacacaaaaaaattagctgggtgtggtggtgcgtgcctgtagtcccagctacttgggaggctgaggtgggagaattgtt

SEQ ID NO: 46087 - DNA, 201 bp, Homo sapiens
cacctgaagcaacaaagtccaggaacaatcagcacaacttatgactccagaggaggaagtccagagacagagcaccatgacttctgagaaaggtaaaatgkatccgggggcttggcaagtattcttgaacaatgcaagaatggtgtgtgtgtgtgtgtgtgtgtgtgtgtgtgtgtgtgtgtgtgtgtgtgtgtgtcctgc

SEQ ID NO: 46088 - DNA, 201 bp, Homo sapiens
tcccaaagtgctgggattacaggtgtgagccactgtccctggcccaaataccctctctttctttctttctttcttctttctttctttctttctttctttcyttctttctttctttccttccttccttccttccttccttccttccttccttccttccttcccttccttccttccttccttcctttctttttttgagacaga

SEQ ID NO: 46089 - DNA, 201 bp, Homo sapiens
agtctcgctctgtcgcccaggctggagtgcagtggcttgatctcggctcactgcaagctctgccttccaggttcacgccattctcctgcctcagcctcccragtagctgggactacaggcgcccgccaccacgcctggccagttttttgtatttttagtagagttgggttttcaccgtgttagccaggatggtctcgatct

SEQ ID NO: 46090 - DNA, 201 bp, Homo sapiens
tatggctgtaccagtttacattcccaccagcaaagtatgacagattcagtttctctgcatccttaccagcatttggtgttttgcatgcgtgtctgtgcacrcacacctatacacacacatatagccattctgataggtgtgtaggaatatctcattgtggttttaatttgtatctccctggtgcaaattaaatggtgagtt

SEQ ID NO: 46091 - DNA, 201 bp, Homo sapiens
gtgcaaattaaatggtgagttggtcacaagtactccaggttgccggtagttccttttgtgtgtgtgtgtgtgtgtgtgatttttaaatttcaaatataaayatatatatatatatatatatatatatatttttttttttttttttttttttttttttgagagggagtttcactcttgttgcccaggctggagtgcaatggc

SEQ ID NO: 46092 - DNA, 201 bp, Homo sapiens
aagtactccaggttgccggtagttccttttgtgtgtgtgtgtgtgtgtgtgatttttaaatttcaaatataaacatatatatatatatatatatatatatwtttttttttttttttttttttttttttttgagagggagtttcactcttgttgcccaggctggagtgcaatggcgcgatctcggctcactacaacctccac

SEQ ID NO: 46093 - DNA, 201 bp, Homo sapiens
gtactccaggttgccggtagttccttttgtgtgtgtgtgtgtgtgtgtgatttttaaatttcaaatataaacatatatatatatatatatatatatatatwtttttttttttttttttttttttttttgagagggagtttcactcttgttgcccaggctggagtgcaatggcgcgatctcggctcactacaacctccacct

SEQ ID NO: 46094 - DNA, 201 bp, Homo sapiens
caaaacaaaacaaaacagaacaaatcaatttccaggtgattctatttcggaaattggaagaaattagggacttttgatcagtccatgcatttttgtcatakacttcaattcttttccaggaaatagttttgggtattttttttgttatttatttataattttagtttaattattattatctttttttgagacagggtctgt

SEQ ID NO: 46095 - DNA, 201 bp, Homo sapiens
acacaggaggctctcacctcctcaaaattcccaagttgacatttaatgtcaatgatgttcatgccattgaaataaacataaaacaggcatctttctaaccytctgaaaggctgccgtaataacagtgcttaacgtttatgaagcatctgctgcgtcaggcaccttgcaaatgttttccattcattgtgttacgtgagtctt

SEQ ID NO: 46096 - DNA, 201 bp, Homo sapiens
ggtgaatcatgcctgtaatcccagcactttgggaggctgaagcaggaggatctcttgagctcaggagtttgagaccaacctgggcaacacagagagaacaygcctccacaaaaaaaataacaaatgaaataaaattttaattttttaagagacagggtctcactgtatcacccaggctatgtacagtgacataatcatagc

SEQ ID NO: 46097 - DNA, 201 bp, Homo sapiens
cttgggaagttgaggcagaaaaatcgcttgaacctgggaggtggaggttgtggtgagctgagattgcaccactgcactccagtctgggcaacagtgtgagwctccatcttaaaaaaataaaataaaataaaataaaataaaataaagaagaggggagcaggaaaagatttctaagatctctctaaatatggcatgacagtg

SEQ ID NO: 46098 - DNA, 201 bp, Homo sapiens
tccttccttccttcctttctttttttgagacagagtcttgctctgtcacccaagctggagggcagtggcatgatctctgctcactgcaacctctgcctccygggttcaagcaattctcctgcctcagcctccagaatagcagggattacaggtgcctgccaccacacctggctaatttttgtatttttagtagagacgggg

SEQ ID NO: 46099 - DNA, 201 bp, Homo sapiens
ggaggtggaggttgtggtgagctgagattgcaccactgcactccagtctgggcaacagtgtgagactccatcttaaaaaaataaaataaaataaaataaawtaaaataaagaagaggggagcaggaaaagatttctaagatctctctaaatatggcatgacagtgtgggctgctttttgtatttcaggagaagaatcgaac

SEQ ID NO: 46100 - DNA, 201 bp, Homo sapiens
ctgcctgcctcagcctcccaaagtgctgggattacaggcatgagccaccgcgcccggcctataaatatatttttaaattttctttttttggtggaagtgcttttttttttttttcttttgacatggagttttgctctcgttgcccaggctggagtgcaacggcatgatctgggctcaccgcaacctctgcctcacagattc

SEQ ID NO: 46101 - DNA, 201 bp, Homo sapiens
acttttagcaggaaatttagcccagggaggagcctctgtagatcaaaccattttctcattacacttagcaggtatttcatcaatgttaggtgctactaatyttatcacaacaattattaatatacaaccacaaattatatctcaatgtcaaaaatcatcatttatttgatctgcattaattacagctgtgcttttgctact

SEQ ID NO: 46102 - DNA, 201 bp, Homo sapiens
tgattccgtgtgtgtactgattcaagaacaagcaatgatgacccactaaagagtgaatgccatttagaatctagaaatgttcacaaggtaccccaaaactstgtagcttaaaccaacaataaatatgtattacctctggcagtttctgtgggtaaggaatttagaagcagcttatctgtgtgttcctgtctcaggtccccc

SEQ ID NO: 46103 - DNA, 201 bp, Homo sapiens
cctgatacggtttggatatttgttccctccaaatgtcatggtgaaatgtgattcccaatgttggaggtggatcctaatggcgatatggctctgatgaatgraggaacaccagggtctttggtctcctgctgatttagataaaacaacacggaaacaccttgagtggttttaaggagtagagagtttaataggcaggaaaga

SEQ ID NO: 46104 - DNA, 201 bp, Homo sapiens
gaggtgtctgatttgcatagggcccaagggattggtttgaccaggtgtgtcattcacgtagaccacaaaaaaccctggcactcccaccttagccctttaayatccaaatgcaggccaccaagatgtcctgagcatgtgtgagttatctggaggtggctatgacacttggcacatgtggtgacaatgagaagagggtgggaa

SEQ ID NO: 46105 - DNA, 201 bp, Homo sapiens
tcctgtagagatggagttttgctgtgttgcccaggctggtctcaaagtcctagactcaagtgatccaccagcctcggcctaccaaagtgctgggattaccrgtgtgagccaccatacctggcccagagcgagtgatcgaagagagaccaaggtggaaatttccacgactttgatgacttcatcttggaatcacaccctatt

SEQ ID NO: 46106 - DNA, 201 bp, Homo sapiens
cctaacctacttttattctacaatgattctactcttacctaacttagaaaaacttggtctctgaagggcctttattgatgatgtgggatttctgccccttsttcaaaacactggtctgcccctgtcgaaacacctgctttatctcatggaggctccaggttgactttcataactaagtaaagtcttgtatgtaggattcgg

SEQ ID NO: 46107 - DNA, 201 bp, Homo sapiens
ctgtaacttttactgccaatggggttgaaagaagaacagtgtagggcctttcccagcttggcttagggaaggagacagagatgagggttttcactaacacyaaatttcctgggttaaataaaggtggttctgtttcctggggttggacttctgttagttgcgttaattcttgttggaagtgagctagagaggttacatgct

SEQ ID NO: 46108 - DNA, 201 bp, Homo sapiens
tattaccaactttcagtaaaaagtcatatcaaacttaatgatagtaaaacttttatactttcatgcttgctttttttctttttttgatatggagtttcgckcttgttgtccaagctggagcgcaatggcacgatctcagctcaccacaacctcctcctcccaggttcaagcaattctcctgcctcagcctcccgagtagct

SEQ ID NO: 46109 - DNA, 201 bp, Homo sapiens
gagatcaggctggccagcttagagagaccatgtcttaaaaaaaaaaaaaaaaaagggttagaatataatgaaggaaaatttaaaagagaaacaaagacacrcttacacctgaattcaagactaaaacataatggtattagagagtggtcaccaaataatgtgactgggggaagaaacctgtgcactatgtttgtgagaaaa

SEQ ID NO: 46110 - DNA, 201 bp, Homo sapiens
ggcgtggtggctcacgcctgtaatcccagcactttgggaggctgaggtgggcgaatcacaaggtcaggagtttgagaccagcctggccaacatggtgaaamcccgtctctactaaaaatacaaaaaaaattagctggacatggtggcgggagcctgtaatcccagctacttgggaagttgaggcagaaaaatcgcttgaac

SEQ ID NO: 46111 - DNA, 201 bp, Homo sapiens
cggatcatgagatcaggagatggagaccatcctggctaacacggtgaaaccccgtctctactaaaaaatacaaaaaaattagccaggcgtggtggcgggcrcctgtagtcccagctactcgggaggctgaggcaggagaatggcgtgaacccgggaggcggagcttgcagtgagccgagatcgcgccactgcactccagcc

SEQ ID NO: 46112 - DNA, 201 bp, Homo sapiens
gtgaaaccccgtctctactaaaaaatacaaaaaaattagccaggcgtggtggcgggcacctgtagtcccagctactcgggaggctgaggcaggagaatggygtgaacccgggaggcggagcttgcagtgagccgagatcgcgccactgcactccagcctgggcgacagagcgagactccgtctcaagataaaataaaataa

SEQ ID NO: 46113 - DNA, 201 bp, Homo sapiens
ccagctactcgggaggctgaggcaggagaatggcgtgaacccgggaggcggagcttgcagtgagccgagatcgcgccactgcactccagcctgggcgacaragcgagactccgtctcaagataaaataaaataaaataaaataaaaaataaaataaaaaaatcagacaggcatggcagcatacacctttaaaggctgaggt

SEQ ID NO: 46114 - DNA, 201 bp, Homo sapiens
aaccctgtatcaaaaaacaaaaacaaaaacaaacaacaactcttttttttttttttttgagacggagtcttgctctttcgcccaggctggagtgcagtggygcaatctcgactcactgcaagctccacctggggttcacgccattctcctgcctcagcctccccagtagctgggactacaggcgcccaccaccacgcccgg

SEQ ID NO: 46115 - DNA, 201 bp, Homo sapiens
caggctggccttgatatcttaggcttaagcgaccatcttgccttggcctcccaaagtgctgggattacaggtgtgagtcactgcctacagcctggtttttkttttttaattttgttttgttgttattgattgtttttattttaaggaatttagtagctctagatgcaggcttatcttcagttttccacagcccttgctcac

SEQ ID NO: 46116 - DNA, 201 bp, Homo sapiens
tgtggatgatgttgtacgcactggagctgcactgcataattctagtaagtcactttagggacacaaatgttgatgcaaaaagaagcatccttcttcaaagktctttcctgagaaaatttgactcatatcttctttttgacatttatattgagatttagttatttaactagctagctcctcttaagaaaatctcagagccag

SEQ ID NO: 46117 - DNA, 201 bp, Homo sapiens
aataaagaagaggggagcaggaaaagatttctaagatctctctaaatatggcatgacagtgtgggctgctttttgtatttcaggagaagaatcgaaccctrggagtttgacgtcttctatgaccccagagaacttcgtaaagaggcctgtctgctctacgaaatcaagtggggcatgagccggaagatctggcgaagctca

SEQ ID NO: 46118 - DNA, 201 bp, Homo sapiens
tggtttttcaagctgcctgttagaaaagaaatggtttgggggttgcttctcatgacaggaaaatttccactgagaacttttaccctttctagtggcctaamaattatttcctaataactcctgtattattccctgcctcaagagaagtaaacctaactgctgttaaggggtgttggacgacaattctttctggctacttcc

SEQ ID NO: 46119 - DNA, 201 bp, Homo sapiens
tttgagacggagtctcgctctatcacccaggctggagtgcagtggcgcaaatttggctcactgcaagctccgcctcccgggttcacgccattctcctgctkcagcctcccgagtagctggaactataggtgcctgccaccacaccaggctaatttttttttttttttttttgtatttttagtacagacgggatttcaccat

SEQ ID NO: 46120 - DNA, 201 bp, Homo sapiens
aagcttggtgaaggattttaaggacattggctggaggctggcaaatggagtttgccatcctctgactgtagcctttctgagggctgggaactacgtcctcragaagtggcctattttatttctgcagggaaatactgaggtttaatttttcttatggagccttcctagattagaaggggcttaagtgccttaacggcttga

SEQ ID NO: 46121 - DNA, 201 bp, Homo sapiens
gcctaccaaagtgctgggattaccagtgtgagccaccatacctggcccagagcgagtgatcgaagagagaccaaggtggaaatttccacgactttgatgayttcatcttggaatcacaccctatttcttttgcagtattctatttgttacacaggccagccatgattcagagtaagaggggactcatacacaaggatttga

SEQ ID NO: 46122 - DNA, 201 bp, Homo sapiens
ggacagggaagtcatgttaaggaatatattatctcttgataggtggaaggattgatctatgtagtaaatgaatgtgatactttagggatgagtgggaactrttaggatgtaataagcttgtgacttaaccatattgcaaagaagagtctgcagttcaattctgagtttcccttgagttacagctttcagacatagagagtg

SEQ ID NO: 46123 - DNA, 201 bp, Homo sapiens
tggtcaacaggtccttcaaccggtgaccccactctgaggtaagaataacactatcacagtgcccatttaatttgatcaagaatcaatgggtatttaagagytgtgcatggtggcacatgcgcctataatcccagctactcaggaggctgaggcaggagtaggaggatcgcttgagcccaggaggtcaaggctgcagtgagc

SEQ ID NO: 46124 - DNA, 201 bp, Homo sapiens
tttttgagacagagtcttgctctgtcacccaagctggagggcagtggcatgatctctgctcactgcaacctctgcctcccgggttcaagcaattctcctgyctcagcctccagaatagcagggattacaggtgcctgccaccacacctggctaatttttgtatttttagtagagacggggtttcaccatgttgcccaggct

SEQ ID NO: 46125 - DNA, 201 bp, Homo sapiens
gcactggagctgcactgcataattctagtaagtcactttagggacacaaatgttgatgcaaaaagaagcatccttcttcaaagttctttcctgagaaaatytgactcatatcttctttttgacatttatattgagatttagttatttaactagctagctcctcttaagaaaatctcagagccaggtatggtggtgcacact

SEQ ID NO: 46126 - DNA, 201 bp, Homo sapiens
ccaagatgggaggattgcttgagaccaggagtctgagaccagcctggccaacataatgagaccccctctctataaaaaagaaaattatgtatcaaacaaastaaacaaacaagcaaacaaacaacatctaagcctaagaacaagaagtgtgtttgtgggaggtaagtggagaagggaatttgggtaaaccgatctaagata

SEQ ID NO: 46127 - DNA, 201 bp, Homo sapiens
ggtgcgtgcctgtagtcccagctacttgggaggctgaggtgggagaattgtttgagcctaggaggttgaggctgcagtgagctgtgattgcaccactgcgytccagcctgggtgaatgcagtgagtccagaaccagaccctgtctgggaaaaaaaaaaaagaagaaatagttaaatcgtcttccaactgacatttttaaat

SEQ ID NO: 46128 - DNA, 201 bp, Homo sapiens; identical to SEQ ID NO: 8757

SEQ ID NO: 46129 - DNA, 201 bp, Homo sapiens
ttgcttaaataacctcaggacatggcagttggcttcctacagattaatttaccttttgaaaaatttcctgtagagatggagttttgctgtgttgcccaggstggtctcaaagtcctagactcaagtgatccaccagcctcggcctaccaaagtgctgggattaccagtgtgagccaccatacctggcccagagcgagtgat

SEQ ID NO: 46130 - DNA, 201 bp, Homo sapiens
ttttttaagactcgccctgttgcctaggctggagtacagtggtgtgatcactgctcactgctgtcttgacctcctgggctcaagagatcctcccgcctcascttcctgggtagctgggacaacaggcatgggccaccagccctgctaatttttttgtagagatgaggtcttgctttattgctcaggctggtcttgaactcc

SEQ ID NO: 46131 - DNA, 201 bp, Homo sapiens
gtcagtctagagcccatgttgcaaggggctttaagaggtaattagctcaagcagagagtgagatgtgattgctgtcacattttttttttaagtttttttawttttatttttttttttttgagacagagtctcactctgtcgcccacgctggagtgcagtggcacaatgtccggctcactgcaagctccgcctcccaggttc

SEQ ID NO: 46132 - DNA, 201 bp, Homo sapiens
caggttcaggccattctcctgcctcagtctcccgagtagctgggactacaggcgcccgccaccacgcccggctaattttttgtatttttagtacagacggkgtttcaccgtgttagccaggctggtctcgatctcctgacctcatggtccgcccgccttggcctcccaaagtgctgggattacaggcgtgagccactgcgt

SEQ ID NO: 46133 - DNA, 201 bp, Homo sapiens
cttggcctcccaaagtgctgggattacaggcgtgagccactgcgtccagcctgctgtcacattttaaatattcctctgggcttgataatttaaaggagctyacattcctcagataaaatgttcattttctttctcaaacctaaacataatattaaccaccgctatattatcatttttagtaggaggatgagaagggctaaa

SEQ ID NO: 46134 - DNA, 201 bp, Homo sapiens
aactcttagcctactcatcaattactcatataagctgagtaacagcaattctaatttataactcctttataataatattaaatctactaatgaggctgggygcggtgactcatgcctgtaatcctagcactttgggaggtcgaggagggcagatcacttgaggtcaggagttcgagaccagcctggccaacatggtgaaac

SEQ ID NO: 46135 - DNA, 201 bp, Homo sapiens
aaattagctgggcgtggtggtgcacgcccgtaatcccagctactcaggaagctgaggcaggagaatcgcttgaacctgggaggcggaggttgcagtgagcygagattgcaccattgcactccagcctgtgggacaagagtgaaactccatctcaaaaaaaaaacccataaataaataaataaataaataataaatttacga

SEQ ID NO: 46136 - DNA, 201 bp, Homo sapiens
tgcgctccagcctgggtgaatgcagtgagtccagaaccagaccctgtctgggaaaaaaaaaaaagaagaaatagttaaatcgtcttccaactgacattttwaaatgtttgtggtgataatattattaattaaaatattcatcctaaggattaaatataatccttttttattccagagtcttccaccctgtttaaagatttc

SEQ ID NO: 46137 - DNA, 201 bp, Homo sapiens; identical to SEQ ID NO: 8756

SEQ ID NO: 46138 - DNA, 201 bp, Homo sapiens
agagaccaaggtggaaatttccacgactttgatgacttcatcttggaatcacaccctatttcttttgcagtattctatttgttacacaggccagccatgaytcagagtaagaggggactcatacacaaggatttgaaactcaggacatgaaaatcactggaagccatcttggattttccctgtaggggctttctctgtttt

SEQ ID NO: 46139 - DNA, 201 bp, Homo sapiens
gcaacagtgtgagactccatcttaaaaaaataaaataaaataaaataaaataaaataaagaagaggggagcaggaaaagatttctaagatctctctaaatrtggcatgacagtgtgggctgctttttgtatttcaggagaagaatcgaaccctgggagtttgacgtcttctatgaccccagagaacttcgtaaagaggcct

SEQ ID NO: 46140 - DNA, 201 bp, Homo sapiens
tcgcccaggctggtctggaactcctgggctcaagcaattctccacccttggtctctcaaagtactaggaatacaggcatgagccaccatgcctaaccaaatttttttttttttttttttaagactcgccctgttgcctaggctggagtacagtggtgtgatcactgctcactgctgtcttgacctcctgggctcaagagat

SEQ ID NO: 46141 - DNA, 201 bp, Homo sapiens
tgtagcctcgaactcctgggctcaagtgatcctcccacttcagccttctgagcagtggggactactggtgcacaccaccatgcccggctaatttaaaaaakttggttttgttttgttttgtttttagagacggggtcttgctgtgttgcttacggtagtctcaatttcctagcctcaagcaatcctcccgcctcagcctcc

SEQ ID NO: 46142 - DNA, 201 bp, Homo sapiens
tccttcctctcgagttgtggtttaaaatatgtataattacaattataaagagatatctatctatctatctatctatctatcatctgtcatcaaagatatcstggcttctctccacactaccaaatactctttcttattttttaattataatttttatttcagattcatggggtacacgtgcagatttgttacaagggtata

SEQ ID NO: 46143 - DNA, 201 bp, Homo sapiens
cagtggggactactggtgcacaccaccatgcccggctaatttaaaaaatttggttttgttttgttttgtttttagagacggggtcttgctgtgttgcttayggtagtctcaatttcctagcctcaagcaatcctcccgcctcagcctcctgaagtgttgggattataggcatgagctatggcacccagccagggactcttt

SEQ ID NO: 46144 - DNA, 201 bp, Homo sapiens
caaagtgtcagtcaaaatcttgggtttatatgtattttggagtctagtagttgaggtcaattactcacatgtgtggtctgatgaggtgtgacatactactyttgcagggaaggggaattacaatctatgttcttatcacagcaatacatgtatcactcaagtagcaaactatggaagtagaatcattttaaagctttaaaa

SEQ ID NO: 46145 - DNA, 201 bp, Homo sapiens
aaaccattttctcattacacttagcaggtatttcatcaatgttaggtgctactaattttatcacaacaattattaatatacaaccacaaattatatctcartgtcaaaaatcatcatttatttgatctgcattaattacagctgtgcttttgctactttctcttccagttttagcattgatattactatacctgtgctatt

SEQ ID NO: 46146 - DNA, 201 bp, Homo sapiens
atttgcatatcaaacttgccggcctggtttttcaagctgcctgttagaaaagaaatggtttgggggttgcttctcatgacaggaaaatttccactgagaayttttaccctttctagtggcctaacaattatttcctaataactcctgtattattccctgcctcaagagaagtaaacctaactgctgttaaggggtgttgga

SEQ ID NO: 46147 - DNA, 201 bp, Homo sapiens
ttttaccctttctagtggcctaacaattatttcctaataactcctgtattattccctgcctcaagagaagtaaacctaactgctgttaaggggtgttggaygacaattctttctggctacttcctgttgaaaaggctcgtcacgtgagggacagcagttggtcctcctcctgaggttgatctaagtgttctaggaagaatg

SEQ ID NO: 46148 - DNA, 201 bp, Homo sapiens
aagagaagtaaacctaactgctgttaaggggtgttggacgacaattctttctggctacttcctgttgaaaaggctcgtcacgtgagggacagcagttggtyctcctcctgaggttgatctaagtgttctaggaagaatggtgtgtccatgggtggctctgctcgcagcgttgtttggagtttgattgcttctaggtgaaaa

SEQ ID NO: 46149 - DNA, 201 bp, Homo sapiens
ttaaggggtgttggacgacaattctttctggctacttcctgttgaaaaggctcgtcacgtgagggacagcagttggtcctcctcctgaggttgatctaagygttctaggaagaatggtgtgtccatgggtggctctgctcgcagcgttgtttggagtttgattgcttctaggtgaaaagagataaattttacaagaagatt

SEQ ID NO: 46150 - DNA, 201 bp, Homo sapiens
aataatttttggcataggccatttttgtgagttgcaatatgattgggagaaatatgatattgggtggctaaaataactttagcattaatcttggcaattcytttcctttaattagtaaattcttttgtgactttcacagaccctcttacaacatactcaaactctctgacttgtcctaaacatccttcctgtatacaacca

SEQ ID NO: 46151 - DNA, 201 bp, Homo sapiens
gcaattcttttcctttaattagtaaattcttttgtgactttcacagaccctcttacaacatactcaaactctctgacttgtcctaaacatccttcctgtawacaaccagtcatttccttttaggacaagaatttaccatacacaatccttccttatataaaatctttctttataaacttcttttaatagtttagaatgcat

SEQ ID NO: 46152 - DNA, 201 bp, Homo sapiens
aaaattagctggacatggtggcgggagcctgtaatcccagctacttgggaagttgaggcagaaaaatcgcttgaacctgggaggtggaggttgtggtgagmtgagattgcaccactgcactccagtctgggcaacagtgtgagactccatcttaaaaaaataaaataaaataaaataaaataaaataaagaagaggggagc

SEQ ID NO: 46153 - DNA, 201 bp, Homo sapiens
acgtgcctctgggctgtcagaggttgatccctcagctgttcaggctttgacttgaatgtggaagtcaggagttgattcctgtaacttttactgccaatggkgttgaaagaagaacagtgtagggcctttcccagcttggcttagggaaggagacagagatgagggttttcactaacactaaatttcctgggttaaataaag

SEQ ID NO: 46154 - DNA, 201 bp, Homo sapiens
agtctctgggcttcttagagcaaaagttttaaaaccatcatttatatgtttaatatatttttatctatttctagatttattttaaaggcagtaaaataatmtaacaggctcctgggtacccatggtgtttattatattatgaagaaataaaatattactcatacagtcgaaaccctacaattaaattcctttccctccctt

SEQ ID NO: 46155 - DNA, 201 bp, Homo sapiens
tcgacgaggtgagagctgcagcagaatgtcactgctctgataaaaggacaactaaaagccaaatatgattattttcagaagaatattttgcagtaaatgtyattcatgtaataaatttattctttaatctatcagtgtattagcgttccctccaggaagtagtttttaaactcatctcaataattactttcatgtttaatt

SEQ ID NO: 46156 - DNA, 201 bp, Homo sapiens
tactaaacaacagtttcatatgatatatcttggacattctgtgaaatagtaagttgctgatgatagagaaaaaacatggctttgtgatcagttactagccrtattcttgaaggttacagacagagcggggtaggctgcagcctacagacagaaagtggggctgtaggtgtagggtcctggctgcacagagtgtgtgatgga

SEQ ID NO: 46157 - DNA, 201 bp, Homo sapiens
ctaatccatttattgctctttaaagattaccatgtactcctttttcttattataaaatattgcatattcatattaaaatctggaaaattcatagaagcagmaataagtaatctaatgaatcaaaaacaatgtcaagtagtgtttcttaatcattacaattatttatgaattttggttttaatttttcaacatttggtctac

SEQ ID NO: 46158 - DNA, 201 bp, Homo sapiens
aggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaa

SEQ ID NO: 46159 - DNA, 201 bp, Homo sapiens
tacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagc

SEQ ID NO: 46160 - DNA, 201 bp, Homo sapiens
tatttcttcatcattcagtcttggtcgattctatgtgtctagcctttatcaacttcttgtaggttattgtatttattggtgtataattgttcatagcagtstctatgatccttttttatttctgttgcaatgtctcctctttaatttataattttatttagttgaatcctcattccttttttcttagtttggctgaaggtt

SEQ ID NO: 46161 - DNA, 201 bp, Homo sapiens
atgaaacagccactaaggaaaatcattgcaaggaacaattagcagggtgtccttgcctgcctcttctattcaaaagccatcagctacattctttataaaakgtgctttaagtgtttgctgttgattcctgcaatctaagctctcaggagcatggtttgttccctagcaagaagataatagccagcacaacccaaggaagac

SEQ ID NO: 46162 - DNA, 201 bp, Homo sapiens
tgtataattttatgcgtagagataagagatgagtactttcgcagaaacaaatgaataattatataccaacatggagaacttaagctcataggtgaatgtgrgaatatggaggagaatgaaaatcattgccaggtgagtgatcaaagagtgcattctagaaaaggtggtacctgtacaggggtttggaggatgcattggtat

SEQ ID NO: 46163 - DNA, 201 bp, Homo sapiens
aagcgttcatgcagaatggctactgagacgtttagaaaccatgatcgagacaaatgagggatcatttatttggacaaactgagaacttttactaatctaayagccagatattgtagtcatggtctctgaggagaaatgcaaactgaatgctctcatttgaatcttagaatgctttagaatcctggtttcacatgtcttcta

SEQ ID NO: 46164 - DNA, 201 bp, Homo sapiens
tctgttatcccagcttctaagctaaccagactcatcattttggcctttcatgtatgcttttcctatggccaaaacgtccacaaattactaataaatgctgrcaaggagagaggttaaaaccaggaagccatgccttttagctgacaaaacattcattgaaatgctatctgggtgaagcactgagaaattaatcatctgaat

SEQ ID NO: 46165 - DNA, 201 bp, Homo sapiens
aagtaggtaagcagagtccaaaatgtagggtcattttcaatggcagagaggaataggagagtcaataagaagcaaatgctcaaggagcttgagtagagackggaataggcatctctttattatcttattggctgatttatacttcttgtaaaataattagcttaagctaattatctaagaaacaagaatctctcctaggca

SEQ ID NO: 46166 - DNA, 201 bp, Homo sapiens
ccaattttgcttttaccaagccttagtgaaaagtgaatgaattctaacaagaagactcaaagacactggtgctccccctgtgtctcccttcacttattctrcatggtcagcacctcttcaaaagaccaataataatggtcccctacaagaagtatacaattgctcctctgatgtgaaagcatatgaagaaaataagtgtcc

SEQ ID NO: 46167 - DNA, 201 bp, Homo sapiens
ggggatagttacagaggcaagagctcccacccagcgccttctgagcttcttcctctgattgatgtactgtaagagaccgtcaatggctaagttcccgtcaytgatgcggatccctgcccacatgtcccacagctcactctcacagagccaagtacacggcccaaagactggggtgagacctcgagagaatacaaagaagtt

SEQ ID NO: 46168 - DNA, 201 bp, Homo sapiens
gggtcccatcagtcttccaggtgtaaaccattagattcctactagatccctatctttcttcccgttactatatcagtgagcaaggtcttgattctatttcrttttttgtcacaattaattattattaatagaaaataaacacttattccagtttcaaagttgttataattgaagttgctaattttaaaaaatgaattttaa

SEQ ID NO: 46169 - DNA, 201 bp, Homo sapiens
aacccccaaatcttaaaatcttagcattatagaggtttatttctcaatgatgcaatgacaaatacaggtccatctggtgactcagggtcccagttgtcctycgcttatgatgtttccaactcaggaaatgccttttatggttgctatggcagaggaagagaggagtggggagctggcacctaggtcttcagtgcttcagct

SEQ ID NO: 46170 - DNA, 201 bp, Homo sapiens
tcatattaaaaatagcaaaaatattacttcttcaaaaatgctttatacttcatgtatattactgattttaagtaaaagtacaattaagacaattagccagwcctatttatgagtagctctaattggagcagcttgttgctggaccctattcagtggtagagataaggttgagatggctgaatagttcatctaatttgaaat

SEQ ID NO: 46171 - DNA, 201 bp, Homo sapiens
gcttaaaatatattcacattatcttaatttctactgtctccaagtccgactccttaccaaatctgtagacagtcagcttcggtcccttaaatttaaatgtraattcctctaagatcattttcccagttgcacaagctgaagtaatagtcttttgggcctgactcatcccatcctctctggacacaaagaagggcagaaaat

SEQ ID NO: 46172 - DNA, 201 bp, Homo sapiens
taattttgcactttagaaaatgtctgcatgtttattagagaagtgaatgctgaaatcagcgaacaaaatgtaaagtgagcaactaagaaatacttataagrgctcacttgtattatttaactgtgtaatcctctatctcatatatatgtaatactttcttcaagttcattatagctcccgggcccagtacatcctagtcca

SEQ ID NO: 46173 - DNA, 201 bp, Homo sapiens
atcaaggatgcatatgaagtagttaaaggctagatctaaggacatgtggtagaaaagcatgtaattcagaaaaagcctagcttgacccctaagaagggggyggtagtgagagggatcaatgagataaggagttcctgtctgctttctaaacaatgcagtttgaacagagaagtgcctcatctttccttttttccatctatt

SEQ ID NO: 46174 - DNA, 201 bp, Homo sapiens
ttatattagctaatcactaaacagaaattttaaaagaagtatttaatattaattctcaagtcttaggagaatatttagctaataattctacagttgactgsagagtttattcattatttaattcataatgtcttttcaatcactttactgtttcttgattcatgaagaatacatgccaagtgtattagtctgttctcacac

SEQ ID NO: 46175 - DNA, 201 bp, Homo sapiens
cttttcctggtccattaatggatatatgacaagtgatggcaaaaggatagttacagttattaacttaatcattaattggctcagggtatccccaaaaccgyagttggaactgaagtgctacaaaaatgaccattttgttgttatagcttttcttcacataaggaaataaataagcaaaaagagggagtgtcttatctattt

SEQ ID NO: 46176 - DNA, 201 bp, Homo sapiens
aagcactctatctcggaaatgttcgtggcccacgtcttttccgtcattgtgcatttttgccccatcgctaacacttggcagtgtcagccctttcttatacyccttgtcatcaaactatattcacattttccttttaaggtgaagtgatatgtatactgaaataatcctatattttttaatgttttagtgtatctttttgag

SEQ ID NO: 46177 - DNA, 201 bp, Homo sapiens
tatattgttatgagcacaatttctacccagattttgttggttcttttcaaatccatcaagtaaaacagtgtgcgtatgatttgtgaatactgcagttgctrtaatcacaataaaagagggtttcttgcaagaaactatgtaaaacaacttttatgaagaatagctgtccttagccccagataaaaactactgtcagccaca

SEQ ID NO: 46178 - DNA, 201 bp, Homo sapiens
actttaaatacctgcaaagttaacatgtcataacagcaactcaaaaaccattaagtgctaaggagtttgtgttattttccatttaaaggatatacatacgyttctaggacccaaatcctagcaaagtacacttcacatttctttctctacatctctagagtttcatagaagaaagtagccccaaaatgttatccctctaaa

SEQ ID NO: 46179 - DNA, 201 bp, Homo sapiens
gaatagagtatctactgtatgactagaggtatagctaagaaaaaagactatagggagaaattaatattgtaggacaaagcatttaattctagaatgatccyactaaggtaagaccaccgtcatcggttgcaaaattgctgaatcactagggttaatagttacagatcctaaatactcctcacatgttttctttcctcgtta

SEQ ID NO: 46180 - DNA, 201 bp, Homo sapiens
atggaaaaattaatgaatttgaagacagaaaatattagacctgataaatcaaaaaggtgactccttaggaatatagattaaaaattaagtgattgtcaagwttcatcaagaaaaataaaggacaaataggcaaagctctaaaagaggtatcactagacaagggaggaaatttaacacataagagatcacttggaaaaactt

SEQ ID NO: 46181 - DNA, 201 bp, Homo sapiens
aacaattctaaacaatcaactttgctgactttagaaaaagcagagttaacttaaagaatgaaaaagatggaaaaattaatgaatttgaagacagaaaatawtagacctgataaatcaaaaaggtgactccttaggaatatagattaaaaattaagtgattgtcaagtttcatcaagaaaaataaaggacaaataggcaaag

SEQ ID NO: 46182 - DNA, 201 bp, Homo sapiens
gagggcaattttaaaagaaggtagtttctcaggtgtttctagtcaaaatgacaaacctacaaagtacatttgcattattttatgtatactttactgatagwgtcctttaaatgttgagttcaagctaatttttcttaatcttcaaaaagtttagggatcaaattgtatcctgcagatttttgttatgctaaatttcatttc

SEQ ID NO: 46183 - DNA, 201 bp, Homo sapiens
tctatagaattaactagattatgctgtttctgataacacaaattcaccccaacacacgaatgacttaattgcaagaggattaaaatagataaggtctacaytgttgttgtttttacccactgaagctcactttttcctctccttgtaattattctcaacttctgtagaattatatttggagaaacacataataaaactagg

SEQ ID NO: 46184 - DNA, 201 bp, Homo sapiens
ctatactgagggcaattttaaaagaaggtagtttctcaggtgtttctagtcaaaatgacaaacctacaaagtacatttgcattattttatgtatactttaytgatagagtcctttaaatgttgagttcaagctaatttttcttaatcttcaaaaagtttagggatcaaattgtatcctgcagatttttgttatgctaaatt

SEQ ID NO: 46185 - DNA, 201 bp, Homo sapiens
actgaatttctctatagaattaactagattatgctgtttctgataacacaaattcaccccaacacacgaatgacttaattgcaagaggattaaaatagatwaggtctacactgttgttgtttttacccactgaagctcactttttcctctccttgtaattattctcaacttctgtagaattatatttggagaaacacataa

SEQ ID NO: 46186 - DNA, 201 bp, Homo sapiens
atcagatgtctgcaccatggttcctgtacagcctgcagaacagagaaccaattaaatatcttttctttataaattacccagcctcagatgtttcttaaaarcagtgcaaaaaatggcttaacactgtgatatttggtattttctagtccattagtgcacatccccccgatgtaggataaatatggtatgaatatttgaata

SEQ ID NO: 46187 - DNA, 201 bp, Homo sapiens
gaagtttgagatcagcctgggaaacatagcaagactctatctctacaaaaaggaaaaatgagtgaaatatctgtatgatagccacataaaagtggaaaacwgaatttctctatagaattaactagattatgctgtttctgataacacaaattcaccccaacacacgaatgacttaattgcaagaggattaaaatagataag

SEQ ID NO: 46188 - DNA, 201 bp, Homo sapiens
aaatcgcatgttgaaatggtattcccagtattggacgtggggactggtgggaggtgattggatcatggggacagatccctcatgaatggtgtagcaccatycccttggtgataagtgagttctcccttagttcccatgagatctggttgtttaaaagaaattgggatctccccctgctctctcttgctcccactccctcca

SEQ ID NO: 46189 - DNA, 201 bp, Homo sapiens
ttccatccaagactatcactaccacttctaaaccacctccagccacacaaaaaacacacactatgcttgagtcattccaaattacacaccttcctctaaayattagtgtgaaattaggacatttgggaaatgtgattgatatgatttgcatgtttgcccccttcaaatcgcatgttgaaatggtattcccagtattggacg

SEQ ID NO: 46190 - DNA, 201 bp, Homo sapiens
aaaaatccaagcaaagcaggtaacaagaggacttgattccagactgtgaacagatttgaggcagggtcagaaagccaccctgaaatttcagtgctataaamctgtagtgggaactctataggaatactaatttctcccttcatcaacaaagatattatactggtcctgtgaagaggcttagtcacttcccagtttatgtat

SEQ ID NO: 46191 - DNA, 201 bp, Homo sapiens
agtgagaagctaaaatggaagggagacgataaatagctcagcaaggtttttagggaagcagaaatgactcagatttgaaatataggtgacagaattagccytaaggaggagaaagaaaagatcttttgagactataagaaaggaggtgagagttgatgtagccataaaaaatacagagatgaaagggtggggagttaaaag

SEQ ID NO: 46192 - DNA, 201 bp, Homo sapiens
agatgagattgtgtgtgatttttaaaaattatatttattctacctaataagcatttattacttttataacctgagagataaacattattgaaaaagaagakcatggatttaaagcgaggatgtgagactgtggctgttacatatttttttggtttggaccttggttaagaaggcaaagagggatagagattgtgggacata

SEQ ID NO: 46193 - DNA, 201 bp, Homo sapiens
taactaccaggtttgcacgttgacttctttatgcttcatttggattttctgaggctttaacgttttccgtttttaagactaagctcaagggtcaactcttycatgaaaattaattgctatttatgtttccatctataagaagagtgaaataaacaatgaaatctaatgacactgaaaagtgctttcaatgtactgttgagt

SEQ ID NO: 46194 - DNA, 201 bp, Homo sapiens
tatcctgtaccaaatggtatgccaggggtgaggatacaaagatagaatagaactttttagtacaatgtgaagaaagaaacataaagaaataagactgctgragtattttaactaccaggtttgcacgttgacttctttatgcttcatttggattttctgaggctttaacgttttccgtttttaagactaagctcaagggtc

SEQ ID NO: 46195 - DNA, 201 bp, Homo sapiens
cggctaattttgtatttttagtagagacgaggtttctccatgttggttaggctggtcccgaactccagacctcagttgatccaactgcctcggcctcccaragtgctgggattacagacatgagccactgcgcccggccgactctggtgaatttctcggatgtaagttgttatggtatgtgtgtaggagtggggagtatag

SEQ ID NO: 46196 - DNA, 201 bp, Homo sapiens
gaatttccgagaaaaagaaggtgactgcaaaggatgcactgtcaggttagttgagatgagaactctcccagggtctgtcctgtgcataataaaagcttcgwttttattgcataatattctattatcatgtggatgatgtggagcaggtttgaaaggattatactcagaggtggaattaccacaaaactaatgaatcttcaa

SEQ ID NO: 46197 - DNA, 201 bp, Homo sapiens
tgtcacatactagacaaagatgatttgttttcattgttctgaatgtatgtgagatctgtaataacatcctttcatcacagatgagaaaatattaactaacytgcccaaaatcatgtactacaaataacaggaccaggtattaaatgagatgatatatttgacttaaatacctccatctatgcacagccaatagattattct

SEQ ID NO: 46198 - DNA, 201 bp, Homo sapiens
tacttacgtagcagagctgtttagtagattaatataattatcctcagtttgtagaaggaaaatatgcccagcaacttgtcaaggacaaacaaaaattccartgcttattttagaattagaaattaaattacggtcctgctcttgactttgtagatgctaactatcacctcttttggacttttatatatttatctttcataa

SEQ ID NO: 46199 - DNA, 201 bp, Homo sapiens
ctctttgagaggatctcactttggcaaacacttgaagatgacgtgggagtgatttgtgcagttatcagggggaagagtactctctgtacagggagcaggcytatgaggatctaagcttggagcatggtgagaaggctcagaggagaaatgggaaactggaacacatagcattgttgaccttaattttaaagattttgcctt

SEQ ID NO: 46200 - DNA, 201 bp, Homo sapiens
tgggcctatatgcattggaatgtggtaaatgaatgaatgtttacagtgagtaaagaagataaaaaaattcctgctcttgtggaactaatatttagttgggrtggagatgagcagacaggactatgatgaatatatgatgaagcaacaaaagaacacctatattgtataaaatgtagttgatgaaaaatgtcctggacaaac

SEQ ID NO: 46201 - DNA, 201 bp, Homo sapiens
tgaattagttattgcagtgcccaacagatatttagtattgctgtgtgtccttcaaatgtttacaatattccactgtgcctttgtgagttcactgcagcacsctggggcacctctacacacagtttgtgaacacaggggtagatagatcctagaggcattgaaactacacggaaacttgaatgacgttagggatcccagagc

SEQ ID NO: 46202 - DNA, 201 bp, Homo sapiens
gcatggtgcttattgcgaacaagatctaatttcttactttcagatcagaagagggtttctccataacctgactccctgtgaaacagtcatctctgaggttsccatatgtggtcactctagtatgtatgtctgtctgtgcagaataagtaatcagatatacagcacatcccaaacttgtgacagctactagggaaagggaag

SEQ ID NO: 46203 - DNA, 201 bp, Homo sapiens
tccctcctttcctgaagctcctactatgaccccctagtgggaggaagagcatatgcaagcatggtgcttattgcgaacaagatctaatttcttactttcasatcagaagagggtttctccataacctgactccctgtgaaacagtcatctctgaggttcccatatgtggtcactctagtatgtatgtctgtctgtgcagaa

SEQ ID NO: 46204 - DNA, 201 bp, Homo sapiens
gtcaagaatataatatatggaaaaaataccttgatatagaaaactgcctacaggtctttgatttgtttagcacctaatgtttgagatatttattgttgtckcaatatcctagatttataataagattaatggttcttacttaataccgcagtgtgtcatcctaaggtaacaatttttatttgcttctgtgtattttctttt

SEQ ID NO: 46205 - DNA, 201 bp, Homo sapiens
gagcttcagtcatgaatgacttagtactgctccctgccatttttatgctgtccttgccttgagggaatctgaacttgccgggagcaatttgttttgctttytaatttttgaatatacatctgttaaaagtaaatttgcccttgtgtgagtttgagatttgaagcctgtctacattgcactgatcgaatgtttgtggagata

SEQ ID NO: 46206 - DNA, 201 bp, Homo sapiens
tacattaaaataaatttgaccacagccataccaagttctgtaatcttttctagtttaatgttcaaataatgtgactgataaaaataatgtaactaaggcartccagatgcctttaacgagtgttatgtctgtgataatctgagttcagatttatatcttcaacagtaagtatttagcactctccaacccttcttgcacttg

SEQ ID NO: 46207 - DNA, 201 bp, Homo sapiens
gaacatagccctaggctacacttagaaaaaattattttctgttctttattaaaaagcacagtggttgccttattagcattttaaataacatatatgaaaayacattctgtttcaaatttcagtttcatgtttctaatggaatcaaaacaatttattgttaaaaggatggcttttgaaaatttggccccatacgtagtcttt

SEQ ID NO: 46208 - DNA, 201 bp, Homo sapiens
aggggaacagaaagactgaaaatgagagataagatacactatgcaaactctaaccagaagaaagctggtatgctaccattaatagcaatcaaaaagacttyaatttttttaaaagaattattaaggacaaagaaagtgatcatgatagaataaaaggaacaaggaaaactaaaaaattatgagcctgcaaggtcataataa

SEQ ID NO: 46209 - DNA, 201 bp, Homo sapiens
ataacatatatgaaaatacattctgtttcaaatttcagtttcatgtttctaatggaatcaaaacaatttattgttaaaaggatggcttttgaaaatttggycccatacgtagtctttaagtcttttttatttttcctcttttaagctccagggagacattacattttctcctgtaaaatagcagcttattctagctgggat

SEQ ID NO: 46210 - DNA, 201 bp, Homo sapiens
gagaaaaaatgaagagacatgtaggcccctaccatactggctcatgaagcctggaccacgtctggtctgagtcattgaccagaagtagccgtgtgccccargctaactgtaagggaggtctggaaaagtaggaggcacataggatatttgatgagcactaactatctctgcttcaggttgtcttcataataaatgcaaaca

SEQ ID NO: 46211 - DNA, 201 bp, Homo sapiens
agcctggaaaaatatcaaaattcaaaatttgaagtatgatttatattgactatgtattgctttggcactatcacaaaatcgaaaaataccaagttcaaccrtcataaattgatgactatctgtaccaccaaatagcccattactcaaatcctcaactttttctcttcaatgtatgtgacctctatttatatagtcaatact

SEQ ID NO: 46212 - DNA, 201 bp, Homo sapiens
gaggatatgaggccctcctctgcccatttacactggaaatgtcttagatgtcttagtgcttttcaatcaggtatatccaaacaacaaacaaacaaataaartaagactaatgcagaatgaattccatagttcagattcttcaagataatggaaaattatcacataatctccacctgttttgaaacattatcttctttcctt

SEQ ID NO: 46213 - DNA, 201 bp, Homo sapiens
gaggcctctagaagctgagagcagcactggattgataatcagcaagaaagcacagctgagctaacatggagactgcagcctctctaggtcgacaggaactkattatcaatgaatgttgttttaagtcactacgtttgtgataatttattatacagtaataaaaaccaaatacaaaagattaaaaagaaatctaagttgaag

SEQ ID NO: 46214 - DNA, 201 bp, Homo sapiens
cttcaatacaatcaagttggcactcagtattaaccatcacagtgaatgaatagattttctatgacgttgactccttggaatgaccaccagaggcaataagyacactctcagtgacacgaggatatgaggccctcctctgcccatttacactggaaatgtcttagatgtcttagtgcttttcaatcaggtatatccaaacaa

SEQ ID NO: 46215 - DNA, 201 bp, Homo sapiens
tcatgagaactcactgtcatgaggacagttccaagggggatggtgctaaaccacttatgagaaatcagcccctattctccaatcatctcccaccaggcccytcccctaacattggagattacatttcaatacgagatttgggtaggatcacacatcctatatcacttttggagaaagaatggaggtagctctgaaggtttg

SEQ ID NO: 46216 - DNA, 201 bp, Homo sapiens
tcaaacaggatccctgtctgccattgacacctcaaggactattggatctgctaggtcatacggcccaatcggcagagcagtttgcacagcagtctggactygttgcagagcccacttaaaattggcagcctttcaggtcactcaataaatgggcccattttaacacacccaggaacaatgctttgcatccttcaatacaat

SEQ ID NO: 46217 - DNA, 201 bp, Homo sapiens
aaatgctcatctaaaataagaaagatgataggcctgatccatcttctgtttactaggttaaatctggaaaatataaacctcaggtgccagacttcagaggsatatagaaaaacaattactttttgcattagtccattcttgcattgctaaaatcctaaagactggataatttctaaagaaaagatgattaaggcgggatgc

SEQ ID NO: 46218 - DNA, 201 bp, Homo sapiens
tctactggagatttgttctccaaaacctgacaatctagtactttgtaggaactaatgtgtataatcttagggggcttagtggacagaaagttcattagccrttggtactgtgataggggaaaaagcaaatgggaccttaaacaatatgaatagacatggtttctcaaagaatagtctatggttcacctgagcacacatcac

SEQ ID NO: 46219 - DNA, 201 bp, Homo sapiens
tgaaaagattttcatcggttagagtgatacgtctgttatgatgcaattaattgtgatatactgtctactggagatttgttctccaaaacctgacaatctartactttgtaggaactaatgtgtataatcttagggggcttagtggacagaaagttcattagccgttggtactgtgataggggaaaaagcaaatgggacctt

SEQ ID NO: 46220 - DNA, 201 bp, Homo sapiens
agatgtatttatggcagcaagctcatttggtacatgtatgtatgagggaatcaagatctgaaaagattttcatcggttagagtgatacgtctgttatgatrcaattaattgtgatatactgtctactggagatttgttctccaaaacctgacaatctagtactttgtaggaactaatgtgtataatcttagggggcttagt

SEQ ID NO: 46221 - DNA, 201 bp, Homo sapiens
ccaaagggagctcatttggggtggcaggggtaaccgaaaagtgtgggagctgaggtattgtttgagagcctgtgggcagtgtgactgctccaatcgtagtytcagtgaggaagagcaccatctgtgcaagattttctcagatgtcctctataagactttcattgtcatcagttctatgtgctctcaaatcattgctttttc

SEQ ID NO: 46222 - DNA, 201 bp, Homo sapiens
tgcatgtctgtagaagctgcccaccgttcttggaggataggagcacgctgggctactgagaagccgacttcaaggtcagagcgtgtgtgcagaccaaagcwagtcagaagggtgcctatggagagacaatgtgccctcccaactaaaggcacacctgggattctttctgggccactgggctcccgtgctaaataatacaaa

SEQ ID NO: 46223 - DNA, 201 bp, Homo sapiens
ccccaaaatttttttaaataagaaagttttaataagcagaatattagtttaattatgaatgagaagagatgtatagcatttgtaggggtacagaaccatgyattccataaaggaagaagttaagagcaatgatgtggaataagcatggggcttttaagaacttgtctgaaaagaggatattctttggtcaatagttgaaaa

SEQ ID NO: 46224 - DNA, 201 bp, Homo sapiens
tagtcaatcacaaactatggtaaatatttagttatataccacataatatgtaatttgatattattagattattcaaattttctgttttttcttacttcatytgtaaatacttaagatgagtaagttagcatcattttcagccattgacttttaaagtttttatttccaatatattttgttgtccacatatttttgtactga

SEQ ID NO: 46225 - DNA, 201 bp, Homo sapiens
tatcaaattttacacagttaaagatagtgaaaataaagagcacattaaaaaataactagatggaaattttcactgtgaaacagaatttctgaagtgacackgtgttcacttctgatcatggtcattgtacaaccattgagtctttgtataattgctgtgagtagtgtcactaccattttcccttcactttttttctataga

SEQ ID NO: 46226 - DNA, 201 bp, Homo sapiens
gaaattgaaaggatattttagcagctgctttaacaagtatctgggaaaagtccggtctcttccttgcatttctgaacgttaatttgtattaaaagcagcaygactcagaaattttatataaaactcaaataaaccttagaattggatcttatcgagtattgtgttatacagagaatatggagaatatgtgggataaatgag

SEQ ID NO: 46227 - DNA, 201 bp, Homo sapiens
tacctggggccacagcattaccactggttgtaaggtgagtgaaccacttttttgctctgataattttttggggagatttttgttttgtagagctctgtaaytgggcatttcaaaattcaatattacatcacaaaataatgtagaagtattactataatgtgattacagatattaatcaatatcttacagtttacttgtagg

SEQ ID NO: 46228 - DNA, 201 bp, Homo sapiens
attagcctttcattgatttcaagtagattgtaattggctaggatcaaatacatgctttatgtaatacagtttatttcttaaactgatacagaaagtgcacrtaattctggaagtaaaaatgttcaaaagctaagaagctctcatgttatttttcttcaatttgctacaaacatatatagagtgtagttattttctagccat

SEQ ID NO: 46229 - DNA, 201 bp, Homo sapiens
aaaataaattaaatagaatatattccaaagtaactaatgttttcccatattaactcagaataactttgtctgaaattaaactgaatatatatcatttataratacaagcatagagtttaaattcaggtaatcttatttggatgtacaaaccgtgaatagagacattaaggaaaagtagtcataattaattatatcgaatct

SEQ ID NO: 46230 - DNA, 201 bp, Homo sapiens
catgactattgtgaggaggatacttatgagttgttcttcatttccatggggacaaggacaatgaaaatacagtataatacattcagagtgttattagaagktaggtagtaccttttaattgttaaacaataaagtaataacattgctcattaggcatgtgcttatgaagacaaaaaggcctgatttactgatttagtgatt

SEQ ID NO: 46231 - DNA, 201 bp, Homo sapiens
ggtatccaggatagagaaggggaggaaggatctagtcacataatatttgagagtcagcaaattctttcaacaataatgtgattgtatttgtctgtgtgagrtttctatgatggtcattttcatggagccagtcaagcattgactttgaaattaggcagatatgaatttgaaaagtagttttccctccactagccgtttgac

SEQ ID NO: 46232 - DNA, 201 bp, Homo sapiens
atatactcagtagtcccgattatgttggtgttaccaaaggatgttccctggaggttggtctgtttttgatagttctctaaacacatttatatcagatttcrcttacttagtgtggctgctcctacaaggatcagtcttttgttaatatattttacttttctactgatcctactcttaaacgataaagcaagattaaagcat

SEQ ID NO: 46233 - DNA, 201 bp, Homo sapiens
aggagtcacctatgggagcctgccaaaggcttcaaacaggatccctgtctgccattgacacctcaaggactattggatctgctaggtcatacggcccaatyggcagagcagtttgcacagcagtctggacttgttgcagagcccacttaaaattggcagcctttcaggtcactcaataaatgggcccattttaacacaccc

SEQ ID NO: 46234 - DNA, 201 bp, Homo sapiens
tccacctctaggagtcacctatgggagcctgccaaaggcttcaaacaggatccctgtctgccattgacacctcaaggactattggatctgctaggtcatayggcccaatcggcagagcagtttgcacagcagtctggacttgttgcagagcccacttaaaattggcagcctttcaggtcactcaataaatgggcccatttt

SEQ ID NO: 46235 - DNA, 201 bp, Homo sapiens
ttttccttatacagacatggacgcagctcataatgttgaaggatacctctgttgctgatacatctctttatttgcaggaaaatgttgaaggaggagactgyagtcgttgcaaatccggcttcttcaatttgcaagaggataattggaaaggctgcgatgagtgtttctgttcaggggtttcaaacagatgtcagagttcct

SEQ ID NO: 46236 - DNA, 201 bp, Homo sapiens
ccaggcacggtggctcatgcctgtaatcccagcactttgggaggccgaggtgggcagactgcctgagctcgggagttcaaaaccagcctgggcaacatggygaaaccccgtctctattaaatattcaaaaaattagctgggtgtggtggtgggcacctgtaatcccagctactcaggaggctgaggcaggagaattgcttg

SEQ ID NO: 46237 - DNA, 201 bp, Homo sapiens
ggcagtttaggttgcatggtgacttgatgacctacagtcaaacattcagtttctaccaaagcccagtaacaggccaagagttgtctctcaaatggagagtrgtgatctgcagaagatggcagggccttgctccaaaatcctagaggcttccacctctaggagtcacctatgggagcctgccaaaggcttcaaacaggatcc

SEQ ID NO: 46238 - DNA, 201 bp, Homo sapiens
tccattaaataatgactttaattctctattctttttgctatgttagtaagtttgaagtttcattttaaaactaaacatgtgggccaggcacggtggctcaygcctgtaatcccagcactttgggaggccgaggtgggcagactgcctgagctcgggagttcaaaaccagcctgggcaacatggcgaaaccccgtctctatt

SEQ ID NO: 46239 - DNA, 201 bp, Homo sapiens
acagcgaataaggcattctgggagttcacggatggtactcttggcagaaacattgggcgtaggatgggcaaatccatatccagaataagtgcctattccaktgaggacaaacctctgcctttgcatgatggaagaggtctgatataatcaacctgccaccaagaagctggctgatcaccctgaggaaggatgccagacgga

SEQ ID NO: 46240 - DNA, 201 bp, Homo sapiens
aaagcttaacaatacagaagagtcctctactcctttgagtctagccctataaagaaggaagaatgttttcaataacttaaaaggaaaaacaaagaaacaawttatacatttgcaggagaaaaggaaaaggtcaagtagtagagcaaccaacgaccactatgaagaaagtggaggtcagacaatttgagaagaaaaaaagca

SEQ ID NO: 46241 - DNA, 201 bp, Homo sapiens
aaatagtggcatgatcattgcagaagcatttctatgttcagttatcctttcagaatgaatctacttttcaaatctaaactaaattttaatccatcttctgwtagataattttctattttaaagaccctaatttcaagttcaccattttcatttcacctgttttattgtatgattattttcagcacctaaaatggtgcctgg

SEQ ID NO: 46242 - DNA, 201 bp, Homo sapiens
agtttcctttttttttttcatcccaatgcttgatacatagtagccatttgataagtacatgttgaatgaaagcatgaatttataacatatataccttcacytgacttggagtttcataaggaatgcaacagcttccaattcatttactttctttttgcttaacaaagtatctgacacgtagtacaaaagttaaatattata

SEQ ID NO: 46243 - DNA, 201 bp, Homo sapiens
aggttcattttgtgatcataatgaaacatcatattctatgagcaatttgtactgtttttggtttctcttgagtgagccctactaatgccatatgttctgtygacttcttattcaaaatagtggcatgatcattgcagaagcatttctatgttcagttatcctttcagaatgaatctacttttcaaatctaaactaaatttt

SEQ ID NO: 46244 - DNA, 201 bp, Homo sapiens
cactactgacttctaactcatctttttgctttctcttatttggaacagttattcagcttaccctaagtccagagtgaatttccaaaaaatcaaaggttctscaacttttcatttctcttcaattccaactcaggttcacacgtttatcacctagtgtagaagggctttcctccacagttttgcttggcaaactccttttca

SEQ ID NO: 46245 - DNA, 201 bp, Homo sapiens
ccagtcttagcaggttcattttgtgatcataatgaaacatcatattctatgagcaatttgtactgtttttggtttctcttgagtgagccctactaatgccrtatgttctgttgacttcttattcaaaatagtggcatgatcattgcagaagcatttctatgttcagttatcctttcagaatgaatctacttttcaaatcta

SEQ ID NO: 46246 - DNA, 201 bp, Homo sapiens
ttatgaggtccttagagtgctagacactgtttgcatgaattattttatatgatctcaccacaaccttataaaaaagtttttattgtccgatgttttagacrgcgtagttataggagttagtttcagccaccagttgtatatagagaagctgctaggcaaacataagatttttttaaatctagcacaaggacctgaacttta

SEQ ID NO: 46247 - DNA, 201 bp, Homo sapiens
gggatattagagatatcccctaaatgaaccagtcttagcaggttcattttgtgatcataatgaaacatcatattctatgagcaatttgtactgtttttggyttctcttgagtgagccctactaatgccatatgttctgttgacttcttattcaaaatagtggcatgatcattgcagaagcatttctatgttcagttatcct

SEQ ID NO: 46248 - DNA, 201 bp, Homo sapiens
ctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtcta

SEQ ID NO: 46249 - DNA, 201 bp, Homo sapiens
agccgatgagaaagctcagtaatagaagcaaatactagtacttgttttcttgtggagataaaattatttttgcattattctactgtgaccatgcctatctrttggtgacaactggaatatcactttgttctcccaatggacatgagtgtttgtgtaagtgtactcacacattcacacatatctgtttttgtccacagcgat

SEQ ID NO: 46250 - DNA, 201 bp, Homo sapiens
aaatagcattattataataaaaactggtaaaacacaccaggacaattttcaaaccaatgtcagtgtgttaccttttacttactgcctatggtaaatccagsactttctcatacatctcccagtttatttctcatatcagtcacatgaaggaagatgttttctttatttgccatatgtaaaaagggacagaaatgacatttg

SEQ ID NO: 46251 - DNA, 201 bp, Homo sapiens
acatatagtatgctttttattctatgtatatacctatgaaaaagtttaatttatgttaggcacagcaagagattaacaacaatagagcaattataacaatwtactataataagagttatgtgaatgttgtctctctcactccccctcaaaatatcttattgtattatactcatctttctccttgtgatgatgtgagatgat

SEQ ID NO: 46252 - DNA, 201 bp, Homo sapiens
gtctgaaactgcagattgtactgacacctacatatagtatgctttttattctatgtatatacctatgaaaaagtttaatttatgttaggcacagcaagagwttaacaacaatagagcaattataacaatttactataataagagttatgtgaatgttgtctctctcactccccctcaaaatatcttattgtattatactca

SEQ ID NO: 46253 - DNA, 201 bp, Homo sapiens
acattccaggacccccagagtatgtctgaaactgcagattgtactgacacctacatatagtatgctttttattctatgtatatacctatgaaaaagtttartttatgttaggcacagcaagagattaacaacaatagagcaattataacaatttactataataagagttatgtgaatgttgtctctctcactccccctcaa

SEQ ID NO: 46254 - DNA, 201 bp, Homo sapiens
tttctctgactaattttatttagctttcaagcatttctttgtggcttcagttttgacttcagtttttaaacaatttaaacaaataaaaattacattacagrattgttacttttaaactcttactttccacggggactgttattgtaaaatctgttcttattcttttaatttaactccattattttgttttaaatgtaatga

SEQ ID NO: 46255 - DNA, 201 bp, Homo sapiens
taaacatagctaatttcccccttatgttattatagagtttatatttatattacaaagaaacgcaagcaataaatcctcattcagaatccttctctagcacrttaaatatagcatgtgaactgtagagatttacctaaagtgcccataaacaagagtggccaacttgatgagaagtaagccaagtgcctcttaataagtact

SEQ ID NO: 46256 - DNA, 201 bp, Homo sapiens
ctctgtggcttgtcttgttctcttgagaagtgtctttcacagagcagaagtttttaattgtaacgaagcccagcttatcaattaggtttctccttgttgarcctttggtgttgtatctaaagactcattgccatatccacggtcatctagattttctcctatgctatcttctaggagcgttacagttttgcattttacact

SEQ ID NO: 46257 - DNA, 201 bp, Homo sapiens
aatagaaaattcagatccagggaaccgtcaatggcattcatctaggagagttaatttaacatacacacattaacacataattttatcttttgttaaaaatrtgtatttactcattttattcctatttgattagagcagagaatttatgtatcgctacctaaaattggttaatagctttcgccctttcaaaaatactcagtg

SEQ ID NO: 46258 - DNA, 201 bp, Homo sapiens
aagctcccactactgcatgcacccacttttctgcatctgtgcccaattattatgactcttttctattactttggatgaattattcttgtttccagaaaagrtcacatcttccccctatgttctcaattctacccctctcccgcttgatgacatcactctggctaatctctcctccttcttatattgtcactttttttttcc

SEQ ID NO: 46259 - DNA, 201 bp, Homo sapiens
tacatgagacagatgattccactaggtcaaaactgaagtgcaacttaaaaataatgagtatacatttcttgagagggacatggcatcatgaaaagaaaaargaatttggtttcagtgaatcctacctagctgcactacttggacaggttacttgctctgtttttgctaaatcttgggtttttacctatacatcctaaggat

SEQ ID NO: 46260 - DNA, 201 bp, Homo sapiens
acaaagaaatgagtcctccagctttcaaaatgaatgacaaccaaattgacaaaaaaagtgtctggggggcttatatatttttgtcagcattgcttttcagkctagttaatacaaagacatttccccctgatttatgttggacagtttcagtgtctacccgtcttaaaatcactggtttcatttgcagtcttctgaggtttc

SEQ ID NO: 46261 - DNA, 201 bp, Homo sapiens
gtccggcgtagctgggcttttggagaatctttgcactgaaaatcagatccttcatatttcatacaccctgaagctaatgtggtttctccctggtcatcttmttctatgatggcaaagcaacgtccattagttatgcatgtgttattaatagcatcatctgggcagtgccctcagcaatagcacttgaaaaaaggcaaggta

SEQ ID NO: 46262 - DNA, 201 bp, Homo sapiens
gtatatttcatagatggcattgatacagtaaaatcctttattctgtaaatggcatttatatagtaaaatcttttccatggtgaatgattattagtcttaartgaaatacaaagatttgattttataagtgaaatatttcttaagtaaactatccttggctgccagtttctttcttaaaagtttaatatttcccagcaactt

SEQ ID NO: 46263 - DNA, 201 bp, Homo sapiens
tgcaagtgtggagaaaaatagcttgtgataccatagtgatcttagagctcattatacatcagcaatgaagagctttaacaaccatgcaattaaaatactaragagtataaataagattgtaccatgtgtatgtggcagcatataaaaactcagaagtggaaggaattttagtcaagtgttactcttgaaaaagcaaacgga

SEQ ID NO: 46264 - DNA, 201 bp, Homo sapiens
caaattaagaaacttaaagaatacagataatgccccatccgcactcgccccccaaaaaaacctagtccttaaatatctgttaaaatataataaacgtgcawgcatgtttagaaattgggaaaaatgctttttgttgttttttgcttgaagcagtaaaacatttttcttgctctgcaatattatgcattttagatactttgc

SEQ ID NO: 46265 - DNA, 201 bp, Homo sapiens
cccaggcttgctcaccaccccaaatcccacgtctatacaccagagaaaggattacccatcaccaaaggtgtctctcattccctaaattatgcatagatcargtggtctgattgtgtctgtccagatagggcacccttttctaatttatgtgaagtgccatgtgggatagctatactttagggaaataagaacaccactcac

SEQ ID NO: 46266 - DNA, 201 bp, Homo sapiens
caattcttctctgaatagcttctactcatctaattctatcaccaaagctacaaaatgtttagatgtagttcaagaaattccagaaactactttagaaaaargtgatcagcgtaagaaagggcaaattaataaggatcagagtcaagcagctgaaacattaaaaaaaaatcagaacagggttggaatatacacattgtaact

SEQ ID NO: 46267 - DNA, 201 bp, Homo sapiens
ttattttatgtgtttaattcaagattgggaaataattatcaagaaaacattgaaaaattgtacaattaaagcaggtgacttattgttatgctccaaaaaawgtcatctcccggaatcacagcctcctttttcttaagatggtctgagcttggtaccatggaaacacagccctaagaagaaacaaaagctggaatatcttat

SEQ ID NO: 46268 - DNA, 201 bp, Homo sapiens
cacatatacaccatggaatagtatgcataaaaaatgaagagttcatgtcctttgtagggacatggatgaaactggaaatcatcattctcagtaaactatcrcaaggacaaaaaaccaaacaacgcatgttctcactcatagatgggaattgaacaatgagaacacatggacacaggaaggggaacatcacactctggggac

SEQ ID NO: 46269 - DNA, 201 bp, Homo sapiens
gaataacagttaaatattccacagctaactattatttaatactaatattatgtcttggttaatggaagacaccatagaccacattttgaatatttgtgctyctttttaatattggtaatcctccttctgagataaattcaggaaatctgacctttctcctcagcccttttgaaataaagaccacttttccaattaggaata

SEQ ID NO: 46270 - DNA, 201 bp, Homo sapiens
actctgctccacatttttacaatctaagaatagtcagatgcccctcttaactgcaaggggctgagaagtgtagggaacacaagaatattttttgagagctmctatctctgcttacatataatggcagaagaaatatcctcctaaatctattaaaatcatactatgctctcaaagattctagctgctcccttaatttgatat

SEQ ID NO: 46271 - DNA, 201 bp, Homo sapiens
ttaggtgaagtaaacagtaagtttagagcaaaatttactcaaaaagaaatagtacacctgagaactataaccgttaaataaattgcatcagtagttaatasaacaaaataacaatatgtacaaaaatgtaaaggacccattatgcaatttgttcccaagaatggaaaaagaagaaaaatttcctcagcttattttatgagg

SEQ ID NO: 46272 - DNA, 201 bp, Homo sapiens
tcaactcccccttggcctccctaatgtgctccttggcacccaaaatccagaaggggccaagatagtagggggctagagtgtcagtgctgccccgagcatakgcacacctggctgggttgcaacagcctcagctttgctctgaaatcagcctgggtgccgggaacagtgagagaccaggaagaaggagcgggcacttctgag

SEQ ID NO: 46273 - DNA, 201 bp, Homo sapiens
cctggcttgaaggtggagcttcactgagggcccacccctttccacccaggaacctgtatgcctcctgccaccaccaacctgccatccacggcgcccactgrcacccaggctgttcatgcctagggtcaccttcaggcccatgcagagccaccctcaactcccccttggcctccctaatgtgctccttggcacccaaaatcc

SEQ ID NO: 46274 - DNA, 201 bp, Homo sapiens
cacgtctggctgagtccggggttttttatgggcctcagaggggaggaagtgtatgctgattggtccatgggtggccatgagctggcccaaaaaaagcaccrtaagttctcactccagtttgtggaaccgacagtccagcccccttccttcaggcagtccctggcttgaaggtggagcttcactgagggcccacccctttcc

SEQ ID NO: 46275 - DNA, 201 bp, Homo sapiens
cctacttaaatagtttaattaaaatgaacctcagaggagatagaaaatctgtcctgcaataaaatctgttctaaaataataaagaaaataggtctaaaatrggtctggaaatgaaacaacaaccctcatcctttacaccagcaagaagttctaaatttctttctttttctaaattcatgatgcatacatgttttaatttct

SEQ ID NO: 46276 - DNA, 201 bp, Homo sapiens
ccctcaacagaggtgagacacacagtgggtagctcctatccacaggtagatcatcctgttgtctgcccacgtctggctgagtccggggttttttatgggcytcagaggggaggaagtgtatgctgattggtccatgggtggccatgagctggcccaaaaaaagcaccataagttctcactccagtttgtggaaccgacagt

SEQ ID NO: 46277 - DNA, 201 bp, Homo sapiens
agcatctgtgcagcaccctcaacagaggtgagacacacagtgggtagctcctatccacaggtagatcatcctgttgtctgcccacgtctggctgagtccgrggttttttatgggcctcagaggggaggaagtgtatgctgattggtccatgggtggccatgagctggcccaaaaaaagcaccataagttctcactccagtt

SEQ ID NO: 46278 - DNA, 201 bp, Homo sapiens
gaggagatactggttgcattaaaaatcttgtaatcaaaaccattctgtaagtgatttgtgtgatcagcttatgcacatcatctaaataagaccagaatttraaaactaaatcaacatttcccaaattgtagatgttcctggaataaagaattctgtgatcacatgagtttgggaagcatccatttgcatgttaaaagttct

SEQ ID NO: 46279 - DNA, 201 bp, Homo sapiens
ttctattttgagacccctttctctatatgtgggaactgtgaggtcttagaaacataatctgagcccatttcaagttgttttcttctcctctctcccagctwgaatcaaagttctattaagcttacctagtaccaaaggccttatatgcaagggtagaggggagggtataatgtctgtgtgtatatgttgagcaaggggaca

SEQ ID NO: 46280 - DNA, 201 bp, Homo sapiens
acttgtgagtctccttgtgcctttgggtcctgaatgcagagcatgggctacagaaataacagaggaggggcagttatacctacctgtagtactgttagcaraattgtgactccagttgaggtgtcaagaggccactcatatgtggttgtgcagtttgtacactgcacaaaggcactcagggaaggggaagattgagggctt

SEQ ID NO: 46281 - DNA, 201 bp, Homo sapiens
accctcttcttttccatgaagtccctgggtgtctagtctgtttactttttctgcatatgtctagaaaggacaatttcttccaacttgtaaaaggcaccatktgagcagggaaacaccctcagtcttttgctgattatgtcaaatgggaggaagtaagaacacagcattacagccacgactctttatacagcagccaccctc

SEQ ID NO: 46282 - DNA, 201 bp, Homo sapiens
ggagaaaagaaaggctttactgcaaaattgttcagcaaggagacaagagtcaggttcaaatctgtctccctaatttgggatatggggaaggttgcaagggrtcagaaggcaaggcaaaggatttagaaatgctggcttggcagagtctgattggagggcttcaaatttgatcacttacagtaaggtatattgaggcagatt

SEQ ID NO: 46283 - DNA, 201 bp, Homo sapiens
attttccctagcactactcctgtcatcattcttagtgattttaatgtccatgaacttaactcttccatactcttcactttcagtttcttgtgcctctctgktctccatttgaagcgtttttttgttgttgtttggtttttgtttgtttttttttttttttcccactgtgtcgtttctctctagttcacttcttctaaatac

SEQ ID NO: 46284 - DNA, 201 bp, Homo sapiens
gatgaaacgagaaatacaggagtattacaaggtttagcaagagatgaacttcattgttgtcatttcaaatttaagacgcttctgtgttatacaatatttaytcaagaagcaattagaagcagaagtctggaacccattagagatatccaggctgaatacataaaatacagagttttgggcacaccattaactgaagtcata

SEQ ID NO: 46285 - DNA, 201 bp, Homo sapiens
ttcctctagactgtgacgacactgtcaaaaatactgtaacagtgtttctgatgactttgagagtttggacaggttcgtgtgtttggtaagctgtccctcarttggggtttgcctcatatctttctcatgattagaatggaattatgagtttttgtgggaaaaacttcagaggtaaagtaccattttcatcacatcaagaac

SEQ ID NO: 46286 - DNA, 201 bp, Homo sapiens
cattactctgaaatctacatagtggtattcctgggactcaatccttggagcaatttgtttctctaactacattcattcagatggtgatcttacccaggcaygtggctttctgtactgagatattttgatattgacatcccacagtatttactattaagtttatgatttaattttatatccactcattactatggtgtgggg

SEQ ID NO: 46287 - DNA, 201 bp, Homo sapiens
gattactttaaaatcaccatcaaaagtctagacttctgaatcgagaaatacttcaccattatgaagaattacaaaaaaaaacaaaactcatagagcctgtrtcagacaattcttgcattgctataaagaaatacctgagactgattataagaaaactggtttaatgggctcacagttctggagggtgtacaggaagcatag

SEQ ID NO: 46288 - DNA, 201 bp, Homo sapiens
cccacagctcatctttgttaagcccatctcccacctctgctcaccttctgaaaccattctactgagccttgtggaactcatggtcaaaacaggcaaaataycccgcagaatcctcctcttccctcagtgttctcttcatcatgctctgactgaaacccaactctcactttgcatgctgctaccccggcagccctcttaagg

SEQ ID NO: 46289 - DNA, 201 bp, Homo sapiens
actgttttggaataatgaagtataagtaagtgattataagtgtatgtgtggataatggatgaggcctaggaaaacttagcacgtttttatactttctattwttgaaattcccacagtctcagctaggagttgttcctccaattttttcccctatgtaccagtgaatatttggcacaactggcagaatcaagtgttaatttt

SEQ ID NO: 46290 - DNA, 201 bp, Homo sapiens
cggggtttcaccgtgttagccaggatggtctcgatcttctgacctcgtgatctgcccacctcggcctcttaaagtgctgagattacaggcgtgagccactsctcccggcccacattttatttttgatatgcactggcacaaaattgtgtgaagaaccaattaataaatatgtctaaggaatatagtttccattgttttaat

SEQ ID NO: 46291 - DNA, 201 bp, Homo sapiens
aatattatatatataaatagtttgtttaaacagtccgcttaagaatatttttctagtcttttgctgctacaaataatcttgcaatcagttgttttgtgcaygtgtcttttgctttttgtcattgcatctttaggatagtttgtttttttttttttgttttttttttttttttgaggcagagtctctctctgtcacccaggc

SEQ ID NO: 46292 - DNA, 201 bp, Homo sapiens
cttctttctttttgaacacgtattctatttgccatcataagtttcagcagcctcggcttcctcaaactccactctttgtctctcaactcagctataatgcrggctttgggtttaccctctctgtgttgcagcctagaaattgcctctgtacactgcttcatgtttttttccttctctcagaaatcacagtcctgtgcttcc

SEQ ID NO: 46293 - DNA, 201 bp, Homo sapiens
aattctaagtagctggagaccttttaaactttcaacttccatatttttagtaatttttcaaatgtgattaatttagcccatgaaaacacaccccatcattkatataaccaatcattataattatttattcgactggtgtactttgtctctaaatgacacatttctatgaaaaaaagatcagtttcactaactcctcaggct

SEQ ID NO: 46294 - DNA, 201 bp, Homo sapiens
acttggaggctgaggtgggaggattgcttgagcccagaagtttgagcctgcagtgagctgtgatcatgccacagcactccagcctggatgacagtgagacmctgtctcaaaaaaaaaaaaaagaaaaagaaaataaaagaaaacaataatagacaggaagatagcttttgcaggttcctgaagaatctaccacaccaacac

SEQ ID NO: 46295 - DNA, 201 bp, Homo sapiens
cttggaggctgaggtgggaggattgcttgagcccagaagtttgagcctgcagtgagctgtgatcatgccacagcactccagcctggatgacagtgagaccstgtctcaaaaaaaaaaaaaagaaaaagaaaataaaagaaaacaataatagacaggaagatagcttttgcaggttcctgaagaatctaccacaccaacaca

SEQ ID NO: 46296 - DNA, 201 bp, Homo sapiens
ttctcttcatcatgctctgactgaaacccaactctcactttgcatgctgctaccccggcagccctcttaaggagtagccatcacctttttgtttttttttycccctgagatgctgactcactctgtcgtgcaggctggagggcagtggcgatcctggctcactgcaacctccgactcccgggttcaagtgattctcatgcc

SEQ ID NO: 46297 - DNA, 201 bp, Homo sapiens
acaaagcctataacagatacatgattaatatgtgtttaatggaagcatagaaacattagaattaaaattttaagatatttcccataaagttgtgttaatgrttgctgtttttatctcctctataggcttgtaactgcagcacagtgggatccttggatttccaatgcaatgtaaatacaggccaatgcaactgtcatccaa

SEQ ID NO: 46298 - DNA, 201 bp, Homo sapiens
accttacaacaggaaacctccagtcccctttcctatcctttgtactatattgtcatatatttttacttctatatattatacatctgacaatataagcttaygattttgatttcaatagtcaattatctttttaaacaagaaaatttctcctataactctttttccttgtgtatatcaattttaatgctttaaattcctttg

SEQ ID NO: 46299 - DNA, 201 bp, Homo sapiens
ctccaaatttccatcttttctcggttcaaagctagaacccatcagtatctaatctgaaaacaagacacctctaaaatttatttaacctcatcccagcactytgggaggctgaggcaggaggatcatgaggtcaggagatcgagaccatcctggctaacatggtgaaaccccatctctactgaaaatgaaaattaaaaaaaa

SEQ ID NO: 46300 - DNA, 201 bp, Homo sapiens
caaggataggtgctattttagataggtaatcagaggagtggctattaccagaatggagggaggacacaagccaaagagtaggaagagcacatagtgggaakatctgcaagtgcaaaggcttagaggcaggaactagttgtatgtacctggcaacatactgaattggtcggtgaagggaaggaaagaagggtatgaaattag

SEQ ID NO: 46301 - DNA, 201 bp, Homo sapiens
aggtagagtttcaaaaagtagtgtggttaagatattcaagggtattatctgctgagaacctgtgacctgcagtgttaaattagcgacaatagtgaattagygacaatgagggcagaatagcagtaaattcttgtaacatggctattataattacataagaataggcaacttttgttttgttattgtttttatttgaaagta

SEQ ID NO: 46302 - DNA, 201 bp, Homo sapiens
ctctttttaaatactcccattacctttccaaaccttttgttcagctgttgggaccatcaacatcctggtcacacctctatggatgaagtctaatttgtcarctactctcttaaatggtggtgtcatgaattgatcacagtgctctggatgtgctctgactagctatgactgctcctggatcgccgtttcctttaatctata

SEQ ID NO: 46303 - DNA, 201 bp, Homo sapiens
cagtgaagtccccatcaccccccatgtgcctactgttttgccttctagcattataattttccaatttctacaacttcttaaaaatagaatcgtagtctgtytttttgagggggggtttgtttgtttctttgtttggcttccttcacttggtgttacgtttttgtaattcatccatattgttgcatgtatcagcagtttgtt

SEQ ID NO: 46304 - DNA, 201 bp, Homo sapiens
ggtagactggagatggagatttatcccaggcttgctcaccaccccaaatcccacgtctatacaccagagaaaggattacccatcaccaaaggtgtctctcrttccctaaattatgcatagatcaggtggtctgattgtgtctgtccagatagggcacccttttctaatttatgtgaagtgccatgtgggatagctatactt

SEQ ID NO: 46305 - DNA, 201 bp, Homo sapiens
tattgtgaactacgtattcttatattttcctcattatccttaaaaatatggaacactttgcatatttgcctgccagttttgcacatagacaatgctattcyactctgaataattacaacttggttatatatgttgcttaggtgaggcttctctgatttctgtaactgtgaccaatttctttaagacaacaaaggagaaaat

SEQ ID NO: 46306 - DNA, 201 bp, Homo sapiens
gtctccttgttatagtttcatgtggtagaaagggcaagggggttatctggcatcccttttataagagcactaatttcattcttgcccttatgacctaatckcctctcaaaggctctgtattaatctcttctcacgctgctataaagaactacctgagactgggtaacttatgaagaaaagacgtataaattgaccacagtt

SEQ ID NO: 46307 - DNA, 201 bp, Homo sapiens
actgagctgaggaatagttggtgtgtgtgggggggtgggggcatggaatccatagtccagtttagaaattttcgatttgaaaacgctgtgaagtgtaaatrtcaatgtgtatttataatattcaggtcttaaattcagcatgtctgtctggtctagagatatgtttttggaaggcgtcataaactatggaactgaataaaa

SEQ ID NO: 46308 - DNA, 201 bp, Homo sapiens
atacctctgttgctgatacatctctttatttgcaggaaaatgttgaaggaggagactgtagtcgttgcaaatccggcttcttcaatttgcaagaggataaytggaaaggctgcgatgagtgtttctgttcaggggtttcaaacagatgtcagagttcctactggacctatggcaaagtaagcaagcaccatttggttctgt

SEQ ID NO: 46309 - DNA, 201 bp, Homo sapiens
aaagcgtaaattcagccttctgctgtattttgaccccttgcaggtgactctgaaggctgagcagaccattctacccctggtagatgaggctctgcagcacrcgaccaccaagggcattgtttttcaacatccagagattgttgcccacatggacctgatgagagaagatctccatttggaacctttttattggaaacttcc

SEQ ID NO: 46310 - DNA, 201 bp, Homo sapiens
gtctaaagattttattaatctgtataataaattatatcttatgaaactcttgtcatttatccagtatatttgaattacccgtgcattactgtttcatataytcatggtactttcatattttataacatttaaaaatatttcaatattccattgatttgaataagattctttaaattacagtgaaagctttctgataaggta

SEQ ID NO: 46311 - DNA, 201 bp, Homo sapiens
gaagaggaagaagatacagaacgtgttctccagcttatgattatcttagaggtagagtactgagagcatgttcacccgtgttacttcctgatgttacttamggttaccagtactgtattttttacctgcctggtttgacactgacttacaggactactaaaaaaaaatataccttaggagatttttgtgccactcttttgt

SEQ ID NO: 46312 - DNA, 201 bp, Homo sapiens
tactgatcctactcttaaacgataaagcaagattaaagcattctctaaattaccatgataaaaaatggtattatgaagtcctagaattgtgatccaatttyccaaatgtatagctctttatagcacatatcattaatactaatctcttttctgtttttctctttttttccaacactacttttcccttttccttatttttgt

SEQ ID NO: 46313 - DNA, 201 bp, Homo sapiens
tttcccttttccttatttttgtcatccattttaaatttattttacttttatgtgttgtatatagctttattagcaaccttacattttttctggaaccattsaagtttacacaagtagcaagtagtaatttacaccgtagccattagtgcatagtctgttgtctacaaacttgaagtctagcccccttgtctttgaaataac

SEQ ID NO: 46314 - DNA, 201 bp, Homo sapiens
tcccgggttcaagtgattctcatgcctcagcctcctgagtagctgggactacaggctcacgccaccacacctggatattttttttatttttagtagagacrgggtttcaccatgttgtctaggctggtctcgaactcctaacctcaggtaatccacccaccttggcctcccaaagtgctgggattacaggcatgagccacc

SEQ ID NO: 46315 - DNA, 201 bp, Homo sapiens
tgcaaagacttgtgtttgacatgcctgcaaagtcctttgttagctgatatcctcagtaactcttctttgatgctaaagcatcctagcattcccctattttygtttaactattttgcactgtttcttcagttgacactgacccatatgtgagaaagaccccggccatagctctactctcttaaaatatccataagcaagagt

SEQ ID NO: 46316 - DNA, 201 bp, Homo sapiens
aggcacaaaatgagataaaagtaatgacaaggtaaaactggatgaaaattggtcaacaagtgaggaattaactgccttgcaaaagcagtttttattatacrgaaaccattttgaaagcagttattcagaaagtttctatcagtatatgatttgtagctcaaattattgttggtctatcaatcacaaatactattttctgca

SEQ ID NO: 46317 - DNA, 201 bp, Homo sapiens
gttctttacagggagtcaggcgaccttggtctcaatgacaactgtgccactatctagacatacaaattgggcaagtcaattaatctgtaagcatcagttcytcaaatctacaataagtgcattatactatagcatacatatagggtatcttcaaatattcatatcatattattttgcagctttcccaaactaattcacaaa

SEQ ID NO: 46318 - DNA, 201 bp, Homo sapiens
ttctttacagggagtcaggcgaccttggtctcaatgacaactgtgccactatctagacatacaaattgggcaagtcaattaatctgtaagcatcagttctycaaatctacaataagtgcattatactatagcatacatatagggtatcttcaaatattcatatcatattattttgcagctttcccaaactaattcacaaat

SEQ ID NO: 46319 - DNA, 201 bp, Homo sapiens
tctttttaagagttctgatggaactagaactaaaacagattcctccattattttttcttcttttttttccaatttctttcttaatcttaacatagtaaatwatcacttttcctaagagtaaactcagcacatataacagcagcaccctgtatttgatattaatatttaaacaacaacaactttctccccagagacaaattt

SEQ ID NO: 46320 - DNA, 201 bp, Homo sapiens
attccatgatggaatggcagatcatgctagatttgctggttattatcagttttattttacgttacctaagtagagtttaagcctttcagttaaaatatgaytcccaagcaaaaggaagaggattaatggattaactattgtttgtgttatcaataatattggcaataactatttgtctatggtgctgtgtcagttacaagg

SEQ ID NO: 46321 - DNA, 201 bp, Homo sapiens
caaaaagaacaaagctggaagcatcacactatctgactttaaaatatactacaaagctgtagtaatcaaaacagtatgctgctaacttaaaaacagatacrtagaccaacagaatagaataggagcccagaaataaatctaagcatttatggtcaattgatttttgacaaagatgccaagaacacacaatgggattgaact

SEQ ID NO: 46322 - DNA, 201 bp, Homo sapiens
ggttatagcacactatgcttatgcctatgaatagccactgcactccagcctgggcagtgtagcaagaccctatctctgaaaaaagaatcaaaggccttaaraaatattttatttttacctcagaaaatttaaaaattaacttagagctaaatagtttgggtttcattatgtgtagaaatgaatcttgcaacagtaacagtt

SEQ ID NO: 46323 - DNA, 201 bp, Homo sapiens
gtcagtaaaatggtctgtgttgattagtttgtctttggggtgtacttgattcatcagatgatggagatcctgctggcgtttcatgcaacctgctatggtaygtgggctttattggcttcccagcagcgacactgacacaaattgtcagattttatgggcagttttaaacctaatgaaatacatccttgagaagcttccttc

SEQ ID NO: 46324 - DNA, 201 bp, Homo sapiens
ctgcaatgtggaaaatgaattggaaaagtcagaagaggaaaattcattaaaaggatgtgaagtaattaaagggatttaggataatggcctgaactaagaargtggcagtgggaatgaataatatgaatggactgacaggattttttttgtattttgactcagcaggtgttggtagcattagatatagagagtggggaggaa

SEQ ID NO: 46325 - DNA, 201 bp, Homo sapiens
cagcactttgggaggccaaggcaggtggatcatgaggtcaggagttcgagaccagcctggccaatatggtgaaaccccgtctctactaaaaatgcaaaaayattagccagacatggtggtaggcgcctgtaatcacagctactctggaggctgaggcaggagaaatgcttaaaccagggggacagaggtttcagtgagccg

SEQ ID NO: 46326 - DNA, 201 bp, Homo sapiens
agtacctttcaattgaacctgtttcctggcgttactttaattttgtgtgaaaaactatcttcttgattttaagtaaaagcaatgaaaaaaggccctctaayattttctgctcacaaaaaaattagctttacagatagtagacttcatcagtagatacagtctttaaggaagaaaaacatagtttgtataaaatattactat

SEQ ID NO: 46327 - DNA, 201 bp, Homo sapiens
aaatactgtatgtcccacttataaatgggagttaaatgatgagaacacatagacatgtagaagggaacaatgttcactggggcctaccagagggcggaggrtgggaaggatgagaggatggagaggattaggaagaataacttatgggcactgggcttaatacctgggtgatgaaataatctgtgcaacaaaccccattat

SEQ ID NO: 46328 - DNA, 201 bp, Homo sapiens
taggtgatcatgtaggatatactgactttcaagtgccctttctccaaaattgtattgataactaagtgctgatattccattttgagtatatgggttctgayacaatacacaaagaggagaatatttgaatgttgctcatcaagggcattcttactgttcagctgaccctgcattttagcttcttgtttatttttcatggtt

SEQ ID NO: 46329 - DNA, 201 bp, Homo sapiens
aggtaagacccttaacttcacagggcctgttgggaagaggttataattttttagcaacagaacctgtttttcaaacaaaatcctaattagaacacccaaaracaaacaaaataaaggattcaaatgggtgacatggccagtcctggttacagtatgagacagatgccggttacggtgggcaacagaacagatgctggctac

SEQ ID NO: 46330 - DNA, 201 bp, Homo sapiens
gaaaggaggaaggaaagaagagagggagaaagaatggaagaaagaaagaaagaagaaagaaagaaggaaggaagagagggagaaagaaagagaaagagaargaaagaaagaaaaaggaaggaaggaaggaaaagggagggagggagggaaggaaggagggagggaggaaggaaggaagaggaagcagggagggcaaggaaa

SEQ ID NO: 46331 - DNA, 201 bp, Homo sapiens
tatgtttataacaaaattagaaccccagcctaggttttatctcttacaggatttttttttaattgacacataggatcctacaagtgcttcaactggaaacmtatgggatttaatgattctgcttcaagagagaaggagaacaaggggccgagatagtccaggaggaaagttcctaatacatgacctcaattataagataga

SEQ ID NO: 46332 - DNA, 201 bp, Homo sapiens
gaagatgagggagtacttccaaacttattttatgaggccagccattagcctgataccaaagccaaaggcactgcaagaaaagtacattacagatcaatatytttgatgaacatagatgcaaaactcctcaagaaaatactaacaaaccaaattcagcagcacattaaaaggatcattcactgtgatcaagtgggatcacta

SEQ ID NO: 46333 - DNA, 201 bp, Homo sapiens
tttactttcatttgtcagtataccatcatttctgttaaattatactttcagatccagtgatttaagaatgctaatgagaataaagctattttatttacttyttatttatttatcttatttactgttcaaactaaattacaataaactcttccgttaatgaaatgaaaatagcaaagtgtgtactattttttttaccaatgg

SEQ ID NO: 46334 - DNA, 201 bp, Homo sapiens
aaatgagaaaaacttagtatgaagaaaagagtcttaggcttgaaattaagacacaggtttaattcttgaccattgctgatcacttgtttcaccttagacargtcagccaacttttttcatctgctccacagatctgtggtaaggattaaatgagatgacatccatgaaacatatgacagaataccttgccatagtggctac

SEQ ID NO: 46335 - DNA, 201 bp, Homo sapiens
ccagttaaccaggtgaccctctagttgctttattaagcacaggcttgactgtcaaacaggtcacaaggaggacaaaaagtgtccttgcatcgtatgaaaasagttgcttgaaatcacagaataccctctattaattgctaaaatccaatttccacctgaagacatgcctccatgactcgtgagaaaaatcaattatttagg

SEQ ID NO: 46336 - DNA, 201 bp, Homo sapiens
caggatgaggtggatgaaatgccaggtactttcatctgtatgacttgagagtgtatgcatcaaattttgcaccctcgagcacctctctcacctccacattraaaaaaatacatgccagattaaaaaaaatgaaattggaaaggatggtttgtagaactgttagagcatccataaaactcattacaaagtaaaatatattag

SEQ ID NO: 46337 - DNA, 201 bp, Homo sapiens
gactccattctcaccctagggaaacacggattttactgctcaggggatgatgaaaattggattccgacttttacacctcagattatttctattaattacayctcagattatttctattacacctcagattattatctcagattattatctattacacctcagattatttctattattcagtcttagccgaagattcccagc

SEQ ID NO: 46338 - DNA, 201 bp, Homo sapiens
tgctaagggggtgactaaaatctatattgaccaatacttgatgagtatatttgacagatgtttaaaagttaaccctgctcaaaaatgtaacgggatctttrctaatcaggatcataggtttgcatgggttcctaggaggaaaagaatgagtgggaccagtttatacaccaagcatcaaaggactccattctcaccctaggg

SEQ ID NO: 46339 - DNA, 201 bp, Homo sapiens
aaaaataattaataacctagcatttcaacaaaatatgcatacaatttaaatactgaaaagacacttagtgtagtgtatttaaatactgaaaagacacttartgtagtgtatttaaatactgaaaagacacttaatgtaacagttcatactgtttcacaaaaacatgatttgacatagatatgtcaactgattgtaaaaaca

SEQ ID NO: 46340 - DNA, 201 bp, Homo sapiens
cccccttgatccagtctcctccctccctccatacgtggagattacaatttcaaatgagatttgggtggggacacagagccaaaccatatcactgtctttcwgaagaaaaaaaaggaattcttgtatgttgccctaaagatataaaactgcttacaatgcctagtgatttgtattgattactatgtgttccctaaagtttga

SEQ ID NO: 46341 - DNA, 201 bp, Homo sapiens
gatatttttaaatgatatctcaccatctgtgtacatcacaatgttgagctacaaatgtggtggctctaacaaaattttaagtatgaagtcagatgtatagwggatcccttctccatcacgttcttctgtttttcatttcccgcttctcacaaactactccccagatgtcaataattctacaatctcctcttcctacaacct

SEQ ID NO: 46342 - DNA, 201 bp, Homo sapiens
tacaattagaaagtgggtaagtctcattcttaaacatatacttttgcattatagtcacatgaaaccactgagcgtgttcatgtgtgtgtgtgtgtgtgtgwgagagagagagagagagagagaaagcccaagagtgagagtttgtcttgaggagaagtgtttaaaaggaatatataaatcaaggatgcactatagtatcac

SEQ ID NO: 46343 - DNA, 201 bp, Homo sapiens
ttttcttcttttttttccaatttctttcttaatcttaacatagtaaataatcacttttcctaagagtaaactcagcacatataacagcagcaccctgtatktgatattaatatttaaacaacaacaactttctccccagagacaaatttacctttgctgttttcaaagtatctgactccaacaggtcagaaaacagcagca

SEQ ID NO: 46344 - DNA, 201 bp, Homo sapiens
ggaaatgtttctaatcaccctatcccccagctctggctgagttaggccttctctgcacaattcccatgaaagcacctaccacccagcaggcagaaatatcsctctttgactttctcactaaactgcaaattcctggtgagtgacaactggattctattcttcttctaacctctagaacctagcagattgctttggagacct

SEQ ID NO: 46345 - DNA, 201 bp, Homo sapiens
tatttaaacaacaacaactttctccccagagacaaatttacctttgctgttttcaaagtatctgactccaacaggtcagaaaacagcagcagacctatacrtcttctaacacataatttcaccgtcaacagtaactcagcaccctctggcatatagtatgtatgtagaaatgtttgttgaatgacagtaacaattgaatac

SEQ ID NO: 46346 - DNA, 201 bp, Homo sapiens
ataaaacactttaagactataacagccatatggtataaaggaaagaatatgaactttggagccaaactgaatagaaattcaataagctttattgcttattktatgtgtgacctttggcaagtgattaagccttgaggaacgtttcttttcagtgtaaagtggatatagtaatgcctacttttcagggtctttgttaacatg

SEQ ID NO: 46347 - DNA, 201 bp, Homo sapiens
aaccaatttggagtctactgacatgctagcagtattccagaaatactgctgtgaggcaggatgctgggccactgtcctgtcacaggctccagcatgattcrccctgctcggtgacacaccagccgtgtgacttacccgaaggtgcacctgtctattttatggcaaccgtttgataaatgaaaattacctgtgtggaaagca

SEQ ID NO: 46348 - DNA, 201 bp, Homo sapiens
tccaaaaaaaaaaaaaaatatatatatatatacaatgcccagaaagtatccacaaatccctgttaaattaatgcagtattgttgaaaaacaaagatggccrgagaaactgaatgagaatggaatcctgaggagaaaacaccaatatttaagagacctggttctctcagtgttgtggaacaggatccactgatatggaacag

SEQ ID NO: 46349 - DNA, 201 bp, Homo sapiens
aaattttttaaaaagagtatgctcccgttatgcattctcagggtgatttctcccctaactttgccgttataaactctgagggtctcttgtctttcctcagrtgaatgtggaaggcatccactgtgacagatgccggcctggcaaattcggactcgatgccaagaatccacttggctgcagcagctgctattgcttcggcac

SEQ ID NO: 46350 - DNA, 201 bp, Homo sapiens
gcatcctagcctgtcctgactgatatgatcccttaactgatttttctactcaaagtctcttctccctccgattattctacatcactatcatattaatcttyctgaaatagaactctaattatataaattccttatgaaaatctttgaatatttccctgttatcttcactggctttcaagaccatcacagtgtgcatctcaa

SEQ ID NO: 46351 - DNA, 201 bp, Homo sapiens
tcatgaacagtggcattcaatgcactttgaaaaaaacacagtctttttctttgaaggtaagttgtaagaaagagaaatcattaaagcctggagtgcagaaytgttgtcgactgaaatggtatcaagtgagttgaatgcctcatattttaaaaatgggcatgatctctattattactaacaaaaaaatctgcattttatgtg

SEQ ID NO: 46352 - DNA, 201 bp, Homo sapiens
ataccattgtatgtgtgtcatatgatggatctggtttctttttcttatttgttgggagatgtccagagactcaaggatctatcctttgaccaaatttttcrctcttcaagggcctcatactgctctgatttcagatgtatagatatattgcttatcaaacactgatgggtctgaacatgagtggtagtaagatatttccag

SEQ ID NO: 46353 - DNA, 201 bp, Homo sapiens
accaggaagaaatacacattaagtatcaaaatcggcacttgcgtttgtaagtgatgttgcccctgccgcaggtgggggaaggccagtctgtctttgcagcyactgaagagctcaagcgttgctaatgcagtatttctaactttgctgtcctaattggcttccttttctttcaggcatgcttgccgggattttatcgactgc

SEQ ID NO: 46354 - DNA, 201 bp, Homo sapiens
ttattttatgtatactttactgatagagtcctttaaatgttgagttcaagctaatttttcttaatcttcaaaaagtttagggatcaaattgtatcctgcasatttttgttatgctaaatttcatttcatctcttcttctttagttctacagagaagttaggtcaagattgtttgaaagtagacttgagtccagaaacttgt

SEQ ID NO: 46355 - DNA, 201 bp, Homo sapiens
tgactctgtagatcattttgggtaatgtggacattttaacaatattagttcttccaattcatgaacacagaaagtctttccatttatttgtgttgtcttcyatttctttcttcaatgtcttatagttttcagtgtacagatctttcacctccttggttaaatttattcgtatatatttcattatttttgacgctattgctt

SEQ ID NO: 46356 - DNA, 201 bp, Homo sapiens
ggcaaagacaacactctggatagggaattttatcaccattatctcaaatggcattagtaaaaaagaaaaaaaagtaaccattgtatataatcacacacaarttggttacatatgaagtttggctataaaattcactttttaataaaaacatactggatcatatgcttctaaacaatttataccatgtttatgaattaatga

SEQ ID NO: 46357 - DNA, 201 bp, Homo sapiens
gagtccagcaaaggaacaagaacactgtgtgcttgctaaatctacagaaaacttcatcttctggttgtgtgggaggagaggtccctttgtgtactctgttwctttgaaggaactagggatctgttggtgctgtacagatgtcgaggtgcacagagccaacatcctacaaaactagtaaatagatgattaggatccaactct

SEQ ID NO: 46358 - DNA, 201 bp, Homo sapiens
taagaaatctttatatctatatatctctatctgtatctatctttctgacatgccttcttctcttctcctcgcttacctctctctctctgtatatatataawatatatataaaatatatatagcaggtagatatatacttatatgtaatctacataaaggtaaaaatatatattatttatatttatttatattatttttaat

SEQ ID NO: 46359 - DNA, 201 bp, Homo sapiens
acccattcttttttgttgtcgcatcagttggttaacttgactgggctcaaagtcccaacttttttctttcctgtagagtgcagaacctaaaatctctgttyagtttttcagccctagctgggctacttggaatctgactagggcaggtgtaggtctggcatcagtgagcaatttggacagagtttatgcacagattgaggc

SEQ ID NO: 46360 - DNA, 201 bp, Homo sapiens
gggaaaaagcagacatgtgtgggatgttttaggcagctggaatcaatagtacttattaatggcccagaggtctgggtagtaaaggaaagaggagaaacttyagataaggcagttagagaaggaaaatcaaggatagattctagatttttgtcttgagcaactgcatggatggtgatgtcattgaatgtgatggaatagatc

SEQ ID NO: 46361 - DNA, 201 bp, Homo sapiens
ctccagcctgggcaatggagcaagaccctgtcttgaaaaaagaaaacaaaaacaaaccatttcaaattcaaacatatttttctgaattaaaaaagaaaaawtactctctttaagtatatgaaaaagcaaatatctttcctagagtatattacattttaacagctcttgaaaattcagttaagtggtctagtgcttgtggta

SEQ ID NO: 46362 - DNA, 201 bp, Homo sapiens
taatatcattagaaaggtgaagaagacaagaccagcgagggctactaatttctcaaggacacgctcatcctcatgtgagagctggaactcaaaaccagacyttgactttgtcaaaatgcacttttggttcccaatctgatattaggtgcagattcttctcttctttaaccaagggccaaataatacagccacccaccccac

SEQ ID NO: 46363 - DNA, 201 bp, Homo sapiens
gcctgaagaaagtactgccacttattcttatgcaatacaagccaaagcataagagcaccattattgcttgtctttgttgtacacagctcctcctttagtckacatagccaccatagaaaaatgcagtttcaaaacactgaaattcttatgtaacataccaggtccaccctacttaaaatgggaagtaactgagaactgatt

SEQ ID NO: 46364 - DNA, 201 bp, Homo sapiens
cctagtttatgtgcttccttttagcatgtaccattgtttctctagggccttataagtatttgttatacagacattacatatatatatatattatatatacrtgtgtgtatatatatgcatatatatgcacacatgtatatgagagtatgtgtgtgcacatgttgaacaaattcatgagacaaaatacaactttaggttgct

SEQ ID NO: 46365 - DNA, 201 bp, Homo sapiens
tttattttacttttatgtgttgtatatagctttattagcaaccttacattttttctggaaccattgaagtttacacaagtagcaagtagtaatttacaccrtagccattagtgcatagtctgttgtctacaaacttgaagtctagcccccttgtctttgaaataacatagactgggacctgtggcaatcaactctgcaaag

SEQ ID NO: 46366 - DNA, 201 bp, Homo sapiens
aatcttctttctttgttctttattcattgcaataataaaaacaaacaaacaaaaaacaacaccaaatcaaatgactgttgatgggggaattataagaataratgggagtgaagacccaagctgactttacctccaactcaaagatttttgtccactaatctaatttctctttctctctgtgtttgttaaaagtttcaaagt

SEQ ID NO: 46367 - DNA, 201 bp, Homo sapiens
tttattcttgtgatagtttgctgagaatgatgatttccaatttcatccatgtccctacaaaggacatgaactcatcattttttatggctgcatagtattcyatggtgtatatgtgccacattttcttaatccagtctatcgttgttggacatttgggttggttccaagtctttgctattgtgaatagtgccgcaataaaca

SEQ ID NO: 46368 - DNA, 201 bp, Homo sapiens
aattattatgcaaatgtaattggcacaaaaacagtattctatcagtctcagaaaaagaaagaaaacatgaacaaatgaaatctatagcaaaccttaggaartcattttggccaagaatttcaagactactgccacaccagaatatgaaccaaaagctgaaaacaactaaatgaacttgctcatgagaattcaaatgagcag

SEQ ID NO: 46369 - DNA, 201 bp, Homo sapiens
aaattaagacacaggtttaattcttgaccattgctgatcacttgtttcaccttagacaagtcagccaacttttttcatctgctccacagatctgtggtaasgattaaatgagatgacatccatgaaacatatgacagaataccttgccatagtggctactcagcatgtaagttttttgtttgtttctttgagacagagtct

SEQ ID NO: 46370 - DNA, 201 bp, Homo sapiens
tctacatgatcatttgacaaataactatatagtccaccagactatagactccaaatgggcaagaaacctttttgtttcttaccacagtatcaccaatattrtacacataataggtgttaagtcaatatttgtttaattaattgtgaatgattttaaaagcatttgaacaacaagatggaaatgtagacaaacccaaaataa

SEQ ID NO: 46371 - DNA, 201 bp, Homo sapiens
tgctttattcttgccccacaaggaaatgtatttacaggggttatacatggtatttagttcagttgctggactggaagtgtttatattctttttaaaagaakagcagtttttattccagaaaaaaatattaaattataggattgtttttgatatctagactcttttgctaaagcacagttaattatcttataattatgctgt

SEQ ID NO: 46372 - DNA, 201 bp, Homo sapiens
atagcaatattatttatgatagctcgaaggtagaaacaatccaaatattcatcaactgatgaatgaataaacaaaatgtggcatgtacatgcagtgaacaytagtcattaaaaggaatgaaatactgatacatgctgcaatgaagttatctagaataggtaacttcatagcaacaaaagcagattgttagtttacaggggt

SEQ ID NO: 46373 - DNA, 201 bp, Homo sapiens
gaggtataattgacaattaaaaattgtgtatattctagatatgcatgacgatttaatatacatatacattgtgaaatgattaccacaaccaaattaattartatgtgtatcacctcacatagttatcactttgtgtgtgcgtgtttgtttatgcatggaggacatttaagatctgtgtttggaaaattccaaataaacagt

SEQ ID NO: 46374 - DNA, 201 bp, Homo sapiens
aaagaacatatctagtcctggagttaagatttctattttttctagatttatagaggtataattgacaattaaaaattgtgtatattctagatatgcatgaygatttaatatacatatacattgtgaaatgattaccacaaccaaattaattaatatgtgtatcacctcacatagttatcactttgtgtgtgcgtgtttgtt

SEQ ID NO: 46375 - DNA, 201 bp, Homo sapiens
agacttacatatattacagagaagcgtaacagagcaaatgattaagttctaagtttcactgtacaccctaaaaaaaaggagaaattgatatggaacatgartagtataggaaaatggtccttaggaaggccagacatgagagggtgagctctaggtgaccacctgtaggatcaggaaagaacatatctagtcctggagtta

SEQ ID NO: 46376 - DNA, 201 bp, Homo sapiens
gccagatatgggatataattccagcctgaagagtttatgctcaagacaagacttacatatattacagagaagcgtaacagagcaaatgattaagttctaartttcactgtacaccctaaaaaaaaggagaaattgatatggaacatgaatagtataggaaaatggtccttaggaaggccagacatgagagggtgagctcta

SEQ ID NO: 46377 - DNA, 201 bp, Homo sapiens
agttgttatttaagaactaagacttaaaagttaactcctgaagtgagaactgcctatttatgagctccatatttgtgctagcacagttgacagaaaagatmtattctcagtgcccttctttttcttctttacacccatcacacccaatcctgccagcaacttacagcatgaggacaacattcactatactacagggcaatg

SEQ ID NO: 46378 - DNA, 201 bp, Homo sapiens
tagataaactaactgaatcaatatgaataaggcatagattatttatggttgcttaaaccaaataaataatttggttgctgccaaaatggctgaaaatcacrtggggtgtttgttaagccaacaggtttcatgggctcccacctagagagtctgtgtaggctgctctggggtttggccccatgtgtacattctaacactctc

SEQ ID NO: 46379 - DNA, 201 bp, Homo sapiens
atccaaccaagaaaattatgtgcagattttaagaggcacagtagaactgcttgagctaaagcaggaaagtaacagctacattgttcagaagtaaattaacrtgtgcctaatggtaatgcatgctgcctagacataaatactctaaaaaacaaaacaagaaaaaatagaaaaagaaatgggaaaaaaaaaacctagttgagt

SEQ ID NO: 46380 - DNA, 201 bp, Homo sapiens
aattaatatcttccagatatatattttctgtaagatcagtatcctggatattcaaacttgtcaccaccacttttggtatattttagatattatctttaatrtaacagagagttactaatgttaactactaacattatacacacatgatagttttagcataattgatagcagtataaaagttttagaaagatccatagactt

SEQ ID NO: 46381 - DNA, 201 bp, Homo sapiens
tcacaatcaatgaggtagaaaacagaaatactttagaggaacccaaaagctcactatttgaaaagatcagtaaagttggtaatattctagaaaggttaatyaagaaaaaagagagaagaaacaagcaatcaaaatcacaaataaaagggggacatcactatagatcctatagacattaagataataatatggtagtaatag

SEQ ID NO: 46382 - DNA, 201 bp, Homo sapiens
accatgcatggtaggggaccattggaagcccagccttttgtttccttcaactacttccagccatgttctggctaatcccttagttctccacagcttctccrtagagaacagacatttgttcttaatagtgactttaaatgtaatgccacccagggatgtttgctctcgagctcctttaaattttaattaaatttctcttct

SEQ ID NO: 46383 - DNA, 201 bp, Homo sapiens
agctcagctgtcataatatttggctccaatttcattcataatggacagaatatctacaatgttttgaatccctactttcaaatgtcagcacactggaacawatattaaagaatgggtttgaatctaagtagatgagtatttccttgaagcaacatgttatagcctaaatgttgtttccttcaattatgtttaaacaatgta

SEQ ID NO: 46384 - DNA, 201 bp, Homo sapiens
aatgatccaggattaagccctgaggaacgataatagttactgataaaaaaaaaaaaagaaaagaatgaagtaaatgaatgtgacttttctgtttcattttktctaagtcttttaagccagagaaaacataatgtgaaacagtgtttttatgtgtgttttatcactagagataagaaattgtcaagctgtccttaaggacca

SEQ ID NO: 46385 - DNA, 201 bp, Homo sapiens
ttgagtaaatttgttgaggagtctaatttagtttgaatcactgggaaaagacacaattgaggttttataaaatgtaaaaaatcaaatgaactctgtacttycacttttttacataaagtacatcttccacttctagttacaaaaaattttttttttctcacttgagtcgtttatctgtagtaagtaaatttgggaaaagtg

SEQ ID NO: 46386 - DNA, 201 bp, Homo sapiens
aaaactgctcagaagatttgaagttatcatataactagaaataatatttcttcaactgctcttaaactttccatgttttcctgctttctaaacctatgatstatttcataatcacattaattgcatcgaggagggtgagtgagatggagaacttatttaaattttcatttctaatggtttctactcttcttttcctttact

SEQ ID NO: 46387 - DNA, 201 bp, Homo sapiens
ctaatgaaaataaacctgaaaagcgaatcattggacaaatgtgagatttttcctttaatttatacattaattgatgtaagatagtatttagaaagtttcartcctttccagttacaattgtaattgtcacttacctcaaactaaacaaacggactctttcccatatttttctacttggtgaaggacattctaatcatctag

SEQ ID NO: 46388 - DNA, 201 bp, Homo sapiens
tattccaggaggaaggaaattgccttaggatatgaatcagatttgataacatgaactatcttatttaattattctaaattgaaaacatcatgaaagataaytgggatttttccatttttattttactcttgtttcttgcttatttgaatcattcgttttattcttctttctacttaggctaagctctcaaaaggaaaggag

SEQ ID NO: 46389 - DNA, 201 bp, Homo sapiens
attttcctgatatggaatctgggagcagcagggaacataagtaatgtcacggtgtcaggattgggaggtgtgcattttggatcctgattaaatgtatcaaygtaggtaatatattgtgattgtttcaaatagtggagatcaggaatccttcctggtacaaattcagttccccacagtaacctcaaaattgacttcaaacct

SEQ ID NO: 46390 - DNA, 201 bp, Homo sapiens
attcgtctgttatggaaacgctctatattttttacattatagccaaagtcttagttaccttttgagggtatctgtaggtgccattaaattcagctatcctsttctgctgtgggtataagcacatggcaaacccaggcaaaaattagaaaaataaaaaggattgtagagaaatggagatataaaaaattaataagagaagag

SEQ ID NO: 46391 - DNA, 201 bp, Homo sapiens
ctgaccaaaaggagctgtgggcctggcctatacaccttattgcctgttttcagcatcaactgatttagtgaagcagcaaaaagaaaaatggtgtgtgcagyattatctttctgccacagatacatgtttttaatttccaagtttccaatgcatcattcagttttatctaacgggaatgcagctgagagaagtttgtaacaa

SEQ ID NO: 46392 - DNA, 201 bp, Homo sapiens
agatcaatttgttcacatattttgcaaaagttagagcttattactcattcatgtactattgatgtaacgcattagaagacagttaacattaggtcctaatkgcacctgaccaaaaggagctgtgggcctggcctatacaccttattgcctgttttcagcatcaactgatttagtgaagcagcaaaaagaaaaatggtgtgt

SEQ ID NO: 46393 - DNA, 201 bp, Homo sapiens
tttgttacattgtatccatttatctcatagaaagataaacttttgtgttgaattagctgtggaagaccagctcacacattaatcactactaagcaaatgcrttacaaaaaagagaggacaacaaaaatgagctggaatacagtttcagttcaaccaccaaacgatttgatatcatgaataaatttcttgggtatatgtagc

SEQ ID NO: 46394 - DNA, 201 bp, Homo sapiens
gctcagggagtccataggtctcagctccccaaaaggccacagcccttctctcctgctcattgctgtcaacatggtgagctggggaagggggtgtgtttcarccctgtttgtgttgtagctctctcatttccaccatttgcgggggggtcccaagttcttgtcccacatcctggaagaatgaggtttgcagacaactggagg

SEQ ID NO: 46395 - DNA, 201 bp, Homo sapiens
aatttatctgcattattattaaataatatattaatatattacttaaaatataaattaaaacataaattccttctaatttctccagtctacttttttgaaaytcccatgagtcaaatttttaccttgttgtattggtgattgatattatcatttctctcatattttcagtatttttttgtttctcttttgtgggtgatgcct

SEQ ID NO: 46396 - DNA, 201 bp, Homo sapiens
tttccaccatttgcgggggggtcccaagttcttgtcccacatcctggaagaatgaggtttgcagacaactggagggttagcaaggtgaagaggtgctttaytgagtgacagtgcaactctcaggaggcctgaaatgggtagctccgttccacaggcaggtaattccagcatctgtgcagcaccctcaacagaggtgagaca

SEQ ID NO: 46397 - DNA, 201 bp, Homo sapiens
aattttcactaatctagaaaattctctcctcaagagaaaagggatttaaaaactttcatgatgtatttaaattcaacatatcttttgcctactttaaatarggaaaaggtgactctaaggtcataacgtgaaattgactttacccttcctggtatagaatggcatttcacattgagaaaaactagggagaagcactgaaga

SEQ ID NO: 46398 - DNA, 201 bp, Homo sapiens
agaagagcagtgaacagcatcagttgctgctctcacaagggagacccaatgaatatggtggcaattgactattgtaattgagcaaataaatgggcttgccrcctgaagcacatagaagccaataacgttggcactggcttcggagaaaagaaaggctttactgcaaaattgttcagcaaggagacaagagtcaggttcaaa

SEQ ID NO: 46399 - DNA, 201 bp, Homo sapiens
gaagagaactttggaaaagtttaaattagagtagaaatgggtaagaggagctcaggaaagtatttatttgcttttctttaattccccattgtgttccagawaggattttagatgggactcaaaaagtaacttttttgcttccaattccaacataatcattctcacgaacttttgtctcagttcaccaagaggaaaaacatt

SEQ ID NO: 46400 - DNA, 201 bp, Homo sapiens
ctaataaatgctgacaaggagagaggttaaaaccaggaagccatgccttttagctgacaaaacattcattgaaatgctatctgggtgaagcactgagaaaytaatcatctgaatagtctaaattatagtacatgaagaatgcaacttgctagggagacataccttcagcattattcgaggttaatttaaaccaacatgtaa

SEQ ID NO: 46401 - DNA, 201 bp, Homo sapiens
tgtgaggtgtcagtgtgcccctgctggggggtgcctcccagttaggctgctcgggggtcaggggtcagggacccacttgaggaggcagtctgcccgttctyagatctccagctgcgtactgggagaaccactgctctcttcaaagctgtcagacagggacatttaagtctgcagaggttactgctgtctttttgtttgtct

SEQ ID NO: 46402 - DNA, 201 bp, Homo sapiens
ttttcatataggttggctttttctttgaatgttttcacttagctagtgtaccaaaacagttctacatttccaccaaattaaaggtctgattagtttaatgyccttcatttgccatatttttctcaagaaagattatacagtgcatgaactcattcttattcagtaaatttaaatttgagtggcattatattccaactagtg

SEQ ID NO: 46403 - DNA, 201 bp, Homo sapiens
tgaaatagagaataaagtaggtgtatgctgaatcttattaaggttgacatccagtttgaatacattcatcctctaaggtatagttttgggtataaaccatygagcaagcacaaaacagtgaagctgagagctgcagaacatagagatctggtggattctaaaggactgagaatgatcgatggctactgaaatgaagtgtga

SEQ ID NO: 46404 - DNA, 201 bp, Homo sapiens
atgtcatcacaaagcattttcaaaatgcctgctatatttgtaaataggaagagatcagttcactagatgtataagaaggcatgaaggaggatagcaacagwtgagttcagacaggtagaaagcaggcctgattataaatgtttagatcaccaaggagtttgtctacgacactacaggtgacaggcaactcacaaaagtctt

SEQ ID NO: 46405 - DNA, 201 bp, Homo sapiens
caccaagggcattgtttttcaacatccagagattgttgcccacatggacctgatgagagaagatctccatttggaacctttttattggaaacttccagaayaatttgaaggaaagaaggtaagcacaagaactttaatgtcaagtgagaacaagataaaatctttttagaatcacaccatttggagatttatccaattcct

SEQ ID NO: 46406 - DNA, 201 bp, Homo sapiens
tgaaaagaagttattgggtgaacatgatggctcatgcctgtaatctcaacagtttgggaggttgaggtgggaggatcacttgaggccaggagtttgagatmaacttgggcaacagagcaagatccatctttacaataattaaaaaaaaaatagaaattagctgtatgtgatggcttgcacctgtagttctagctactcagg

SEQ ID NO: 46407 - DNA, 201 bp, Homo sapiens
aactggtatagcaaaaagtaatcagcattcgtggattaaatagttgagcttttcccctgttgttgactcatcctgtagtagctctaaggatacggacagamtatgatgaaaagatgaatatgtacatatgccaaaatatcagaaagaatggataatgataactttagtttctgctgataataactctcatggataaaccaa

SEQ ID NO: 46408 - DNA, 201 bp, Homo sapiens
cagaactttcaggatcttcattgttcatagctacaggctccaatttggaattggccatagacacccactctgagaagtttgggaataagaaaagagaaaayacattaagaactaaaactgtaaggacccatactggcttcttaaaggaagttttactgagaattttaatcttcaaagcctaactctcattcacattcaaaa

SEQ ID NO: 46409 - DNA, 201 bp, Homo sapiens
cattttgtctgctgcttctaatcaaaattatcttaaaccactccaatagaattagggaaatgaagggaaaatgtgggtaaagaaaaaagtaaatccaccayttgaatgatgaggtttaaagactggaacagaactttcaggatcttcattgttcatagctacaggctccaatttggaattggccatagacacccactctga

SEQ ID NO: 46410 - DNA, 201 bp, Homo sapiens
agtgtttggattttgtcattctaataagtgtgtatggtatctcattcttgttttagtttgcaattccttaatgacatatgatgtcgagcatcttttcataygcttatttgccatctgtatatcttctttggtaaggtgtctatttaggtctttttccattttttcattgggttgttttcttgtcgaattcagagttttttg

SEQ ID NO: 46411 - DNA, 201 bp, Homo sapiens
ctcttctaagctttcctctttgttgtctttattttcactagggttttctctgtaaggtgcctaaaatggctactagtagctacaggtttaggacctggtcyttagcagtttaaatcggaggaggaaaaatacctcctgttcttaaagtccctattaatctctgttggccttgcatgggtgatgggcccaaccatgtaggaa

SEQ ID NO: 46412 - DNA, 201 bp, Homo sapiens
ttcatatcactagcctggaaaaatatcaaaattcaaaatttgaagtatgatttatattgactatgtattgctttggcactatcacaaaatcgaaaaatacsaagttcaaccgtcataaattgatgactatctgtaccaccaaatagcccattactcaaatcctcaactttttctcttcaatgtatgtgacctctatttata

SEQ ID NO: 46413 - DNA, 201 bp, Homo sapiens
tattgaccctgatcacctgactaacatagtgtttgccagatttttccactgtaaagttactcttttatgcccttttcatactctaatactatttttatctrcccattcttcagattcagtaacataaaaggcgcagaaataggactactgaaagcaaagatcactttgatgggttgagaagggggaggaaatgtaaatact

SEQ ID NO: 46414 - DNA, 201 bp, Homo sapiens
cacctgactaacatagtgtttgccagatttttccactgtaaagttactcttttatgcccttttcatactctaatactatttttatctgcccattcttcagrttcagtaacataaaaggcgcagaaataggactactgaaagcaaagatcactttgatgggttgagaagggggaggaaatgtaaatactcattaattacttt

SEQ ID NO: 46415 - DNA, 201 bp, Homo sapiens
aaataggactactgaaagcaaagatcactttgatgggttgagaagggggaggaaatgtaaatactcattaattacttttttcctaccatatttataattasaaatatatcttccatgcagaccataaatactcaagtcaacatgaccaattctctctttccctgtggtcaagctgcatgacaatcaaaaggtgaattaata

SEQ ID NO: 46416 - DNA, 201 bp, Homo sapiens
tatgagccagatgttagccagctgataggttgatgggcatatacgttgctaaaaaaatgtgacccagagtacactctagtgatatctccaatgatgaggcrtaagctttgtatttgaccttgttgtgttcaaaatatctgtaaatgctttggatgatatctatcaaatattcagataatataaagctgaaagtattatcta

SEQ ID NO: 46417 - DNA, 201 bp, Homo sapiens
tgtgaccgctgtgcccacggctatttcaacttccaagaaggaggctgcacaggtctgtaaatatgacttaagtcctacatattcactctgatagttttagrgtctgacttctgtaacagtttgttcttttaaaggaagcacagattgatacaacgtatttaacataatgagtaatgtctacttatttttacgttacttaaa

SEQ ID NO: 46418 - DNA, 201 bp, Homo sapiens
gtaaaccttaactattagaataggtgtttttacatgtatttgatatccaataacttttattttagttctagaagtttatcagttgattcagttattgttawgtttaccattttttttttttttttttttttttgagagggagtcttgctctgtcacccaggctagagggcagtggtgctatcatggctcactgcaacctcc

SEQ ID NO: 46419 - DNA, 201 bp, Homo sapiens
ctaggaattatgacactggggatagaagtgtgagcaaaactgcacagtccttgccctcattggcttagtatagtctaatgatctgacgttagagacacaaraagtatttcttttttttttttttttttgagacagagtcttgctctgtcgccgaggctggagtgcagtggtgcgatcttggctcactgcaacctccgcctc

SEQ ID NO: 46420 - DNA, 201 bp, Homo sapiens
ttagttattgttgttaaatctcttactgtgcctattttataaattaaacttcatcaaagatgtgtgtgtatagaaaaatacattgtatatatgggcttcaygcattgaatgagggtcttaggatgtatccccctgaggataaggagggactactataattctactgttaattctttgaggaaccactatattgttttccat

SEQ ID NO: 46421 - DNA, 201 bp, Homo sapiens
accaccgcacctggccccagtaggtggtttaaaccctttctccttctctctctcccctctgttgtattgcccagtgtctgttgttcccacttttatgaccwtatatttttcttctttaaatcagtaattttttatgttgttaaaatcaatttttgcagagattagaatgtatttggcctaatttctcattcttaagtaaaa

SEQ ID NO: 46422 - DNA, 201 bp, Homo sapiens
aaaagtaacagttttaaatgcttcgaagataattgagtaagaaaagcataaaataggtttcccttgcttttgacaacatggccatccattgaacacctttstaaagtactcagcagattcatagtggcaagaggcacactgaagaggtaataaatgaatgatgaagaagaagaggggactatagaaatattctgtcaagta

SEQ ID NO: 46423 - DNA, 201 bp, Homo sapiens
tttcccttgcttttgacaacatggccatccattgaacacctttctaaagtactcagcagattcatagtggcaagaggcacactgaagaggtaataaatgartgatgaagaagaagaggggactatagaaatattctgtcaagtatccttgatgtgaaagagaatgaaggacagaggaggttgtggagttgcaaaggttttc

SEQ ID NO: 46424 - DNA, 201 bp, Homo sapiens
tcaagtatccttgatgtgaaagagaatgaaggacagaggaggttgtggagttgcaaaggttttcaaagataagagacatttgagttggtttagatgcttgkggggaaaggcagggaagttgaagaccaagtggtggtgggcatggtgtctctctagaagtaaaaacatatgggtcattaagcataggcaaaaaccttatat

SEQ ID NO: 46425 - DNA, 201 bp, Homo sapiens
atcagcagttgcctttttctgggaatggaggttgggggatttattgcaaaaggtcagaaagaaaactttttgagattatagaaatagactatgtattgggyactttgtcagatgagtatttacatctaaaaaatgtttcaaatgagcatatttattgtgtgtaaattgtaccttatttaggtttatttggaaaaaatatag

SEQ ID NO: 46426 - DNA, 201 bp, Homo sapiens
tcatctcccagtcctcctttttgtgactaattctcttatcagtttgacctgaggtggcagataccacaatttcctattagacaacttctctcacaattacytaagagccatgaatttgatttagaaatggggttgtatgtgtgtgtttttctatcacatattaaacgcacaatctgtaaaaaagattcaggaggatgtttg

SEQ ID NO: 46427 - DNA, 201 bp, Homo sapiens
atgctgaggatacctgcctgatcggacactaagttactttcagaataagtttgtaacctcagcaacatgtcatacattatggagaaggcatttcaaaaagrcaggcaagttcatctggtggattctataggacaacatgaaacttaatgggatacatagacttcttaagccctccccgctccccagctggcaaatttttaa

SEQ ID NO: 46428 - DNA, 201 bp, Homo sapiens
aaatctccctttagtcactttggtatctaatttcttggcactccagtgacctctgcctcctatatctgctttgtcctctgatccttctcctggcatccgcyttggtggccagcagttcttactggacaaaaacatcaaaccctaagagcctgaagtagttacttaagcaaataggacaagcaactgaactgattttttctt

SEQ ID NO: 46429 - DNA, 201 bp, Homo sapiens
cattttttgtttgagatgtgcctgttgaagtagaagagagggaagataagggtcagggtaaggaggagatactggttgcattaaaaatcttgtaatcaaarccattctgtaagtgatttgtgtgatcagcttatgcacatcatctaaataagaccagaatttaaaaactaaatcaacatttcccaaattgtagatgttcct

SEQ ID NO: 46430 - DNA, 201 bp, Homo sapiens
tcttgtggaaatataggttatgattcagtagggcagagctgagacgctgcacttcaaaaactttccaggtgatgctgatgttgccggtttgtgggccatcraataatttggttttatgcttgattaatgaatcacaagccatagttttaaaaatgcagtgctataggagaaaactgattctacatactgttttattttcct

SEQ ID NO: 46431 - DNA, 201 bp, Homo sapiens
aactataggctttgggtaattttgacgtgtcaatgtcatttcatcagtcattacaaatgtactactctactgggggatagtgataataggggaggttataygtttatgggggcagtgagcgtatgggaaatctctgtattttttttttttcttttttgagacaaagtcttgctgtgtcgctcagactggagtgcagtggca

SEQ ID NO: 46432 - DNA, 201 bp, Homo sapiens
aaactatttcaatggaccagacaagaaatggtaatggcctgaaatgagtggagggagtggaaatgaagtcacatggctgcagttgccatttattggagaarctgaatttcagggatttggatcaggtcaaggtatgttatgcacataaaccaaatattaatgatatttatttagtgtgcaccagtgatatttgttttttcc

SEQ ID NO: 46433 - DNA, 201 bp, Homo sapiens
aatatcctgtctcaaaaaagaaaaaaaaaattgacatctgggtgtcaccccagcccaattaaactataatctctgggtagggcccaggcattggcattttytaaaaatccccacttgattcaaatgtgaaaccaagactgaaaacccctgggctcctgtcacctccacattttatggggaggaactagaaggaactcaagg

SEQ ID NO: 46434 - DNA, 201 bp, Homo sapiens
cagcagctcacgcctgtaatcccaacactctgggaggccaaggcaggaggatcacttaagcccaggagtttgagaccagcctgagccacacagtgagaccytagctctaaaaaaaaaaaaaaaaaaaaaaaaaaaaaaaaaaaaaaaaaaattagcctggtgtgttggtggtgcatgcctgtgtggtcccgactatttggg

SEQ ID NO: 46435 - DNA, 201 bp, Homo sapiens
atgttgtcacccaggcaggagtgcaatggcaccatcttggctcactgcagcctcaacctccccagttcaagtgatcctcctgcctcactccccaagtagcygggactacaggtgggcaccaccacacccagctaatttttatatttttagtagagatgggtttcaccatgttgcccaggctggtctcgaactcctgagctc

SEQ ID NO: 46436 - DNA, 201 bp, Homo sapiens
catctttttcaagtaacatgctcttaagggcagttaccatcgatatgtcactatcatgtgcgtttctcaccaagctccttttacatgcaaaagcctgttaygcaaactccacccaatatagtaaacatttcattaataattacatcaatagagtttacaaacttttcacctatttacttgcatttttaatctttcttctta

SEQ ID NO: 46437 - DNA, 201 bp, Homo sapiens
aatggggtatccatcacctcaaacatgtatcctttatgtttcaaacaatctgattatactcttttagttatttttaaatgtacaattattttttttttttwactgtagttacccttgtgctagcaaatactaaatcttattcaaactatttttgtatcattaaccatccctactcctccctgccactaaccttcccaacct

SEQ ID NO: 46438 - DNA, 201 bp, Homo sapiens
gatatgctttttaggtctatcaaaaactaaagtctctgaagtgacactggtacaagcaattcacttgaatttctaaaaacagataaaatataatggaccakagtgtgattgagttacttctaaattccttgaacccccaatgtttcatgcaaactttcaagttttatgcatatttgcattttcttaggggagggtctgctg

SEQ ID NO: 46439 - DNA, 201 bp, Homo sapiens
atgccatggaacactgagtggggaacctggagccaaactgtcttggtttgaatacctatttaactattgactagctgtgtgttttggagcaagttaatctyttttaacaaagatttctcttttgcaaaacagggtaatgataatactaaacaaaaaggattgcataaagattaaatgaggtaatttatttaaagtgattgg

SEQ ID NO: 46440 - DNA, 201 bp, Homo sapiens
ctgcctcggcctcccaaagtgctgggattacaggcctgagccacctcgcccagctgacagaaggttttttagatagattagattatgagagacaatgccayggaacactgagtggggaacctggagccaaactgtcttggtttgaatacctatttaactattgactagctgtgtgttttggagcaagttaatctcttttaa

SEQ ID NO: 46441 - DNA, 201 bp, Homo sapiens
tgccaagaacacacaatgggattgaactgtctgtccagtgaagggtgtttggagcagtagatgtccacatgcagaagaatgagtatagacccttatctcaygccatataaaaaatccattcaaattctaaatgaattaaagactgaaactgtaaaactactgaaagaaaacacaggggaaaagttccatgacattggtctg

SEQ ID NO: 46442 - DNA, 201 bp, Homo sapiens
atgttccaaatgtagattataccttacctgagtataccttgtttaagtacaacagaatatagttaaaatcacagttctttacctgctttagttgtatataratttttaagatcatttgttcagtatcacaagtagaatctgtggttaattagaaaatatattttccctttaaaagaatttgtgctgacttttaaaattatt

SEQ ID NO: 46443 - DNA, 201 bp, Homo sapiens
agtctgaacaagactttctaaaatagattgaatgtgggcagttttcacagctgcctgatgacttccacacacaaaacatccacatttcatccttttggtggaatactgtgtattttccaattttattcttagagtttaattttttacttacatattatgcttatgtatatcatatttgttatatatattatatataactaa

SEQ ID NO: 46444 - DNA, 201 bp, Homo sapiens
gtttacatttttaatatttctattgacacttagaagatgctatgttcacgtaatcatagaaagcttttaattaaaccctctactctttggttttaactttyctttattgatatatataaaaaatctatttttgtgtcaaaatagcattttaaaggttactgtcattaaaactttaacaactaaattatgtacttgttttag

SEQ ID NO: 46445 - DNA, 201 bp, Homo sapiens
gctagttcttattaccccgagagagacacatttatgggaacctatccagtttctcactgggtctggatagccactctctcccatatttattttacctcatyaatctcaattactgaccatgaatgtctgctccttaagtttgtttactagtggggttttctttagcctttgaaacaaatttttgaacaaatttgtaaacat

SEQ ID NO: 46446 - DNA, 201 bp, Homo sapiens
ttacagagcacctctgatgggtccaaaagacaagaaactggaggctttcagtcagtaaaattccacactgtaggttgtcttgcaggtagatcggatgaggygcctccaaggctgtctcagggtagcagtgagaacagtgcatcaggcaggagcatagagagtttttagtaaatgttaggcctgattactattattattacc

SEQ ID NO: 46447 - DNA, 201 bp, Homo sapiens
acaaatggcacatgtgctgggaatggaagtcaacctttttgaatttttcaaatgtaagtcagtctggaaaatcccagtaaattggtatatttgttttgggytatttttgaagacctcttttaaaatttgcctaaaataaattctcggtatgctataattatagcagaactcttttctcagtcacccactaccactgttagg

SEQ ID NO: 46448 - DNA, 201 bp, Homo sapiens
cacatggtgcatctgtacataaaatatatctggagtattaaagtttcatggtggggatgattatgaaaaaatgactatataggctccatagggacatgatrataaaaaatagattaagtagattgaaaacactagtctaaagtgaagtgatgtgttttaatatcataatatgtgagaatataaaagtatttacgtatggat

SEQ ID NO: 46449 - DNA, 201 bp, Homo sapiens
agtctgtattttcatcttgttttgctttgtttttattgcattttccattaagtccttacaggcccacgagactatgtgatctggccttggcttacctctcmagaatgttcttgagtttcagtcactgtttttcagctttgcttaaatttcttgagtctcttagttgtttgtagcatctggaattttataagttctattcag

SEQ ID NO: 46450 - DNA, 201 bp, Homo sapiens
ttgttattatgtacagtttttaattattttaataatttcaacctttctgcaactttccattttagatatgtctcattaatggcatatagtgaagttttgaygttttgtctagtttggcagtgttggtcttttaatgaaacatgcattttcagtggatctgtgtgtatctaagtgaagcatgtacacagaaaaggtgacaaa

SEQ ID NO: 46451 - DNA, 201 bp, Homo sapiens
attggagatgattcgccagctgaaggcctgtggcagtcattgggtttactaactccagataccaaagtggtttctgagggtgtggttattaactcaggctrtcatcattcattggtaatttatgtgccagatattgtgcctgagatccaggaggaataaggtaggatatcgtctttgagctactgatatatagtgtggtaa

SEQ ID NO: 46452 - DNA, 201 bp, Homo sapiens
aattactattatgttcaaatcgtatatacagcatattttttatatatgtatctaaaatatgctgaataagcaaatcaacaactacatctagacttctgcaycgcaaaccagaactacatttaaatgcattttatctcacacttaaagaattaaaataaaactcttttctgaacaatcttccaatatattgaccataagtaa

SEQ ID NO: 46453 - DNA, 201 bp, Homo sapiens
ttataggagaaaggatggataatgattgcagcattctctgaccactctaatatctcaccctagaaattttaataaatgatttactaacattctcatcaggstttttattataaaataatatcaaagaaaacctgctttttaaaaaaatatcttgatacttgtattttaccaaattcatgggtatagataactttttgattt

SEQ ID NO: 46454 - DNA, 201 bp, Homo sapiens
catgaaccactgtgcccggcctagcatgtagtttttaaaaggcaaagcaattgaaatttgtaaagcatttggatatctacaaaagttatttgacgagaacwtacaaggggacatctcttatggactggtaattttaggattgtccacttgatgttaactaaatatccttcctaatgccaaaccaacacatggggtaagaat

SEQ ID NO: 46455 - DNA, 201 bp, Homo sapiens
atcactaattgtcaataaggaattgagatccacagataaacttatcaggaacagaaaattgttttgaatacatttttaatatttaaatagtcacagatcaraactaaatttttttttaaagattctgttgaataggtaggacttcacattggattcaacctggtatttaaaatgcaaatactttttgatttctctttttgc

SEQ ID NO: 46456 - DNA, 201 bp, Homo sapiens
actctaaccttgaactcctaggctcaagtgattctcctgccttggcctcccgagtagctggggctttcagcatgcaacaacatgcccagctaattttttawttttttaatttttttgttgttgttgttcttttggagagacagaggggggcaggggtcctcactttgttgcccaggctggtctcaaactactagcctcaag

SEQ ID NO: 46457 - DNA, 201 bp, Homo sapiens
caggaaattcaagagatgcttatcaacgaatcatacgcactcctgaatctaagaactcatttccaaatgtcagccaccaatctgcagttagttagaaaagrccattgctttattctgacctgaagttaaatgagtgacagtgtgggggtgaaaacgttttggccccgttaccaatttggtgcactatctacttccctaaac

SEQ ID NO: 46458 - DNA, 201 bp, Homo sapiens
tatttattaagcacctactaagtgcaaagatgaatacgatattatcattgctagtcagagaaaaagagggagagttgctttttctgccatagccctcccayttttattccatgaattctggcaggttacttgtcccttctaaatgtaaaataattaatggacaaataaggataataatatcttccttctaggattactatt

SEQ ID NO: 46459 - DNA, 201 bp, Homo sapiens
cacttagtagatgagacagaagcaaaaagttgagtagcatgccaaattggttggtttagaaagaatcacagaacattagagctagaagacaccctaaagaktccaactcttaacttgcacatgaggaaagaaagccctcaaacttacagcatggcccagggggttacacacatgagcgatagttggcactaaaacccagat

SEQ ID NO: 46460 - DNA, 201 bp, Homo sapiens
tttttataaccttctgttctaatttcgatttccatttcctctcagcagtgtatgttttaacttttccgaaaacagagcattccacttagtagatgagacakaagcaaaaagttgagtagcatgccaaattggttggtttagaaagaatcacagaacattagagctagaagacaccctaaagattccaactcttaacttgca

SEQ ID NO: 46461 - DNA, 201 bp, Homo sapiens
aggcgcctgtaatcacagctactctggaggctgaggcaggagaaatgcttaaaccagggggacagaggtttcagtgagccgagatcgcaccactgcactcyagcctgggcaacagagcaagactccaactcggaaaaaacaaaacaaaacaaaaacatttaaactttaaggaatttcaataagtaactgcagatttgagaa

SEQ ID NO: 46462 - DNA, 201 bp, Homo sapiens
acattagccagacatggtggtaggcgcctgtaatcacagctactctggaggctgaggcaggagaaatgcttaaaccagggggacagaggtttcagtgagcygagatcgcaccactgcactccagcctgggcaacagagcaagactccaactcggaaaaaacaaaacaaaacaaaaacatttaaactttaaggaatttcaat

SEQ ID NO: 46463 - DNA, 201 bp, Homo sapiens
ttgtagtcatggtctctgaggagaaatgcaaactgaatgctctcatttgaatcttagaatgctttagaatcctggtttcacatgtcttctagattagatgktaggccctttgacaaactttaatccttttcattgcggaaaggactttttaaaagatttaaactttagccgggcgtggtggctcacacctgtaatcccagc

SEQ ID NO: 46464 - DNA, 201 bp, Homo sapiens
gagtatgaatatgtagcagtagttcagccaagccaatactatcctgcagtgaaagacctacatttactaattatcctcttggggaaaacatttagataagyaataaagatttcttaccttctaagtaaacaacaaagctttcctcagtttttattattattattattaggtagaggattaggctgtaggatgaattgatac

SEQ ID NO: 46465 - DNA, 201 bp, Homo sapiens
ctgctctttatgatttctacccgtaggtagaataatcaagaggtgagattgatgttgtttttgattctggacattaactagagggaaaattcgaagccctstaagaatggtatctaacttaatagacacctctccattacctttactcaaaactaagactctttgtggtatgggcccaccccacctctagtagccagctgc

SEQ ID NO: 46466 - DNA, 201 bp, Homo sapiens
ggatacttttaaatgcaacgagtatgaatatgtagcagtagttcagccaagccaatactatcctgcagtgaaagacctacatttactaattatcctcttgkggaaaacatttagataagcaataaagatttcttaccttctaagtaaacaacaaagctttcctcagtttttattattattattattaggtagaggattagg

SEQ ID NO: 46467 - DNA, 201 bp, Homo sapiens
tcttcccattgaagactacagaaatctctttcttccagttgagctcaaaaggaaaagcaaaaaaagatggacagaagccagaaatgctgaataaattagtrtcctttttatttactttttaaaaactatgaattggctcatttaaatagattctaaaagtatttgtatgtgggtctgaacactgttgtcatggagattaaa

SEQ ID NO: 46468 - DNA, 201 bp, Homo sapiens
cccagagacttcaggggttcagacctccaagccagcaatccatttatcagactgaagacatagaaaagaactggaaatccaatttgatgaggcctcaaaayacagaggatacttttaaatgcaacgagtatgaatatgtagcagtagttcagccaagccaatactatcctgcagtgaaagacctacatttactaattatcc

SEQ ID NO: 46469 - DNA, 201 bp, Homo sapiens
gtccatgttaccatgtggggtatattattatttaacaagcctattaagactattagaaagttttcctgatcacaggtctctcttctctttgcagcctgtckctgtaatgccggtggctctttctctgaggtttgccacagtcaaactggacagtgtgagtgcagagccaacgttcagggtcagagatgtgacaaatgcaag

SEQ ID NO: 46470 - DNA, 201 bp, Homo sapiens
cttcagttgacactgacccatatgtgagaaagaccccggccatagctctactctcttaaaatatccataagcaagagtcaatagtcaacagcaaatattarcaagaattttatagaaactcaatagtgatcagcttgtttttaaaatgaaaacgttaaatatgtcattctcatacatttttaattatcctatcataataca

SEQ ID NO: 46471 - DNA, 201 bp, Homo sapiens
aaatgtatatggtccccaaatggtctaacgtaggctttcagatttgaaaacctcaacgtcttaccttacaaaattctgaagagtcaaattaagttagaagkcaaatgaaaggaagaaaactacagtgtttagtcacatttactttcatttgtcagtataccatcatttctgttaaattatactttcagatccagtgattta

SEQ ID NO: 46472 - DNA, 201 bp, Homo sapiens
tttcccgttatctagtatgaaagcaaggtaaaatttaaatttatgcatgccttcttcgagtgcatgggttgggtaaatgtggcttcttagataaagcagcygtgcagaagcagagcaacaccagtacagctttgttcatagtatgtttcacgagcaagccgtgcattctgtgagagttctcctgctgccccttgctggccg

SEQ ID NO: 46473 - DNA, 201 bp, Homo sapiens
caatttgaaagtgtttcaataaactctcaatgtaaaacttcacgttgttttctgtagcttttcagtaacttcttacactcatgttctatgtgcggctcagkggggaactatctgtatccagtggattgttggttctgacacactagcctacgtgcatatggggcaacccccaacatgctggcccctgccacttgcaataga

SEQ ID NO: 46474 - DNA, 201 bp, Homo sapiens
ctgcatgaatatattttagtaaaagttggagcaacagatgataaaattccacaaattcagtgaactctgagaataaatatggaaggtccgcagttaattaycctgcaaagaaaacgaaccttgaactttctgttaatagactttgcttcccaattaaaagctagcagtttgaaaggtttacctcatcagcgattccctatc

SEQ ID NO: 46475 - DNA, 201 bp, Homo sapiens
ctgagcaggcaaacaatgaaaaagtcccctccatgcaaaatgtatgtaaaatcagctttcaataagtgaacagtatttactacctgctgttccttttcacyatttgcagtaccattcttagactcactgcaggcataaaccctgggataaggaaaagttaagcctccgttcttcatacctctaataaggctttgccaatgg

SEQ ID NO: 46476 - DNA, 201 bp, Homo sapiens
gcagctataaaattaagaagatacatgtttaactttgtataacccagtatttgtcatatttatttgagccaggaacatccaagaaactagcatcctaaagrataaacatttagaaattcccttataacccactggttcaaatgcccattttcaaacccttgcttattcagatcctacatcagacaaaggtttagaggccaa

SEQ ID NO: 46477 - DNA, 201 bp, Homo sapiens
gaatcatattagagcctacaaatgatatcccacttatctttttgtctgttaaatactttaaaaatgttttcagtgatttgtaggagtggttattatcaaayttttattttagaattgtagattattattattattattatttgaaatttgacagactttcctttgttcagatccaagctgtgccgcttattacatgtgtaa

SEQ ID NO: 46478 - DNA, 201 bp, Homo sapiens
ctagtattattttccattaatgctacttgaagtgtccccctccaacccaaaacaacaacaacaacaaatcccactgcaggtagagcaccttcactctgagyggatccccaaaggccctagtcaatgctccaggaactttccttttctttccattgacatttcaaacacccaacacctagcagcccatcctggggactcatt

SEQ ID NO: 46479 - DNA, 201 bp, Homo sapiens
ttccagtggcacaaagtcactctcttagtggtaaacaaaatgagatgtgaatatatgtggatgtgatcataagctctgaatattaaataagacaagaagamtcaggttaaaattcaaaagaatctccttcttatctttatcaaatgcctctcttgaagggattttgggggaattttgtgcactcaaattttattgcatatt

SEQ ID NO: 46480 - DNA, 201 bp, Homo sapiens
gtacaccagtaatgtgctgaagtgttgcagaaaatagtcccactttcagtaacatggcatatgaattttctatcacgtatattcacaaattttccttacaygtcctgcaagaaaaaataaataaaagacagatgcttctttagttattctatttaattatagttattttcctcctgaaatgagtttttttattatggagaa

SEQ ID NO: 46481 - DNA, 201 bp, Homo sapiens
aggcaataatatagaaagcaagaagtgttcataaaggactaagaaggtagtagtcatgaattaatgaacagaaagaggctgacactaatttaagctaaagmcttcctttgaggaatgaaattcatgaactccaaacattaagaaatcaaatgccaacataactccttgatataaaagcgtttgggagctacttccagggca

SEQ ID NO: 46482 - DNA, 201 bp, Homo sapiens
taaaacagtatgacaacatttattgaatacatgttatgtgctaggtaccaagtgaggagttttatgtttattttctcatttcatcctaagagcaaacttcrgaggtaggtgtgattcgtctcattttagtgaaaattcactgatgctctgaaagcaaaattaactttcccaagggccttgtagtgcttaaaggcagaatca

SEQ ID NO: 46483 - DNA, 201 bp, Homo sapiens
ccctaatgcttatataaagcagttaacttacttttgtatttttagtttcgtatcatttatttctgctctcatcttggctagcaaggactgaacattccatwtttccatgctggcctcctatttcactcacatcatctccccaggacaattgtcttctctaggatgttcctgttgatcaattgtaggtgcaaagtcaccctc

SEQ ID NO: 46484 - DNA, 201 bp, Homo sapiens
gctagactgcttaaactcatcatataagcgagcaagagaagtataattttgctctcctttaaacagaattcccagcatgtctctttgttcttactacttawttttctatactgtaaattaaatttttaaagaactggagaaaagtccactaaaacaaattactaacagtgacaaataagcagtgctttatgttaatatgta

SEQ ID NO: 46485 - DNA, 201 bp, Homo sapiens
atcatcatcactgacattctgatagcctttgtttgttgagcacttactgtgtgcagtgctattccttaatttattaaacctttgcaatttgattatgtagrtactatgattattattatcatgcccatttcacatataagaacactgagtcttggagaacttagatcacttgcaacatctggactcaagggcaaggacttc

SEQ ID NO: 46486 - DNA, 201 bp, Homo sapiens
tatttttttttaattgcaacctggatgtcatgaataatagcacattgtagaaactctgggttttgttatgttcctctgaagagcactcacccattcttttytgttgtcgcatcagttggttaacttgactgggctcaaagtcccaacttttttctttcctgtagagtgcagaacctaaaatctctgttcagtttttcagcc

SEQ ID NO: 46487 - DNA, 201 bp, Homo sapiens
attttagcacttctaacaataaaacaaaagctcttctacaagagaatatcttcattcatgttaaacatatcaatatctcaagtaagtatgatgaattttgwgatagggatcatgccattggggtctcatctggtggtcatggggaaatggtcctctttcttggatatctttggagagtatactatttgactctttagtcaa

SEQ ID NO: 46488 - DNA, 201 bp, Homo sapiens
gctagctatatttaataggacaattattcttttaggtatttttcttgtttgtttttacaaaagtctggtttgaggtgtccattggtatgtgtattttagtycttttttaataaggcaattgtgtttgattttattgaagacacatctttttgaaatgatagggctataaacttcaagggaattttggaatttgatgtttct

SEQ ID NO: 46489 - DNA, 201 bp, Homo sapiens
tccgcagtgtttgtgtccctgggtacttgagatcagggagtggtgatgactcttaacgagcatgctgccttcaagcatctgtttaacaaagcacatcttgyacggcccttaatccattcaaccctgagtggacacagcacatgtttcagagagcacggggttgggagtaaggtcatagatcaacagcatcccaaggcagaa

SEQ ID NO: 46490 - DNA, 201 bp, Homo sapiens
ggatagtttgtttttttttttttgttttttttttttttttgaggcagagtctctctctgtcacccaggctggagtgcagtggcaggatctcagctcactgyaaactcttgcttcccaggttcaagtgagtcttctgcttcagcctccctagtagctaagactacaggcgtgtgccccacacctggcttttctttttttcgc

SEQ ID NO: 46491 - DNA, 201 bp, Homo sapiens
tattctagtgatgattttaattatcataaaataatttttaggaattatctataaaggtgtgcctgttaaattctataaaatctgttaaaatctgaatctgytaaatgaatctttatcactaaaatgtttttactttcatgatacagcattgcataattacagtatactatttccatggtgtggcacattatttcaaaacag

SEQ ID NO: 46492 - DNA, 201 bp, Homo sapiens
aaagtttaaaagaactccactgagtttgggtataggcaggtccctgaggactttagcaagaccagagatgacagagtagtgggagaggaattgaaataagrctccagcaatgtggatgattgctccttttcagtgaccagattatttgttttatatgaattattctcaactagttggcaagagcactgtctcttgaaattc

SEQ ID NO: 46493 - DNA, 201 bp, Homo sapiens
gtataattgacaattaaaaattgtgtatattctagatatgcatgacgatttaatatacatatacattgtgaaatgattaccacaaccaaattaattaataygtgtatcacctcacatagttatcactttgtgtgtgcgtgtttgtttatgcatggaggacatttaagatctgtgtttggaaaattccaaataaacagtaca

SEQ ID NO: 46494 - DNA, 201 bp, Homo sapiens
ggggaggaccgaaatagtatgccaaattcttttccagccctcaaattttatgagcctgagttgcattgtgtgggtaaaagtcttgtgctctgtggatcagraggaagttagatgttttggatatttacatagaaacaaagaatttgaagactggaaagaacttgagcaggactctattaaatgtgttttgtgtgagatggt

SEQ ID NO: 46495 - DNA, 201 bp, Homo sapiens
ttgatgttatatgaattatttgctgaattattttgtgtataatataatctatgattaacatgaaaacaaaacacaatatcgtaatccatttttgcaaaccytgagtagtcttttttactaccacttgcaaagggtatgacttaactgctaatgccagtttttaatctcatttttaaagtcttttaatctcagttaaattaa

SEQ ID NO: 46496 - DNA, 201 bp, Homo sapiens
tgagaggggtgaagggtggcaggaaagaatttgatttccaactgtattgaatcagatgtgacttatacttgtttatttttaatattttatcagcatctttrcagttcaagtggatgaaaacagaagatacatgcaaaacctgacagttgaacagcctatcgaagttaaaaagcttttcgttgggggtgctccacctgaatt

SEQ ID NO: 46497 - DNA, 201 bp, Homo sapiens
gaaataatcctatattttttaatgttttagtgtatctttttgagctgtgctaatactttgatcaggattgttattgttttgtgagttctctaattacacasttgtgtaagtttttagcaggtcagccccaaccctattttcccataagccctgttatttgtaagaataatttttatagaactcctggtgtttgtttgtttg

SEQ ID NO: 46498 - DNA, 201 bp, Homo sapiens
ctacctgtctcttagagttcttgttagcagaaacaaatttctgtgtaataaagtgcctggcaaaaagtaggtcctaaataaaatgttattttccccaaggraaagattattaggaattataacattgggacacacctttgtttaaaaagctctaattaacaagaaccacagcaggggcgcgcatacaggggttggagagaa

SEQ ID NO: 46499 - DNA, 201 bp, Homo sapiens
aactgatatggtttaaaaaaaaatcttaaacccacattccaaacaaataagaaatagggtataagtaatcaggtaattatgaaactctaagaatcagccaytgaaactgtaaaaaaaaaaataaagctgacctattacaatactaaagtaatacaaagtttaatgtacctttttgcacatagcaggcctcagtaaaaagct

SEQ ID NO: 46500 - DNA, 201 bp, Homo sapiens
aatttggcacccaacctttgcagtatacttgcatgacccttggagaagggccacagttctgcccatactcaaacacaaatgaggctcttggagacacctcytggtgtcatgatcatatggaggctgttttggtttctaggctatcttgttgggagtctgcacagccctttcatggaggtaatgatgatgctagttggtttt

SEQ ID NO: 46501 - DNA, 201 bp, Homo sapiens
gagagacaacacaaatgaataggatcaagaatgaaaaggggatcataactgtagatacattatagattgaaaaataaaaatggatatattggaggatatgmgcaattttattcaaacacatttgaatacttaggtgaagtaaacagtaagtttagagcaaaatttactcaaaaagaaatagtacacctgagaactataacc

SEQ ID NO: 46502 - DNA, 201 bp, Homo sapiens
aattttatagaagaagcatttctgaagatagaaaataaggataatttttaaacacaagaaatcacatgcttttcatatcattatcaatgtggaaaatgctraaacaacttgctattaaaaaccatttatcagaaacttgtttaattaatatgtcaaatatctgggtttttaaatcatgtataacaatgaaaatattcctaa

SEQ ID NO: 46503 - DNA, 201 bp, Homo sapiens
aatgaatttggcttataaaagatatgaggcatttaacagcaattggagccaaacttggtgttctttctgatttttttaaaattaatataccagaggaatchtaaaatgttatggaacttatttcctcaagttctggaaatcattgggttaaacatagctaatttcccccttatgttattatagagtttatatttatattac

SEQ ID NO: 46504 - DNA, 201 bp, Homo sapiens
caaaaccacatctctacaaaaaattgaaaaattacctgggcatggtacatgcctatagtcccagctacttggggagatgaggtgggaggatcacttgctcyggaggatgaggctgcagtgagccatgtttgcaccatggcactccagcctgggtggcaaatagaaaccctgtccccccccaaaaaaaaagagaagaaaaaa

SEQ ID NO: 46505 - DNA, 201 bp, Homo sapiens
ttcaataaactctcaatgtaaaacttcacgttgttttctgtagcttttcagtaacttcttacactcatgttctatgtgcggctcagtggggaactatctgkatccagtggattgttggttctgacacactagcctacgtgcatatggggcaacccccaacatgctggcccctgccacttgcaatagatcagacccacccct

SEQ ID NO: 46506 - DNA, 201 bp, Homo sapiens
tagcaagaaagaaaaccttattattgtatactaaaaagccatggatgagagtaccttcctcttgctaaaaacaaaccaaaaaaaaaggccaactaatgggkttatggcaggaatgaaggaacaatatacagaataagagcaaagagaaacaaacattttacatatatattcttttgtctggtataaacaacaataaaaatg

SEQ ID NO: 46507 - DNA, 201 bp, Homo sapiens
ggttcatcttaccttggtaaatacagaagcacaaaaaacaaaggcaatgccaggtatttctccagggtgaataaattttagaaggcaaatttaaactgtcrtatttctgattgcctgtgattcacaccattgttgtactctgtgacagtttcattgaaaggactgtcatgttccatgaggaactcagcctacctgctcttt

SEQ ID NO: 46508 - DNA, 201 bp, Homo sapiens
acccactgaagctcactttttcctctccttgtaattattctcaacttctgtagaattatatttggagaaacacataataaaactaggtcttaacaaatgarcaactactgggatatcaaaatgttctctcttaaacatcccacagtttaaattgaaagtcaagaaaaactaaaaaaatagctacaaaaaataataacaaga

SEQ ID NO: 46509 - DNA, 201 bp, Homo sapiens
gttccaggacccccccccacagatatcaaaattcttgaatactcaagtcccttttataaaatggcatagtatttgcatataacctatgcatagcctcccayatactttaatccctagatcatttataatacctaatataatgtaaatgctatgtaaattcttacagtgtattgtttatgaaataatgacaagaaaaaagtt

SEQ ID NO: 46510 - DNA, 201 bp, Homo sapiens
tacctcggtgaggttctagacttctgccctgctgcagctactcagtactttaggccatgacctccgctctccttcctcagcaactcaccacagaccttccrgaaaaatgttaaacccttctcatccttttcttgttattggtttctattttctttctttcttttttctttagcgtcacaggggaagagctgataattgtat

SEQ ID NO: 46511 - DNA, 201 bp, Homo sapiens
ctattcatattaataaaaaataaaaattccatttgagaaactcaactggatggaatttgaatagtcaaattaaacatttccattaaaatttataaaaatcrtcccgatatttagttgaaaagtgaggaatatatacataggtatacatatgtttaggaaatataaaaacgaaataaacttaggttctggaccaagtaattt

SEQ ID NO: 46512 - DNA, 201 bp, Homo sapiens
tattattattaggaattctgaggtggtggaataattcattttccaatgtgttaacttctcatgagtttaatgtgagtataaaaagtctgttttaactgagrgcagagtattcctttttctcttataatacaggagccagttacaacacaggaggtgaaatggcctgtttgcttacctgcaacttcaggaatttcatgctta

SEQ ID NO: 46513 - DNA, 201 bp, Homo sapiens
gagtatctacctccctgactgattgtgaagatgaaatgaaatagtcagtagaaagtagttagaatagttcacagcatacagtatttattatttttatgattaactaatgttttatgaggtccttagagtgctagacactgtttgcatgaattattttatatgatctcaccacaaccttataaaaaagtttttattgtccga

SEQ ID NO: 46514 - DNA, 201 bp, Homo sapiens
aagtctccaaaattattcatccttttggggacaactataaccatgattttttgtgacactcataacctgttgaattggaaaaatattaatgttagaaatcygttctcatgtcacttttaaaattcttctccttttttgcctcctgtagcatgagtcctagtttgattaaactagacacttgattttctccaatggtaacat

SEQ ID NO: 46515 - DNA, 201 bp, Homo sapiens
attttgagagccagtgcaaactgcaccgcaggtgtattgcctgttcaaatttttctttaccactctatattaacacctaagttaaaggccggcacaataarcaatgtgttgcttgataatatttgtaaaacaaatggattagtgaacaagttaatatgtcactctgtggtctttaaaatatatatggaaatgcagaatatt

SEQ ID NO: 46516 - DNA, 201 bp, Homo sapiens
actaccaaattagagggtggggaatttttgtcccatttaaatcctaaggtacatatttttaaaaaccctcttacaccagcacttctcagtccttttccaamtgccagtttaataaaggaaggtgatagaagttttattaaaacagtatccatcctgttgcaaatcaatgattgatagtaaacatcaccttggatgtcctta

SEQ ID NO: 46517 - DNA, 201 bp, Homo sapiens
aatcctcacaactttatgaaggaagtatatgtgtgagaaaagatacacacgattagattttgagagccagtgcaaactgcaccgcaggtgtattgcctgtkcaaatttttctttaccactctatattaacacctaagttaaaggccggcacaataaacaatgtgttgcttgataatatttgtaaaacaaatggattagtga

SEQ ID NO: 46518 - DNA, 201 bp, Homo sapiens
attggtcagccgtcccattcgctggtaccccaacatctccactgtcatgttcaagttcagaacattttcttcgagtgctcttctgatgtatcttgccacaygagacctggtaaagatcatatgcatagcagagtttccgtgactaaaatgcgtttgcttcttttatcagttattggtaaaatcatcagttattggtaaaat

SEQ ID NO: 46519 - DNA, 201 bp, Homo sapiens
tgagtgtgatccctatggctcactgcctgtgccctgtgaccctgtcacaggattctgcacgtgccgacctggagccacgggaaggaagtgtgacggctgcmagcactggcatgcacgcgagggctgggagtgtgtttgtacgtatactaactttgctgttagttttggaggccttgattccagttctgtctcatttccaat

SEQ ID NO: 46520 - DNA, 201 bp, Homo sapiens
agttcgtaacttagttttaaagaaatgtccaaagcgtaaattcagccttctgctgtattttgaccccttgcaggtgactctgaaggctgagcagaccattytacccctggtagatgaggctctgcagcacacgaccaccaagggcattgtttttcaacatccagagattgttgcccacatggacctgatgagagaagatct

SEQ ID NO: 46521 - DNA, 201 bp, Homo sapiens
aggatgactaagagatggagatggtaatttaataaaacacagaaagagccaaactgaatcagacagatagttcctatcatgtagtatttagcattcattcrtaacattatcaatagcctgtcctgggtgagattgatttttgtgaattttgctttggcagtgataccactatctatcaccactacccataggtgatagtgc

SEQ ID NO: 46522 - DNA, 201 bp, Homo sapiens
tatacctgcttcattaagctaaacaaacagatggacaaaatctcattgccagacatggagttttcattgatatgcatttgttggcataccgataaacactrcttttctagagcttattttcaacccaaacccacctttttttctagttggtggagatgatctattttcaatggtatagtgattttttaaaaaatatattag

SEQ ID NO: 46523 - DNA, 201 bp, Homo sapiens
ttataacaagcatagctatatttacagatattttttctataaagttttcaatatagattctgatttttttatcttataaaaaatagttaacaccattaacrtttggatttatttctgtctagttctcctctgctcacacacacacacacacacacacgtgtacacacaaatacatatatataaaatgggcagcacactaat

SEQ ID NO: 46524 - DNA, 201 bp, Homo sapiens
ttaaagagcataattaaaagaaaaaatatgctatttaggtttggattactaattttaagtttaaatgcctttatatcatatttctttgaagctagacatgkattcaaacctcagctcccccaataattagatatttgaacatggtggaaatagtgaacctatcatctttaaaacaaaggatataaaatctaatagagtgga

SEQ ID NO: 46525 - DNA, 201 bp, Homo sapiens
ataacaaaagatctgtatgaaatgatgcataatagatggtgatggctgaagctgctgaaaattgatggtctaaatcaaaaggatggattaggaatctttgyggaattattacagacctgtagttttgtgagaaaagcagagaatgtcaaggtcttttacttcaaggaggatttgaagtatttgggggtatacattattgca

SEQ ID NO: 46526 - DNA, 201 bp, Homo sapiens
actttcctttcagtaccttgggctccccatctattaagtggagatcattaaaatctgccttgcaccgctgtcctaaggatttgagataaagcatacaaagkgcttggcacatagtaggtgctcctaaatggtaactttattcttcacatcaggctttgcttatacttataaaagccagttttgtagataatttgctgaata

SEQ ID NO: 46527 - DNA, 201 bp, Homo sapiens
cttaatatcttcttccacgtatgcaatccaactgatatggtttaaaaaaaaatcttaaacccacattccaaacaaataagaaatagggtataagtaatcargtaattatgaaactctaagaatcagccattgaaactgtaaaaaaaaaaataaagctgacctattacaatactaaagtaatacaaagtttaatgtaccttt

SEQ ID NO: 46528 - DNA, 201 bp, Homo sapiens
cctccccttgacactgatacgtattcagaggcacacacatacatgcatgttcattattccaaatgggtagatgttaatttagcaccaggctctgttgtttyctgtcttgaaactttcatgcatgtgaatctatgacaaaatgaaaaattcttttctcaaaatggacattttccagtattggatgaagtggtctgctctctc

SEQ ID NO: 46529 - DNA, 201 bp, Homo sapiens
agttctgaggctgggaagcccaagatcaaggtaccagcaatgttcgatgtctagtgaaggcctgttcctcacagagggtgacttcttgctatgaccccacrtttaattcatttaatatctggatactgaggaaaaggatagctagctctctggggtctctttaataagggcactaatcccaatcatgaaggctacattctc

SEQ ID NO: 46530 - DNA, 201 bp, Homo sapiens
ttacttcctgatgttacttaaggttaccagtactgtattttttacctgcctggtttgacactgacttacaggactactaaaaaaaaatataccttaggagwtttttgtgccactcttttgtttcactctgagacatatctagaagattgagtatatttgttgggtttgaatgataaaggagaactttagaccagacttgaa

SEQ ID NO: 46531 - DNA, 201 bp, Homo sapiens
ccttacaaaaccaataaaattcaaattaaaaacattaatataaagtaacatgattttggctgaatggaaattgctgcttgcaacaagaataggatattgastattttcacacagttcttccaccagagatgatgtggtaactcatttctcctaccttaccacatttgaaccagagagccccctacaaagggtcctgaaatg

SEQ ID NO: 46532 - DNA, 201 bp, Homo sapiens
ttttaaaataatacattgctcccactgtgctgatggtgtgtgcacttaaaggttcttggataacaaggctcttgagcaaattgcctctcattactgagagytgagaaagttttgacagttgctttcaagttaaacttgggtgactaaatgaagtaacaagctttgtagttatacaaaattgatgccggaagttgttcaagt

SEQ ID NO: 46533 - DNA, 201 bp, Homo sapiens
tcctgggagaaggggagaatgaaaaatatgtaaacattgccccaactgaggtccccccaaaggctcactgatgaaatttcttgccttaggtgtgcagaagrctattttggacaaccctctgtacctggaggatcatgtcagccatgccaatgcaatgacaaccttgacttctccatccctggcagctgtgacagcttgtct

SEQ ID NO: 46534 - DNA, 201 bp, Homo sapiens
atggggtatccatcacctcaaacatgtatcctttatgtttcaaacaatctgattatactcttttagttatttttaaatgtacaattatttttttttttttactgtagttacccttgtgctagcaaatactaaatcttattcaaactatttttgtatcattaaccatccctactcctccctgccactaaccttcccaacctc

SEQ ID NO: 46535 - DNA, 201 bp, Homo sapiens
acccaggtctcaagatcctgcactgggtatttaggttgacttaggggacagggtctttagaaatctcaagaagccaaaatctgaacacagtcacttatgcytgtaatcccaggtcctttcaaaagtaatcacatttccatgaatttcacccttgtgaatggggcattctttcagggcatttatttgtgccctattcatatt

SEQ ID NO: 46536 - DNA, 201 bp, Homo sapiens
gcaagatcctgtctctacaaaacattttttaaaaatttagtcaggtgtagcagcgtgagcacataggcatagctacttggaaggctgagccaggaggatcrctttagcccaggggcgtgaagttaccgtgagttgtgatcacactactgtacaccagcctgggtaacagagtaagatcctgtctctaaaaagaaaaacaaa

SEQ ID NO: 46537 - DNA, 201 bp, Homo sapiens
gattctgagaatttacatcattattatagtaagaacattatccttgattttgattcatagtctaacataccaaactctaaatttcttctgttactcacttyacataaacacattgcagccagtcaccaacccttacatatatccctgcacagtttgagcagttttctttattgaaaatatttttaatttaaaatcatttaa

SEQ ID NO: 46538 - DNA, 201 bp, Homo sapiens
aattagaaattggtacaaaacaattgacaaaaagttttaaaataaaaaacatacttcaaagtaatccatggcttgagaaaaaaacacagtttaaatttacraagtatttaataacagaatggaaataaaatttcacctcaaaatttgtgtgtgcaaataaagtggtaccaacaggaaaatgtacagtttggaatgcagata

SEQ ID NO: 46539 - DNA, 201 bp, Homo sapiens
cgatgaagtaactcatgaaacaaacaaaggaccacaacctagatcataaagcaagtatcagcaaatcctaatgatccaatagcatctagactacatcctcktatcataatgcaatacaattagaaattggtacaaaacaattgacaaaaagttttaaaataaaaaacatacttcaaagtaatccatggcttgagaaaaaaa

SEQ ID NO: 46540 - DNA, 201 bp, Homo sapiens
cttaatggccttatagaactctatgtcaactagataattaattctacatgccccattcgatgaagtaactcatgaaacaaacaaaggaccacaacctagaycataaagcaagtatcagcaaatcctaatgatccaatagcatctagactacatcctcttatcataatgcaatacaattagaaattggtacaaaacaattga

SEQ ID NO: 46541 - DNA, 201 bp, Homo sapiens
ctactaattttttatttttatttcttgctattaggggtcccaatgcatctacattgtctacagctatgcaggggaggagggaaacaatgaggatcttcaayttagactgagaaaagcacactaatggacttaaaaaggcatgcggggattgggcttaattgtaaggaagcaaaaaaacgaaaataaaaaaatcttatttat

SEQ ID NO: 46542 - DNA, 201 bp, Homo sapiens
attgttaccatatttctattaatgcacctaagaatgttttaatgtttttaatagatatatcatgctactaattccaaatcgggtaccatattcaatcaagmagaacctcatggaccttcttctctaccactagaacatcctccaggcaggtctctcagcctgtgctggtttggatttttagggataaccctgccagcctcc

SEQ ID NO: 46543 - DNA, 201 bp, Homo sapiens
tttgtggtagttctttgataatttgtcctcttttgatacccttgattagctttgtttaccgtttccttttgcttgcttttctttttttcaaatctctttayttcctgtggtgtttatattttctcttttttatacttaaatgaattaaattttaatttatctatttttaaaataatggactatttaagcctataagtttac

SEQ ID NO: 46544 - DNA, 201 bp, Homo sapiens
aagcagcaaaaagaaaaatggtgtgtgcagcattatctttctgccacagatacatgtttttaatttccaagtttccaatgcatcattcagttttatctaaygggaatgcagctgagagaagtttgtaacaacccaaaactacatgctaatatagtttagttttcaagtcttgtggagtctttttttttttaatggaataag

SEQ ID NO: 46545 - DNA, 201 bp, Homo sapiens
atagtatgccaaattcttttccagccctcaaattttatgagcctgagttgcattgtgtgggtaaaagtcttgtgctctgtggatcaggaggaagttagatsttttggatatttacatagaaacaaagaatttgaagactggaaagaacttgagcaggactctattaaatgtgttttgtgtgagatggttttcaccctgtgt

SEQ ID NO: 46546 - DNA, 201 bp, Homo sapiens
cactttcttctgcctgcttttattctagccacactggcagcttattagatggtgcccacccacattgagggtgggtctgcctcttccagtccagtgactcmaattttaatctcctttggcaacaccctcacagagacacccaggaacaatactttgcatcgttcaatccaatcaagctgatactcaatattagtcatcaca

SEQ ID NO: 46547 - DNA, 201 bp, Homo sapiens
atagtattttgatttacctgatttcttctagagatacagtattttgatttacctgttttaagttgtttaaaagaaatacctataactgaaaatcaaaacasaaagtattcaaaaggaaaagactactgattatgtactggctgtcaacagtttgggctaagtgaatgtttcagtttctgagagtatattcaaaaccagaaa

SEQ ID NO: 46548 - DNA, 201 bp, Homo sapiens
acgtcagctattgtttgttgtgaattgccacacattccctaccaacaattgtctggccattagaagacacatgaaacataaatacattcttcttgattgaytaaatgaagcagagcccagtctatgggatatcatccaagttcaagctggcggcttcgtggctccagctgagattatcaggaagtcaattcactaacatgt

SEQ ID NO: 46549 - DNA, 201 bp, Homo sapiens
gagcaaaaccagccatcgaatgctgccatcaaaaaacggacctatgacaacagggggcatgtgggttgcaaatactggttacataaattggtccgacaacrttctattgtccggcgtagctgggcttttggagaatctttgcactgaaaatcagatccttcatatttcatacaccctgaagctaatgtggtttctccctgg

SEQ ID NO: 46550 - DNA, 201 bp, Homo sapiens
ttttttttttttgagacagagtttcgctcttgtcacccaggctggattgcaatggtgcaatcttggctcactttaacctccacctctcaggtcaagtgatkctcctgcctcagcctcccaagtagctgagattacaggcatgcaccaccacacccagctaattttgtatttttagtagagacgaggtttcaccatgttggc

SEQ ID NO: 46551 - DNA, 201 bp, Homo sapiens
tcatatgcttctaaacaatttataccatgtttatgaattaatgaatttttatgaatttttgaattaaaaagctcttaacctttggctacaatcattgttcrtaatacatttggaacaagtattttagagtttgggcattccaagttctatcacattatttgaatgccttcaatggtgacaaatctttatgctttagatgta

SEQ ID NO: 46552 - DNA, 201 bp, Homo sapiens
acaaggattctaatttctccacacccttgccaacacttctttttctgtttttttttttttctttttaaatagttagcatcaaatgcgtatgaagtggtggyggttcatattttcagtcatcgtttcccagtatttcttgagacaattttgaaatattgtaagagatataaaataactttgatgttggaaagaatagcagtg

SEQ ID NO: 46553 - DNA, 201 bp, Homo sapiens
tcttcaattaacacacgtgtggaaatatcttccctgtttccagtggcacagcattttaaattaccttgatccattaattcaaacaagccatgttgtaaaasattcttgtgtttctgtacatgctatactttaagtcagctcatacaaaagctaagggctaaaattggcagttgtgtaaaagaatgttagacccttggaaga

SEQ ID NO: 46554 - DNA, 201 bp, Homo sapiens
gcaaagctttgctacagcagcatcaaaagtctgatttacaagtagactcaaatatggcttagtaggaagtgaacatagccctaggctacacttagaaaaarttattttctgttctttattaaaaagcacagtggttgccttattagcattttaaataacatatatgaaaatacattctgtttcaaatttcagtttcatgtt

SEQ ID NO: 46555 - DNA, 201 bp, Homo sapiens
ggaaaactgtacaagagaaatagtcacctgctgattgcaggcctgtgggtttcttggaaaaactcagcaattttgcttatccaggactatctttttgcccrgttcctctgattctgaaggaagttgaaaagatagttttcctttgctgtatccaacatccttttctacatttgatttaagaaatgtcaatttaacttttta

SEQ ID NO: 46556 - DNA, 201 bp, Homo sapiens
tgtagcaaatcattgtaggaacagtgtctgacaatagtgcttggcacattgcaaacattcaacgatgctggctattatgattataattattattattataygcagatgatacagacaaacatttatgagtccaatatttataatctaattattcgtttattttacaaatacattgagtgcctactctgtccctactatgtg

SEQ ID NO: 46557 - DNA, 201 bp, Homo sapiens
accaggcatatggtcagtttgagtgctattagataggctttagaacttccaagggatcattggtttgattgtcattgtatccaccaatcacccaacatctwtgacccacgacaatttgccagacactatgcttggcactctgaggaataaaaagagtaagacagatccctagccttttctaatctatctatctaatggaga

SEQ ID NO: 46558 - DNA, 201 bp, Homo sapiens
tgatgttatagtatcattcatagatcatttggaagatactgatttactagttatgcagatcagccacaacttgacagattttcttataaaatattttaatyacattttttatgactattgatctcaccagaaaagtccctaaatattagaagctgttaatctcacaatggtagagacaaatttttcagaatttttattttc

SEQ ID NO: 46559 - DNA, 201 bp, Homo sapiens
tggttttagagacgaggcaggtgaataggtatagactgaatgctcctaagctagatgataatgaccaaatgattactgagacagggatgagcgatggtcartgaaattgaaaggatattttagcagctgctttaacaagtatctgggaaaagtccggtctcttccttgcatttctgaacgttaatttgtattaaaagcagc

SEQ ID NO: 46560 - DNA, 201 bp, Homo sapiens
tctttgtatgttttggaccatatcaggtatatcttttgcaaatattttcttgcaaatggtagtttctcttattctcttcacagtgtctttcacagagaagrtgatttttaattttaataaaatctaaaatgaatttttatttcatggatcttgactttagtgttatatataaagagttactgcaaactcagggttatttag

SEQ ID NO: 46561 - DNA, 201 bp, Homo sapiens
aagttatgtggttttttttctttcatggcaatggcgcctccagcctcacctttttcaaacccacatcttatcttcatatcctattttattgtagtgaaatmgtgaaatttctccttttgcttaaatacagaggagacttctatgtcatgtgtactttaaggccacagtgactagatatacactttggaggactttggaaga

SEQ ID NO: 46562 - DNA, 201 bp, Homo sapiens
gcccctcttgtgtcgcagaaggacttgacgactaccgctgcacggcttgtccacggggatatgaaggccagtactgtgaaaggtaccaacagccatgaaaygtacagagtaatgatatgtagggactatatggtaaagggtcacaataggaaaacattcattatttgaagaacttcaatatttgcatatcctttagaagtt

SEQ ID NO: 46563 - DNA, 201 bp, Homo sapiens
gagaccctgcctctagagaaaatgaaaaataattaggcaggcatagtggcacatgtctgtagtccctgatactcgagaggctgaggtgggagaattgcttragtccaggagtttgaggctgcagtgagccatgatcttgccactgtgctccagcctgggcaatggagcaagaccctgtcttgaaaaaagaaaacaaaaaca

SEQ ID NO: 46564 - DNA, 201 bp, Homo sapiens
tataatgtatctttaatttactagctgattttaaaatattctcattaggccgggcacagtggttcaccccaggaatcccagtactttggaaggccgaagcrggcaagtcgcttgcggtcaggagtttaagaccaacctggccaacatggtgaaaccctgtctctattaaaaatacaaaatttagccaggcatggtggcagg

SEQ ID NO: 46565 - DNA, 201 bp, Homo sapiens
ctgtttagagacctaattgaattcttgccaagtttgggcatgatccagagctgctccaattctcggtattttccatgctatgtattttcccctattctaasatgtatatagcattgatacctctatctgcagaatgtaagaaattgtaactgtatacatgagagtatattataaatgcagtagttcctgctccttggcgtg

SEQ ID NO: 46566 - DNA, 201 bp, Homo sapiens
cacttttatatatgtattccttgggtttccttttgatatttctcactataacaggagattatttttatatgaaataataaaaaaaatatacttaaaaaacrctgttatctatactgttaattattttagaatatcacatgtaaattaggtggcagaagccatagcagatttgcatgtcttagaaaatagcaggtaatttcg

SEQ ID NO: 46567 - DNA, 201 bp, Homo sapiens
tcacacagaacagcaagaatgaatgcaatgttgtcgaacctacatgatgggaatacttcaagggagtattccgtgttttcttatgaccaaaattggccaaytgaaatgaggcttgttgggtctgacacttaggaccacactggtaacattcatgataccggtctcagtgtcctggggcagaattaatctcaagcttttaaa

SEQ ID NO: 46568 - DNA, 201 bp, Homo sapiens
tcaggggaaccaggcagggccaagttggtccagtctcctccaactgtgagcattctaatctgttcaccccagtgtgccatacaatgttgtcattttccctrtgcatcatgttgagaaatgattctgaatcactttgaaaaaaatcacacagaacagcaagaatgaatgcaatgttgtcgaacctacatgatgggaatactt

SEQ ID NO: 46569 - DNA, 201 bp, Homo sapiens
cattacagggaaagtagaatggaaagagaagatggcaagaaaattgaagaaaaggtcagaaagtaaatgaattgatggattattagtttcaggttcattargcaagatgacaaagcctgatggagggaaactaccattggttcagggactggtggccttgaaaatttcatagagaatgtgagaaagcccaggggcatgaac

SEQ ID NO: 46570 - DNA, 201 bp, Homo sapiens
tgattaaaattagtggtcgtgtgtatcacagaatatcagaaaacatgttaagacaccaaagaaggcaaccaccagaaacctttcctattaatgactctggktaatttctttcttttttgttttgttttgttttgttttattttgagacggagttttgctcttgttgcccaggctggagtgcaatggcacgacctcggctca

SEQ ID NO: 46571 - DNA, 201 bp, Homo sapiens
ctacaattagaaagtgggtaagtctcattcttaaacatatacttttgcattatagtcacatgaaaccactgagcgtgttcatgtgtgtgtgtgtgtgtgtkagagagagagagagagagagagaaagcccaagagtgagagtttgtcttgaggagaagtgtttaaaaggaatatataaatcaaggatgcactatagtatca

SEQ ID NO: 46572 - DNA, 201 bp, Homo sapiens
aggcgttgtgccttttttcttggagctggttaaagagaggcatgcatagtcccctcattatataatttaggaatgcagaaaacattagtatatttcagcarttgacacttgtttgattaaaattagtggtcgtgtgtatcacagaatatcagaaaacatgttaagacaccaaagaaggcaaccaccagaaacctttcctat

SEQ ID NO: 46573 - DNA, 201 bp, Homo sapiens
aactagataaagcaaagaaaaatctgtcaattactcagccagtttcatcttagtagcctactgtaaattgaggtctatgtttttgagtgaatgaaatctartaaattaagttcaccaggtcttattctagtttattttagatggaaatgtatgatttttaaaagtgggagtaaaatcttacacatatttctgaaatgttaa

SEQ ID NO: 46574 - DNA, 201 bp, Homo sapiens
tttgagatagagaaacctattgatttatgtatgacaattattaaacatgctttatctcaagtaatcctcagatccaccctatgaaaagcagaacctaccaytgattgagtgcttactatctcctgtacacttcctaatacagttacaccaacatcatcgactataatttatgatccccattttacgggtgagagaattgag

SEQ ID NO: 46575 - DNA, 201 bp, Homo sapiens
aaagaaaattgaaaggcgttgtgccttttttcttggagctggttaaagagaggcatgcatagtcccctcattatataatttaggaatgcagaaaacattastatatttcagcaattgacacttgtttgattaaaattagtggtcgtgtgtatcacagaatatcagaaaacatgttaagacaccaaagaaggcaaccaccag

SEQ ID NO: 46576 - DNA, 201 bp, Homo sapiens
tctttaagaatgttgaatattggcccccactctcttctggcttgtagagtttctgccgagcgatctgctgttagtctgatgggcttccctttgagggtaamccgacctttctctctggctgcccttaacattttttccttcatttcaactttggtgaatctgacaattatgtgtcttgaagttgctcttctcgaggagtat

SEQ ID NO: 46577 - DNA, 201 bp, Homo sapiens
gaaatgtctctcttctcagtcctcaggtggaagatagtgaggggactattcaatttgatggagaaggttatgcattggtcagccgtcccattcgctggtamcccaacatctccactgtcatgttcaagttcagaacattttcttcgagtgctcttctgatgtatcttgccacacgagacctggtaaagatcatatgcatag

SEQ ID NO: 46578 - DNA, 201 bp, Homo sapiens
gtagtttcattgctcttttttttttaaattataaaatgtataaaatgagagctttttctcacaatttacattttttatcccaaaaagaaaattgaaaggcrttgtgccttttttcttggagctggttaaagagaggcatgcatagtcccctcattatataatttaggaatgcagaaaacattagtatatttcagcaattga

SEQ ID NO: 46579 - DNA, 201 bp, Homo sapiens
atttctccttcacttatgaagcttagtttggctggatatgaaattctgggttgaaaattcttttctttaagaatgttgaatattggcccccactctcttcyggcttgtagagtttctgccgagcgatctgctgttagtctgatgggcttccctttgagggtaacccgacctttctctctggctgcccttaacattttttcc

SEQ ID NO: 46580 - DNA, 201 bp, Homo sapiens
agaaaaaagattagattctatttattatgtaaattacaaacattaggacacatttctcttaatatcttcttccacgtatgcaatccaactgatatggtttwaaaaaaaatcttaaacccacattccaaacaaataagaaatagggtataagtaatcaggtaattatgaaactctaagaatcagccattgaaactgtaaaaa

SEQ ID NO: 46581 - DNA, 201 bp, Homo sapiens
aaatgcttaattttatatgatgtgaatttcatctaaactaatgacaagaaaagtaaatgcctgtgacactgcatttttcattgacagggttcctcagtgargggggaaaaaagcatttaatgattttcaaatgacacatgtaacctaaacactataggacagtgatatttgcctaatctagaaccttctaccaggttgtcc

SEQ ID NO: 46582 - DNA, 201 bp, Homo sapiens
tgttatgccacattatagaagccgtgagaagtgacataaaagttctagaaagaacaatcacctctagtagggcctgaagatttcctgaagggaaggatttsagccaggcattgaggtgggatagtgctggggagttgggggtggagtcaggtaacagggagagtattctgagaagagggaatgacttaaaccaaggcagtg

SEQ ID NO: 46583 - DNA, 201 bp, Homo sapiens
tttttttttaggcagagtttcgctctgtcgcccaggctgcagtgcagtggcgcgatctcggctcactgcaagctccgcctcccgggttcacgccattctcytgcctcagcctccccagcagctgggactgcaggcgcacgttgccacgcccggctaattcttttttttttttttttgtatttttagttgagacggggtttc

SEQ ID NO: 46584 - DNA, 201 bp, Homo sapiens
tgctcgttagttgtttcagtttcttcctagcatcgatggtctttacaatttggcatgtttttgcagtggctggtactggttgttcctttccatgtttagcrcttccttcaggagctcttttagggcaggcctggtggtgacaaaatctctcagcatttgcttgtctgtaaagtattttatttctccttcacttatgaagct

SEQ ID NO: 46585 - DNA, 201 bp, Homo sapiens
gcatccgccttggtggccagcagttcttactggacaaaaacatcaaaccctaagagcctgaagtagttacttaagcaaataggacaagcaactgaactgaktttttcttctgggaaagctttcttcacacaggtacagaaataggctaaaggtcaggaagtagggtgagatattttaggagtcatttggggtttccagaat

SEQ ID NO: 46586 - DNA, 201 bp, Homo sapiens
gattcccaaatctaacaagttatttggtaattgtgaatcactgatcaacaaaaatctaccatcactcctgagaaaggaactgaaaaatgcaggccatagcragaatcagttgcttctttcttatggttacaagatgccatatcatatgctataaaatgtctatcggtaatttttaaaactgtgattattatgagtcaatag

SEQ ID NO: 46587 - DNA, 201 bp, Homo sapiens
ggttcattaggcaagatgataaagcctgatggagggaaaccaccattggttcagagactggtggccttgaaaatttcatgaagaatatgagaaagcccagrggcatgaacggagttgtggggaggaggtgcgagtgtgtagatgtgtgtttaggatgggctgtgcagacggggagaattagagagataaaatatgtaaaac

SEQ ID NO: 46588 - DNA, 201 bp, Homo sapiens
aaaaagacaaattcttggaccccatccctaaatgaccaactcagaaactctgagaatggggcccagaaatccgtgttttaaaaattcctccagtgattaaratgcagcttcaaggttgagaaccacgggtataaacactaaaacaccatctctgattacttcaagtaacttgtatttagtgggaggtacacataagcaaac

SEQ ID NO: 46589 - DNA, 201 bp, Homo sapiens
catttaattatgtgctcttagagtttatttaaaatttattttcatgcactaaaatgatttggagatacaaatagtgaaaagtatatttcttgtaatgtttygtagtaatttttatttggtttcaacagtcaatgaaaataggttaataaaatgtctagtatttcataataacctactgtgtgttacatattataccaagaa

SEQ ID NO: 46590 - DNA, 201 bp, Homo sapiens
gaatgctccatgtagatgctaaagtcatctaaagatttctggctaagaaatctttatatctatatatctctatctgtatctatctttctgacatgccttcytctcttctcctcgcttacctctctctctctgtatatatataatatatatataaaatatatatagcaggtagatatatacttatatgtaatctacataaag

SEQ ID NO: 46591 - DNA, 201 bp, Homo sapiens
tgtgtcagtgatgagcccccttagagcagcagcctcagcgtaacctagcaacttgtcaaaaagacaaattcttggaccccatccctaaatgaccaactcaraaactctgagaatggggcccagaaatccgtgttttaaaaattcctccagtgattaagatgcagcttcaaggttgagaaccacgggtataaacactaaaac

SEQ ID NO: 46592 - DNA, 201 bp, Homo sapiens
gctataaatttccctctacacactgctttaaatgtgtcccagagattctggtatgttgtatctttgttctcattagtttcaaagaacatctttattccagmcttcatttcgttatatacccagtagtcattcaggaacaggttgttcagtttccatgtagttgagccgttttcagtgagtttcttaatcctgagttctagt

SEQ ID NO: 46593 - DNA, 201 bp, Homo sapiens
tagtgagccaagattatgccactacactccagcctgggtgacagagtgagactctgtctcaaataaataaataaataaataaataaataaaaagaaaaaaraaaagaaaagaataggaagagcaaatatattaagtggaagtggatcattgtaaaggtcttcatcctcgttgtcttcattttgagcagactaaagaggagg

SEQ ID NO: 46594 - DNA, 201 bp, Homo sapiens
taatgttttgtagtaatttttatttggtttcaacagtcaatgaaaataggttaataaaatgtctagtatttcataataacctactgtgtgttacatattayaccaagaagtttatattcatttccttttaaatcaagctcatggtgtatggactattatattatctccattgtatagaagaaaaaattgaggcctagaaag

SEQ ID NO: 46595 - DNA, 201 bp, Homo sapiens
ttcattggtaatttatgtgccagatattgtgcctgagatccaggaggaataaggtaggatatcgtctttgagctactgatatatagtgtggtaagtacaarggaaagaatgagcacagcgttctgcagaagagagaggatggccacaaaggcttggtgtaagtaaaggcttgccagaaggagcgatatccaagctgatgac

SEQ ID NO: 46596 - DNA, 201 bp, Homo sapiens
attgtgtcagtgatgagcccccttagagcagcagcctcagcgtaacctagcaacttgtcaaaaagacaaattcttggaccccatccctaaatgaccaactsagaaactctgagaatggggcccagaaatccgtgttttaaaaattcctccagtgattaagatgcagcttcaaggttgagaaccacgggtataaacactaaa

SEQ ID NO: 46597 - DNA, 201 bp, Homo sapiens
tccattccccattgcttgtttttgtcaggtttgtcaaagatcagatggttgtagatgtgtggtattatttctgagggctcttttctgttccattgatctayatctctcttttggtaccagtaccatgctgttttggttactgtagccttgtagtatagtttgaagtcaggtagcatgatgcctccagctttgttcttttgg

SEQ ID NO: 46598 - DNA, 201 bp, Homo sapiens
catactgataacatagtagattaacatatatttgtgtgggtattatatattgtattcttataataaagtgagctagagaaaagaaaatgttattaagaaartaataagggctgggctcagtggctcatgcctgtaatcccagcacttcgggaggccaaagcaggcagatcacttgaggtcaacagttcaagaccagcctgg

SEQ ID NO: 46599 - DNA, 201 bp, Homo sapiens
agaccattaatgtcttaattccagcttgctgagaacctctggccaaaaaaggatcaaatgactccattgtagacattctcttttacttcatttggggccayagtgttgattcaggatcttttttctcatttctacttgacttcttgtgaagtgttctgcagttaaatctttcaaaaattttcttactttcatagtgctgtc

SEQ ID NO: 46600 - DNA, 201 bp, Homo sapiens
ttccttccttccttccttccttccttccttccttcctttctttctttctctctctctctctctttctttctccttccttctttgcttccttccttcctttytctctctctctctctctctctttcttgacagagtcttcctctgtctcccaggctggagtgcagtgatgtgatctcagctcactgcaacctccacctcccg

SEQ ID NO: 46601 - DNA, 201 bp, Homo sapiens
aaacgtgctagacaccaaaattgattgtgtcagtgatgagcccccttagagcagcagcctcagcgtaacctagcaacttgtcaaaaagacaaattcttggrccccatccctaaatgaccaactcagaaactctgagaatggggcccagaaatccgtgttttaaaaattcctccagtgattaagatgcagcttcaaggttga

SEQ ID NO: 46602 - DNA, 201 bp, Homo sapiens
aggagaatcgcttgaacccaggaggcggaggttgcagtgagctgagatcgtgcctctgcactccagcctggtgacagagcgagactccatctcaaaaaaawaaaaaataataataataagggtaaatacaaggagtgtgttttgaatacaaaatatctatttttagaatctcaaacccatgagttactttcttccatatat

SEQ ID NO: 46603 - DNA, 201 bp, Homo sapiens
gatccacccttatcaaatgaacatatgttataacatgcattttgaattctaaatacacccttaagtttatcttttttttagtatttttttctctttaaccwtgctttattcttaatgcacatattttgacagatagaattaaattctttttagaacaaggttaattgtttctctatgtatgcattcacatacataaacata

SEQ ID NO: 46604 - DNA, 201 bp, Homo sapiens
attgtgtatatgtactgcaaattatacagaaaaaaaattttaattttccaatggattcttatcctttcatcctttcatttgtgatgttaacacttgcaggwtgagaagttagatgataatagttggactttatattccttcatttgtgcaaaaccttgaaaactttcataaattaaacctcttgctgcccttggaaaatca

SEQ ID NO: 46605 - DNA, 201 bp, Homo sapiens
acaaggcaaagaagcatggctggagtgaaacatgttgctgaaagctaaagctagcacctgagttctctgttggttcttcatctggtgttcagctctattgyttcagacccaaattagaaatatgtgcaaagagagaagtgaattttgaaacatgccagagggtatgagatggcaaggttgcttttgtttggttaggtttat

SEQ ID NO: 46606 - DNA, 201 bp, Homo sapiens
caactttagagaatatttactataagttaggcatcatactaggagctggatatatgataaacaaaacagaccaagttctcacccccttagagcttaccttwcagttggagaggttgtcaataaataggtgagccaattactaagtaattctcaaatccatggtgctatgaaggaaacgtcctgctgcaggaagtgtggaaa

SEQ ID NO: 46607 - DNA, 201 bp, Homo sapiens
aaagaaaaaagaaaaaaaaatccaaagttataaatgcacagtcttacatacttctcttctgggaatttattctgtaagtatatatatatatatacacacayacacacacacacacacacacacacacacacacgtgtgtgaaatgacatatatgcaaagtgattcattccagaaatgtttgtaattgtcaccacaaagctg

SEQ ID NO: 46608 - DNA, 201 bp, Homo sapiens
agttgtgaccagggtatgagaaatgcagtggccacaacttccaattacccatgactacattagaggagacagtgctctagactaggactgcacattggaawtaccaggagccctatctcacacccataggttgtgatgcagttggtctggggtagagtcagaccactgggatattcaagaactccccagattatactgata

SEQ ID NO: 46609 - DNA, 201 bp, Homo sapiens
aatggcatttcattcattcattcacttaactaatactttttgggagtctctcatgttctaggaattatgacactggggatagaagtgtgagcaaaactgcrcagtccttgccctcattggcttagtatagtctaatgatctgacgttagagacacaagaagtatttcttttttttttttttttttgagacagagtcttgct

SEQ ID NO: 46610 - DNA, 201 bp, Homo sapiens
gaaatcagtagcacgcagaaaaattggggatacctggaaattgtcaatggctaaaaagtccagaatgacagtgtattttgagaactttattcagtagcctycgtggtaaagtttgtatctgttctgatttccaaaagcactatctttgattgtgtaaagagaaagaaaaacaaatgaaaatacttgtggtctctttcatct

SEQ ID NO: 46611 - DNA, 201 bp, Homo sapiens
tcccccttcgcttggcacttcttcttcctgctgccttgtgaggaaggtaccttgcttccccttggccttctgccacggttgtaagcttcctgaggtctccscagccgtgctgaactgtgattcaattaaaactttttcctttataaatcacccagtttcgggcagttctttatagccttgtgaaaacgactaatacagcac

SEQ ID NO: 46612 - DNA, 201 bp, Homo sapiens
gttagcgcctagccaggtctctatgttaaggcctgccgttctcttttttacctgtgatctgtgtctctgttaattggaatgggagccttaaatgggccagrcaaggagtttatcttaactctaccccttactgactgtgtgatctcgtgcacatttttaactgtcttcaagacagtttgctctttcatgaaatggaataat

SEQ ID NO: 46613 - DNA, 201 bp, Homo sapiens
gcttttcttgtgatagtgagtgagttctcatgagctctgatagttttataaggggctcttcccccttcgcttggcacttcttcttcctgctgccttgtgargaaggtaccttgcttccccttggccttctgccacggttgtaagcttcctgaggtctccccagccgtgctgaactgtgattcaattaaaactttttccttt

SEQ ID NO: 46614 - DNA, 201 bp, Homo sapiens
tgaacagtattactctattcatataggcattccttttttagcaatttatagtaatttttaaggtattattcaaaagaaaagggagctgttaaatacattartagtgatagccattggaaattatttccatttcatttcctgacaacttcatgaaaaggtacaatttattctgaaatgtatgttctgagtagaatgattaat

SEQ ID NO: 46615 - DNA, 201 bp, Homo sapiens
aacagtattactctattcatataggcattccttttttagcaatttatagtaatttttaaggtattattcaaaagaaaagggagctgttaaatacattaatwgtgatagccattggaaattatttccatttcatttcctgacaacttcatgaaaaggtacaatttattctgaaatgtatgttctgagtagaatgattaatat

SEQ ID NO: 46616 - DNA, 201 bp, Homo sapiens
caaaattgtattgataactaagtgctgatattccattttgagtatatgggttctgatacaatacacaaagaggagaatatttgaatgttgctcatcaaggrcattcttactgttcagctgaccctgcattttagcttcttgtttatttttcatggttttaacccaccattaagtagcatggtttttagcatgaaaaataaa

SEQ ID NO: 46617 - DNA, 201 bp, Homo sapiens
ttcctcttgaaaactaaaagaaaaatagtttcttagtttaagtgataccaaaaccgctgaaatttcaattgtaaaatttcattaaacaaccttaatgaagrtcattctcattagctccatgtaaaatcacctgcctaaaacgttcccatattgataatggagaaatgtatgacgttagaagtttgttagttgcatgcttca

SEQ ID NO: 46618 - DNA, 201 bp, Homo sapiens
actctggttcattttctatgcattaaggatgatgtaactttaaaacctctcatgtaaattctgcctgttttctaattctacaatcctcttgtttatgttcyattctaataattatcgagcttttaaagaagagaaatctgttcttaactcaaatttatacatacactgaaggaaataacaaaaccttgaagtaaaacactg

SEQ ID NO: 46619 - DNA, 201 bp, Homo sapiens
tttttaaggaagtttttcagcaaaagtgtgtgtgcatgtgtgagagagagtgacagagtgcttgcgtgtttggtggtgttgagggaattaagtacttaacygggtttaaggacatttatactcataaagtgcagttcttctttcagaaaagatacattctgttaaagaaggtgaaccttatttgataaattcattcttttg

SEQ ID NO: 46620 - DNA, 201 bp, Homo sapiens
aattatttttcatattgtgtagattcacatctctttaatcaatgggagaccaagtgccgatgatccttctccagaactgctagaatttacctccgctcgcyatattcgcctgagatttcagaggatccgcacactgaatgctgacttgatgatgtttgctcacaaagacccaagagaaattgaccccattgtcaccagaag

SEQ ID NO: 46621 - DNA, 201 bp, Homo sapiens
agtctctattgaattgccctgtcatatataatagaaaacaaatctacttagggaaaacataataagagaaagattaattgagggcatttccctttaaaacrgtagcgcaacagaccttacagaattcaaaatggttgatggcccttcagagagccagtcgagaacgcattaccgtgtgtcaatcttggggtaggggttcat

SEQ ID NO: 46622 - DNA, 201 bp, Homo sapiens
aacccatgagttactttcttccatatataagtcccaacatgttttctataatcagtctatgtctattagatgtgtaattatattaattatgtaaatgcacrtgaataccaaattatttggttaatcttcgaatttcttttagcaattatatactctcctccaggttagattgagctttcccttcaactcagagaaatcagt

SEQ ID NO: 46623 - DNA, 201 bp, Homo sapiens
ggtagggctggtgcttgttacagtggccagtaggcctggtttctggttatagcacatggcagagttaggagctctacctacattatgtccccacggcctcrtctgtggtttccccataagaaaactaccttttgggaaaacatgatacaaacagatcaggtgaattagaaggtctcctgcagatttaaaattttatgaata

SEQ ID NO: 46624 - DNA, 201 bp, Homo sapiens
tgattaaatggaattaggtgttgggaaaccactatgggtgagatgcaggagcacaaccaaatataatggataatcctgggcttgtcagaatcatcctgagwtgagattagtcagaaaatgtgaaaagccagggtgaccccaaatttatgaggactcaaccttcatatagaatgaggttattttatttactttgagtacgag

SEQ ID NO: 46625 - DNA, 201 bp, Homo sapiens
gaagcagctcatgcatgtctagtaggttcctggtagctggtaccctaagccctcagtaatcagtgttttgtcctgactaggtaggatgctttaaattagasgtgtagctgtaggcctgaccttggctgaagcataaagatgtaaaaacaaatcattatgcattcccagattcctcctttaaggttccttccatttctgggc

SEQ ID NO: 46626 - DNA, 201 bp, Homo sapiens
taaggaccaaaattcacttttatatatgtattccttgggtttccttttgatatttctcactataacaggagattatttttatatgaaataataaaaaaaawatacttaaaaaacgctgttatctatactgttaattattttagaatatcacatgtaaattaggtggcagaagccatagcagatttgcatgtcttagaaaat

SEQ ID NO: 46627 - DNA, 201 bp, Homo sapiens
tttctttctttctttctttctttctttctttctttctttctttctttccttccttccttccttccttccttccttccttccttcctttctttctttctctytctctctctctttctttctccttccttctttgcttccttccttcctttctctctctctctctctctctctttcttgacagagtcttcctctgtctcccag

SEQ ID NO: 46628 - DNA, 201 bp, Homo sapiens
atcaccattatctcaaatggcattagtaaaaaagaaaaaaaagtaaccattgtatataatcacacacaaattggttacatatgaagtttggctataaaatkcactttttaataaaaacatactggatcatatgcttctaaacaatttataccatgtttatgaattaatgaatttttatgaatttttgaattaaaaagctct

SEQ ID NO: 46629 - DNA, 201 bp, Homo sapiens
tcggggcatagtggacactggtgatgaatttggtgtcagatccagaacatgttgtctgtacccctcttacagcagtgattttcttccaccttgtaatatamttatctgaagtccgcctcatcagaaagtacatagggaaactatcgtgactctatttctccaagtagaaactgtgctaagggaactaaagcaaaaaagaaa

SEQ ID NO: 46630 - DNA, 201 bp, Homo sapiens
tctttctttctttctttctttctttctttctttctttctttctttctttccttccttccttccttccttccttccttccttccttcctttctttctttctytctctctctctctttctttctccttccttctttgcttccttccttcctttctctctctctctctctctctctttcttgacagagtcttcctctgtctccc

SEQ ID NO: 46631 - DNA, 201 bp, Homo sapiens
tgtgttaatttaaaaatatacggcactagaaatagcaaccctttaaaactaaagtgcattcaaatctacctttgcatctaattcagtaatgaattctgtcwagggttttattctgaatttttaaataatcttctaaagtttgaacccagataagccttaaaatactcattatattcaaatttttctgttcaattataaaaa

SEQ ID NO: 46632 - DNA, 201 bp, Homo sapiens
aaaaagaaaaaagaaaaaaaaatccaaagttataaatgcacagtcttacatacttctcttctgggaatttattctgtaagtatatatatatatatacacayacacacacacacacacacacacacacacacacacgtgtgtgaaatgacatatatgcaaagtgattcattccagaaatgtttgtaattgtcaccacaaagc

SEQ ID NO: 46633 - DNA, 201 bp, Homo sapiens
tcaggaaggtttcttttttcttttctttctttctttctttctttctttctttctttctttctttctttctttccttccttccttccttccttccttccttycttccttcctttctttctttctctctctctctctctttctttctccttccttctttgcttccttccttcctttctctctctctctctctctctctttctt

SEQ ID NO: 46634 - DNA, 201 bp, Homo sapiens
cattttcatagaaaaagctttccctttcctcacactgaatcacattactttgtgttcaaggtaaaatgtagtttgaaatctggatgtaaattagaaaagayattattttattccaagtgaaacatgtattcacacttcacgtcttgaagcaccagtggccatttgggctgagttttcaagaaaaaaaaattatatagattt

SEQ ID NO: 46635 - DNA, 201 bp, Homo sapiens
aaaaaaagaaaaaagaaaaaaaaatccaaagttataaatgcacagtcttacatacttctcttctgggaatttattctgtaagtatatatatatatatacayacacacacacacacacacacacacacacacacacacgtgtgtgaaatgacatatatgcaaagtgattcattccagaaatgtttgtaattgtcaccacaaa

SEQ ID NO: 46636 - DNA, 201 bp, Homo sapiens
agtaaaatatcaagccatgagatttagtcaggaaggtttcttttttcttttctttctttctttctttctttctttctttctttctttctttctttctttcyttccttccttccttccttccttccttccttccttcctttctttctttctctctctctctctctttctttctccttccttctttgcttccttccttccttt

SEQ ID NO: 46637 - DNA, 201 bp, Homo sapiens
gaaataaagagtttaagaatgagtcatagatgaccagtttgaatgattgatcagttggttgtggtgtcatttactgagctgaggaatagttggtgtgtgtkggggggtgggggcatggaatccatagtccagtttagaaattttcgatttgaaaacgctgtgaagtgtaaatgtcaatgtgtatttataatattcaggtct

SEQ ID NO: 46638 - DNA, 201 bp, Homo sapiens
aaaaaaaaagaaaaaagaaaaaaaaatccaaagttataaatgcacagtcttacatacttctcttctgggaatttattctgtaagtatatatatatatatayacacacacacacacacacacacacacacacacacacacgtgtgtgaaatgacatatatgcaaagtgattcattccagaaatgtttgtaattgtcaccaca

SEQ ID NO: 46639 - DNA, 201 bp, Homo sapiens
aacagaaaaattatgaagtctctcaatggccaactaatgaatataaaaatactatttttcaaatgtttatactggaataagcacacaagacagcagaaaaycttttatttcatgcagaagatccataatgcttttctgattgatgtagagacttttagtaaaagagtaaattaaggaccaaaattcacttttatatatgta

SEQ ID NO: 46640 - DNA, 201 bp, Homo sapiens
aaggaagttttagggtccatttaggaaaaagaagtccagtttgcccagagtaattgataaaggaaacacataaccagaaagatcaacagaggccaggtctygtcaggccttcaataatcagttaagcaatttcatttaacaacactggtacttgggataagcctcactggttaggataagctgaaagctttgagcatggaa

SEQ ID NO: 46641 - DNA, 201 bp, Homo sapiens
gattataattattattattatatgcagatgatacagacaaacatttatgagtccaatatttataatctaattattcgtttattttacaaatacattgagtrcctactctgtccctactatgtgccaagctttgaggataaggcagaaaatacaaattcaagatctagagatcttggtaaaaaaggcagaaaacacaaactc

SEQ ID NO: 46642 - DNA, 201 bp, Homo sapiens
aggttgtgtttaaaatgttgtacatttttttaattttagcattggtaaatttactttgtttttattttaacatagtattccactgaaatgtaattatactscaaattatttatcatatctccactgacggtccttcaggttatttctaacttttcttgattataagcaatgttgtaatgactatcttgtacaagtatgttt

SEQ ID NO: 46643 - DNA, 201 bp, Homo sapiens
aatcgcttgaatccaggaggcagaggttgcagtgagcagagatcatgccactacactccagcctgggtgacagagcaagggattccatctcaaaaaaaaaagaaaaaagaaaaaaaaatccaaagttataaatgcacagtcttacatacttctcttctgggaatttattctgtaagtatatatatatatatacacacacac

SEQ ID NO: 46644 - DNA, 201 bp, Homo sapiens
tggagtaaatgcctttcttatttgttcttaaaagtagttcacttattgataaggaaatagatgccaagtgaaaaagaggaaccttgtccgggaagcattaygttttgagatgggaagagtgagggcaccagagcatgaatgttgatatgagctaacacaccaatgagaaccaggacttgtcacacattcattccaaccaac

SEQ ID NO: 46645 - DNA, 201 bp, Homo sapiens
gtataatcagagctgtgctttttaaatataaatccagaagcagtgtatggggtagatgaaagaaagaagaatgaaggacccaactatagctgtggcaagakaaaagaagaacgtgatgtaccactcctatattttgcaatgttaacttggaagaagcaataagagtaaatattattttgtgaatctcacatttagccacat

SEQ ID NO: 46646 - DNA, 201 bp, Homo sapiens
gacatatgtataaggagggagaaaagaaagaaaagattctttgggggcagctctttgggagatcttaagaatgactgagacaagaactgagttgtcacttkatcttttgaattcatttacctgtggaattttttggagtgattacaacaaagatttaaactatttataattgcaatttttactgtactattatcttttttt

SEQ ID NO: 46647 - DNA, 201 bp, Homo sapiens
tatttctcatcccatagtcaccaattcaaagccagacttaccttgtttctcctagtgttttctaatgaattaaatgaactggggggatctacagctctgtktttagccactcccagtccacaactctttcccgcaggtatctccacaatcgcagtaacatcagacagataggtaggtagatagacagatacataaaaatag

SEQ ID NO: 46648 - DNA, 201 bp, Homo sapiens
tttataaaatcgccagatattatgagacttatttactatcacgagaacagcatgagaaaaacctgccctcatgattcaaatacctcccaacgtgtccctcycacaacacatggggattacaggcgctacaattcaagatgagatttgggtagggacacagccaaaccatatccaccattatgtttattcaatgtgtaacct

SEQ ID NO: 46649 - DNA, 201 bp, Homo sapiens
cagttagttagcgcctagccaggtctctatgttaaggcctgccgttctcttttttacctgtgatctgtgtctctgttaattggaatgggagccttaaatgkgccaggcaaggagtttatcttaactctaccccttactgactgtgtgatctcgtgcacatttttaactgtcttcaagacagtttgctctttcatgaaatgg

SEQ ID NO: 46650 - DNA, 201 bp, Homo sapiens
gctcggcttaacttcaactttctcaggaaagctgcccctgcatcctcaagtcatatcattctcatggcataatcacttttcaaacctttttcttttcttttatgatctcataatgagtaattctgttttatgtctatcttacctctggtgatgatatggaccctatatattttctttaccattgcacaataagaagataac

SEQ ID NO: 46651 - DNA, 201 bp, Homo sapiens
gcacagggagtcttacccatacctgcaaaacaggaatgaggccatggtcagggtcagaactagtcagtgctgagggaggaggcaaaaatccgagagaaaargtgacaatgccctggtgaagttttagaaatgttagcacctgcctgagatggcttttgtgtaagtaagctggctgtctttgaagggggcagatggagctag

SEQ ID NO: 46652 - DNA, 201 bp, Homo sapiens
cacttgacaagtttatgtgactaacgtgctcagtctgccataggctcaaacacacaggcaaatgtaggcactgagatcaggtggccatattcatctctcargtgcctagcctgggatccagaaatgcttacattaatatttaaggttatcatcaaaatgaaaacacatgattagaatcttgtactaaagagctagaactag

SEQ ID NO: 46653 - DNA, 201 bp, Homo sapiens
aaagtacacaaaaggaaaataactacaaaaggaaaccagtagccacaaaaatgaggatatttgtacacaaagaactagaaagggtagtctgaaataaatttgtattcataaaaatctgtgatcatattcttatcacataaatcataaaaatatgtttaaaatgtacaattataaaagcatgattagaagattgaagaataa

SEQ ID NO: 46654 - DNA, 201 bp, Homo sapiens
aaacatatgcaatgatgtgattttttgccttaaatattaatatgcatttaaaagaatttaacagggaaaaagtctattgacatcaaatgtacttatactgwcttttatcatctccaattttctattaatcacatgtagtggatttttttttcattctagatactgtgttacatttttcagtcacagaatttatattcaata

SEQ ID NO: 46655 - DNA, 201 bp, Homo sapiens
ctccaattctcggtattttccatgctatgtattttcccctattctaacatgtatatagcattgatacctctatctgcagaatgtaagaaattgtaactgtwtacatgagagtatattataaatgcagtagttcctgctccttggcgtgcagatacacctcattactctgcaatgcaaaactaaaaatatacatgtttttta

SEQ ID NO: 46656 - DNA, 201 bp, Homo sapiens
ttccaacactatgttgaataggagcggtgagagagggcatccctgtcttgtgccagttttcaaagggaatgcttccagtttttgcccattctgtatgataytggctgtgggtttgtcatagatagctcttaatattttgaattacgtcccatcaatacctaatttattgagagtttttagcatgaagggttgttgaatttt

SEQ ID NO: 46657 - DNA, 201 bp, Homo sapiens
aagtgacacttgagcacttgacctgaacacctaggaaccaggtgggagaagaccaagggagaagaattctaggtagagaagacagcaagcaaaaggacctyttccaaatccttgctcccttgaagattgagcatccctataatttatcacctggtccagtggttttatcctttggctacatggtttttcaattactggaat

SEQ ID NO: 46658 - DNA, 201 bp, Homo sapiens
atgtttggctttcaagcttaccttgcttgattcacaaagcttctaggaactataaattgagattttattccacatttaggaaattttaggctattttttttatttttacttattttttttaggcttttgtttaaaacctgttttttgaccagtgtttttccttctctttctaggactccagctgcatgtgtgctagggcgt

SEQ ID NO: 46659 - DNA, 201 bp, Homo sapiens
cctatacacatgatcatgaatatcattaactggagttaaatactgctaatttttttcaagctcaaatttatctacattgaaatgcataaattatcaccccrtgtaacattcactcactgaatgtaatatttaattaacaaatacatacaccattataatacaaactgctatcaagaatattatcatcatcccagaaatttt

SEQ ID NO: 46660 - DNA, 201 bp, Homo sapiens
aaacttacctttcacttatggaaatgtgcttgtactttgttccccaaaaagcaaatacagataccataagacatgggataataataaacctttggacacaraaacataaaatggaatgtatgagcccttgaaagagcaattaaatacattttcatttcaacagctgaagatgaggaaccaaaacagatgggcaggggatag

SEQ ID NO: 46661 - DNA, 201 bp, Homo sapiens
tcaacacagtatcatttcagtataaaatctcatattttgaataaaacaaacatatctttacacattattaaatgaactacgctgacaaattttgtttcttyttttgagaaccagaaaaacaattatacttagatgggccatctaaaatgtccttccagcttgtggagtaggttgtgtttgtttttcaatgaacatctgttt

SEQ ID NO: 46662 - DNA, 201 bp, Homo sapiens
tgaagtctttaaaattggctgctaaaaccaataaaattatatttttggaacatagttaaccactttgtgcacataagtgaggctgtagaaactagggttttaaatgacttaaaagatatatatttctccaaactataggtaattatatcaatattactttgacagagatatagtaattctccatcttatagtaaaatttat

SEQ ID NO: 46663 - DNA, 201 bp, Homo sapiens
attactgcactttatcaaagaacagttgtttacagaatgtgaatattccatgtctctacacactcttcagattttccctatgatagtaaattacatttggwtttaatttgcattccatttccaatgtttgttgccagacactttggactttttgagggcaaataaaagtagcttctggtgtaagtgaaatattttgtgtca

SEQ ID NO: 46664 - DNA, 201 bp, Homo sapiens
ctttcctctctattcaaagaaatgacaggttaaaaggtcttcttaatgactctggaatcaaatttttatttgagaagatatttattttaaaatagaatgaytaaatacatcttaataagccctaaatatatgctaatgtaaaagtttctttttgaaggggaaaaagggaagtgagaaatagaaaattcagatccagggaac

SEQ ID NO: 46665 - DNA, 201 bp, Homo sapiens
cattgttatcatcattgttattatgtgaccatttttttccccaaagacctgatgttttgtgcaacgcatcagtttctgatgaaatattttctttagtttargctgactttcagtttcctgttactatctctaattctaggttcttcaagtcactgaaaaccacttttatggccaccttacatttctcctgtctttaagccc

SEQ ID NO: 46666 - DNA, 201 bp, Homo sapiens
gtaaatgtggaggagaaaaaagagatgaggaccaaagttagaattaagggcgtcaattatattgaacagaaagggaaggaagagtcgataaaggagaattygagtagccgcagaagtaggagaaacatcaactggcttactcttaaagaagccatgggggctgggcacggcagctcccgcctgtaatcccaacactttggg

SEQ ID NO: 46667 - DNA, 201 bp, Homo sapiens
ttaaggaagtttttcagcaaaagtgtgtgtgcatgtgtgagagagagtgacagagtgcttgcgtgtttggtggtgttgagggaattaagtacttaaccggktttaaggacatttatactcataaagtgcagttcttctttcagaaaagatacattctgttaaagaaggtgaaccttatttgataaattcattcttttgtta

SEQ ID NO: 46668 - DNA, 201 bp, Homo sapiens
agcctaaacctctcctctcaccccctcccatccttaccctcagttgatggtgttgcctcttatttcattgagaatttagaagctgtcagaagagaggtaamaagctcccactactgcatgcacccacttttctgcatctgtgcccaattattatgactcttttctattactttggatgaattattcttgtttccagaaaag

SEQ ID NO: 46669 - DNA, 201 bp, Homo sapiens
agccaagatcagactctgagtattgattcgagatctaatgaatttggaatgttagaaactaaacagccagttttctcttaaattcttaaaaacaagtctcygcattttatatcttttaaatctggaattaccagaaatgtgatgcatatttcattttctgtatgttcctccccttcacttcaacacgtacccttgaagaac

SEQ ID NO: 46670 - DNA, 201 bp, Homo sapiens
gagataagtggaaggaatgaagatgtatttagggtatttcctgccctacaacagcctatagtctcattgctattcagtgatgcattgaataatgacagacygaatagatatgatctgattcatgtgaaatgtctctcttctcagtcctcaggtggaagatagtgaggggactattcaatttgatggagaaggttatgcatt

SEQ ID NO: 46671 - DNA, 201 bp, Homo sapiens
acatccttttccagctgcatttccaacaggaaactctagagaaacctctcatatgggacaaaaactggctttgcaattctttattttggagtgctgctgcrtacattgttcctgtgtaagagaggcacaatgcacatttgcatgtcagaagctctgtgtagttagttgttcagtaagaagaatgtttagctgtttaaccca

SEQ ID NO: 46672 - DNA, 201 bp, Homo sapiens
ggaggtcattatcctaagtgacataacccagaaacagaaaatccaataccatatgttctcacttacaaggcgagaagctaaacaatggatacacgaagacrtgaagatggaaacaatagacactggggactccaaaaggggggagggaggagaaggggtgaagatttaaaaatcgcctgttgggtacagtgttcactgtgt

SEQ ID NO: 46673 - DNA, 201 bp, Homo sapiens
attttaagtagagatgtgacagggtaatttcaatttaagtatattactcgaggtgtcagtgtggaagacatattgtcagaagaccaaactgaagacaaagygaacaattggattcaataatagtctaggcaggaggtaaattatgcttgaagtaagagatgcagtgggaattgacatcaaagaaatgcagaataaatccac

SEQ ID NO: 46674 - DNA, 201 bp, Homo sapiens
aaagatttctcttttgcaaaacagggtaatgataatactaaacaaaaaggattgcataaagattaaatgaggtaatttatttaaagtgattgggttgggcrtggtggctcacacctgtaatcccagcactttgggaggccaaggcaggcagatcacttgagaccaggagttcaagatgagcctggccatcatagcaaaacc

SEQ ID NO: 46675 - DNA, 201 bp, Homo sapiens
attgttatgagcacaatttctacccagattttgttggttcttttcaaatccatcaagtaaaacagtgtgcgtatgatttgtgaatactgcagttgctatartcacaataaaagagggtttcttgcaagaaactatgtaaaacaacttttatgaagaatagctgtccttagccccagataaaaactactgtcagccacaggt

SEQ ID NO: 46676 - DNA, 201 bp, Homo sapiens
tcaacaatgatgttaatgaatattatcatcattatatttcaaaatgtgaaagcagtgctagctcaagacactcaaatgtttataatatttttgcattgttraaaatgttgaaatttctctcacgaattacaagaggcaagtcaatctcagatatatgacaagtcattgactataagtgctgtctgactctcagtatttgtt

SEQ ID NO: 46677 - DNA, 201 bp, Homo sapiens
aactaaacaatataattgtatatgcggtaagtgctatgaaggaattaaacaaggtgacacaacagaaagtagttgtgtcgggcaattttagataaaatggygagtgaatgctgtgcatggaggtgacatcttgccagagacaggagaatgagaaagagtttggcatgtgaagatcggggaaatgagcacatggggcagagg

SEQ ID NO: 46678 - DNA, 201 bp, Homo sapiens
aattaccataaatatggtaacttgcgtccttcatttatcagaactttgtaatattttacctcagtcccacctccccatcagatttaattctatagttctcwtatgtttaattctatgtatatattaaactccataggaagtaattgttaccatcataaacatgcagttttcatctaattttaaacacctttaacttttttg

SEQ ID NO: 46679 - DNA, 201 bp, Homo sapiens
atttcacctgaatcaggtttcggttgagacaataattttctgagtatgtctccacttcacaaaattaatttattttcaacttttctctagttttaccactsttttgataaataatcttacagtggaggaagacttattgaaacaatttcatcacttttttttctcttgtttgcctcagagtatggttgattcattctctcc

SEQ ID NO: 46680 - DNA, 201 bp, Homo sapiens
tatatataataatatgtacctatgtgtatataatatttacactagaaaggcaagaaataagaaaatgtatccaatcataaaaatgggatggaggaatgatrcaaagattggggtagaaaataatttagttctccactcaattatttttattcttggctggaaaaatggatgagatgcattgtcagattgagtccaaaagct

SEQ ID NO: 46681 - DNA, 201 bp, Homo sapiens
ttggaatttggactgagttttgaacagaagagaatttcgatgggcagatcaggaaaagagcagttcaggaggagggaatggtggactgtggagcatgggcraccagaaaggcagattaagttaaaacagggttgacaaattgggagaacacaggattaagggactggaatttaagtttagatttgctttaataaagaaaaa

SEQ ID NO: 46682 - DNA, 201 bp, Homo sapiens
tgaaaaaatatatttgcatagttgtgcagaaacattaacatgcaattatgtcttgatactagatacaaaatatctgaaatggaagatggaagatttagtgrgatcttttaccaataacttcaacagaagatttgtgttttagaatgtgtcctagagacaggaccttcttcctagctaaatattagagataaaaaattaaaa

SEQ ID NO: 46683 - DNA, 201 bp, Homo sapiens
aaaatgttgacttatttaggacattatgttacctatttattccaaaatatttcatttgaaaatcagctacattcccatgtagacttttctttatacaaaarttaaaataattacagaaaggtaaattattctgatgctaaaattagcctttcattgatttcaagtagattgtaattggctaggatcaaatacatgctttat

SEQ ID NO: 46684 - DNA, 201 bp, Homo sapiens
aaatacataaaatccaaagaatgagataaatcttacatatgtgtcatatttctatagatttttttgaccaacattttattttgaaaattttcatgcacttrgtaaggttgaaagaatcatacagtgaacactatgtactcgaaatctagattctaaaattaggccaagcatagtggctgatgcctgtaatcccagggattt

SEQ ID NO: 46685 - DNA, 201 bp, Homo sapiens
aggaggcagaagaaggctacttgtctttccccagtgattttatgaatccattgaggagatctgcagaagtgttgtcactgctggagaaaaccaaggcttcrcttgcaaaaaggagtactttcttaaaactgagaaatttggaaatatatcataggacttgtaaagctatgatggaagttagcccatgagtgtgtttacaga

SEQ ID NO: 46686 - DNA, 201 bp, Homo sapiens
gtgttagacatagttgagatccattataataatgtcactacattttgaaataaaattctgaaatgccttaatacataaatccttttatgaagtctttaaaattggctgctaaaaccaataaaattatatttttggaacatagttaaccactttgtgcacataagtgaggctgtagaaactagggttttaaatgacttaaaa

SEQ ID NO: 46687 - DNA, 201 bp, Homo sapiens
tcaggatgaaactgttccacctcagatcatcagccattagattcttataagtagctcacaacctagatccctcgcatgcacagttcacaatatggttcacrttcctgtgagagtctaatgctgttgcttatctgacaggaggcagagctcaggtggtaatgcttgtttgccagccactcacttcctgctgtgcagccctgt

SEQ ID NO: 46688 - DNA, 201 bp, Homo sapiens
gttttaggttaaaaaaattctttaccttttagctttgatgaattacttcatttttatatctaataggtttttttaaccttcactttaattgatttcttaamctctttatcttgctcattttttaatctttttaatgattttaaaatgctgattttaataattttatcttggcatatttatatttatcagtttttctgcttc

SEQ ID NO: 46689 - DNA, 201 bp, Homo sapiens
atggtttcaggatgaaactgttccacctcagatcatcagccattagattcttataagtagctcacaacctagatccctcgcatgcacagttcacaatatgkttcacattcctgtgagagtctaatgctgttgcttatctgacaggaggcagagctcaggtggtaatgcttgtttgccagccactcacttcctgctgtgcag

SEQ ID NO: 46690 - DNA, 201 bp, Homo sapiens
cttattttttattttggggttttagtattttcatgttttaggttaaaaaaattctttaccttttagctttgatgaattacttcatttttatatctaataggtttttttaaccttcactttaattgatttcttaacctctttatcttgctcattttttaatctttttaatgattttaaaatgctgattttaataattttatc

SEQ ID NO: 46691 - DNA, 201 bp, Homo sapiens
ttaagactattagaaagttttcctgatcacaggtctctcttctctttgcagcctgtcgctgtaatgccggtggctctttctctgaggtttgccacagtcaractggacagtgtgagtgcagagccaacgttcagggtcagagatgtgacaaatgcaaggtaaggagtagaggctgacccataaattactttctccttacag

SEQ ID NO: 46692 - DNA, 201 bp, Homo sapiens
cccctttgcccaaataccactaagacacccttaagcatcaatataactatctactaccaagtgcttttacaaaacataaagcacttaaaaaaactaatgayttagttattgcacacctcatgaaaggtgagaggtggtttttacttattctagcacggtggcagtagagatggagataagtggaaggaatgaagatgtatt

SEQ ID NO: 46693 - DNA, 201 bp, Homo sapiens
aagtaatatacggacaccaagaaagaaacagaaaattctgtgtggcaaagtcagaaaacactttcacagagcagggaatatttgagctatgaaagatgaamatgcaacaaaaagggagaacattctttgttgaagggacaagataatgtcatcacaaagcattttcaaaatgcctgctatatttgtaaataggaagagatc

SEQ ID NO: 46694 - DNA, 201 bp, Homo sapiens
gcatatgatgggccagacatgatgctaaagcctttatgttaattatccctacagcttgtagagttgttatagggattaaatgatagaatgcctaacagggyacttaacaaatcagaaaacattctgttactgaacttaggcgtccatgttaccatgtggggtatattattatttaacaagcctattaagactattagaaag

SEQ ID NO: 46695 - DNA, 201 bp, Homo sapiens
ataaatttaaagtgtcaagtcagaaaaacattacaaatcaaatttaaatagtaccacagttattacctagaaattcatttgccagtcattcaccaaaagtytgttgagtatctactatgtgacaggctccataccaaatactaggaatccagtggttgttcaaatctaagatttgctttacaagatcattaaccatatatt

SEQ ID NO: 46696 - DNA, 201 bp, Homo sapiens
ggtcatccctaggttttgatacctgtacagaatagtcattgcttactgctgccgccatcactactttctctttcattcctctgatatgactatctctactmctatcattatctgattttccttatctctctagtctgtgcttcacatgcttaatattcaaattcctaggccaaagtcacatgtacatgccctaactgctat

SEQ ID NO: 46697 - DNA, 201 bp, Homo sapiens
aggatctgggatacaatgggttcccgagtgcagtggtgtgatctcggctcactgcaacctccgccttccgattttcaagcgattctcctgcctcagcttcyggagtagctgggattacaggcgcccaccaccacccccgactaattttttttttttgtattttttagtagagacggagtttcaccatattggccaggctgg

SEQ ID NO: 46698 - DNA, 201 bp, Homo sapiens
tgaatttcagtgtcttcatgctcaaaattggaatgatgatgatgacattaatattttaatggcatatgatgggccagacatgatgctaaagcctttatgtkaattatccctacagcttgtagagttgttatagggattaaatgatagaatgcctaacagggtacttaacaaatcagaaaacattctgttactgaacttagg

SEQ ID NO: 46699 - DNA, 201 bp, Homo sapiens
cctccctagtgccatgctgtctgctgaagaatcaaactgtgctctcacatgcttaccactgccttcttgctttttgcaggcctgcagatatgcaaacattyacacagcctttgcacctcttgtcaaagctgtttatctattgacatgtttatttaaaactagctatggtgccagatgaaggaatctctggaaatactatat

SEQ ID NO: 46700 - DNA, 201 bp, Homo sapiens
acatttgaaatataccatataacttgcagagttgatgggaaaatttgaaaaccagggtgagaagatggcaggcatcaaggtcatccctaggttttgatacmtgtacagaatagtcattgcttactgctgccgccatcactactttctctttcattcctctgatatgactatctctactcctatcattatctgattttcctt

SEQ ID NO: 46701 - DNA, 201 bp, Homo sapiens
cttcactttcagtttcttgtgcctctctggtctccatttgaagcgtttttttgttgttgtttggtttttgtttgtttttttttttttttcccactgtgtcktttctctctagttcacttcttctaaatacttccacttcaatgtgtgtaatctcacaattgatgcacacacttttttcttgttccttatctcatgctttca

SEQ ID NO: 46702 - DNA, 201 bp, Homo sapiens
ctccatagacctagaagctgaaatggaaagttagaatcattcaaacacaaattttgattttattcctttgagagatggtaggtgattggcatgaaatagcwggataaatattgtctaccaaaagtaagatgagagagagaggaagacagagagacagagacagaaaggataaggatcagccatgtattattgtaaacagta

SEQ ID NO: 46703 - DNA, 201 bp, Homo sapiens
tcatgaggttgtattatgttgttagatattatttaaaatctttacgatctttgtttggatgtcccataatttacccatttcccttagaattgaggtagctsttatttttttatgtttctgctggcaccctgcactctctaccaccatctgcattagaacaatcagaacaatcatgtgttccaccctttttatcgtagtcac

SEQ ID NO: 46704 - DNA, 201 bp, Homo sapiens
attgccccaactgaggtccccccaaaggctcactgatgaaatttcttgccttaggtgtgcagaaggctattttggacaaccctctgtacctggaggatcaygtcagccatgccaatgcaatgacaaccttgacttctccatccctggcagctgtgacagcttgtctggctcctgtctgatatgtaaaccaggtacaacagg

SEQ ID NO: 46705 - DNA, 201 bp, Homo sapiens
aaatttgctgctaaccttttgtttttctttgaccaataacatttctcagcttagtgtatgggctatgtaaagtgcctgtcaaatggagggatgtctttgtkgaaagaatccagactcacagaaagtgagtgactttctggtcagatggttagaactctcccaattttgacaaagatcgttctctgtttgggatttgtaaag

SEQ ID NO: 46706 - DNA, 201 bp, Homo sapiens
cagagctgtggactaccttccagaaagccagagatgtttgttgatacattttcataataaacccaaatgaagatggaagtcttgattttgcatatgtcagyttcactagaagttttctgtttgctttcagatttttattgcaaaaagaaaaaaattatatcagggaaagataaattttattggtggtctaatagtcgcaag

SEQ ID NO: 46707 - DNA, 201 bp, Homo sapiens
ccattgttgtactctgtgacagtttcattgaaaggactgtcatgttccatgaggaactcagcctacctgctcttttaccagtagctggtgggaaagccatrctgtgccaatgacttattcacaggaggcaggtcaatcttttgaaaccacagattgtttcaaatgagagaaaaatatgtgagaagagaatagatgtcaagg

SEQ ID NO: 46708 - DNA, 201 bp, Homo sapiens
gatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttggtgaaaaaaataaaacttattt

SEQ ID NO: 46709 - DNA, 201 bp, Homo sapiens
ggtgatggatgagatttcaatgcaaattgtaaagactgaaaatgatgtgaccagagaagggacccctagatagtaagtactcaataaatgacagaagcagrgtatagtatgaacctgtttcttgggaaaatagacttgaagttagacaagaatctatttaatcaaactctagatatgatgttttgctaacttttgtttttt

SEQ ID NO: 46710 - DNA, 201 bp, Homo sapiens
ccagagctgtggactaccttccagaaagccagagatgtttgttgatacattttcataataaacccaaatgaagatggaagtcttgattttgcatatgtcakcttcactagaagttttctgtttgctttcagatttttattgcaaaaagaaaaaaattatatcagggaaagataaattttattggtggtctaatagtcgcaa

SEQ ID NO: 46711 - DNA, 201 bp, Homo sapiens
gaaagtccctagagaaggataagaaaatggggcaatacataagcttggaaatagatgatgatatttcttttttttttaatttaattttatttatttatttwttttattaatcattcttgggtgtttctcacagagggggatttggcagggtcacaggacaatagtggagggaaggtcagcagataaacatgtgaacaaagg

SEQ ID NO: 46712 - DNA, 201 bp, Homo sapiens
tattattaaaaatacaaggagaaaggaatatgttagaaacaagtaagaagttccatatggaaaactgataagcaattttttagaagcaaaaatctcatgaygctaaaacaagatgatgaagaaattactctgtgtgcaagtgtggagaaaaatagcttgtgataccatagtgatcttagagctcattatacatcagcaatg

SEQ ID NO: 46713 - DNA, 201 bp, Homo sapiens
ggatgatggagaaagactgaattttgcaagcaggttataataactcctgagagtgattgtaatagggtgattaggtcatgcatggactacaagggatcaartagaaaaggagtggtaaagtagtaaacagcagagggtacaggctactcttaagaaagtccctagagaaggataagaaaatggggcaatacataagcttgg

SEQ ID NO: 46714 - DNA, 201 bp, Homo sapiens
ggatgtggaggtactagaaagttcttaatctgatattttttctggcttagtcagcaatcacttttctttcatcaatgggcataagatttttaagtgaaaaraaaaaattctacttaaccaaggtggtaaaatagtccccttgtaattctccatgggatttgaaaaactgactcctaccttttattcataaatcaagcaatg

SEQ ID NO: 46715 - DNA, 201 bp, Homo sapiens
aaatgttattttccccaaggaaaagattattaggaattataacattgggacacacctttgtttaaaaagctctaattaacaagaaccacagcaggggcgcrcatacaggggttggagagaaattcagttagtgctgtcttctggacactccttctatcttcattctctcctctgccattgttaaccttccattttaggcaa

SEQ ID NO: 46716 - DNA, 201 bp, Homo sapiens
tttatatatatataattttatatacatatttatatattatatatattttatatattatatatataatttatatatataatatataatttatatattatatrtatataattaatatatatattcaaggatgaaatccatgcacagaaaatccagttttattcagtggtcagcttgctaaagaattggaataacccacactat

SEQ ID NO: 46717 - DNA, 201 bp, Homo sapiens
ataaagtcctatctctcatagtaacacacatgcatgcacctagcaagtatgtcaataacacaacaattttatatatatataattttatatacatatttatrtattatatatattttatatattatatatataatttatatatataatatataatttatatattatatatatataattaatatatatattcaaggatgaaat

SEQ ID NO: 46718 - DNA, 201 bp, Homo sapiens
tatacatagcaaaggtacattaaaaatatagttttataatcttatgggaccactgtcgtacacatggtcctatcattgaccaaaatgtcattatgcagcarcacatgactgtacaatattcctacattccaggtgaggaaaccaaggcacacagtattcagaaccttactacatacaaagtggtgaaacaggaattaaact

SEQ ID NO: 46719 - DNA, 201 bp, Homo sapiens
actggcctgggtttgaatctcgacttcaccatacagtaagcctgagaccctgcactgggtgctacacctctttaggctttagcaggtaaacaccaagtccytgagtaactaccactacactttcacctctcccgcagaccccacagtctgaagcctggcatgcatggggcctccaggactgctccagccctacagctggga

SEQ ID NO: 46720 - DNA, 201 bp, Homo sapiens
gagataaggagttcctgtctgctttctaaacaatgcagtttgaacagagaagtgcctcatctttccttttttccatctatttctgaattcttatcttcatmacattaaaaataccttgagagacccaaaagaaaagcaagaaggcatgaggactgtacctctgtcacaacacttagcatcctggtctaaaatgtaatttac

SEQ ID NO: 46721 - DNA, 201 bp, Homo sapiens
ttaggatttggtacatgagccccagaaatttaaacagcttcaaaacaatgttaattatcttgatttaatcatcccacaacttatctatgtatcaaaatatyacattgtttaaataaatatagttgacccttgaacaacatggtggttaggagcatcaaccccacctcatgcagtcagaaatccacatataacttttgatac

SEQ ID NO: 46722 - DNA, 201 bp, Homo sapiens
tacaatcatattttacaacagtgacactttgcagatgagtctaaatcccagtagttcctgtggatagtaaaacttacagaaagagccatagattaggcatrtttctaattaattatctgattcctaattagatatctttgttatttagcatttttaaccttgctttattttctaactacttatctagattatagaaaacta

SEQ ID NO: 46723 - DNA, 201 bp, Homo sapiens
atcctctctcctcagcatctccaagtaactgggactccaggcacacaccaacatgcccagctactttttttggaggggagggcaaagacagggtctcactmtgttgcctcaggctggtcttgtcttgaactcgtggcctcaagcgatcctccctcttcggcctcccaaaatgcagggattacaggaatgagccactacact

SEQ ID NO: 46724 - DNA, 201 bp, Homo sapiens
acaaagctaggtatcatcagatccaggctctaagtccttacttggggacatattggtcatttggcctgaaacaggccatttaaccttctgaaattcacttrgtctcttctgggaagtgcacctaccccagaaagattttgtgaaattaattccagtaatgtagtacaagtgctctgaatctcacagcatgcttcacaaata

SEQ ID NO: 46725 - DNA, 201 bp, Homo sapiens
gataaacttatcaggaacagaaaattgttttgaatacatttttaatatttaaatagtcacagatcaaaactaaatttttttttaaagattctgttgaatasgtaggacttcacattggattcaacctggtatttaaaatgcaaatactttttgatttctctttttgctaagtaatattctaagagattagccatacatttt

SEQ ID NO: 46726 - DNA, 201 bp, Homo sapiens
ttgtgacaataagtgtgtaaaggacactgttggtgccctgcctaggcacctacactgaagccttctctccaacagaagaggcagaaaggcctgaatgtttmcccgcccttcctgcagtggcccatgactaaccagcgtgagagtacaaaagtccagctctttggcccctaagtggaacaagttttgagatcttattttatg

SEQ ID NO: 46727 - DNA, 201 bp, Homo sapiens
aaaatgcagggattacaggaatgagccactacactcggccagtaaacctaatttttaaacatctgttttttagactatataatccaaaagaatgtttcttrgactttgttttacttaaaagccttaaagagatatgtaatattatcttattttttagctatctcccaagaaaaagcctcaaataaaaaaaaatctttttca

SEQ ID NO: 46728 - DNA, 201 bp, Homo sapiens
ctgtctgccttctttcacccagtctactgtctgtaaaaatcattcatgtttttgcatccatcaatattttgctccttttaatcgctaacattttccgttgwatgaatgtacctccatttttattttattggcctgttgatgacattaagactgtttccagtttttaattatcatgaataaagttgctatatacaagtcatg

SEQ ID NO: 46729 - DNA, 201 bp, Homo sapiens
gcctccttgagctgtggtgggctacacccagttcgagcttcccggctgctttgtttacctaatcaagcctgggcaatggcagacgcccctcccccagcctmgctgccgccttgcagtttgatctcagactgctgtgctagcaatcagtgagactccgtgggcgtagtaccttcccagccaggtgcaggatataatctcgtg

SEQ ID NO: 46730 - DNA, 201 bp, Homo sapiens
aatgattatgcatcttctgtcttgtagctcccagcagtaggaggacagttgacatttaccatatcatatgaccttgaagaagaggaagaagatacagaacrtgttctccagcttatgattatcttagaggtagagtactgagagcatgttcacccgtgttacttcctgatgttacttaaggttaccagtactgtatttttt

SEQ ID NO: 46731 - DNA, 201 bp, Homo sapiens
ttgttagaagaaagagaatttattgtgagtgggatactttaaatctttcagatgttaaggattctatttcccaaataacttcattcatgtaagaagtatayttcatgtgagtcaggttttattctctaggtgttttctaatgtgggaaagtgaaatacaagggtttgaaatggttctggggatgcagtctttcctgtcaga

SEQ ID NO: 46732 - DNA, 201 bp, Homo sapiens
aagaagttctaagaataaagcagtttacaaacaaatagtatatatacatgtatatgctttgttagaagaaagagaatttattgtgagtgggatactttaamtctttcagatgttaaggattctatttcccaaataacttcattcatgtaagaagtatacttcatgtgagtcaggttttattctctaggtgttttctaatgt

SEQ ID NO: 46733 - DNA, 201 bp, Homo sapiens
taaatgacgagttaatggatgcagcacaccaacatggcacatgtatacatatgtaacaaacctgcacattgtgcacatgtatcctataacttaaagcatamcaataaaaaaagaaacttaaaaaaaatgaaatgtccgtatattttcttgattttttccaaatgttttgaagaaagtttttgtattattaaatgctattca

SEQ ID NO: 46734 - DNA, 201 bp, Homo sapiens
agtaaatcattaaatcaaaaaaactaactaaatttttctagattaatagtaacattaaaattttgccaggggtgctattaattttgaaaattcctcaaaaytattttagttctaaagtcagtatgcattacttacaatgggataatagtattttaagtgttaccctgatgtatctgtaaagaactaaaacagcgttacacc

SEQ ID NO: 46735 - DNA, 201 bp, Homo sapiens
tcatgtcctttgtagggatatggatgaagctggaaaccatcattctcagcaaactatagcaaggacaggaaaccaaacaccgcatgttctcactcataggwgggaaacgaacaatgagaacacttggacacagggtgggtaacatcacacaccggggcctgttgtggggtggggtgaggggggagggatagcattaggaga

SEQ ID NO: 46736 - DNA, 201 bp, Homo sapiens
gaatcttaaaaaaggcataaatatttcacctcaaaccattttttaaacttaacacaaaaccggcacacagtaaatcattaaatcaaaaaaactaactaaayttttctagattaatagtaacattaaaattttgccaggggtgctattaattttgaaaattcctcaaaactattttagttctaaagtcagtatgcattactt

SEQ ID NO: 46737 - DNA, 201 bp, Homo sapiens
actatatttaaaataagtatttgcgttaatagtaaagaagtgtgagatagttctcctagcttctcaggagcattttaattcttactagcattagcataaargctgtgagcaatgggcctccataaatggctgaacaaacctcagagatgtgcagggctggtatcctctggctagagctaaaagcctggtgttttggcattt

SEQ ID NO: 46738 - DNA, 201 bp, Homo sapiens
gcagttcttttgtttgtttatttgtttgttttttaaaaggagaacctagagccaggagaataaaatattagcataggctgatagagtacctgtttatagcwtaattttaggttgtgttcaaatcaaaatattcagaaatttaacaaaatcatctatgagtagcctaaattcccatgtcatctcctccttgtatttttattc

SEQ ID NO: 46739 - DNA, 201 bp, Homo sapiens
acttcacagctgttgaccatcaatccaacctttatttgattaagctcagtatatagtacatcactggaaaccagtcatttagttaattggccatataaacraacagttttgccattcattgttaattacaggataatatatgacatattagtgtgtagtcactgaactctgtgccaaaacagtaatacatttgctaccata

SEQ ID NO: 46740 - DNA, 201 bp, Homo sapiens
actgttctctcaatatcaagaggtagcaattttaaatgttctgtgttttaaactttaatgtataacttacgtcagtcaatcctgataataccactattctyactagtcatcaacatcattatcatcattgtcatcatcatgtaacaattatataatggttaatattggccacaaatcaatcctagttccttaaaatctatt

SEQ ID NO: 46741 - DNA, 201 bp, Homo sapiens
ctcaacaaaataaatagaatctctaatttcaaaatactattatccccaaaagtaatgggaattttaaaaattatttagtgtttccagtttagatatttaaraacaccactcacatctacatgccaaataaattgactccaccctccacccgttatatcagggccccactccatccattgtcttttttcttagttatatctt

SEQ ID NO: 46742 - DNA, 201 bp, Homo sapiens
aaattgttatattgtattgaatcctgctcttatatgtcttgttttttacttctcgttattttttattttagtttactacattttcttagcttcttgaaatsgatacctatgttattaatatttcagttcttttttcctaatatatttattaacgcctacaatttgcctctacatagggctttagttgcctcctacaagttt

SEQ ID NO: 46743 - DNA, 201 bp, Homo sapiens
tgctggtattcaaatcccagcactgtaaccgaccatctgtgtgaatttgggaaagctacctgtccaatctatttctcagtttcccatccaagtactaaccrggcccaaccctgcttagcttttgagatcagaaaagatcggatgctttcagggtgatttggccatagactatttctgtttcctcatctgtcaaatgaggat

SEQ ID NO: 46744 - DNA, 201 bp, Homo sapiens
aaatctgactcatgatgtttctcctctcccatcacttttcactgtgttctgctgatctccatactgtttcctcaatgatgggcccaaaaaatgctggaagktttcttctatttctctctttgagaatcatgaggcactcattgggattgtggttcttggattgtttccctctttgtatgtatttatgtatgagccatatac

SEQ ID NO: 46745 - DNA, 201 bp, Homo sapiens
ctttcaataataagcaaaaacaattttcatagctacaaaccgccgacacaactttctatttaaagaggacttctttgcaggaggcagaataataactcaamaaaataaatagaatctctaatttcaaaatactattatccccaaaagtaatgggaattttaaaaattatttagtgtttccagtttagatatttaagaacac

SEQ ID NO: 46746 - DNA, 201 bp, Homo sapiens
tactcctatcctcccgtaaacactatctagaaaattgtcacccaacctattgtagaactaaaaacctagtggtcttcctcatcttcattgtcttcattatytccactacacgaaacattcccttgtaacaaatataatattcacagcattgtgcaaaaaatgtacattttaaatttctagtataaaatttgatttgtgact

SEQ ID NO: 46747 - DNA, 201 bp, Homo sapiens
cagctgtagacttttcctttcaataataagcaaaaacaattttcatagctacaaaccgccgacacaactttctatttaaagaggacttctttgcaggaggsagaataataactcaacaaaataaatagaatctctaatttcaaaatactattatccccaaaagtaatgggaattttaaaaattatttagtgtttccagttt

SEQ ID NO: 46748 - DNA, 201 bp, Homo sapiens
ccccctaaagtaattaaaataaccttgtatctttatttattcaattataaatttaaatctcaaaagcagagagtttaagagtttatattctgtttgaggtwtgaactttgtacattgtatcagtgctggcattatcttttttctttgcttttgtttccttttataaagtttaatttaaggaaatagcaacttttgcatttc

SEQ ID NO: 46749 - DNA, 201 bp, Homo sapiens
accctgtgtttgttggaggcttcccaggtgagtgttggctaccccagcaacaatttctttgctctcttatgttactggttttgaaaacatttatatttacrtgtgtctaagaatgtgtgcttatgtgtacttgcttcctagctttagaatctgcttagaatctgcaccttacctaaaatttccagtgtgtaaaatgaacat

SEQ ID NO: 46750 - DNA, 201 bp, Homo sapiens
ctttgccatgttgctcagactgaactcctgggctcaaacaatcctccccacctcggcctcccatagtgctaggattataggcatgagccactgcacctggyttttatattcttaatatttcttgtttcttctatttattttctttactttaaactcgttgttataaagtggtatgggttaatcaagagtgatggaaagatt

SEQ ID NO: 46751 - DNA, 201 bp, Homo sapiens
gaggcggagcttgcagtgagcagagatagcgccactgcactctggcctgggcgaaagagcgagactccgtctcaaaaaaaaaaaaaaaaaaaaaaaaagtmcaatacctttagtcttatatctatttaaaaataaagcatttttaaaagatccatgaactcctaacaatgaggttaactacatgtgccatttgagatgtga

SEQ ID NO: 46752 - DNA, 201 bp, Homo sapiens
tatgagacagctgtcattgaagaaattctgttgagaatctgaattactctccttctgtattattttaatgtttgatattcacatgatggttgttttaaccrtttttttttactttaaagaaaaagctataaactagttatatgatcttttcttcttcctttcatatgatgctgctaactcaatagagagacacccgattac

SEQ ID NO: 46753 - DNA, 201 bp, Homo sapiens
catttgtatgtgtgaaccatcatgatacttctttaatgaaaccatctgtgactgttctatttcctactttccagttgatgtttcatgtggacaatggtgcrggcagattcactgctgtctatgatgctggggttccagggcatttgtgtgatggacaatggcataaagtcactgccaacaagatcaaacaccgcattgagc

SEQ ID NO: 46754 - DNA, 201 bp, Homo sapiens
gatgccctttgtatgttcacatagcattttggacttctcctattatataatgcttattctatcatgttatgctaacatatttacttgtctccctctactasaccgtaaggtatgtctccaaataaatgtttaaatgctacaattatgagataataaggtaaaataactttgtctaaaatttaatctttgagacaaagcagt

SEQ ID NO: 46755 - DNA, 201 bp, Homo sapiens
atccaagatgttctcactggtccgtggcaaagtaagaaaatgagaacaactttccacatttttcataaaaatagaaaggatacaatttaaataattgtcckccattttgatattatgggttttaaaaactaatgatggtttttaaatgccctttgtttcatgaaataataatgatgctttattaaatgatagaaatatatt

SEQ ID NO: 46756 - DNA, 201 bp, Homo sapiens
atttgtgcatgtacatagaattctttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctcca

SEQ ID NO: 46757 - DNA, 201 bp, Homo sapiens
cttttacaaaacataaagcacttaaaaaaactaatgacttagttattgcacacctcatgaaaggtgagaggtggtttttacttattctagcacggtggcartagagatggagataagtggaaggaatgaagatgtatttagggtatttcctgccctacaacagcctatagtctcattgctattcagtgatgcattgaataa

SEQ ID NO: 46758 - DNA, 201 bp, Homo sapiens
aagggaccctgggaattgccttctagcagagaggccaactcacatttcaaataagtatttttccctcctcaactgcttttctaagctttgcacattaacaytgacctagtgcaccatttaaaagtcctaaatatatcacacagtcgccagcccaatcaaggtgagtggtcagacaccagcatgctgtgcacagtatgctag

SEQ ID NO: 46759 - DNA, 201 bp, Homo sapiens
ggagtgcaatggcgtgatcttggctcactgcaacctctacctcctgggttcaagtgattctcctgcctcagcctcccaagtagctgggaatacaggcaccygccaccatgcctgtgctattttttttttttttcatagagatggggtttcactgtgttggccaggctggtcttgaactcctgacctcaggtgatctgccca

SEQ ID NO: 46760 - DNA, 201 bp, Homo sapiens
aatttgtgcatgtacatagaattctttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctcc

SEQ ID NO: 46761 - DNA, 201 bp, Homo sapiens
aacaaatgatagacattacttccttctggatgagcaaaaccttgatgctttcagtagaaggtatttggaactatggttgaatcttttctgggggtattgaygggactagagtcaggatgaggtggatgaaatgccaggtactttcatctgtatgacttgagagtgtatgcatcaaattttgcaccctcgagcacctctctc

SEQ ID NO: 46762 - DNA, 201 bp, Homo sapiens
accagcctggccaacatggcgaaaccctggtctctactaaaagtaccaaaatcagccaggtgtggtggcaggcacctgtaatcccagctactcaggaggcygaggcaggagaattgctaaaaacttgggaggcaagagttgcagtgagctgagatcgcaccactgcactccagcctgggcgacaagagcaagactccatct

SEQ ID NO: 46763 - DNA, 201 bp, Homo sapiens
ggcgcccgctaccacgcccggctaattttttgtatttttagtagagacggggtttcaccgtgttagccaggatggtctcgatctcctgacctcgtgatccrcccgcctcggcctcccaaagtgctgggattacaggcgtgagccaccgcgcccggccgataatcattttaataacagaatctgggaagatttttaaccaaa

SEQ ID NO: 46764 - DNA, 201 bp, Homo sapiens
tgacctgaggtggcagataccacaatttcctattagacaacttctctcacaattacctaagagccatgaatttgatttagaaatggggttgtatgtgtgtktttttctatcacatattaaacgcacaatctgtaaaaaagattcaggaggatgtttgggaaatgttttctgtgatatttatttttcttcagaagaagtgcc

SEQ ID NO: 46765 - DNA, 201 bp, Homo sapiens
taatttgtgcatgtacatagaattctttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctc

SEQ ID NO: 46766 - DNA, 201 bp, Homo sapiens
tgttctttgctgtataaatggttttgtatgagttacttaaccacactgagcctcaaattcccatcagttatatgtggattataatgtctgcctcatgcttrttgtgaacattcaatgtaatcattcatatgaagaagcaatgaacacagggtctggtgcacataaatgttcaacaaatgatagacattacttccttctgga

SEQ ID NO: 46767 - DNA, 201 bp, Homo sapiens
ttataaacattagcatttttaaaatggtcatctgcaaattccatcttttttattgcaggactattcctactgactgacttttctcctgtttctgagtcatrttttcttgattctttacatgcctgataatttttatttggatgccagacattatatacttttcattgttgtgtattggattttattgtatttctttaaaga

SEQ ID NO: 46768 - DNA, 201 bp, Homo sapiens
agatttcttaccttctaagtaaacaacaaagctttcctcagtttttattattattattattaggtagaggattaggctgtaggatgaattgatacaaagcrttcatgcagaatggctactgagacgtttagaaaccatgatcgagacaaatgagggatcatttatttggacaaactgagaacttttactaatctaacagcc

SEQ ID NO: 46769 - DNA, 201 bp, Homo sapiens
aagttatgatttgtatttccccatttttatttacctgtagtgttttctaaaccagtcacagtctggatttactttacattattattatttattattatttwttattattattattattattattattatttgagatggagtctcactctgtcacccgggctggagtgcagtggcacaatcttggctcactgcaaccttcgc

SEQ ID NO: 46770 - DNA, 201 bp, Homo sapiens
aggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttatt

SEQ ID NO: 46771 - DNA, 201 bp, Homo sapiens
tcttgttaacagaaagaatggaaatattatggggatgatcctcgagtccatagaactgtgacccgagaagacttcttggatatactatatgatattcattrcattcttatcaaagctacttatggaaatttcatgcgacaaagcaggtaaactctaatagaaaatattcaagctcttattttagagtctgtaaggaaggtt

SEQ ID NO: 46772 - DNA, 201 bp, Homo sapiens
gtattttttatttctgatagtttctattgttaagtgtccaaagtcactgattttttaatgcagcctaacctgtttttaatccaattgagtctattttttawtttaaacattgtatttttttatcttttaaatttccttttggacattgtatatcttttatttctctactatactcacattttttcatttattcttgaaaat

SEQ ID NO: 46773 - DNA, 201 bp, Homo sapiens
gattatttcaggaatgcagaagtggtttaatgttagaaaatcaaaatatcagccaggcacagtggctcacgcctgtaatcccagcactttgggaggccaakgtgggtagatcacaaggtcaggatttcgagaccagcctggccaacatagtgaaatcctgtctaatttgtatactaaaaatacaaaaaattagccaggcat

SEQ ID NO: 46774 - DNA, 201 bp, Homo sapiens
gaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttat

SEQ ID NO: 46775 - DNA, 201 bp, Homo sapiens
acactgtttgaaaaaccttattttgtaaaaaaaaatctgttctattcactgtctcacagatttaggacagtttattaattaagaacactagatttcaagtyaaacagacctgaccttaaaccttgaccttgttctttgctgtataaatggttttgtatgagttacttaaccacactgagcctcaaattcccatcagttata

SEQ ID NO: 46776 - DNA, 201 bp, Homo sapiens
tcctgttgtttcaggtctgctgacaataattttttccttttttttttttttttttttgttccagaaaggttttttttttttttccgaagatgtttttgcaragtatgtaatcctaaatactggtttgcagcaatttaattatgctttttgttttctttttgtgtgtttaataattattttttcatgggattagttagatct

SEQ ID NO: 46777 - DNA, 201 bp, Homo sapiens
actcacaaaataaaacaggcaaagacaacactctggatagggaattttatcaccattatctcaaatggcattagtaaaaaagaaaaaaaagtaaccattgyatataatcacacacaaattggttacatatgaagtttggctataaaattcactttttaataaaaacatactggatcatatgcttctaaacaatttatacca

SEQ ID NO: 46778 - DNA, 201 bp, Homo sapiens
agaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagtta

SEQ ID NO: 46779 - DNA, 201 bp, Homo sapiens
atattgctattttatgtgctttgaagcaattacactgtttgaaaaaccttattttgtaaaaaaaaatctgttctattcactgtctcacagatttaggacartttattaattaagaacactagatttcaagtcaaacagacctgaccttaaaccttgaccttgttctttgctgtataaatggttttgtatgagttacttaac

SEQ ID NO: 46780 - DNA, 201 bp, Homo sapiens
ttaactacttcctaatctttatcattttattcctgttgtttcaggtctgctgacaataattttttccttttttttttttttttttttgttccagaaaggtkttttttttttttccgaagatgtttttgcagagtatgtaatcctaaatactggtttgcagcaatttaattatgctttttgttttctttttgtgtgtttaat

SEQ ID NO: 46781 - DNA, 201 bp, Homo sapiens
aagaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagtt

SEQ ID NO: 46782 - DNA, 201 bp, Homo sapiens
tgccaggattttacccctcatatctgtcagttatcggctacaagtccaaggggcagggggaagtgcaagtgatgtatcttgctggaagtctcagggtcagraggctctcattcaaagaggcaggtctctggaatgatgcagctgcaagccattagcagccaacccttgcctcagctgagagatgggtaccaggatgaaagg

SEQ ID NO: 46783 - DNA, 201 bp, Homo sapiens
tgtgataacttgcatgaaaagaacattccttcttttgcttactttgagtttaattttctcttgtgttccaagtttttttgttttttgttttttgtttttgrgacggagtcttgctctgacccccaggctcgagtgcagtggcagatcttggctcactgccagctccgcctcccgggttcacgccattctcctgcctcagcc

SEQ ID NO: 46784 - DNA, 201 bp, Homo sapiens
ctttacgtatcttgcctattaactcccaacaatgccccaaagcaaagagcataatttgtggctcctggtgattagatttatactttaatttgtcaagtttwaaaatttttttcaatatgcccagttacatccatttcaaatgattctggctgatgtctttcctagagacctgatcatttgtatgtgtgaaccatcatgata

SEQ ID NO: 46785 - DNA, 201 bp, Homo sapiens
tattaatttttctatatatcaggtaatggtcagagctcactttttatggatacccaatttttcaaacattatttgttgaaaagactatcctttttcccatygaattactttgactcctttgtcaaaatctatcaactatatatatgtttatgcatttctggactcttttctgcttcaccgatctattcttatgttaatact

SEQ ID NO: 46786 - DNA, 201 bp, Homo sapiens
catttccagtatggttttatatcactggtcatgaaggtacagttaggaaaaagaaataggaaataacctctacataataattttttaatcctttaattttwttgtgggtacacagtgggtgtatatatttatgggtgacctgagatattttgatgtaagcatgcaatgcataataatcatatcagggtaaatggggtatcc

SEQ ID NO: 46787 - DNA, 201 bp, Homo sapiens
acagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgacaat

SEQ ID NO: 46788 - DNA, 201 bp, Homo sapiens
ttctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgt

SEQ ID NO: 46789 - DNA, 201 bp, Homo sapiens
tttcaagtgatactcccacttcagcctcttcactagctgggactacaggctcttgccaccccacctggctaatttttctattttttttgtaaagatggtaytttgccatgttgctcagactgaactcctgggctcaaacaatcctccccacctcggcctcccatagtgctaggattataggcatgagccactgcacctggc

SEQ ID NO: 46790 - DNA, 201 bp, Homo sapiens
ttttttttttttgagacaggctcttactccgttgcccaggctgaagtgcagtggcaggatcatggcttattgtgcccttgacatctcagtttcaagtgatmctcccacttcagcctcttcactagctgggactacaggctcttgccaccccacctggctaatttttctattttttttgtaaagatggtactttgccatgtt

SEQ ID NO: 46791 - DNA, 201 bp, Homo sapiens
tgtttgctagctcttgtatagaatgtaagaggaaaggacatatgtcagagccctttgcttttatgtaaaagccaagggagttcaggtaaatggagtcaagrcaataaagggaaacagatttcaagggaaaaaaatcaggaaaatgaggcattaggtatgtgatgaaggaaagaatttttaggaagaaaaagtaacagtttt

SEQ ID NO: 46792 - DNA, 201 bp, Homo sapiens
acgggctccaaaatgtaatttatgtaactctcaatcttgtatataaaatgaaatccatgaaggaaaaaaatataattaaaacatcaaaagtttaaaatttwaaaaatcctttactttgaatttgtaaaccaaattaatgagtcactttaaacaatatcttttaagaaaattttataaggttcagtcagaactctcacattc

SEQ ID NO: 46793 - DNA, 201 bp, Homo sapiens
tccagtgccttcccaaggaaagatcagactctttgagcattagaaaccctctgtaatctgactacctttccaggctccaagccctcaactccattctatayaatgccaagtttggcatttcttgcacttatctagacatcattagcagtctgctcttgctattccctcagacaatccctgtgaaatctaatttatttttaa

SEQ ID NO: 46794 - DNA, 201 bp, Homo sapiens
caggtagagcaccttcactctgagcggatccccaaaggccctagtcaatgctccaggaactttccttttctttccattgacatttcaaacacccaacaccyagcagcccatcctggggactcattttcaatttgtttcaatcaaacactggtatgagaataaatgctagcatatgttttagtagatcctattatcaacact

SEQ ID NO: 46795 - DNA, 201 bp, Homo sapiens
agtgatccacccgcttcagcctcccaatagatatattttttgttaatattatttcatatataatatattaaaaggtagatatatattatatgtagagagakatattttacatatctatagatcgatctatagatatctatatctatagatcgatctatagatatctatatctatagatagatatatagaggccagaaagta

SEQ ID NO: 46796 - DNA, 201 bp, Homo sapiens
gctggcaaatttttaacaacttctccttaagtgatgagagaggggtcaaaagccaggactaatctcacaattgccactgaaaatgtggaaggtgtttgaayctaattgcttaatattttgaaaattcatctacagttttatcctcaagattcatactagatatcaaagaaattcctttttgtatcttaaatttcagttcca

SEQ ID NO: 46797 - DNA, 201 bp, Homo sapiens
agttaattttagcaagtacgtagattatatgcctttaatggcagctttgcagcaaagtgcaaaacataaataaatcagttaaccagatttgtgaaataccygcagagtgttttagactttattttgaaggtgccaaattagagctaacatgcatcgcttcatgtcttcccaagaaaattacatgacaaatatctatctctg

SEQ ID NO: 46798 - DNA, 201 bp, Homo sapiens
atagtagaacaaataggacttactgattcgagactgtatgtcaggggagagattaaagaaataaagagtttaagaatgagtcatagatgaccagtttgaaygattgatcagttggttgtggtgtcatttactgagctgaggaatagttggtgtgtgtgggggggtgggggcatggaatccatagtccagtttagaaatttt

SEQ ID NO: 46799 - DNA, 201 bp, Homo sapiens
ttttattttgtttttgaggcagaatctcactctgtcacccaggctggagtgcagtggtgcgatctcagctcactgcaaccgccatctcccgggttcaagcrattctcctgcctcagcctcccgagtagctgggattacaggcacgtgacaccatgcctggctattttttgtatttcaagtagaaatggggttttaccatgt

SEQ ID NO: 46800 - DNA, 201 bp, Homo sapiens
acacagctaaagatgtactggcacagattacagagctccaccagaacctcgatggcctgaagaagaattacaataaactagcagacagcgtcgccaaaacraatgctgtggttaaagatccttccaagaacagtaagatctcctttttcattgtgatgatgtcatttatttcctctcactgtaaaagtatcccagacctgt

SEQ ID NO: 46801 - DNA, 201 bp, Homo sapiens
ctatctccctagatagaaatatgtggaggttggatttcctgctgagtttctttatttttttcctttcttttttttttttttttttttaagatggagtctcmccctgttgcccaggctggagtgcaatggcgtgatcttggctcactgcaacctccgcctcccgggttcaagtgattctcctgcctcagcctcctgagtagc

SEQ ID NO: 46802 - DNA, 201 bp, Homo sapiens
tctttaatttactagctgattttaaaatattctcattaggccgggcacagtggttcaccccaggaatcccagtactttggaaggccgaagcaggcaagtcrcttgcggtcaggagtttaagaccaacctggccaacatggtgaaaccctgtctctattaaaaatacaaaatttagccaggcatggtggcaggcacctgtaa

SEQ ID NO: 46803 - DNA, 201 bp, Homo sapiens
ggcccaggtcagcaatgcagcaactcccatttttcttgatgaggatgtttttgctctttaggtctcgatgagcaattgcgggctttccttgggtgccatamgtttctgtgtgcaggtggcacagaccacaggcagctgaataagccaatttaagcagggctctggtgtccagcgtagcacatttcaggaagtcatagagag

SEQ ID NO: 46804 - DNA, 201 bp, Homo sapiens
cccatgataagcccatcttagtaatatttttattctcagatcctttactgtctggcataatatgtgctcaaaacatatttgatgaaggaatagttgtaccrttaaatgcaaaatggtgatgaatgacaaaatagaaagatatacagacaaactttatttaatcgcatatcatttattaacctagaaaataaaatgtctaag

SEQ ID NO: 46805 - DNA, 201 bp, Homo sapiens
aaatgccattgcctgatttcctggtggcttttattttccttctgaaatcatttacaaatatttcttagggtattggctactgttggtttgaaatgagatamaacttatggattataaatatgtttgtgcaaattttctctagcagtaattctaaaacctttgtggacattaagctgtaattgtagctttctcttgcaagct

SEQ ID NO: 46806 - DNA, 201 bp, Homo sapiens
tggcaaatgatgtatatttatatttcttttgtgttgttttttaaatattttttatttttgtttctggaatttaatgtatgtcagttgtgcaatagacttgktagaattttgtttgctttaataatttttaaagtgactttttgcattacttttgatcattttactcttagcttattttgagcttttgatgtctaaatataa

SEQ ID NO: 46807 - DNA, 201 bp, Homo sapiens
agaccatacttatatgccattccctctgcctgatacgtttgttttttctttcttcattttccctaacagataaacttctatttctccttgaaaattcagcwcaagattacttcccatgataagcccatcttagtaatatttttattctcagatcctttactgtctggcataatatgtgctcaaaacatatttgatgaagga

SEQ ID NO: 46808 - DNA, 201 bp, Homo sapiens
tttaaagaaattgccattgatttacatggttgtatggaagagttttgtttaaatgccattgcctgatttcctggtggcttttattttccttctgaaatcayttacaaatatttcttagggtattggctactgttggtttgaaatgagatacaacttatggattataaatatgtttgtgcaaattttctctagcagtaattc

SEQ ID NO: 46809 - DNA, 201 bp, Homo sapiens
caaatcttcacatatgaaaagaatcagaaatgttaactcaggtcttaaataaaaaggaagaattaatatgatatattaaaagtgatacgaaagtcaaaggraagattgatgagacttattaatatgaaatgaggtttcttcaataaatatgtaagtacaaaaaagttaaattgtattaagaaacttgagatttaaaaaaaa

SEQ ID NO: 46810 - DNA, 201 bp, Homo sapiens
aggccaaggcaggcggctgggaggtggaggttgtagctagccgagatcacacactgcactccagcctgggcaacattgagcactgagtgaacgagactccrtctgcaatctcggcacctcgggaggccgaggctggcagatcactcgcggttaggagctggagaccagcccggtagatgatgatatttcatttgcaatagc

SEQ ID NO: 46811 - DNA, 201 bp, Homo sapiens
agggatttaagaatcagaatttcatgacattttgtcctactttaaatggaaatgtctatagacttttctagtgaaggcttttacaaatgttaagggatgaytgaatgctcacagcaggacacatggcattacagaaagtctccaaaattattcatccttttggggacaactataaccatgattttttgtgacactcataac

SEQ ID NO: 46812 - DNA, 201 bp, Homo sapiens
tcaagatgagattttgtgaggacactgagccagaccatatcactaagagaataaaaatggacacagaatgccactttcctattccctttaaatatttccasttgaaagtatttccatgacctagtgagttcttagagaattcaatcactattgatgtcccaactggtataataaaagaagaaaacacataattttgagaca

SEQ ID NO: 46813 - DNA, 201 bp, Homo sapiens
ttggcagggtcacaggacaatagtggagggaaggtcagcagataaacatgtgaacaaaggtctctggttttcctaggcagaggaccctgcggccttccgcmgtgtttgtgtccctgggtacttgagatcagggagtggtgatgactcttaacgagcatgctgccttcaagcatctgtttaacaaagcacatcttgcacggc

SEQ ID NO: 46814 - DNA, 201 bp, Homo sapiens
attataaaaatcttcctaatttactttcttttttaattttttgtttctttcaatgcaattctaaggccaaccaggtccgcaaggtagcactagatctatgytggtttcataaaacattgtagatgccattcagtagagtgattaagaggatagactctggagccagattgctttggttcaaatcatagctctgctacttgc

SEQ ID NO: 46815 - DNA, 201 bp, Homo sapiens
ctgaaggccagaatataataagcattgttaatttagttaaaggaaaaggctgctgttgaaggttagacttcttgtgtatgtgtgggagataacagaataaygtctcttttccaagatgcatatggttttcttttgcttatgtgccaattttaatcaatggagaaattaatatgttaaatgaaataattaaccattttataa

SEQ ID NO: 46816 - DNA, 201 bp, Homo sapiens
tcaagaatgctcataacagcactattaataatatctaaagctggaaataaccaaatgacatcgctattggcatgaataaatatttcatagtatcataatawtaggaatactataaagcagtaaaaatgaacaaacaactgttatacccaacagcacgggtgaacccttaaacataatcttaaggaaaagaaattagacata

SEQ ID NO: 46817 - DNA, 201 bp, Homo sapiens
aaacacctaaattgtaatgagtatatgtgtgtatatatatataaatatatataatatattatatataatatataatacatatataatatatcttatatatwttatatatatatattatatatataatatatataaaattagagaatctttaataagaggtgaatggctccaaacacagatttaatttggaagctcccaccc

SEQ ID NO: 46818 - DNA, 201 bp, Homo sapiens
gaaataagacaaggaagaaacacttgtgaacaataggaaggtatgtgaagtgaaggagcgttaaggaacagagatttctagacaagccctaagcaaggaaraagcagagctttattctagaatcggactaaaggcagtattctttgaatgtgatcagaggacattgtaagccaggataatcattttgaattttaacctagg

SEQ ID NO: 46819 - DNA, 201 bp, Homo sapiens
gctgttcacctgctgattgcgtgtccatcctgctgagccaagaacagctgagaaaatcctcagtgtgctttagtcagttcattgaaagacctacaatgaakctcctggaggcattttatttgatttgtccatctcagggtttacagttttgcctcaagttggcattgcctttgtgacagattaaagatgtgagtgtattaa

SEQ ID NO: 46820 - DNA, 201 bp, Homo sapiens
ttttttttttttttgagacggagtctcgctctgtcgcccaggctggatggagtgcagtggcgcgatctctgctcactgcaagctccgcctcccaggttcaygccattctcccgcctcagcctcccgagtagctgcaactacaggtgcttgccaccacacctggctaattttttgtatttttagtagagacagggtttcacc

SEQ ID NO: 46821 - DNA, 201 bp, Homo sapiens
tataatatacatgttccaaatgtagattataccttacctgagtataccttgtttaagtacaacagaatatagttaaaatcacagttctttacctgctttarttgtatatagatttttaagatcatttgttcagtatcacaagtagaatctgtggttaattagaaaatatattttccctttaaaagaatttgtgctgacttt

SEQ ID NO: 46822 - DNA, 201 bp, Homo sapiens
acccagtttttgattaggcagaagtatgcttatggtcagtcagagtaaaaagtgagaccagcatggtggcatgcacatgtaatcccagctacttgggaggyggagacaggaggaccctttgagcttaggagtctgaggttatagcacactatgcttatgcctatgaatagccactgcactccagcctgggcagtgtagcaa

SEQ ID NO: 46823 - DNA, 201 bp, Homo sapiens
cctctcatcaccattattattagaatacatggctagattgcaatattaggtaggcaaattgagagtccatgtttgttcctcatagcaatgtgatttgttcmttatgtgaggtattccttcaaatttaaaaaggattgtgttctaatctaaaaggtcattcataagccactcattcgaaacatcttcccagatacttagttt

SEQ ID NO: 46824 - DNA, 201 bp, Homo sapiens
atctccgcatgttagttaaaaatataataatatgccaagtacggacaatgaagacagctactccacaatattcatttaatttaatttttttttttttttttgagacggagtctcgctctgtcgcccaggctggatggagtgcagtggcgcgatctctgctcactgcaagctccgcctcccaggttcacgccattctcccgc

SEQ ID NO: 46825 - DNA, 201 bp, Homo sapiens
tgttgaaacaattacagattcaagtactctgactcactcatcatttacataagctttcagcagagagaccatacttatatgccattccctctgcctgataygtttgttttttctttcttcattttccctaacagataaacttctatttctccttgaaaattcagctcaagattacttcccatgataagcccatcttagtaa

SEQ ID NO: 46826 - DNA, 201 bp, Homo sapiens
aggtatcatttcattggaagactcccaaatatcctctcggtaggctatttttatggacaggtattttccaatctttgtctgctagcatttttgttgagaayggagtatgagctaaggatgagaataatcacactctacaatatgtagattttcactttttcatttttagtatgaattcttatcctcacccctcatccttca

SEQ ID NO: 46827 - DNA, 201 bp, Homo sapiens
tgtcctttccccattgcttatttttattgactttgtcgaagattagttgtaggaatatggatttatttttgcattctctattttgtctcattgccttatgygccatttttataccattaccatgctgttttagttactatagcctcatagtctcagagcatagtgtgaagtcaggtgatgtgatgcccccagcgttgatct

SEQ ID NO: 46828 - DNA, 201 bp, Homo sapiens
aatttttaaccaagaagtaaccttacttattactagtatgctctttccttaaaagcttttctgatttatgttattttaattatatcaatcttgttattatktacagtttttaattattttaataatttcaacctttctgcaactttccattttagatatgtctcattaatggcatatagtgaagttttgacgttttgtcta

SEQ ID NO: 46829 - DNA, 201 bp, Homo sapiens
gatttaattaaatgtaggcctttagtctaagggtttttcaacatcaaaatgttcttcaaaagacattttgatagcttctctctttaagatgtgcaaaaaaagacggtgagaaaaagaaagaaaaccaattttgtgtaaaaaccctgatttaaatacagttctggcttggacagactaggtgacattttaaagatgctttca

SEQ ID NO: 46830 - DNA, 201 bp, Homo sapiens
gcactttatggacattaatatttctatggagaaagcttaaaaagtgtcacttgtgcattgaaactcttttgtaacagcttctttactcttctgttgttgtyatgatatcctccagattacttaaatttttaaccaagaagtaaccttacttattactagtatgctctttccttaaaagcttttctgatttatgttatttta

SEQ ID NO: 46831 - DNA, 201 bp, Homo sapiens
ggccttttctctgtctttttaaatagaccttatttttagagcagtttgaggttcacagcaaaattaagaggaaagtacagaaattccccatatttcccccrccccaacacatgcgtggacttctccattaccaaaatccccctccagagtgctacatttgttacagtccatgaacctacattgacaacagcatcacccaaa

SEQ ID NO: 46832 - DNA, 201 bp, Homo sapiens
tgattcctcaatgagcagctgaatttccacctgttcttgacgtattacctatcaccatcaggctatgttatgaaactcacttttagagataaagcaaattrtccaaatgtcaccaattattgaatctaaatgtgggcatacaggttttatttgaagcagtctttcagcttttctatatgattacatttttatttaaaaatt

SEQ ID NO: 46833 - DNA, 201 bp, Homo sapiens
agttccccagcctgcagtgtccccagagggcaccttccctcggctagtaacttctcagacactctggccttggggatgtcttggatcttctaggtacacartggctgcacacagttttgccaggcctttctcaagaggtaaaagttcctagctgtttgcatttcccagaaataatgttttccatgtgtagggattttacag

SEQ ID NO: 46834 - DNA, 201 bp, Homo sapiens
tgtggaggttgcagtgagccgagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagcc

SEQ ID NO: 46835 - DNA, 201 bp, Homo sapiens
ttcagatgagacataaaagtgctttaaaaacaagtatgtggtaaaaatcactttggaaaacctttggcattatctaatgaaattaatatgtgcctactctrtgatgttgcaattcaacttgtaagcatatactcaagagaaataggtgcacatgtgtacaaagacatattcaagaatgctcataacagcactattaataat

SEQ ID NO: 46836 - DNA, 201 bp, Homo sapiens
ctactcttgtttatattcttcacccttgtgttccttctactcaggactccattgtaaatgctcaggattaatttttttgtcatttgatgcagttctatacygtaccttgtctttctgcaaagcaaagataatattgtagtttaaaacttggctatccaccaccatgagggaatatgcttctcttatttttctgcagaaaca

SEQ ID NO: 46837 - DNA, 201 bp, Homo sapiens
gtgcttagcctcaagactgagcaaagaaatgaactttccagagattactcttaaaatatcccattctgagagcacatgtttctcttagtactgtttactcsggactttcagggtcagtaggcaagcttttcaacaaatttggtttcttttaaaaactatttttggtagttttgttaaatgtgtctggtaattcattttaag

SEQ ID NO: 46838 - DNA, 201 bp, Homo sapiens
ctatgaatgtgttgggtcagaggtatatggaaaatctctgtaccttctgctcaactttgttgtgaatctaaaacagctctaaacaatagtctattaaaatwaaaaaataaaatattcaacttcaccaatgaatagatttttacctaaatattacataatatgtgaagaacctaaaatagtaaagataattttgttttgtaa

SEQ ID NO: 46839 - DNA, 201 bp, Homo sapiens
gtggtctttacaaacttgactataaatgttgagacatttttcgagaaatacatacacatgtgtgtgtatgtgtgtgtataagtatctattggtatctccgyatgttagttaaaaatataataatatgccaagtacggacaatgaagacagctactccacaatattcatttaatttaatttttttttttttttttgagacgg

SEQ ID NO: 46840 - DNA, 201 bp, Homo sapiens
ccagttgatgtttcatgtggacaatggtgcgggcagattcactgctgtctatgatgctggggttccagggcatttgtgtgatggacaatggcataaagtcrctgccaacaagatcaaacaccgcattgagctcacagtcgatgggaaccaggtggaagcccaaagcccaaacccagcatctacatcagctgacacaaatga

SEQ ID NO: 46841 - DNA, 201 bp, Homo sapiens
catatacaccatggaacactaggcagccgtgaaaaaggatgagttcatgtcctttgcagggacatggatgaagctggaaaccatcattctcagcaaactamcagaggaacagaaaaccaaacactgcatgttctcactcataagtgggtgttgaacagtgagaacatatggacggacacagggaggagaacatcacacact

SEQ ID NO: 46842 - DNA, 201 bp, Homo sapiens
attctaatttgtatgacttggtatctcattgtggttttaatttgcatctccctgatgattagtgatactgagcattttttcatttgctttttggccacttrtatgtctttttcttttcttttcttttcttttttttttttttagaagtgtctgttaatttcctttgcccacttttaatggagctatttgtttttttcttgt

SEQ ID NO: 46843 - DNA, 201 bp, Homo sapiens
actattcacaatagcaaagacttggaaccaacccaaatgcctatcaatgatagactggataaagaaaatgtggcacatatacaccatggaacactaggcasccgtgaaaaaggatgagttcatgtcctttgcagggacatggatgaagctggaaaccatcattctcagcaaactaacagaggaacagaaaaccaaacactg

SEQ ID NO: 46844 - DNA, 201 bp, Homo sapiens
aggaattggcagaaccaggatttaggcactaaaatctgtttatttaaccactagcctacatggccattggaaatgaattatacagagatgaaaagttttcrttatagattccctcgttgaaactcaaaaacagaaggcaaaatatgtaaaagaactcaaaactgagaatatttttaaaaatagaataaaatgtcatagaaa

SEQ ID NO: 46845 - DNA, 201 bp, Homo sapiens
gttactgataaaaaaaaaaaaagaaaagaatgaagtaaatgaatgtgacttttctgtttcattttgtctaagtcttttaagccagagaaaacataatgtgraacagtgtttttatgtgtgttttatcactagagataagaaattgtcaagctgtccttaaggaccagggagggcccatggggaacagcatctttcctgatg

SEQ ID NO: 46846 - DNA, 201 bp, Homo sapiens
attttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgccttat

SEQ ID NO: 46847 - DNA, 201 bp, Homo sapiens
aatcattctactataaagacacatgcacacgtatgtttactgcagcactattcacaatagcaaagacttggaaccaacccaaatgcctatcaatgatagaytggataaagaaaatgtggcacatatacaccatggaacactaggcagccgtgaaaaaggatgagttcatgtcctttgcagggacatggatgaagctggaaa

SEQ ID NO: 46848 - DNA, 201 bp, Homo sapiens
tattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgcctta

SEQ ID NO: 46849 - DNA, 201 bp, Homo sapiens
ttataatggatgctacacatggaagctcttgggtcaccattggaggtaatagcgccctatagagttttgtgtctgggaagaagtggactttgtagttaggygattaaatatttaccagcttgccttaagccaagtacatgttaaaggactattttgtattattattttgtttttaaataggcccctttctctcatatttat

SEQ ID NO: 46850 - DNA, 201 bp, Homo sapiens
ttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgcctt

SEQ ID NO: 46851 - DNA, 201 bp, Homo sapiens
aataaaacaataacaaataggatgcatgcaaaatatctcataaatgtgtacctaacaaataaaacatacatcttcaaatacgaatatgcatttagagcctrgcttgctgtctgaggtcttaacttgttctgtgcttcaactccctattataatggatgctacacatggaagctcttgggtcaccattggaggtaatagcgc

SEQ ID NO: 46852 - DNA, 201 bp, Homo sapiens
tttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgcct

SEQ ID NO: 46853 - DNA, 201 bp, Homo sapiens
tttgtatttactattggtttcctgagggaagcaattattttaattattgattatttatggtttaatggggaaccattgtattctaactcacaggaataaamcaataacaaataggatgcatgcaaaatatctcataaatgtgtacctaacaaataaaacatacatcttcaaatacgaatatgcatttagagcctggcttgc

SEQ ID NO: 46854 - DNA, 201 bp, Homo sapiens
ttttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgcc

SEQ ID NO: 46855 - DNA, 201 bp, Homo sapiens
aaagtataaaatatttgtatgggcaaatgttttactaagggtgtttgggttattttctattgaacaaaacctgctaaaccagcataagatgcactgaactmaagtgcagcagagatgctactgtcagcaagagaaggattcaaagagaggaagcccaatccgagcattacctggacaattaaacagtcagttattgggatt

SEQ ID NO: 46856 - DNA, 201 bp, Homo sapiens
gtttccaatgtagaaatacatctcaaaaattatgcagaagttctatcatataatgttcttgcatgggtctgaagctctttgaaggcaagggtccttgactrtgttgttcattgttgtgtaattactgcctagatgagtacttggaaaggtggagtgattcaatgaatatgtgttgcatatagtttaagaagaactgggact

SEQ ID NO: 46857 - DNA, 201 bp, Homo sapiens
aaagtaaacattcaagtgtagtttgagtataaaagtcatttttcaattttattgaaaaaataaaatgtatgggtttttgcatttggttgctttattttgtkattgttctaatgtagaatacagactttggggtcaatctgtaaactaaattaatctgttaaaaaaaaacatttttttattttgagacagggatctcactct

SEQ ID NO: 46858 - DNA, 201 bp, Homo sapiens
taccaagtccctgctctttgggtaacagtggataagaaatgctacacaagctccttatgtggagaaaagactgttctcctatttggaagccttgtgcccayatccatgccctttgcacatttatcaaataaccgtgacttgtcctttatgttttttcaagcatttgtatcattaggcaaggctctgcctaatggaagagat

SEQ ID NO: 46859 - DNA, 201 bp, Homo sapiens
cctggggtcctaatctttgcctaggaatttaaagtaaagattggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtag

SEQ ID NO: 46860 - DNA, 201 bp, Homo sapiens
agggttagtatgattgttactttgagagttggttgaatgaggacaaacagatagaccagttaagagacttggcattcatccagtcattagctgtgaagtctggaccacagtgataatggtgaaaatgatcaagtgtggtttgattccagatacattttgaaggtaatgctgaaaagatatgctaatagtttggctgtggaa

SEQ ID NO: 46861 - DNA, 201 bp, Homo sapiens
atcaaaatcctaactttgtttctggtctacacaccttcatttgtccatctttttcaggtttattccctgctgtcctgaatcttgcttctaatgctcttatyacgaccaatgcaacatgtggagaaaaaggacctgaaatgtactgcaaattggtagaacatgtccctgggcagcctgtgaggaacccgcagtgtcgaatct

SEQ ID NO: 46862 - DNA, 201 bp, Homo sapiens
tcctgatggattctttactgctctcagctaatccattatatggttttagacatccaggatagacactgaaaggaataactattacaaaagtaattttaagrggagcatttgattgactgatgctcctcttatgtattcattgtgtgtatgtattgaatttgtgtattcattgtatgtattcaatattcaatgtatgtattc

SEQ ID NO: 46863 - DNA, 201 bp, Homo sapiens
tgatgaggctaaaaacatctccttcaatgccactgcagccttcaaagcttacagcaatattaaggactatattgatgaagctgagaaagttgccaaagaarccaaagatcttgcacatgaagctacaaaactggtaagaaacaaatggcacatgtgctgggaatggaagtcaacctttttgaatttttcaaatgtaagtca

SEQ ID NO: 46864 - DNA, 201 bp, Homo sapiens
ggaattaccaggagccctatctcacacccataggttgtgatgcagttggtctggggtagagtcagaccactgggatattcaagaactccccagattatacwgataaagaattactgtgatcctgtagttacctaatagctaagactctcttccctctggaaaatgccttaattggtactgccaatcttttttttttttttt

SEQ ID NO: 46865 - DNA, 201 bp, Homo sapiens
gttacctaatagctaagactctcttccctctggaaaatgccttaattggtactgccaatcttttttttttttttttaaacagagtttcacccttgttgtcsaggctggagtacaatggtgtgaactcagctcactgcaacctccacctcctaggttcaagcaattctcctgcttcagcctcccaagtagctgggattgcag

SEQ ID NO: 46866 - DNA, 201 bp, Homo sapiens
agtcttttgctgctacaaataatcttgcaatcagttgttttgtgcacgtgtcttttgctttttgtcattgcatctttaggatagtttgttttttttttttkgttttttttttttttttgaggcagagtctctctctgtcacccaggctggagtgcagtggcaggatctcagctcactgtaaactcttgcttcccaggttca

SEQ ID NO: 46867 - DNA, 201 bp, Homo sapiens
gggaaacaatgaggatcttcaacttagactgagaaaagcacactaatggacttaaaaaggcatgcggggattgggcttaattgtaaggaagcaaaaaaackaaaataaaaaaatcttatttattacattctattagccccatggactttgcaaggcctgtgtccttcaaaaatgctgacattggtcgctgtgcccatcaga

SEQ ID NO: 46868 - DNA, 201 bp, Homo sapiens
tctgtaacttagcaaaaatacaaattggtgtttccactttgatttctctttttgaaataaattttcagcttgactttcttttgcctcgggtattctggatkatcattttgtagcatctggataattttacattaacatctggagttgagggtctttttatttgtcggatgcatatagaatacttctgtaagaaatgtattt

SEQ ID NO: 46869 - DNA, 201 bp, Homo sapiens
gattgttttgcatatttcctgtcctggttttagaaacagtcatttcttggaggagccctggttccttatagtgaaaaagggtatttcaagaccacaggtcrgtagggctgttcactgttaatatgtaggttgtttctaggtcttttcagtggatcaggtgggaaatatatatttcaaatagagaaaatacattatagttta

SEQ ID NO: 46870 - DNA, 201 bp, Homo sapiens
ttcttttctctgtgcccatctcataccattgtatgtgtgtcatatgatggatctggtttctttttcttatttgttgggagatgtccagagactcaaggatstatcctttgaccaaatttttcactcttcaagggcctcatactgctctgatttcagatgtatagatatattgcttatcaaacactgatgggtctgaacatg

SEQ ID NO: 46871 - DNA, 201 bp, Homo sapiens
aaaatgaacaataattatttcatcccatcaaatattgacaagctattattcttttactatatattggctagaattttatgtaaagaaaagcttttcaccaytgactcttatttacctacaggtagaattcaaacaggaaagcagatcaaatacttgattctttctttttatttcccagtttttagaaaaaatgagttggtt

SEQ ID NO: 46872 - DNA, 201 bp, Homo sapiens
acctggggtcctaatctttgcctaggaatttaaagtaaagattggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgta

SEQ ID NO: 46873 - DNA, 201 bp, Homo sapiens
cagtggtgttttcagcatggacaactggagctttaacttaaaagatctagaaactgggcttgttggccacagttttagtgtgattagaggtggtcataggktagtcaaagttgccactatcctggttatggatggtaatagaactgcctatttatttgatgtcttcacttagttgtctcctaggtccttcacagcgaacat

SEQ ID NO: 46874 - DNA, 201 bp, Homo sapiens
tgtgtgtgtgtgtgtatgtgtgtgttttgtggatgtatgcgtgcatatgtatttcttagtttattctttcagaagccttgaatttacatgaagttatgtgwtaatgacctaccttatataggacctagaattttttgttgttcttctgtaaaaccatgctccctgaactgtagtctagtcatcagaatttgccagtcaact

SEQ ID NO: 46875 - DNA, 201 bp, Homo sapiens
attaaggcaatcagaacctagtaaacattgctgaattcaccattgtatcccccagtgctaatacacaaaaagtatacaatgaattctactacctacctttygcagtgtggctatccttgcaaatttcaccctttcccttcctttcagtcattcttgtttccccatgctccatagatcatttagccaccacatctttttgtg

SEQ ID NO: 46876 - DNA, 201 bp, Homo sapiens
cttacctccatatttaatggattaccattctcattgattttaccttcttaatttctcttaaattgattttctttctctatacctaatgttagtacctttcygccatgtttctatctggtttacattgctggaacagcacctgatttgctatcttgttcttagtcttgccatcccaacttagtccattcctctgatgtcttt

SEQ ID NO: 46877 - DNA, 201 bp, Homo sapiens
ttttcagcatggacaactggagctttaacttaaaagatctagaaactgggcttgttggccacagttttagtgtgattagaggtggtcatagggtagtcaargttgccactatcctggttatggatggtaatagaactgcctatttatttgatgtcttcacttagttgtctcctaggtccttcacagcgaacatttgccagg

SEQ ID NO: 46878 - DNA, 201 bp, Homo sapiens
agtctgattgtgtacttgcaaacacttccatggtatctatttcaagtgtattttgaaaagtctaacatctaggctttcaacttgatctgttgtactttctrtattctatacctgagtgtcagcaaagacgcctgggagctgtctttgagtcttccttctctcttacctccatatttaatggattaccattctcattgattt

SEQ ID NO: 46879 - DNA, 201 bp, Homo sapiens
tctacttggtgaaggacattctaatcatctagatgcctaagtcagaaacctaggcatcatcccttcattctttctgttcctcacagtcacacttaattaaytgaacgattttcggtccctacatacttcctgatttcctcccctgtgccctactgcttctctccctaactcagataatgatttctcgactatcctatttta

SEQ ID NO: 46880 - DNA, 201 bp, Homo sapiens
gcaataagtgacacatacacaatttataaatgataaaatataaaatatttgtcttaaatagggagatgctgtaatgtctctttcccctcttcaacgtatcrtattacagtgattcctcaatgagcagctgaatttccacctgttcttgacgtattacctatcaccatcaggctatgttatgaaactcacttttagagataa

SEQ ID NO: 46881 - DNA, 201 bp, Homo sapiens
agaactactatcaacaataaaaaaagctttgattttaacgtgtatatcttaagatttcttttgatcaatactaatgaaaataaacctgaaaagcgaatcaytggacaaatgtgagatttttcctttaatttatacattaattgatgtaagatagtatttagaaagtttcaatcctttccagttacaattgtaattgtcact

SEQ ID NO: 46882 - DNA, 201 bp, Homo sapiens
acctatgtctttactgtgtatacatatacacccatatccctatatattcgcgtgttcacttttgatttcaaattttatttgtgaaaaaagcagatttattyttttttttctttgagatggagtctcgctctgtcaccccctggctggagtgcagtggcttgatcttggctcactgcaacctcagcctcccaggttcaagta

SEQ ID NO: 46883 - DNA, 201 bp, Homo sapiens
caaactatcttgcaaggctctactgcaacatgtctgatacacagcacctgcagtcaacagactctgtagttgcaaagtattgagttttgtgctcaagctayagaagttaatggactgtcataacattgttcagatgaaacccagcaaagcttaacagactaaggtggattttgcctccccttttaatccagtgctaatttc

SEQ ID NO: 46884 - DNA, 201 bp, Homo sapiens
catagtcctaatatgcatttttatggtcgacagtcgtggtatatgagagaaaatatgtagcctttgatgtaaaaagattgtttttaaaaaaacataaactktacaatatatgcttgtgtgtgtcagtcagagggggaggtggagagaggcagtgtttctgaaacaagagatctatgaaagaagggaacagtctgttagttc

SEQ ID NO: 46885 - DNA, 201 bp, Homo sapiens
acaaactatcttgcaaggctctactgcaacatgtctgatacacagcacctgcagtcaacagactctgtagttgcaaagtattgagttttgtgctcaagctrtagaagttaatggactgtcataacattgttcagatgaaacccagcaaagcttaacagactaaggtggattttgcctccccttttaatccagtgctaattt

SEQ ID NO: 46886 - DNA, 201 bp, Homo sapiens
tccttgctcctctatttttgaaaattaacatagtcctaatatgcatttttatggtcgacagtcgtggtatatgagagaaaatatgtagcctttgatgtaaraagattgtttttaaaaaaacataaactttacaatatatgcttgtgtgtgtcagtcagagggggaggtggagagaggcagtgtttctgaaacaagagatct

SEQ ID NO: 46887 - DNA, 201 bp, Homo sapiens
ttcaaagtgttcgctaactcacctcttgcaagaacaaactatcttgcaaggctctactgcaacatgtctgatacacagcacctgcagtcaacagactctgwagttgcaaagtattgagttttgtgctcaagctatagaagttaatggactgtcataacattgttcagatgaaacccagcaaagcttaacagactaaggtgg

SEQ ID NO: 46888 - DNA, 201 bp, Homo sapiens
atttacctgtataaattattaataagtacatacaacataatccctgtcctatctgtttagggagacaataaatatctatgaaaaatgggatctcagcactrtataattaagggagaggtatgtgctacagaacatacatgcaataatcattcaaagggatgagctactgcagtggagagagatgcaaagtgtcctggagtg

SEQ ID NO: 46889 - DNA, 201 bp, Homo sapiens
ttatgtgagtttctcagtatatacatgaaagacactctgcctgtatccttgctcctctatttttgaaaattaacatagtcctaatatgcatttttatggtygacagtcgtggtatatgagagaaaatatgtagcctttgatgtaaaaagattgtttttaaaaaaacataaactttacaatatatgcttgtgtgtgtcagtc

SEQ ID NO: 46890 - DNA, 201 bp, Homo sapiens
gttcaaagtgttcgctaactcacctcttgcaagaacaaactatcttgcaaggctctactgcaacatgtctgatacacagcacctgcagtcaacagactctrtagttgcaaagtattgagttttgtgctcaagctatagaagttaatggactgtcataacattgttcagatgaaacccagcaaagcttaacagactaaggtg

SEQ ID NO: 46891 - DNA, 201 bp, Homo sapiens
aaaaaaatatggactgctttgattttcctttgaagtaatgtcacaagaagaaaacagcaagctggttcatttgccaaggaaggaagagcatgaaagacaaratgaaatgccagtaactaggtactagaggaaaggagtgctaagaaaatgttcaaaagggatcttgaaaagcaaagatcacttggtagatgaacttgttca

SEQ ID NO: 46892 - DNA, 201 bp, Homo sapiens
gctgtgtaggccaagaatctagttatcctttcagaaatttttttttctgaccacctactctgtgccttaagcaaaagtacctgcccttctttctttctttyttttttttttttttgagagcatggtgtggtctcggctcactgcaacattcgcctcccgggttcaagcgattcacttgcctcagcctcctgagtagctggg

SEQ ID NO: 46893 - DNA, 201 bp, Homo sapiens
ttccaacttgtaaaaggcaccatttgagcagggaaacaccctcagtcttttgctgattatgtcaaatgggaggaagtaagaacacagcattacagccacgmctctttatacagcagccaccctcttctgtgcctttgccaatacgttccctctgcctggaagattgcagccctttcactcctccacccgagactaactaat

SEQ ID NO: 46894 - DNA, 201 bp, Homo sapiens
atcgcttgaacccaggaggcggaggttgcagtgagctgagatcgtgcctctgcactccagcctggtgacagagcgagactccatctcaaaaaaaaaaaaaataataataataagggtaaatacaaggagtgtgttttgaatacaaaatatctatttttagaatctcaaacccatgagttactttcttccatatataagtcc

SEQ ID NO: 46895 - DNA, 201 bp, Homo sapiens
gtgcccatggaaggcgagagtggaggagtgtcctctttctcccccaccctcaggcggcggcccggccaaagccagagggggctgtctcctcctcttccccrgcagctgctgctcgctcagctcacaagccaaggccaggggacagggcggcagcgactcctctggctcccgagaagtggatccggtcgcggccactacgat

SEQ ID NO: 46896 - DNA, 201 bp, Homo sapiens
ggagaactttgccccagtccggcaaagtattgtcacctagttggcattgtaattatgacttcaaaagggcattccacaattctatcaatccacctgcttcrggatgatgggaaacatgataagaccagtgaattccatgagcatgagcccagtgctgcacttctttagctgtaaagtgagtgccttgttcagaggcaatgc

SEQ ID NO: 46897 - DNA, 201 bp, Homo sapiens
ctggatttccgaaatatttttaaaagattttttctgggatcatttaaggcctcatctgttcagaaccaaggggaggaccgaaatagtatgccaaattcttktccagccctcaaattttatgagcctgagttgcattgtgtgggtaaaagtcttgtgctctgtggatcaggaggaagttagatgttttggatatttacatag

SEQ ID NO: 46898 - DNA, 201 bp, Homo sapiens
ggatgtcctagaaaggggctgtagtgctgcagctgtccacttttgggtgctacctgcatatcttgcagaatcatctgtgaaccaggccctagtcttctctkcctctgtcaactgatcatggggaactccctgtgaggccatcagtgcaggcttggggagagaaggcagggtggcaggagtggaggccatgggcgtttgagc

SEQ ID NO: 46899 - DNA, 201 bp, Homo sapiens
agaatcgcttgaacccaggaggcggaggttgcagtgagctgagatcgtgcctctgcactccagcctggtgacagagcgagactccatctcaaaaaaaaaawaaataataataataagggtaaatacaaggagtgtgttttgaatacaaaatatctatttttagaatctcaaacccatgagttactttcttccatatataag

SEQ ID NO: 46900 - DNA, 201 bp, Homo sapiens
acttgaacaaagatatacagcttctccagagaccaggcagacactaggtttatgatttcctgacttccactgcagatctcttaccatttttctatgagagwcataaaaaaagaatcagctatttactttctagtcaaggtgggttaaaatcaagccacttgttttcaaacatcgatttcgggttcatgccatcaaattaaa

SEQ ID NO: 46901 - DNA, 201 bp, Homo sapiens
aaaagaatcagctatttactttctagtcaaggtgggttaaaatcaagccacttgttttcaaacatcgatttcgggttcatgccatcaaattaaaaaattcrcttaactgagtttaatttgctttcacttaggaagcagctgcctttcaagataataaaataaacagatacaataatatttggtcagctgtggcttttaatt

SEQ ID NO: 46902 - DNA, 201 bp, Homo sapiens
caaaagtggggttgaccattttcttcttcgctgtctccatgattttgctttttccaagatgtcatgtagttagaatcatacaatgtgttgtcttttcaggytggcttttttcacttagcaatatgcctgtaaggttccgccatgtcttttcttgccttgataattcatttctttttagctctgaatactattttgttgtct

SEQ ID NO: 46903 - DNA, 201 bp, Homo sapiens
tgttgtctggatataaccacagttgaattatccatttacctcctgaaaaacatcctgcttgctaccatgttctggcaatatgaatcaagctgctataaacrcttatgtgataagtcttgtgtggatataaatattcaacttatttgggtaaataccaaagagtgcaattactggatcatatggtcagagcatgctagtttt

SEQ ID NO: 46904 - DNA, 201 bp, Homo sapiens
taaccacagttgaattatccatttacctcctgaaaaacatcctgcttgctaccatgttctggcaatatgaatcaagctgctataaacacttatgtgataartcttgtgtggatataaatattcaacttatttgggtaaataccaaagagtgcaattactggatcatatggtcagagcatgctagttttgtaataaactgcc

SEQ ID NO: 46905 - DNA, 201 bp, Homo sapiens
attttgcattctcaccagcaatgaacaagagttcctgtttctccacattctcaccagcatttcatattgtcaatgttttagacatcagctattctaatagrtatgtagtggtatatcgttgttttaatttgaaattctctaatgatgtaagatgatgagcatgttttcatgtgcttattttccatctgtatataagctttg

SEQ ID NO: 46906 - DNA, 201 bp, Homo sapiens
aattccctttgctcctttgtgaaagatcagatggccatattcatgcgggtgtatttctgggctggctattctgttccattgatctaagtgacttttttctsaccagtactatattgtcttgataactatagttttatactaagtcttgaagttgggtagtgttagctttacaagtttgttcaatattatttaatgatgtgt

SEQ ID NO: 46907 - DNA, 201 bp, Homo sapiens
cccaaagttaatatatttcctgggtactcattcacactcttctgccaatagtattaatgctttgggaaatgtttgagaagtgttgttccagtggaaatgarcctgtgggttcactgattcatttatccattcattcatttattccttcatacagtatatagctttcaagccacttttatggactattttattaactttgaa

SEQ ID NO: 46908 - DNA, 201 bp, Homo sapiens
aagtccccattcttatgatgtttttattttagaggggataggaagaaggagaaaaagccaatgaataaggaaagaaataaatcaacaagataatttcatawaatgctaaggatgggaagaaatgaaaacaggtgttggaatagatcatggggtgggagttaattgaaggggtagtcaagaaaggccctgctaaagaagtgt

SEQ ID NO: 46909 - DNA, 201 bp, Homo sapiens
gcgctctaattgtctgttagacttttctaagagttttaaaacaaactcgggcctcaactctcccccagaggaattgactccacctcctctagggctggacyggaccacagactcccactatgggcgcttgtctattgtgtcaggctgcctgtcggggaaaaccacagtaataggaaaaatgtgttgtgcgttagagtagac

SEQ ID NO: 46910 - DNA, 201 bp, Homo sapiens
ttatcatgacaaatgctagtcaatgttgaatcacagagggctatatgagatccattttcattcttaaagaaaattattatatctttttattaatatggtgratattaactcagtaaataataaagaaaactaatatgaagtacaatttgtaatattctacttatgatgcatgatttttgttgcacaattagaaaatactta

SEQ ID NO: 46911 - DNA, 201 bp, Homo sapiens
cacccacttgctatacatcaggcttggaaacatactcctgaccagcatttatgctagacatgatttatgtctcatactgtgctaagggggtgactaaaatytatattgaccaatacttgatgagtatatttgacagatgtttaaaagttaaccctgctcaaaaatgtaacgggatctttactaatcaggatcataggtttg

SEQ ID NO: 46912 - DNA, 201 bp, Homo sapiens
cattatcaattttcagcctctcttcttttttatttttaatttctttgccacctcttcttaatacataatgctctttcttccttcgttcctccccctctctstttcttccttcctcctttctttcttgctttcttctttcttttctttattctttctttttttttttttttcaaggtcttgacgtgttgcccaggctggagt

SEQ ID NO: 46913 - DNA, 201 bp, Homo sapiens
tgacaaatgctagtcaatgttgaatcacagagggctatatgagatccattttcattcttaaagaaaattattatatctttttattaatatggtgaatattwactcagtaaataataaagaaaactaatatgaagtacaatttgtaatattctacttatgatgcatgatttttgttgcacaattagaaaatacttaagttct

SEQ ID NO: 46914 - DNA, 201 bp, Homo sapiens
gatttatacagtagtcttatgatccaatgcccatgtatgaacaaaggttactgttcctgtcttctaaattggggttcccagtgtaatacaggaagactachgtgtgctagtaaacagaaagcacaatccacatttgaccatattttcctcgttggatgtgtttatggatatattttattctgcttttatctttctgagatt

SEQ ID NO: 46915 - DNA, 201 bp, Homo sapiens
ttatctatggaactcttctttgttagatattgaatttcatggattaatcccctagctttttgtctttggtttattttgattactctttttttttttttccytttttttttttgagacaaagtctcgctcttgtcccccaggctggagtgcaatggcatgatcttggctcactgcagcctctgcctcccaggttccagcgat

SEQ ID NO: 46916 - DNA, 201 bp, Homo sapiens
ttctttaaaatgagcaaagatgagctcagcaaataaggtacttgtaataatgaaagtactatatgcaggaatactggctttttgtttttaatctgcaattrgttaattaaatttcattgtagatgtattgcataaaatacatttgaaaggcaccattcttcctcataatacagctagtgaaggtccaaatttcagtgactc

SEQ ID NO: 46917 - DNA, 201 bp, Homo sapiens
cttttgcatgtcagcatgttgtcattattattagaagaacacatctttcaaagaaaggaaacataaactccataatgctgtctgatattattcttgaagayggctatcattttagctgttataaaacaggaaggaacatcatggagcattagattataatatctatagtcccactagcacaccattaaataaagtgaaggt

SEQ ID NO: 46918 - DNA, 201 bp, Homo sapiens
ggttattctttaaaatgagcaaagatgagctcagcaaataaggtacttgtaataatgaaagtactatatgcaggaatactggctttttgtttttaatctgyaattagttaattaaatttcattgtagatgtattgcataaaatacatttgaaaggcaccattcttcctcataatacagctagtgaaggtccaaatttcagt

SEQ ID NO: 46919 - DNA, 201 bp, Homo sapiens
agattttctatttcttcatcattcagtcttggtcgattctatgtgtctagcctttatcaacttcttgtaggttattgtatttattggtgtataattgttcrtagcagtgtctatgatccttttttatttctgttgcaatgtctcctctttaatttataattttatttagttgaatcctcattccttttttcttagtttggc

SEQ ID NO: 46920 - DNA, 201 bp, Homo sapiens
aatcatggaaatgaactagtgtccacataactgaaatccttcacatctggctatctttaggccctaaattatgtgaaattcactgagtattttccacagabttgtttactgttgtaaaatcttaaatcaaaatgttacatcaaaggaagagttgcatcaaaagaacctcagcaaaacctcaaaacaaccaaacactccact

SEQ ID NO: 46921 - DNA, 201 bp, Homo sapiens
taggtatacatgtgccatgttggtttgccgcacccgtcaactcatcatttacattaggtatttatcctaatgctatccctcccccagccccacaccccccmcaacagaccccaatgtgtaatgttcccctccctgtgtccatgtgttctcattgttcaactcccacttatgagtgagaacacacactgtttggttttctgt

SEQ ID NO: 46922 - DNA, 201 bp, Homo sapiens
tcgctcttgtcccccaggctggagtgcaatggcatgatcttggctcactgcagcctctgcctcccaggttccagcgattctccggccttggccccaccccscccccgccgacccccatgagtagctgggatttcaggtgcctgccaccaaacccggctaatttttgtatttttagtagagatggggtttcaccatgtgggc

SEQ ID NO: 46923 - DNA, 201 bp, Homo sapiens
ctcttttatggctgaataatattcctctatctccctctctccctctctttctgtgtgtgtgtgtgtgtgtgtgtgtgtgtgtgtgtctgtgtgtctgtgtrtgtgtgtatactatatttactttatccattcattcactgatggatacttaggccatttatttatcttgactgttgtgaatgatgctgctatgaacatgtg

SEQ ID NO: 46924 - DNA, 201 bp, Homo sapiens
tatttatctatggaactcttctttgttagatattgaatttcatggattaatcccctagctttttgtctttggtttattttgattactctttttttttttttccttttttttttttgagacaaagtctcgctcttgtcccccaggctggagtgcaatggcatgatcttggctcactgcagcctctgcctcccaggttccagc

SEQ ID NO: 46925 - DNA, 201 bp, Homo sapiens
aaaaattcttttctcaaaatggacattttccagtattggatgaagtggtctgctctctctctttctgtctctctctttctctctctctctgtctctctctytctctctctctctctctctctctctctctctctctctatatatatatatatatatatatatatatggcaactagatgtatactttggaattcctttaagg

SEQ ID NO: 46926 - DNA, 201 bp, Homo sapiens
tgacactcaatgtgtaagtgcccagttgaaatagtttccttatcttttctttgaaggtgagaaggctaagttccttttatatacaaaaatgtgttctgtcraacactatcactgcaaggccatttactaaaaatgtttatgggatggaatctttttcagcacttgctgtcacctcagcgggccccagagaggcttattcag

SEQ ID NO: 46927 - DNA, 201 bp, Homo sapiens
cttcacttcgagttaactgatttaaatttaatttttctctcctcttccattgccaggctgggacctttggcctacaatcagcaaggggctgtgttccctgmaactgcaattcttttgggtctaagtcattcgactgtgaagagagtggacaatgttggtgccaacctggagtcacagggaagaaatgtgaccgctgtgccc

SEQ ID NO: 46928 - DNA, 201 bp, Homo sapiens
atttccttctcttttatggctgaataatattcctctatctccctctctccctctctttctgtgtgtgtgtgtgtgtgtgtgtgtgtgtgtgtgtctgtgtstctgtgtatgtgtgtatactatatttactttatccattcattcactgatggatacttaggccatttatttatcttgactgttgtgaatgatgctgctatg

SEQ ID NO: 46929 - DNA, 201 bp, Homo sapiens
atcatccttacaataggctttatcttttggaaatacatataatattgatgtgctctggttttaatcatcacctgcctcttgcctcagcaagctctaggttrtattttaaaggagattaaatatattttcactgaatttaattgtatctaagtaatacctttcgaagagtcaaataatacagaaaagctcataacaaaaagt

SEQ ID NO: 46930 - DNA, 201 bp, Homo sapiens
agcaggatttccttctcttttatggctgaataatattcctctatctccctctctccctctctttctgtgtgtgtgtgtgtgtgtgtgtgtgtgtgtgtgtstgtgtgtctgtgtatgtgtgtatactatatttactttatccattcattcactgatggatacttaggccatttatttatcttgactgttgtgaatgatgct

SEQ ID NO: 46931 - DNA, 201 bp, Homo sapiens
aatccaaacagtgttattgtaaagtctctgggcttcttagagcaaaagttttaaaaccatcatttatatgtttaatatatttttatctatttctagatttrttttaaaggcagtaaaataatctaacaggctcctgggtacccatggtgtttattatattatgaagaaataaaatattactcatacagtcgaaaccctaca

SEQ ID NO: 46932 - DNA, 201 bp, Homo sapiens
ttgaaaaaacaaaaacaaaacctatgtctgtagtatgtatatttgtgcatttaaatgtttgtgcccatggacttgtgtgtgtgtgtgtgtgtgtgtgtgtkaatgtatgtctatatatatatgtatggtgtttgtgtgagaggcaaagagaagagaaaaaagaatgacgttagcttatcaatatattataataaaattgtg

SEQ ID NO: 46933 - DNA, 201 bp, Homo sapiens
ggacctgtttttatgcttccaagatggcactttgaatgctcaggagaggaggaacattgtgccctcacatggcagaagagcaagagagagagagctctcamccctgtaagcctttttaatagtggcatcaattcattcatgaggacagagccctcatgaccgaaacacttcccaaaaggcccccctcccaacactgttgca

SEQ ID NO: 46934 - DNA, 201 bp, Homo sapiens
caaaaacaaacaaaataaaggattcaaatgggtgacatggccagtcctggttacagtatgagacagatgccggttacggtgggcaacagaacagatgctggctacagtggtcgacagagttcattttagttcaagcagaaggtagggctggtgcttgttacagtggccagtaggcctggtttctggttatagcacatggca

SEQ ID NO: 46935 - DNA, 201 bp, Homo sapiens
gtttctttctttttccctctgcattacaaatacatacgcaatactttttcaggttgttttttccaaaagcaacaataaactactagtggagtaaaaaatayggaactgaaagtccaactgtttgattaagtgtatgttataaccattgtatgactttgagtgaatttctatttttaagaaagtggtatttggaaccacaat

SEQ ID NO: 46936 - DNA, 201 bp, Homo sapiens; identical to SEQ ID NO: 8792

SEQ ID NO: 46937 - DNA, 201 bp, Homo sapiens
tatatgagatccattttcattcttaaagaaaattattatatctttttattaatatggtgaatattaactcagtaaataataaagaaaactaatatgaagtrcaatttgtaatattctacttatgatgcatgatttttgttgcacaattagaaaatacttaagttcttgagaatagttggaaagggttgtaatgatcagaaa

SEQ ID NO: 46938 - DNA, 201 bp, Homo sapiens
attcttaaagaaaattattatatctttttattaatatggtgaatattaactcagtaaataataaagaaaactaatatgaagtacaatttgtaatattctayttatgatgcatgatttttgttgcacaattagaaaatacttaagttcttgagaatagttggaaagggttgtaatgatcagaaacacatattatacctaaac

SEQ ID NO: 46939 - DNA, 201 bp, Homo sapiens
aataaacttgggcctgtagccaatagtttgtattccaggcttttaaaaaaaattcaaatacagaaacatcagattttcattgccataggggtcatgacatmttttaacataagtgcagaaactatctgtaatgaatcaaaacttaaatcagatgacattaagaccagctttgctattaccacagatggcatcacaattaac

SEQ ID NO: 46940 - DNA, 201 bp, Homo sapiens
tcataggtagaataaatgagagaattatggtgatctaaatatagaaagcatttaaattagagaacagctgaaattgtgcttctaaaacatttcagtgttgytcattttctatatgttacattgaaaaaagtaatatggaaatgtaatgttttcatttgcagatgcttaaatttagatacatgtttaatactgtaatcattt

SEQ ID NO: 46941 - DNA, 201 bp, Homo sapiens
agagaattatggtgatctaaatatagaaagcatttaaattagagaacagctgaaattgtgcttctaaaacatttcagtgttgctcattttctatatgttayattgaaaaaagtaatatggaaatgtaatgttttcatttgcagatgcttaaatttagatacatgtttaatactgtaatcattttgatcaaacagcagctat

SEQ ID NO: 46942 - DNA, 201 bp, Homo sapiens
attgaaaaaagtaatatggaaatgtaatgttttcatttgcagatgcttaaatttagatacatgtttaatactgtaatcattttgatcaaacagcagctatyatttattattcaatatttatatgtaaaacctgaaactttcatctaccttaatgatggtattgtgataaaagtacccatgtatcaccaagctttgccaatt

SEQ ID NO: 46943 - DNA, 201 bp, Homo sapiens
tgctgtgtatgcccaactttatggctagatgggtcagaaagcatccagttcatgaaaggcagtttaggttgcatggtgacttgatgacctacagtcaaacrttcagtttctaccaaagcccagtaacaggccaagagttgtctctcaaatggagagtagtgatctgcagaagatggcagggccttgctccaaaatcctaga

SEQ ID NO: 46944 - DNA, 201 bp, Homo sapiens
cagcagctatcatttattattcaatatttatatgtaaaacctgaaactttcatctaccttaatgatggtattgtgataaaagtacccatgtatcaccaagmtttgccaattctttttattccttaaagaatatccgacaatttgctggtttgtataagtttgagttaagacaccgtaataatgtcctgcagtatatatgtc

SEQ ID NO: 46945 - DNA, 201 bp, Homo sapiens
aacataatgttgtgggaacaggaagcaaaattttgctagtgggtcactagtggtgatggtgagtggtgccacttccgcttccaccccttgattctgggacmcgtgaacactggctatgggagaaacagtaccatattttggacactgattcaaggcatacacagccttctggagaactttgccccagtccggcaaagtatt

SEQ ID NO: 46946 - DNA, 201 bp, Homo sapiens
gacctttggcctacaatcagcaaggggctgtgttccctgcaactgcaattcttttgggtctaagtcattcgactgtgaagagagtggacaatgttggtgcyaacctggagtcacagggaagaaatgtgaccgctgtgcccacggctatttcaacttccaagaaggaggctgcacaggtctgtaaatatgacttaagtccta

SEQ ID NO: 46947 - DNA, 201 bp, Homo sapiens
tgagttcaactttttagattccacatgtgagtgagatcatactgtatttgtttttctatgtgtggcttatctcacctagcacaatgcccttcaggcttatmcatgtcattgcaaatagcaggatttccttctcttttatggctgaataatattcctctatctccctctctccctctctttctgtgtgtgtgtgtgtgtgtg

SEQ ID NO: 46948 - DNA, 201 bp, Homo sapiens
gaactttattcagtagcctccgtggtaaagtttgtatctgttctgatttccaaaagcactatctttgattgtgtaaagagaaagaaaaacaaatgaaaatrcttgtggtctctttcatctcatcgtgggatttttgcattagtatagaaatacagtgtaaatcagtctttccacacaaaagaggaaatcttctctattgtg

SEQ ID NO: 46949 - DNA, 201 bp, Homo sapiens
taaaacctgaaactttcatctaccttaatgatggtattgtgataaaagtacccatgtatcaccaagctttgccaattctttttattccttaaagaatatcygacaatttgctggtttgtataagtttgagttaagacaccgtaataatgtcctgcagtatatatgtcaaaatacatgggtcaaaaagacactctaaaatag

SEQ ID NO: 46950 - DNA, 201 bp, Homo sapiens
gcatttctttgtggcttcagttttgacttcagtttttaaacaatttaaacaaataaaaattacattacagaattgttacttttaaactcttactttccackgggactgttattgtaaaatctgttcttattcttttaatttaactccattattttgttttaaatgtaatgattgttcattatatttttctccaactgcttt

SEQ ID NO: 46951 - DNA, 201 bp, Homo sapiens
ctacttatttttacgttacttaaaaaatgaaatacatgtcagtttgaaacactgccttaataactgtgtgcaagtactcagtaaaaatcagcagatgctcktttggttgtgtccctccctgtctgtgactttgattcagccagtcactcaaacactgctacggcttgaaagttaaatgttcgatttttctggtaccagtct

SEQ ID NO: 46952 - DNA, 201 bp, Homo sapiens
ctttaaatgaagtagctcaataacagaacagtgaacctaactggccccattttagtcaatctaatgcattcctgcacaggtatttatcatgacatttactytacactcaacctacatgaagatcaacatagtcacttttacgagagtagatttgcatccatccaataatctttctcaccagtgtaattagaaaggatacag

SEQ ID NO: 46953 - DNA, 201 bp, Homo sapiens
atatataaacacatacgcacaagaagactgtctctctgtttgtatatatacatacacgcacatataaatacacagagagagtgtgtgtgtatatatacacmgagagagagagagagagagagagagagagtcagtcttgctctgttaaccagctggggtgctgtggtgcaattatggctcactggagcctccacctcccag

SEQ ID NO: 46954 - DNA, 201 bp, Homo sapiens
tcataaaggatacaggtaaaagttctgtgaaattgtttaaaaaataactaaataaatgaattcccaaatgattttgagtctttattgtagttcttatcacwctttgcagtggccatttctagcacttttcaggcaataaatggtcttctttcacttccatattattgaaaattcttttgcataatgcctagcaaatatctt

SEQ ID NO: 46955 - DNA, 201 bp, Homo sapiens
atttataacatatataccttcacctgacttggagtttcataaggaatgcaacagcttccaattcatttactttctttttgcttaacaaagtatctgacacrtagtacaaaagttaaatattataaataaaagattaattgcacagatatttttaaaggagacagaaaagatttgaatatccaggaattccacccaacgatg

SEQ ID NO: 46956 - DNA, 201 bp, Homo sapiens
cttttaaaacacccacggtttccctacgtgtacacacacactttctaacacgttcgcttttctgttcctatgattctaagatgctctctgctagtcctgtstaagtgctacctattcttaagtaacagttcaaatgccagtatctctatgaggctttttctggatctctgcaaaaaaaaagggacaagaaacaccttcctc

SEQ ID NO: 46957 - DNA, 201 bp, Homo sapiens
atagttcacagcatacagtatttattatttttatgattaactaatgttttatgaggtccttagagtgctagacactgtttgcatgaattattttatatgayctcaccacaaccttataaaaaagtttttattgtccgatgttttagacggcgtagttataggagttagtttcagccaccagttgtatatagagaagctgct

SEQ ID NO: 46958 - DNA, 201 bp, Homo sapiens
tatagatcagttccccccacccttcacacatgggcccaaaatgtacacggagcaggagcaagaaatacacgtccttgctatctttgttagtttaatccacrgagactttggagtctgcagttatacagcatcctagcctgtcctgactgatatgatcccttaactgatttttctactcaaagtctcttctccctccgatta

SEQ ID NO: 46959 - DNA, 201 bp, Homo sapiens
ctttatcaacttcttgtaggttattgtatttattggtgtataattgttcatagcagtgtctatgatccttttttatttctgttgcaatgtctcctctttartttataattttatttagttgaatcctcattccttttttcttagtttggctgaaggtttgtcaattttgtttatctttaaaaaaacaattcttacttatat

SEQ ID NO: 46960 - DNA, 201 bp, Homo sapiens
tcgccatgctatagagacagatgatcttccagatggatgcctgagtgtagaatatatagatcagttccccccacccttcacacatgggcccaaaatgtacrcggagcaggagcaagaaatacacgtccttgctatctttgttagtttaatccacagagactttggagtctgcagttatacagcatcctagcctgtcctgac

SEQ ID NO: 46961 - DNA, 201 bp, Homo sapiens
gcccaggtcagcaatgcagcaactcccatttttcttgatgaggatgtttttgctctttaggtctcgatgagcaattgcgggctttccttgggtgccatacrtttctgtgtgcaggtggcacagaccacaggcagctgaataagccaatttaagcagggctctggtgtccagcgtagcacatttcaggaagtcatagagaga

SEQ ID NO: 46962 - DNA, 201 bp, Homo sapiens
aggacccatggtgcttctggctttgtccttctttcttaagattgctttggatattttgggtcatttgtgatttcatatgaattttaattattaaaattctyattcttttttttagaactgttttttctacattttctttctttttttctttcttttttttctgaggtggaatttccctcttttcgctcaaggtggagtgca

SEQ ID NO: 46963 - DNA, 201 bp, Homo sapiens
gggctgtgttccctgcaactgcaattcttttgggtctaagtcattcgactgtgaagagagtggacaatgttggtgccaacctggagtcacagggaagaaaygtgaccgctgtgcccacggctatttcaacttccaagaaggaggctgcacaggtctgtaaatatgacttaagtcctacatattcactctgatagttttagg

SEQ ID NO: 46964 - DNA, 201 bp, Homo sapiens
tgcataattcgccatgctatagagacagatgatcttccagatggatgcctgagtgtagaatatatagatcagttccccccacccttcacacatgggcccaraatgtacacggagcaggagcaagaaatacacgtccttgctatctttgttagtttaatccacagagactttggagtctgcagttatacagcatcctagcct

SEQ ID NO: 46965 - DNA, 201 bp, Homo sapiens
tagcaggatttccttctcttttatggctgaataatattcctctatctccctctctccctctctttctgtgtgtgtgtgtgtgtgtgtgtgtgtgtgtgtgkctgtgtgtctgtgtatgtgtgtatactatatttactttatccattcattcactgatggatacttaggccatttatttatcttgactgttgtgaatgatgc

SEQ ID NO: 46966 - DNA, 201 bp, Homo sapiens
ggccggtactgtgagctctgtgctgatggatattttggagatgcagttgatgcgaagaactgtcagcgtaagtcctgaactattgatgcccctgacagaaytgatgtattgtacctcaaagtagctgatgagttcttgagtgtggattgaagagtaggaaattatgtggaatacatggttgatagatgcatagaatataca

SEQ ID NO: 46967 - DNA, 201 bp, Homo sapiens
atactggcagtccaggcaaccctggaggctcctgccaagaatgtgagtgtgatccctatggctcactgcctgtgccctgtgaccctgtcacaggattctgmacgtgccgacctggagccacgggaaggaagtgtgacggctgcaagcactggcatgcacgcgagggctgggagtgtgtttgtacgtatactaactttgctg

SEQ ID NO: 46968 - DNA, 201 bp, Homo sapiens
gtgcataattcgccatgctatagagacagatgatcttccagatggatgcctgagtgtagaatatatagatcagttccccccacccttcacacatgggcccmaaatgtacacggagcaggagcaagaaatacacgtccttgctatctttgttagtttaatccacagagactttggagtctgcagttatacagcatcctagcc

SEQ ID NO: 46969 - DNA, 201 bp, Homo sapiens
cttactttccacggggactgttattgtaaaatctgttcttattcttttaatttaactccattattttgttttaaatgtaatgattgttcattatatttttytccaactgctttaaaagcaccaatccttctttgctgtatatgtatcaaagtccataaatattctttgacattatcctagccttgaataataaaaggaaaa

SEQ ID NO: 46970 - DNA, 201 bp, Homo sapiens
cagaactgacatgctttactcttagattgaatacgagttttacaagccagtgcataattcgccatgctatagagacagatgatcttccagatggatgcctkagtgtagaatatatagatcagttccccccacccttcacacatgggcccaaaatgtacacggagcaggagcaagaaatacacgtccttgctatctttgtta

SEQ ID NO: 46971 - DNA, 201 bp, Homo sapiens
actgaatgtgtataattataagaattatttcattttcttacaactttttctctttattttatactctcaccctattatctgtcctttttcttttttttttctttctttctttctttctttctttctttctttttttttttttttttgagacaggctcttactccgttgcccaggctgaagtgcagtggcaggatcatggct

SEQ ID NO: 46972 - DNA, 201 bp, Homo sapiens
aacagaactgacatgctttactcttagattgaatacgagttttacaagccagtgcataattcgccatgctatagagacagatgatcttccagatggatgcstgagtgtagaatatatagatcagttccccccacccttcacacatgggcccaaaatgtacacggagcaggagcaagaaatacacgtccttgctatctttgt

SEQ ID NO: 46973 - DNA, 201 bp, Homo sapiens
tgtattctgcattctcaattaaaagtcattttatcttttactttttcttttattcctttttaagcaacaaatgaattaaatttcctttgttttatatatgrcctattaacctcaatggagaaagaggctccctttgtttgcttcaggacttacatattgttacagttagtccttaggtaaatgaaatgagaagagcttcac

SEQ ID NO: 46974 - DNA, 201 bp, Homo sapiens
ttgtgctggctttctttccttttttaaaatcccatggtatctcatcatctcttcttgtcctcccattctacaaatagaacatgaaattgaagccttttttwaaaaaaaaaaaactaattacagaattaatatatgtttactatgtacttactacaattagaaactatatataaacaaaaaagagagcttgcccatcaatcc

SEQ ID NO: 46975 - DNA, 201 bp, Homo sapiens
tatataaaatatatacatataaaacacatatcataaaacatatatataaaacataaatatcgttacttggtatgtcgacaaattcatcagtctcagctgargtctacagctttcctctctattcaaagaaatgacaggttaaaaggtcttcttaatgactctggaatcaaatttttatttgagaagatatttattttaaaa

SEQ ID NO: 46976 - DNA, 201 bp, Homo sapiens
gatttttttaaaattaatataccagaggaatcataaaatgttatggaacttatttcctcaagttctggaaatcattgggttaaacatagctaatttccccsttatgttattatagagtttatatttatattacaaagaaacgcaagcaataaatcctcattcagaatccttctctagcacattaaatatagcatgtgaact

SEQ ID NO: 46977 - DNA, 201 bp, Homo sapiens
aatgctgacaaggagagaggttaaaaccaggaagccatgccttttagctgacaaaacattcattgaaatgctatctgggtgaagcactgagaaattaatcrtctgaatagtctaaattatagtacatgaagaatgcaacttgctagggagacataccttcagcattattcgaggttaatttaaaccaacatgtaaatgttt

SEQ ID NO: 46978 - DNA, 201 bp, Homo sapiens
taagttagtcatttactgacattttatcctgtcttccaataacccccacccccataaagttagggatattattccactaattttattatggtaatttattrtgggattattttattatggtaattaattattattttattatggtaattaattattgtagaaaattattatgggattattttattatggtaatttattatg

SEQ ID NO: 46979 - DNA, 201 bp, Homo sapiens
taaaaggggacattaaatataggcaataccttcattctgagttggtttgaaaaattattacttaaactatttaatagcaactgaaattttctttctttaaygtaaatgtgtttacctttctaacttcactgcctacactacccactgccttttcaaatctgtgcaaagagcatgttgtctccctatacagaaaagtgtcag

SEQ ID NO: 46980 - DNA, 201 bp, Homo sapiens
tgatagggatggcattgaatctatgaattaccttgggcagtatggccattttcacgatattgattcttcctatccataagcatggaatgttcttccatttstttgtgtcctcttttattttgttgagcagtaatttgcagttctccttgaagaggtccttcacatcccttgtaagttggattcctaggtattttattctct

SEQ ID NO: 46981 - DNA, 201 bp, Homo sapiens
ctttgctcatttctttttattcttttttctctaaacttcccttctcacttcatttcattcatttcatcttccattgctgataccctttcttccagttgatygcatcggctcctgaggcttctgcattcttcacgtagttctcgagccttggttttcagctccatcagctcctttaagcacttctctgtattggttattcta

SEQ ID NO: 46982 - DNA, 201 bp, Homo sapiens
agagaaaattcttgagtcaaatggcttcattgatgaatagaagttagaatactggttattgttacaaggagagggaagataatgactgggagagggtatgwggaaagtttcatttcttatttttgattatataattgtacaataataatgtgttagtacatagaactaatataattgtaaataagtgtgtttatatataat

SEQ ID NO: 46983 - DNA, 201 bp, Homo sapiens
tatttttgatagtctgtgattctgagccctatctatgctttcagtcaaattaccaatggtatgaaactctttaattttgtgtgtctcacgtttagagggtrgcttaagaggttctttaactgcatgactattgtgaggaggatacttatgagttgttcttcatttccatggggacaaggacaatgaaaatacagtataata

SEQ ID NO: 46984 - DNA, 201 bp, Homo sapiens
taatttttatggttacatagtaggtatatatattttagatagatttttaacgtggacagcagtatctaaatatttactgtgatttgtaatgtatatttttyactaagcattgaatggtcattttcttccagaccttcaaaatattccttaaatatgtcagaaataagaaaaacaagtccctccctctctgccttcctccct

SEQ ID NO: 46985 - DNA, 201 bp, Homo sapiens
agcaagagacttgaccatttattagttcttcttttgtataaatttcaacaagtgccagtattgttgttgataaatgcttggctcctctgtgacacattttyataaattagtatcttaaacataacagaaacgattgcatttatttgattaaatcactatagattacagtgggtttttttttttttttttttacattttaac

SEQ ID NO: 46986 - DNA, 201 bp, Homo sapiens
aggaggtgcgagtgtgtagatgtgtgtttaggatgggctgtgcagacggggagaattagagagataaaatatgtaaaaccataagtgtgtgtatatgtatrcaggtatatatatatatgtagagagagagagagaaaggaggtaataacgtgaatacttaatgccaagtgaggtgaactatgatgggggtaaagcttcaca

SEQ ID NO: 46987 - DNA, 201 bp, Homo sapiens
gctagagaacaaagtgttttgctataaacactgtcaaatctcactgtgaaaaaaatttgtctataaaacaagtattttcatagatacactaaagctgcatrgaatttgcttttatagcataaaacagaattagatgcttgagtcagctatgaaatactttttcatgcaacactcattctaattctttacactatgcattag

SEQ ID NO: 46988 - DNA, 201 bp, Homo sapiens
gagaagacagatatacatatacatactgtacatttatgataatataaatagtgcagaagaagtgtgcacaatgcatataaatagtgcagaagaagtgtgcrcagtgcatactggtagaactaagaaggaagcaatgaattcttgtgttagcatttaatacacttttaataaatagctgcaaaagtatcagtttctgtcagt

SEQ ID NO: 46989 - DNA, 201 bp, Homo sapiens
gcaataaacatacatgtgcatgtgtctttatagcagcatgatttataatcctttgggtatatacccagtaatgggatgactgggtcaaatggtatttctakttctagatccttgaggaatcgccccactgtcttccacaatggttgaactagtttacaatcccaccaacagtgtaaaagtgttcctatttctccacatcct

SEQ ID NO: 46990 - DNA, 201 bp, Homo sapiens
ttaaaaaaatctcataggaatcatcctgaataaaatgttcagaaccatcatttatttattttgtttcacatagaacctaccaaacacatgagaattttttkggggagaaatctgattggacatttgactgtgagtgaaatacacataagcagtggtgttaaagaaactgatcaatattttctttgcttcagtgttgggcaa

SEQ ID NO: 46991 - DNA, 201 bp, Homo sapiens
ccctaagatatgaatgtggctggcatgttcaaagaccctcaaggatggggtaagagtggggaagagttgaaggatatggggaaggggaaaatatcgtaggyctttggcacactgtagttaatgtcttcacatttttcttgcaatgcaatgagaaacacagacatgtaatgatctgagttatgttttaatagggttagtatg

SEQ ID NO: 46992 - DNA, 201 bp, Homo sapiens
aatgaaatgtgaacagaactgacatgctttactcttagattgaatacgagttttacaagccagtgcataattcgccatgctatagagacagatgatcttcmagatggatgcctgagtgtagaatatatagatcagttccccccacccttcacacatgggcccaaaatgtacacggagcaggagcaagaaatacacgtcctt

SEQ ID NO: 46993 - DNA, 201 bp, Homo sapiens
aatttttatgaatttttgaattaaaaagctcttaacctttggctacaatcattgttcgtaatacatttggaacaagtattttagagtttgggcattccaarttctatcacattatttgaatgccttcaatggtgacaaatctttatgctttagatgtaaagcaacattttgtacatgagttgtgtgatagtaagttggtag

SEQ ID NO: 46994 - DNA, 201 bp, Homo sapiens
cagtaaaactagagattaaaataattgaccatggaatctaagacagtgatgagaaaccctcaagctacagcgatttcccattgtctccctaaatgctattrgtactgtagccaagacaagtctttcttttataggactatacaaggccttagaggatatttagtatccttggcctaaaggataaaggtaaagtggtacagt

SEQ ID NO: 46995 - DNA, 201 bp, Homo sapiens
atagaaaggtatatattcttattatagcagtgtctgccagggctgcagtcctgttgttagaaggctgtcagaattttaaatgtaagccttcctttcccagrtgttataatttaatcttctaactcctattaatttctgaagactgtggggccatcctatatcttagaacaaaatatagatacgtacattcctgattttttt

SEQ ID NO: 46996 - DNA, 201 bp, Homo sapiens
gtgtggtctcggctcactgcaacattcgcctcccgggttcaagcgattcacttgcctcagcctcctgagtagctgggattacaggcgcctgccaccaagcygggctaatttttgtatttttagtagagacaaggtttcaccatgttggccagactggtcttgaactcttgacctcatgatctgcatgcctgagcctcccaa

SEQ ID NO: 46997 - DNA, 201 bp, Homo sapiens
catagacaccgtcaatgaaatgtgaacagaactgacatgctttactcttagattgaatacgagttttacaagccagtgcataattcgccatgctatagagmcagatgatcttccagatggatgcctgagtgtagaatatatagatcagttccccccacccttcacacatgggcccaaaatgtacacggagcaggagcaaga

SEQ ID NO: 46998 - DNA, 201 bp, Homo sapiens
atgaagtctctgcttcatgacctggtcacctccaaaggccccacttcctaatcctatcaccttgaggattaggatttcaacatatgaattttcaggggacrcagacattcaggccactgccctttacttattcaatttcccacttatgtaaaaagtgatcaacatgggatccaaagattggaataacaaaatgcttacaaa

SEQ ID NO: 46999 - DNA, 201 bp, Homo sapiens
atgatagtcctgcatttcatggcaattttcaatagcagtttaatggtcttaagtgggtagcataatagccaggtgaacaacaaaaaaaacaaaaacaaaamcaaaaaaactatttggcaaattgggatatgagaattgaggccaaaacttttagtccttgccaattttttttaaaacttcaattatcttgattcatattcc

SEQ ID NO: 47000 - DNA, 201 bp, Homo sapiens
cacatgagaccttaaaagtagaagagggggtcagagtgatgaaacaatggaagaagaggaaggagaagtttgaagcatgaaaaatatttcattcatcattkctggctttaaagatggagagtcccttgaaccaaggaatgtgaatgacctctagaacctggaaaagagcattggctgacaaacagcaaggaaatgggaacc

SEQ ID NO: 47001 - DNA, 201 bp, Homo sapiens
gtaggattacatttgctcacccctgaaattaggcatagacaccgtcaatgaaatgtgaacagaactgacatgctttactcttagattgaatacgagttttrcaagccagtgcataattcgccatgctatagagacagatgatcttccagatggatgcctgagtgtagaatatatagatcagttccccccacccttcacaca

SEQ ID NO: 47002 - DNA, 201 bp, Homo sapiens
gtttcatagcttgggagtgagcagagctgtgatcccaaaccagaagggctgtcacttggatgtagcttttaatcactgtgccctagtacatagagaatgaytgagacaaggataggtgctattttagataggtaatcagaggagtggctattaccagaatggagggaggacacaagccaaagagtaggaagagcacatagt

SEQ ID NO: 47003 - DNA, 201 bp, Homo sapiens
gatatttttttctcactacttcttcctttctccctctttttacacaattaaaaaactaaagataaaagttggctctatagggaaaggttttattttttacrtttctggcaaatttgagatttctataaaattcttcataggtatataaaacagagtaagtatattttgtttaacttttaaagcagggtattattcatttgt

SEQ ID NO: 47004 - DNA, 201 bp, Homo sapiens
tttgtaccctcttttcagttttactcttttttatttcttttttttccccctttagggtaatgacttgagcatcagcacagcccaagatgaggtgtacctgsacccatctgaagaacatactaatgtattgttacttaaagaagaatcatttaccatacatggcacacattttccagtccgtagaaaggaatttatgacagt

SEQ ID NO: 47005 - DNA, 201 bp, Homo sapiens
atagatattgcagttattctccttttgggcatatagtaggattacatttgctcacccctgaaattaggcatagacaccgtcaatgaaatgtgaacagaacwgacatgctttactcttagattgaatacgagttttacaagccagtgcataattcgccatgctatagagacagatgatcttccagatggatgcctgagtgta

SEQ ID NO: 47006 - DNA, 201 bp, Homo sapiens
taattgagcaattatacttatgccatactttttgtagaataattctccctatacataggccttctttctgtttcttaaatactctaagtttcctatcttargtattttatatgctacatcattttctatctgtgcctctctttgtttttattgtactcatctaatctttctttaagaatatattatacattaatttactca

SEQ ID NO: 47007 - DNA, 201 bp, Homo sapiens
atgataccgtaatggatatttttttctcactacttcttcctttctccctctttttacacaattaaaaaactaaagataaaagttggctctatagggaaagrttttattttttacatttctggcaaatttgagatttctataaaattcttcataggtatataaaacagagtaagtatattttgtttaacttttaaagcaggg

SEQ ID NO: 47008 - DNA, 201 bp, Homo sapiens
tgtctttagtcattgcttctacatggcaataggaaatatgaccataaaaacctcagtgaaagtaacccacatttagagaaggcttgtattccttaatcccrcccctctacacaccccacccattcaacccatctgtagcctccctttcagctgttcttaaaagaccttcccttttaagggaacttacattttcccttcaat

SEQ ID NO: 47009 - DNA, 201 bp, Homo sapiens
catagatattgcagttattctccttttgggcatatagtaggattacatttgctcacccctgaaattaggcatagacaccgtcaatgaaatgtgaacagaamtgacatgctttactcttagattgaatacgagttttacaagccagtgcataattcgccatgctatagagacagatgatcttccagatggatgcctgagtgt

SEQ ID NO: 47010 - DNA, 201 bp, Homo sapiens
gctgtgaggcaggatgctgggccactgtcctgtcacaggctccagcatgattcgccctgctcggtgacacaccagccgtgtgacttacccgaaggtgcacytgtctattttatggcaaccgtttgataaatgaaaattacctgtgtggaaagcatagtaagtatttgagaaatatttcaagaagagttatatggcacagtc

SEQ ID NO: 47011 - DNA, 201 bp, Homo sapiens
ttctcgagaagtatctttgtggccttctctgtatttcctgaatctgaacgttggcctgccttgctagattggggaagttctcctggataatatcctgcagwgtgttttccaacttggtttcattctccccgtcactttcaggtacaccaatcagacgtggatttggtcttttcacatagtcccatatttcttggaggcttt

SEQ ID NO: 47012 - DNA, 201 bp, Homo sapiens
gcaataggaaatatgaccataaaaacctcagtgaaagtaacccacatttagagaaggcttgtattccttaatcccacccctctacacaccccacccattcracccatctgtagcctccctttcagctgttcttaaaagaccttcccttttaagggaacttacattttcccttcaatactaaatcccaaaagctaatagcaa

SEQ ID NO: 47013 - DNA, 201 bp, Homo sapiens
ggttttcttctagtgtttttatggttttaggtctaacgtttaattctttaatccatcttgaattgatttttgtataaggtgtaaggaagggatccagtttyagctttctacatatggctagccagttttcccagcaccatttattaaatagggaatcctttccgcattgcttgtttttctcaggtttgtcaaagatcagat

SEQ ID NO: 47014 - DNA, 201 bp, Homo sapiens
ctttctctaagtcagtggaatagtctagtttaactttgatgtagaaaatttaggcagtcctcaacctctctaggtatgctgaattaaaaaaaaaaaagaakgacatttttaattcccatggcaaatggagttctcctctttcttctgttcctcttcttcaccttgcaatgactgtcattttgtaaaactttctctctgtct

SEQ ID NO: 47015 - DNA, 201 bp, Homo sapiens
atagtggcaggaaagagagagaatgaaaggggaagtgccacataccttcgaacaacctgatcttgtgagaatttattcactatcacaagaacagcaagggrggaggtttgctcccatgattcagtcaccacccaccaggcccctccctcaacatgtgggtattacaacttgagatgagatttgaggtggtcggtgggggga

SEQ ID NO: 47016 - DNA, 201 bp, Homo sapiens
tttctcgagaagtatctttgtggccttctctgtatttcctgaatctgaacgttggcctgccttgctagattggggaagttctcctggataatatcctgcaragtgttttccaacttggtttcattctccccgtcactttcaggtacaccaatcagacgtggatttggtcttttcacatagtcccatatttcttggaggctt

SEQ ID NO: 47017 - DNA, 201 bp, Homo sapiens
aatctggcctaaaatcacaagcaaacattccatgatggaatggcagatcatgctagatttgctggttattatcagttttattttacgttacctaagtagartttaagcctttcagttaaaatatgactcccaagcaaaaggaagaggattaatggattaactattgtttgtgttatcaataatattggcaataactatttg

SEQ ID NO: 47018 - DNA, 201 bp, Homo sapiens
aatttgtttgagttcattgtagattctggatattagccctttgtcagatgagcaggttgcgaaaattttctcccattttgtcggttgcctgttcactctgmtggtagtttcttttgctgtgcagaagctctttagtttaattagatcccatttgtccattttggcttttgttgccattgcttttggtgttttagacatgaa

SEQ ID NO: 47019 - DNA, 201 bp, Homo sapiens
ccagtgaattccatgagcatgagcccagtgctgcacttctttagctgtaaagtgagtgccttgttcagaggcaatgctgtgtggaataccatgacagcgartaaggcattctgggagttcacggatggtactcttggcagaaacattgggcgtaggatgggcaaatccatatccagaataagtgcctattccattgaggac

SEQ ID NO: 47020 - DNA, 201 bp, Homo sapiens
agtcttagtatgaaaacagttttgcttctcctgaggaatttttacttacctttatagatactgtatgcctcttaagaatcctatttgtattccctgctacrcgtagtctactaagatgcttagtagtggacttaggatgcactgcattgaacgttatggcatggttttctgtctactaattctttccctaatttatacaac

SEQ ID NO: 47021 - DNA, 201 bp, Homo sapiens
ttttctcgagaagtatctttgtggccttctctgtatttcctgaatctgaacgttggcctgccttgctagattggggaagttctcctggataatatcctgcmgagtgttttccaacttggtttcattctccccgtcactttcaggtacaccaatcagacgtggatttggtcttttcacatagtcccatatttcttggaggct

SEQ ID NO: 47022 - DNA, 201 bp, Homo sapiens
tgtttgtttttttcttgtaaatttgtttgagttcattgtagattctggatattagccctttgtcagatgagcaggttgcgaaaattttctcccattttgtyggttgcctgttcactctgatggtagtttcttttgctgtgcagaagctctttagtttaattagatcccatttgtccattttggcttttgttgccattgctt

SEQ ID NO: 47023 - DNA, 201 bp, Homo sapiens
tcttactggactccaatatgagactttatttctatccattggtttgcaaggcctggagatatatgcattagataaaaagactgtatttgtaattagaaaarcctccagtaattaatgtccaaatatgcaaccaatttaaatgatgtctacataataccacacatagatgaaaatccaaaaagtcaaacattcattataata

SEQ ID NO: 47024 - DNA, 201 bp, Homo sapiens
tatctatttcagctttatgtttggatagatgtactattcatcctatctttcattatgagtcatgacctcgttatagataatcaccttctattcatctaagrcattcttatctcactataattttataatatctaccgtgctatgactcctgattagttcataaataaactgttttattccacgcattattagaattaatga

SEQ ID NO: 47025 - DNA, 201 bp, Homo sapiens
ctgccgagagatctgctgttagtctgatgggcttcccttccagggtaacccgtgctttctctctggctgcccttaacattttttccttcatttcaactttrgtgaatctgacaattatgtgtcttggagttgcttttctcgagaagtatctttgtggccttctctgtatttcctgaatctgaacgttggcctgccttgcta

SEQ ID NO: 47026 - DNA, 201 bp, Homo sapiens
ctggaatgaattggataagttataaggcagatggtaagattggatctgatgggatggagtttggtgaagtggaaacttttaagcattaggtttgagatagmtagggagtgttgacctctctttccccctgacattatcctcacatttgtttttattccaccatatctaccttgatccacctgattcttttcatttttttct

SEQ ID NO: 47027 - DNA, 201 bp, Homo sapiens
tatggctgcatagtattccatggtgtataagtgccacattttcttaatccagtctatcattgttggacatttgggttggttccaagtctttgctattgtgrataatgccgcaataaacatacgtgtgcatgtgtcttcatagcagcatgatttacagtcctttgggtatatacccagtaatgggatggctgggtcaaaggg

SEQ ID NO: 47028 - DNA, 201 bp, Homo sapiens
attgatttttgtgaattttgctttggcagtgataccactatctatcaccactacccataggtgatagtgcatttgtcataggcttctttatgaagtctctygtgggtatttttgaccagggtgaatcttcaacttaattactgtgtaatgagacatgatttttaaaaatatatctagatgatgttctgatatgattttgaa

SEQ ID NO: 47029 - DNA, 201 bp, Homo sapiens
tcccattattaatgtgtgggagtctaagtctctttgtaggtcactcaggacttgctttatgaatctgggtgctcctgtgttgggtgcgtatatatttaggwtagttagctcttcttgttgaattgatccctttaccattatgtaatggccttctttgtctcttttgatctttgttggtttaaaatctgttttatcagagac

SEQ ID NO: 47030 - DNA, 201 bp, Homo sapiens
gattaagttaaaacagggttgacaaattgggagaacacaggattaagggactggaatttaagtttagatttgctttaataaagaaaaatgttactttgtgrtgagagaaaataagctaaaaattaaaaatttaaaaaccaatccactctgagagattaattaaagtgaagatggggtctgctaatgtgttactgaagtgaa

SEQ ID NO: 47031 - DNA, 201 bp, Homo sapiens
gtcaattttggaataggtgtggtgtggtgctgaaaaaaatgtatattctgttgatttggggtggagagttctgtagatgtctatcaggtccgcttggtgcmgagctgagttcaattcctgggtatccttgttgactttctgtctcgttgatctgtctagtgttgacagtggggtattaaagtctcccattattaatgtgtg

SEQ ID NO: 47032 - DNA, 201 bp, Homo sapiens
gtcaatgattaattttacatataaagagactttctcaacaatgaggattgctaatgattagagaaggattggagaccttaaaggtggccttacatttgagkgtactttggtctgaagatggagacaaaagaaatgaatttgtgaagaaatgtaatccacatgaaagacccaaatgaaaagtaattctttcaatcttttgat

SEQ ID NO: 47033 - DNA, 201 bp, Homo sapiens
ttgttataatttctgttcttttacatttgctgaggagagctttacttccaagtatgtggtcaattttggaataggtgtggtgtggtgctgaaaaaaatgtrtattctgttgatttggggtggagagttctgtagatgtctatcaggtccgcttggtgcagagctgagttcaattcctgggtatccttgttgactttctgtc

SEQ ID NO: 47034 - DNA, 201 bp, Homo sapiens
gaacaatggggtcaattattaatataatttgcacaaatcacttatagtactctttgagctgaacagcaatattatttacctgttatcaaacatggcagcawttttcccctcctaatttacaactggatggcgcaaccacaagtttttactaaatcatttctaacttgcctgtttttatcaattcagcaagtcaaagagttt

SEQ ID NO: 47035 - DNA, 201 bp, Homo sapiens
gatgatgatatttcttttttttttaatttaattttatttatttattttttttattaatcattcttgggtgtttctcacagagggggatttggcagggtcayaggacaatagtggagggaaggtcagcagataaacatgtgaacaaaggtctctggttttcctaggcagaggaccctgcggccttccgcagtgtttgtgtcc

SEQ ID NO: 47036 - DNA, 201 bp, Homo sapiens
caccaatactattttacttaagctgaaatacatttgaaatataccatataacttgcagagttgatgggaaaatttgaaaaccagggtgagaagatggcagrcatcaaggtcatccctaggttttgatacctgtacagaatagtcattgcttactgctgccgccatcactactttctctttcattcctctgatatgactatc

SEQ ID NO: 47037 - DNA, 201 bp, Homo sapiens
acaaatgtatgtatatttataggatgcttaggcaaaatgaagccctgagctgtaaaatgtttcatgacagtctttgctgacagagaacgctgtaaatgggwgtcaggtccccacttagacagtgtaacagaaatccatgccagggtgaaataagagctggcagttaggatgatagactttgaaatcagccatcacagtata

SEQ ID NO: 47038 - DNA, 201 bp, Homo sapiens
caaacgtctgtcacttttaataattttgttctatgttatatgacctacgaatgttaagagtctgtaagagtttcttcagctgcatttgattttaccaacaycttgtgggtacagttaagaagatgacttatttgaggctttataactgaaattggatatggttcaaacgttcaacagatataaacatattttaattaagaa

SEQ ID NO: 47039 - DNA, 201 bp, Homo sapiens
gagaccagcatggtggcatgcacatgtaatcccagctacttgggaggcggagacaggaggaccctttgagcttaggagtctgaggttatagcacactatgmttatgcctatgaatagccactgcactccagcctgggcagtgtagcaagaccctatctctgaaaaaagaatcaaaggccttaagaaatattttatttttac

SEQ ID NO: 47040 - DNA, 201 bp, Homo sapiens
aacaattctcctgcctcagcctcccaagtagctgggattacaggcacctgccaccatgccagctaatttttattttatttttttgtatttttagtagagaygggacttcaccatgttggccagcctggtctcaaacccctgacctcaggtgatcctcccaccttggcctcccaaagtgctgggattacaggcatgagccac

SEQ ID NO: 47041 - DNA, 201 bp, Homo sapiens
aaaacctgctttttaaaaaaatatcttgatacttgtattttaccaaattcatgggtatagataactttttgatttctcattactttcaagtatcttcttcwtgtaaaattttaatcaaatttcagatcccatgcttaacacataaaaattaataaattgatgttgagggactatcacattattttatactgaaaagttgtt

SEQ ID NO: 47042 - DNA, 201 bp, Homo sapiens
gacagctaatgcatgcagggtgctttctatcaggtgtacagatgatcagtgtttcccaggctttaaaagtccacaagacaggcttggaaggccaattccasgtggtaaattgagactgtattcagagcatgcacagacaggagatttagtcctagagacattagatttctggtttacctgcacccctagaggcctaggaat

SEQ ID NO: 47043 - DNA, 201 bp, Homo sapiens
catatgttcatagtagaattgcatggtgttctgttatccagtctttgccattcacatggactcagtttatagtgtctggttatgctactgaagatcttccygctttaccatttgctgttaagtaattgtagtcagacagactgcccaggaagccccatggactcagttttatcccttgggtatcacaaatgaggaagagtt

SEQ ID NO: 47044 - DNA, 201 bp, Homo sapiens
tcatggtaaactgaagtctgaaaatattacatacaaaaacattttaagagagagagagggagaagctacattcacataacttttattatattatattgttstattttttattagttattgttgttaaatctcttactgtgcctattttataaattaaacttcatcaaagatgtgtgtgtatagaaaaatacattgtatata

SEQ ID NO: 47045 - DNA, 201 bp, Homo sapiens
ttaatactatttgggattcaaaagcttctagattctgtggatcaatgtctttcaccaatttggtaaaattcttagccgatattttctcgaatgttgttacygtccattctttctctccactctccctgagacttcagtcacatccctgctagactgtttgccgtgctcattatgtattctatggcttcttttcatttgtct

SEQ ID NO: 47046 - DNA, 201 bp, Homo sapiens
ggtctagtgtaaaatggagcaaataggcccacttccttattacgaagcatattataaggataaagtgatgtgttataggcaaagagcatagcacactgctrcactttaggtgatactcagaaaatattacttttggtcttccacattgaaaataatggtgaatggagaataaatgggctaagttgtaatgtgaaaaatgga

SEQ ID NO: 47047 - DNA, 201 bp, Homo sapiens
taactagcattacagaaaaccaaacaccgcatgttcttactcgtaagtgggagttgaacaatgagaacacatgaacacagacaggggaacatcacatgccrgggcctgtcagtgggtgggggtctaggggaggaacagcattaggagaaatacctaatgtagatgacaggtcgatggctgcagcaaaccaccatggcacgt

SEQ ID NO: 47048 - DNA, 201 bp, Homo sapiens
attttgtatttcatatgtatatatgctgtattcttataataaagtgtgttagagagaaaagaaaatactaagaaaatcataaggaagataaaatatatttktgttaatcaagtgaaagttgatcatcttaaaggtcttcatctgcatcatcttcatgttgaaaaggctaaggaggaggaagaagaggaggggttggtcttg

SEQ ID NO: 47049 - DNA, 201 bp, Homo sapiens
aaacgattgcatttatttgattaaatcactatagattacagtgggtttttttttttttttttttacattttaacattcaagataagcactagaaaaaatascaatttgtttggaagaaagtagctacttattttataagtagattgttcttagatacgtattactaagggattattaacttttctcattctatttactcat

SEQ ID NO: 47050 - DNA, 201 bp, Homo sapiens
atgttcaaagtataacaaagatgagaagtaagttgaaaaaagaattattagtgatatttcttctaccatatacatgttatcttggaattggaattttttcrtaataagaaatccattagcataaatacagtttaaattgaataagtaaatttcattaaaaacaaaatatttatttgggggtacattttataaatagctgca

SEQ ID NO: 47051 - DNA, 201 bp, Homo sapiens
ctctcatagcacataggctgtccctctaacatagcatgagtcacacgctttccaaactggtgtttacctgcttgtcttctttactgcattgctccttgagrtagcaaggatgtcttctttattagcttttttatactgagaaaattttaaaatacaggaaaagaaacatgataaaatatatacccacattcctaactcata

SEQ ID NO: 47052 - DNA, 201 bp, Homo sapiens
caccaacgctctcatgtttctcataaaaaatgctcagctttatttggaaactttggccattgttttctttttcttctttcttcttctccttcctcttttgrgttaaaaaggccacagtctgacctacttatatgtgtgatgaaatgtgcagactctgccaaggctatttattctaatgatttatctactcaagataaaaag

SEQ ID NO: 47053 - DNA, 201 bp, Homo sapiens
aatgaatgaatcaatcaatccaattaattcaataaactaatcatgattttagtgagtattctatgaaccctcacttagtttgattaccttgactgtgacakttaactttgtatttcactacttctttgcttctcttacattcagttaaaaatatttttaaaatacaattttcaaggttcagaaacaaaaaaaataaatgac

SEQ ID NO: 47054 - DNA, 201 bp, Homo sapiens
aaaatccagatcatactgatttgttgccatggtatagtagtcagagaatcttgctctgggcagttacaatattttggagattgttttacataatagcaacwataacaggaacaatgataactgctaacttgtttacatttacaaaatgtcaaatactattctagattattcaattgaatcatcacaacaacgctatgaggt

SEQ ID NO: 47055 - DNA, 201 bp, Homo sapiens
gagagtatctacctccctgactgattgtgaagatgaaatgaaatagtcagtagaaagtagttagaatagttcacagcatacagtatttattatttttatgwttaactaatgttttatgaggtccttagagtgctagacactgtttgcatgaattattttatatgatctcaccacaaccttataaaaaagtttttattgtcc

SEQ ID NO: 47056 - DNA, 201 bp, Homo sapiens
aacaacgctatgaggtagttactgttatattgttttgatttccctgatggagacttgacacaaagagagactaagtaattcactcctgtcacacacagctwaaaagtggcagagctgagtgttttgccccaggtagtccagttctagaactgtactcttttccactatgctataccatcttcctaatactatctgtacaag

SEQ ID NO: 47057 - DNA, 201 bp, Homo sapiens
tcgccgtttcctttaatctatacactatgtgtcttcctaatacagagagtatgttgtttgcctatatatcataacaaattgaaaatgcatttataacttayaaagtatatattactaggtgctagaatttacactattatcctaatatacagaagctgggaaaagtaatgccatagagttgatttatgtgtgtaaatgtct

SEQ ID NO: 47058 - DNA, 201 bp, Homo sapiens
tcagtttccttctatggtgactctttgtaagccttatccaactctaacctgttgttatttatatggcagagtgaacattctaaattgcagatcctatcatstcattctcttccttaaattgtactatggctttccacttttttcaggatgacatacagtgctctcccaccatgatctaatctctgcttctctctcatctct

SEQ ID NO: 47059 - DNA, 201 bp, Homo sapiens
tagtgtgaaatgtttacagtattttaattttgaaaactatacttattaaaacagtatgacaacatttattgaatacatgttatgtgctaggtaccaagtgrggagttttatgtttattttctcatttcatcctaagagcaaacttcggaggtaggtgtgattcgtctcattttagtgaaaattcactgatgctctgaaagc

SEQ ID NO: 47060 - DNA, 201 bp, Homo sapiens
ctaagcacatcatcttcttctatgtgatgttttgcaaatctattcataggagatttatattttcaagtgtgctcaaatggatctgtgttggggaaagataygtgaaataagaaaataaaagctaatccatttgttttaaaattttgtctgcctaccacattttgttggacttcttgttatatgagaactcctaattgtctg

SEQ ID NO: 47061 - DNA, 201 bp, Homo sapiens
tgtagggatttaggggatacttttaatgttatattctatgccttaaaggaaatcttcaatacttgtgcaatacactttttctccccaaatctatttgctcstcctctttggtccctcagtttatattatcgcctctatttcaggttctgggcgacatgcatatctgttcttttgttgttgttcttatctttcctcaaccat

SEQ ID NO: 47062 - DNA, 201 bp, Homo sapiens
atctctggtggtctgttccagaactatgtccttgactctgtcacattcatacttttcatcactactttttatacttctgcaatttaggtcacccaatacasgttatcttatcaggttaaactgattgtagtggtcacattgaaaaagaaaaaaaaaatcccaaattcaggacttttcccaaccagttctaattaatgcacg

SEQ ID NO: 47063 - DNA, 201 bp, Homo sapiens
tagttgaaaagtgaggaatatatacataggtatacatatgtttaggaaatataaaaacgaaataaacttaggttctggaccaagtaatttaaataaaaaakgaataaagtcataaatagcattattataataaaaactggtaaaacacaccaggacaattttcaaaccaatgtcagtgtgttaccttttacttactgccta

SEQ ID NO: 47064 - DNA, 201 bp, Homo sapiens
acagggaaaaagtctattgacatcaaatgtacttatactgtcttttatcatctccaattttctattaatcacatgtagtggatttttttttcattctagayactgtgttacatttttcagtcacagaatttatattcaatattttttgttgttaccatttcttttttgctacaagaattttcgtatgtgtgtatgtccttg

SEQ ID NO: 47065 - DNA, 201 bp, Homo sapiens
attttcgtattgctataaagaaatgcctgaagctcggcaatttgtaaagaaaagaggtataattggctcatggttccatcaggctgtacaggaagcatggytggggtggcctcagggaactttcactcatggcagaaggcaaagctggagcaggcatcttcacacaggcagagcaggaggaagtgggggctggaggtggca

SEQ ID NO: 47066 - DNA, 201 bp, Homo sapiens
ttaaactgattgtagtggtcacattgaaaaagaaaaaaaaaatcccaaattcaggacttttcccaaccagttctaattaatgcacgtgtgaaaggacatarttattgtgaaaagaaatgctatcaaaacagtctaatggctacaagaagaaaaagaaaagaagaagaaggaggaggaagaggagaaggagatgaagaagaa

SEQ ID NO: 47067 - DNA, 201 bp, Homo sapiens
gagatacaggaaatgctcccctctcagtccacaactagagtgaaatttgcttaaggataaagtcaggggatgtgtttagttcttaatttgcttgacttctrtagcacgtcataatgctgctcagttatgtccttacaacaccgccagttatcatgcatcgagtcacttctgcatctcttaatttccatagtgttatgctct

SEQ ID NO: 47068 - DNA, 201 bp, Homo sapiens
aacatgtatatagcattgatacctctatctgcagaatgtaagaaattgtaactgtatacatgagagtatattataaatgcagtagttcctgctccttggcrtgcagatacacctcattactctgcaatgcaaaactaaaaatatacatgttttttaaatctgctaaaagattcaatatatgttaattttggaaattatacg

SEQ ID NO: 47069 - DNA, 201 bp, Homo sapiens
tgagaactataaccgttaaataaattgcatcagtagttaatacaacaaaataacaatatgtacaaaaatgtaaaggacccattatgcaatttgttcccaakaatggaaaaagaagaaaaatttcctcagcttattttatgaggctgatacaatcttgatggcaagccctacagaggacagtactacaaagaaaaactatag

SEQ ID NO: 47070 - DNA, 201 bp, Homo sapiens
ttccttaactctgtaaaattggcaacttccaaccacttggtgaaaccggaagtctgaagttttatcctatcttgatctacagagatataatcaacattgtygtttttaatagccagttgccaccaaagatctgatcacaataatgcagagacctttatatattatcactagaacactgttgtacatttataatcaaaaatg

SEQ ID NO: 47071 - DNA, 201 bp, Homo sapiens
tggttattatcagttttattttacgttacctaagtagagtttaagcctttcagttaaaatatgactcccaagcaaaaggaagaggattaatggattaactrttgtttgtgttatcaataatattggcaataactatttgtctatggtgctgtgtcagttacaaggcactctgccatgcattcttccatctgatcctcacca

SEQ ID NO: 47072 - DNA, 201 bp, Homo sapiens
ttatgatgtcctagaggtggctgtctttctgttgctgtgcataccctgagcagacttgacattgctttggaagcacatattttctgatagacatattactstcataatctaaaatttttcagaagtgacaaaagtggggttgaccattttcttcttcgctgtctccatgattttgctttttccaagatgtcatgtagttag

SEQ ID NO: 47073 - DNA, 201 bp, Homo sapiens
ttaagccaaaacaacaggtaataggaaattgtcctgggcaaaccagaatgtatggccctgctagcattgtgtaaagttaccaaacttccagtgtcataacmcggagtgaaatacacttaggtgaatggatgcatagatacgtggaagagtcaattaatggactgcatttagggttcatccagttggattctctttctactt

SEQ ID NO: 47074 - DNA, 201 bp, Homo sapiens
aagatctctagcacagaaaagtctggttacaagattacagagagagagagaaaaaaaaaactgtagtgacttgtctagggaactgtgtggttgccacataraaaatgtggaagggagtgatgggagacaggctatgttcctagcaattgccttgactcaccataattatttcacctactgaataactgaataaattgagta

SEQ ID NO: 47075 - DNA, 201 bp, Homo sapiens
aagcaattgaaatttgtaaagcatttggatatctacaaaagttatttgacgagaacatacaaggggacatctcttatggactggtaattttaggattgtcyacttgatgttaactaaatatccttcctaatgccaaaccaacacatggggtaagaataagtgatgctggactaaaaaaaaaatttgatttctctatcaaat

SEQ ID NO: 47076 - DNA, 201 bp, Homo sapiens
tcagcatcaactgatttagtgaagcagcaaaaagaaaaatggtgtgtgcagcattatctttctgccacagatacatgtttttaatttccaagtttccaatrcatcattcagttttatctaacgggaatgcagctgagagaagtttgtaacaacccaaaactacatgctaatatagtttagttttcaagtcttgtggagtct

SEQ ID NO: 47077 - DNA, 201 bp, Homo sapiens
ctcacacaattccctaaaggaaaactacaaaaaggatgtttcttgagataggaatacaaataaacttttgcttgtttgtttgttttgttttaaatccagtrataagaatgaatgttttctgtatttgctttttttaaaaaaactctatattttatgtgcagacatttaacataaaatcttttcccaatgtctttcttagat

SEQ ID NO: 47078 - DNA, 201 bp, Homo sapiens
gcatttttacattatcgattccttgattcaatttctactctgtgctgacctgtcatatgggataaatctaactacagcaaagctctgttattcttcagtayagtacaacagataagtaagccagatataatacatttgggtgaaaaaactacaaaatcatagagggggatctttttaagagcttttaaaacaatcttttgg

SEQ ID NO: 47079 - DNA, 201 bp, Homo sapiens
gtagccctgcagacaaaatgataattgagagaagattagggagttgtgaacagaaagaataaactcaagcttcaagtgagatggaatccctactccctccrgaagaccttttatgtgatataaggaaacagtgcaatccaccataatatcataatttgaaaaaaattgtatcaactattcaagaattactacattcctata

SEQ ID NO: 47080 - DNA, 201 bp, Homo sapiens
tatggtagaaatttaactcttatgacggagtggcagtgctcacacacccttagaagtttccagtgccttcccaaggaaagatcagactctttgagcattasaaaccctctgtaatctgactacctttccaggctccaagccctcaactccattctatataatgccaagtttggcatttcttgcacttatctagacatcatt

SEQ ID NO: 47081 - DNA, 201 bp, Homo sapiens
ggaggcatgatgagtgattactgactcatttccacggcattagttcaagtcctcattatctcttaccaaaacaaatatggtagaaatttaactcttatgayggagtggcagtgctcacacacccttagaagtttccagtgccttcccaaggaaagatcagactctttgagcattagaaaccctctgtaatctgactacctt

SEQ ID NO: 47082 - DNA, 201 bp, Homo sapiens
ctacaagaagtatacaattgctcctctgatgtgaaagcatatgaagaaaataagtgtccaaagctgcataaatatttgcacccctttgagagtatgagaargtgtgtgttttatgttgtgattgataggacaactttcatggcccactttgaactcttagcaggaactttggaatgtcctgagggtctgtctgcctttgta

SEQ ID NO: 47083 - DNA, 201 bp, Homo sapiens
ccaccacgcccagctaatttttgtatttttagtagagacaggatttcaccatgttggccatgttggtctcgatctctcgacctcgcaattcgcccgcctcrggctcccaaagtgctgggattacaggcgtgagccaccgtgccggtccctcatgctccatttttatagtttctccaagaagcactttctgacctctagact

SEQ ID NO: 47084 - DNA, 201 bp, Homo sapiens
ccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgat

SEQ ID NO: 47085 - DNA, 201 bp, Homo sapiens
tattcttataggatgatgcacttaatattcataattgcttcatgacagtccttgcgcatttcaaattgcagaatgcctgccttttaaagaagcttgtgttsattaaatggaattaggtgttgggaaaccactatgggtgagatgcaggagcacaaccaaatataatggataatcctgggcttgtcagaatcatcctgagtt

SEQ ID NO: 47086 - DNA, 201 bp, Homo sapiens
tataaagttcatactcacatctaattaaaagatttatgaatactttgggaaatatcacaggagctataagctttcaaaacatgatctggtttttaaagttytcaagttgctcttattcttataggatgatgcacttaatattcataattgcttcatgacagtccttgcgcatttcaaattgcagaatgcctgccttttaaa

SEQ ID NO: 47087 - DNA, 201 bp, Homo sapiens
tgaagcttagttttatgaattaccttttagccttctccagtcatgtgggaaaactttcctgcctcattaaatctttaatgcaatgtgcaccatgcacactrtattgttatttgtgacattaggttatatattgcatagtaactataatattacttgcaaacaagctggtttttccccctgaaggtagaattaaaacaggta

SEQ ID NO: 47088 - DNA, 201 bp, Homo sapiens
ctggtttttccccctgaaggtagaattaaaacaggtactcatgggaaacagctacttgtgttcttcttttcttaatggggtgaagctgaagaacaggaaaktgaatggcttagcccagaaccatctccaggaatggaggtaaattttttcctgcagtgccttctcaatttgatatctgaatctccctgaagagaatttgcc

SEQ ID NO: 47089 - DNA, 201 bp, Homo sapiens
gaaggtagaattaaaacaggtactcatgggaaacagctacttgtgttcttcttttcttaatggggtgaagctgaagaacaggaaattgaatggcttagccyagaaccatctccaggaatggaggtaaattttttcctgcagtgccttctcaatttgatatctgaatctccctgaagagaatttgccttagtagatatggag

SEQ ID NO: 47090 - DNA, 201 bp, Homo sapiens
agcattacagccacgactctttatacagcagccaccctcttctgtgcctttgccaatacgttccctctgcctggaagattgcagccctttcactcctccayccgagactaactaatccctgttcagctcccaaaagtcagcactatcatcctgaaaatgtccttgattgggcctaatctgagttggttgcccttttgtgtg

SEQ ID NO: 47091 - DNA, 201 bp, Homo sapiens
gtcttatttacatttaaacggccctttttcaaaatattgcaatttgatttgaaaaagttaacagatgtggaaaggaacaatgcctttgttatgtcaagatrtccgtttctagcaaggcattcattcgataaactatttttaaaaatgcactcattctgccttgcatatgaaaatgagagggcttgacatttcacattacaa

SEQ ID NO: 47092 - DNA, 201 bp, Homo sapiens
gatgagcataaaagtggtgtactactgaggaaattatattctcccacattgtttttgatccccttcaattttgacacttgctgcaaaagactttatcttgrtaagatggcaaagataacagagctagcctgaccataagattcagatgccctgttctgtttctcctttggcaaatgtggcttagtataaagtgtgagcaaa

SEQ ID NO: 47093 - DNA, 201 bp, Homo sapiens
tggatgaagtggtctgctctctctctttctgtctctctctttctctctctctctgtctctctctttctctctctctctctctctctctctctctctctctmtatatatatatatatatatatatatatatggcaactagatgtatactttggaattcctttaaggtgaaaagagttctctaaatgtaaagtgttgagtgaa

SEQ ID NO: 47094 - DNA, 201 bp, Homo sapiens
tcttcatagccccaaactggaacaacccaaatgtactttaatagttgaatgtattaaaaaattgtgatatatccatacgatatagaatgatagatactatyagaatgatagaatattattcagagatgaaaaggaatgtattactgatataagcaacatgactatacctccaaaacatgttgcaaagtgaaagaagccaga

SEQ ID NO: 47095 - DNA, 201 bp, Homo sapiens
gaagatacatgcaaaacctgacagttgaacagcctatcgaagttaaaaagcttttcgttgggggtgctccacctgaatttcaaccttccccactcagaaayattcctccttttgaaggctgcatatggaatcttgttattaactctgtgtaagtggatctcctcattactactactaattttttatttttatttcttgcta

SEQ ID NO: 47096 - DNA, 201 bp, Homo sapiens
gaaatagttccaatattattcatagtggcttgtataattatgtcctctctcttcatccatcatcttttctgtattttcaaggcataaaaataagagggaakagtcagctaaagcatttgacttagttgacaattctttgatagctcatgcatctctaaaatttagtactatattattgccaacattatgtatttaaatgaa

SEQ ID NO: 47097 - DNA, 201 bp, Homo sapiens
agaatgtatccttagtgctttcaaagttccctcaacattgctttcaataacctattctaataagagctgttttttttctatcaataattacacaaataatktgtatcacttaaaaacaaaacttgaatatctaccaaaagctgtggctttcaattagagtattaaccacataatttcattttgtaactctttctctctgag

SEQ ID NO: 47098 - DNA, 201 bp, Homo sapiens
aagacccagtagggtaccctatttcattaagaaatgtgtctctctcatcacaggtttagaagatgagttctagctttttgttatttaataatgataattcrttgaatcaaaaccaaatcactttctggaccaactggcagctgttaatataacctgtaaattgatctttttttaaagcaaaatttccaacagctcagtgcc

SEQ ID NO: 47099 - DNA, 201 bp, Homo sapiens
tcagaatctctctaagaatcaaagactgatgagaaacctctgaaagctgtgaaaagtgtgttattgtttttaattgcttccctaaagaatgagagaaggcraagctgggaccctagtggtattgatgggctgttgctccttatccatgatgtgtaagagtgaggaactaagtctgaaaactttttaaggggaaaatagcag

SEQ ID NO: 47100 - DNA, 201 bp, Homo sapiens
ttgtgtaaatttaatctaattttttgatgaaacaatatattatgaaaataaattaaagatagacgagagcagaagaaaattgagccatgaataatttcaayagtggggaagagaactttggaaaagtttaaattagagtagaaatgggtaagaggagctcaggaaagtatttatttgcttttctttaattccccattgtgt

SEQ ID NO: 47101 - DNA, 201 bp, Homo sapiens
tcaagactgacaccccaaagcatccttaatctataataaacacaggagtacagggaagctcacctccactttgtttacatttctatgggcaaatgtgccgwctttctagtgagatgtgaggaatttaagtgcccttactgcagccttgggaatagaaacaggatcatcaacagcctccactcctgccatcctcacccatgc

SEQ ID NO: 47102 - DNA, 201 bp, Homo sapiens
tagttttagggtctgacttctgtaacagtttgttcttttaaaggaagcacagattgatacaacgtatttaacataatgagtaatgtctacttatttttacrttacttaaaaaatgaaatacatgtcagtttgaaacactgccttaataactgtgtgcaagtactcagtaaaaatcagcagatgctcgtttggttgtgtccc

SEQ ID NO: 47103 - DNA, 201 bp, Homo sapiens
aactagtttcactagcagaaaagaaaaataaaaatataaaatagcaaataatctttaaagaaaactgattttcttattatgctgaaatttattaaagactrttgtgttgactgaagaatatgtttaaatattttgtggaaggcaaagctttcattcaggaatgacaagtgcaaggactgtaattctaaagaaattaaagaa

SEQ ID NO: 47104 - DNA, 201 bp, Homo sapiens
ggtaagcactgcttatacagtaagcactgctctttccaatatacatatgtacacatagtgtatgggtgaaaactgagactgtgtggcacatatgaaatgartgacctttccagtgagcattgaagattttaaaatggaggacagaaagaatgtgagatttttctagacaagagatggaatttcctttatcccaggtagcgt

SEQ ID NO: 47105 - DNA, 201 bp, Homo sapiens
tcattcataagccactcattcgaaacatcttcccagatacttagttttatgaaattctcaagactgacaccccaaagcatccttaatctataataaacacmggagtacagggaagctcacctccactttgtttacatttctatgggcaaatgtgccgactttctagtgagatgtgaggaatttaagtgcccttactgcagc

SEQ ID NO: 47106 - DNA, 201 bp, Homo sapiens
ttttgaaatgacatttttatgaatagaaagactaagtgattttcattttaattatgccataagtcttttaaaatgtactttgggaaaaatattgggttacmtttaaacacttcactaacatgcagtaggaaataatactcagcccaaaactgacatggaattgttttacttaccctaagaagacaaaaataagtatgtcat

SEQ ID NO: 47107 - DNA, 201 bp, Homo sapiens
ctatgtggcatgcattccttgtcttggatggctttgaagatattctcaaacattatttttgcaatctttgaaaaagtacaaaaggtagataactttgtacyctttgaatattgcatgatagcaacaaaaatgaaaaatctatagaaaaaagtcaggtggtaaataaaaatcgaaagtatctttatatataaacagtgtcca

SEQ ID NO: 47108 - DNA, 201 bp, Homo sapiens
attttttagcatataaatttaaacataatggtaactatttttcttcttaatgaaggacacatctaaaataaatcatttggcttaaaattagcaacaacagyaataaccaaaacagcaatgactaacatttatttagtgtttactcggtgtaaagtatttttctaaacaccttccacagctggtgtgtaatgctgtgagcaa

SEQ ID NO: 47109 - DNA, 201 bp, Homo sapiens
attgatttgtccaagaaaactcagcccatttatcaggcatttcatcataattaagaattttgttaatttccacatcaattgtgcttatgtgtacaacaaaygcaagaaacacattttcacacactataaatggacaaatacccaaaacggggaaagttgtttctaattacaaaagtgtggttctcatatcacaggacaaaa

SEQ ID NO: 47110 - DNA, 201 bp, Homo sapiens
tgaaatgaatgtgagcatcacttgacaagtttatgtgactaacgtgctcagtctgccataggctcaaacacacaggcaaatgtaggcactgagatcaggtrgccatattcatctctcaggtgcctagcctgggatccagaaatgcttacattaatatttaaggttatcatcaaaatgaaaacacatgattagaatcttgta

SEQ ID NO: 47111 - DNA, 201 bp, Homo sapiens
aaatttataaagcttaacttgctttaaaatttgattataaattatctgaaaaatatttttggcaccagaacaaaatctaaacttctgcaatagtgtaggtstatatttaaaagacattttaactcaaagtccatttgaagtaagccaggaagtattcaatgtcacatgggaagatttcatgcttgcttcttctcatagttc

SEQ ID NO: 47112 - DNA, 201 bp, Homo sapiens
gtgaggagggaaagagcccaggcatctgtattttataaatgttcatgtgattccaatgggcagccaaaggtgagaaccactgatccacaccaatgttgtcrcattctaatgtgcagagataatgtgggacgcagattctgatttcctagatctggggtagagcccgattatacatttctaataagcttccaggtggtgcca

SEQ ID NO: 47113 - DNA, 201 bp, Homo sapiens
gccttaatttgtggatcagtggatttttgaaatgacatttttatgaatagaaagactaagtgattttcattttaattatgccataagtcttttaaaatgtrctttgggaaaaatattgggttacatttaaacacttcactaacatgcagtaggaaataatactcagcccaaaactgacatggaattgttttacttacccta

SEQ ID NO: 47114 - DNA, 201 bp, Homo sapiens
tttaatagttgtaaacataagtatggctttgacctctttggacttcaatcacttcatctgtaaaataaggaggaggacaattgctctgccagcttcaaaargtcaccgcaagaattgaattagagagctgcaaaagcacttggctagtggtaacccagcacacaaatatgaagcatttctatcttatctacttcatcccaa

SEQ ID NO: 47115 - DNA, 201 bp, Homo sapiens
attactaaatgagtatgtgaggacagagcagaggaaaaggccaagggttgagcactgtggtgctctattatgagaaagttaggaaggattaaagttggcastgaaggggattgagaaggagtagctgaagcggtagaaggaaaacaagaacagtgtgtcctggaagtcagtggagtaatcacttgtctcaaatgctgctaa

SEQ ID NO: 47116 - DNA, 201 bp, Homo sapiens
tctatgcagaagaaaagatactagctgggtgcccagattaacttcacagcctctttttttctaaaaggaattatttgggacagctttacaatgttatgtawgttggtgagttctgaagagatattttattaatttcccaaattaagatttcttcttgataagttaatacaaatccatcctcctctttcaactgtcattcat

SEQ ID NO: 47117 - DNA, 201 bp, Homo sapiens
aaagtggcctaaagtacaagtaagcagaaacatggctcaaaatgttgagaacattcttaagtggaatatagcatgttctaaggtttcaacttgtgaaccaycttgaattagttattgcagtgcccaacagatatttagtattgctgtgtgtccttcaaatgtttacaatattccactgtgcctttgtgagttcactgcagc

SEQ ID NO: 47118 - DNA, 201 bp, Homo sapiens
gcagtttcagtggaatggaggaagaccaatggaataataggagcattgtggaggaataaaccaaaatgtacctatttaccatccagagccagactcagagyctttactctgtgctagaaacacaatgaccaattgttgcattgttccctttccttgagctttctacagctcacctcgcttcttcaaacatgtacaatcaga

SEQ ID NO: 47119 - DNA, 201 bp, Homo sapiens
tatagtacctaagtacctatacattttctagaaaacttagaatcatcaatgtatctgcaccaaattaatggctctgccccagaattgggatttgttaaagkactctcaatataatgtactggatttaaaccatttttatttcaaatggtagagagcctttctctaaataatgactgcatatctgtgagtagatgagcataa

SEQ ID NO: 47120 - DNA, 201 bp, Homo sapiens
cctttggggtagtatataccttctcaaacttgagtatcagattggataatgctatccttatttccttttccacattgacttttgtgcagttcttgcttttrattacagtctcttctgaaaacctttcttaataaagatataaagtggcctaaagtacaagtaagcagaaacatggctcaaaatgttgagaacattcttaag

SEQ ID NO: 47121 - DNA, 201 bp, Homo sapiens
gtgaaaatccaatagatataataatgggatactcaataatgtttgagttcatcatgattaactggtaaataatgttgcagtattgaaatgccttaaagatrcttaatgcttagtgatttttctttagatgtcttactaaggatctgcattagaaataacaataattgatagagccaaacattctaaaaggatgtttgaatt

SEQ ID NO: 47122 - DNA, 201 bp, Homo sapiens
tcatattatccatcctcctctacatcagggtccacaacccctgggccacaggaggatattggtccgtggccttttagaaaccagaccacacagcaggaggsaagcagcaggcaaaggagcaagcgcagcttcattagcatttacagctgctcctcattcctggtattactgtactgcctgagctccacctcctgtcagatc

SEQ ID NO: 47123 - DNA, 201 bp, Homo sapiens
ggttcattttgtgatcataatgaaacatcatattctatgagcaatttgtactgtttttggtttctcttgagtgagccctactaatgccatatgttctgttracttcttattcaaaatagtggcatgatcattgcagaagcatttctatgttcagttatcctttcagaatgaatctacttttcaaatctaaactaaatttta

SEQ ID NO: 47124 - DNA, 201 bp, Homo sapiens
tagaaaataccataaaatagtcattttcatagaaaaagctttccctttcctcacactgaatcacattactttgtgttcaaggtaaaatgtagtttgaaatytggatgtaaattagaaaagatattattttattccaagtgaaacatgtattcacacttcacgtcttgaagcaccagtggccatttgggctgagttttcaag

SEQ ID NO: 47125 - DNA, 201 bp, Homo sapiens
cttagttctagggatagactttcaggactccagtggaaaccccgacttgtttaccacactctttccttcttggctgactcttaactccaaagtttgtcttsccaactctgggagacttcccaaggatcttcttagtttttcacttctcatgagttcatttttgcatgatgtttatcttctggctccttcaccacttagaaa

SEQ ID NO: 47126 - DNA, 201 bp, Homo sapiens
gtgagggtctgcttcctggttcatagatggccttcttcttgctgtagcctcacatggcagaaggggcaaataagctttctggggtttcatttataagggtrctaattccattcttgggggctctgtcctcatgacctaattacctccccaatccccatcacctaataccatcacattaggggttaggatttcaacatatga

SEQ ID NO: 47127 - DNA, 201 bp, Homo sapiens
aaagatataaagattataaaatattaaaagttcaatattgtcattagactctaatcaataatgagtatatcacgtattatattttgacatgaagaactatytagccttagagctttgaaatataactaagaaatctattaaaataaattaaatagaatatattccaaagtaactaatgttttcccatattaactcagaata

SEQ ID NO: 47128 - DNA, 201 bp, Homo sapiens
catttcagaagaattataataaggaatatagcatctttaacccatttctcatttgcctgaagaatacttgcagacagcatttgtggcttaatgtttacccygagataacttgtggcttactgtcctaaccttatccccaaagtttgccatgaaatatctcacttttattattatttttgcataggtctagcatattgactt

SEQ ID NO: 47129 - DNA, 201 bp, Homo sapiens
acattccagagaatcaaaattgcttgggatgacatcgggtactctcttaggctaagactatatgatgagtccttttatatcagctgccttttttacagtastttttcttctactttcctgtctgtgcttttttctttgagactgtcacatttcaattctttatatctctgctttattttaccatttcagaagaaacaccaa

SEQ ID NO: 47130 - DNA, 201 bp, Homo sapiens
agaggattcaatgtggtaacaggtataagtgcctgttagagggcctgtcatagataaatcctcaatgaagggtaactgttactaaaaggaagatataaggrgagatatgacactacttccaaataaaaaccctggttcaatattggagcatggggaccccctttaagagaagcatcctcccagcataatgtccaaaatgaa

SEQ ID NO: 47131 - DNA, 201 bp, Homo sapiens
caaagaggagaatatttgaatgttgctcatcaagggcattcttactgttcagctgaccctgcattttagcttcttgtttatttttcatggttttaacccascattaagtagcatggtttttagcatgaaaaataaatttataaatttataaagcttaacttgctttaaaatttgattataaattatctgaaaaatattttt

SEQ ID NO: 47132 - DNA, 201 bp, Homo sapiens
tgattcaattttttaaaacccttaagtatttgaagacataattttagttgtatcagtgagataacatgcaaataattttacaaaaaaacaagcaattcttyagtaatagcttagtttagctaaacttaaaaattgaaaggaagtaaaacaaaaatcaaatcggggaaaaaatctttcttcaaatggatccatgttttgcac

SEQ ID NO: 47133 - DNA, 201 bp, Homo sapiens
tatctttttggtttggaacttttaaaattggcacgtgaaatatttaggaagaaattccacatggaactggctcattgtcattccacggggtcagctggttkctccttctttccttgtgtgttgttggtccttatggcttgcctgatgagtgcttcactaccacttagacatatggagctggtaatattggaagatgaccct

SEQ ID NO: 47134 - DNA, 201 bp, Homo sapiens
gctctatgactacacacacacacacacacacacacacacacacacacgcaatatcatgtattttcttaaggaaaataaagaaaaaatgaagtaagatttgyataatgaaaaacattaaaatgaatttcaatcatctttttgtaagtatgcatatgctgaaactactgtgttgtttataagctagatattaaattaactttc

SEQ ID NO: 47135 - DNA, 201 bp, Homo sapiens
tatactggtttctttttttttttttttcatttggaacatataattgagaaagctttagtatcaagcatatgtaaagactcataaaataataaggaaaggcmaaactgcctgatagaccaaaaaaaaaaaaatcaacaataaacattttacagaggagaaacagagaaacatatacagctaaaaacatatggaaggatcttg

SEQ ID NO: 47136 - DNA, 201 bp, Homo sapiens
catttttaaaccatcatggtactttagcatttcacaggctttcatgctcctttacctaaattcagactcaaggtttttatactccagccagtctttacacsccttatttcattctgtctcagaagataattcactccaccgccctaaatttcagcctcagtcacttctctatcttactcccccactttgtactcatcaggt

SEQ ID NO: 47137 - DNA, 201 bp, Homo sapiens
tctcctgcctcagctggactacaggctgtgttgaataaaaatcaacaatttttactcaaaagtgattataaataactatacttttaaataaaaggaaattmttttctgaagaactctcttaaaggtgagcttagtgcttaataaggttcatatcgtattgtacactttccagctatctctaggcactgtgacaacactgac

SEQ ID NO: 47138 - DNA, 201 bp, Homo sapiens
actcctaggagtttggcctgaagaaattttcctgaaatagtatggattaaaggaggagcagaatggagatactgggtggcaattaagggtctgttttaacrtgttatctttgaagcattcgagtggtgccaggcatggtggctcactcctgtaagcccagcactttgggaggttgaggtgggaggattgcttaagcccagg

SEQ ID NO: 47139 - DNA, 201 bp, Homo sapiens
atttatctagcaaggttttgagaaaataagacattggtttaatgcaggggtcctcaaccatctatagcctgttaggaaccgggctgcctagcaggaagtgmgtggttggcattaccacctgagctcagcctcctaacagatcaggcaggcattagattctcatagaagctcaaaccctattgcgaactgcacctgcgaggg

SEQ ID NO: 47140 - DNA, 201 bp, Homo sapiens
ggagagaaatgttctaaatgtgcacccaatacctggggccacagcattaccactggttgtaaggtgagtgaaccacttttttgctctgataattttttggrgagatttttgttttgtagagctctgtaattgggcatttcaaaattcaatattacatcacaaaataatgtagaagtattactataatgtgattacagatat

SEQ ID NO: 47141 - DNA, 201 bp, Homo sapiens
gtgttcaaacagctgctagagaacaaagtgttttgctataaacactgtcaaatctcactgtgaaaaaaatttgtctataaaacaagtattttcatagatayactaaagctgcatagaatttgcttttatagcataaaacagaattagatgcttgagtcagctatgaaatactttttcatgcaacactcattctaattcttt

SEQ ID NO: 47142 - DNA, 201 bp, Homo sapiens
ctgcacctgcgagggatctagcttgtatgctccttatgagagtctaactgatgcctgatgatctgacgtggaacagttttatcccaaactcctcccctgcrtctgtggaaaaattgtctccaacaaaacaagtacctggtgccaaaaattttggggaccactggttaatgtatgttagtgatcagaacatttccagggcct

SEQ ID NO: 47143 - DNA, 201 bp, Homo sapiens
aagaatcagaaatgttaactcaggtcttaaataaaaaggaagaattaatatgatatattaaaagtgatacgaaagtcaaaggaaagattgatgagacttaktaatatgaaatgaggtttcttcaataaatatgtaagtacaaaaaagttaaattgtattaagaaacttgagatttaaaaaaaaaaaaaagcgaagtattta

SEQ ID NO: 47144 - DNA, 201 bp, Homo sapiens
aggaaaaacattcaatattgacaaacaccctaaaaattatttaaattgaaagaatagtgcaaaataatcaaggaaaagagagaatttctgttttttttttwaaaaaaaacagcacgttttaagtttctaatctttgcgttgtcaaatactctctctctctcttttgctacctcatagaaatttaatccatcaggatacgaa

SEQ ID NO: 47145 - DNA, 201 bp, Homo sapiens
tatgactagaggtatagctaagaaaaaagactatagggagaaattaatattgtaggacaaagcatttaattctagaatgatcccactaaggtaagaccacygtcatcggttgcaaaattgctgaatcactagggttaatagttacagatcctaaatactcctcacatgttttctttcctcgttacttaacttcccacaccc

SEQ ID NO: 47146 - DNA, 201 bp, Homo sapiens
aagttaatgactgtagaataaattctactgatatttgcagtctagtgtcatcaaggctaattctcctttaaagaggcaaaagcttcttattgtccccaaarctgttgatatagtatgtaactcagcatgtcacagaaatgttgtttatccactttggctattttgtttaaaaaaaacttttctaccctttttatttattta

SEQ ID NO: 47147 - DNA, 201 bp, Homo sapiens
ggtatatattcttattatagcagtgtctgccagggctgcagtcctgttgttagaaggctgtcagaattttaaatgtaagccttcctttcccaggtgttatwatttaatcttctaactcctattaatttctgaagactgtggggccatcctatatcttagaacaaaatatagatacgtacattcctgatttttttctccata

SEQ ID NO: 47148 - DNA, 201 bp, Homo sapiens
agcaccactatcaatccagcagagctggctgcccattgcatcatgtgaattccagctgaatacatattagaattatataattgattgagtatgcaaaccckatggatttaccctcaagtctgaccaacattactataaatgcagaggaaacattagggagataattttgcttggataattataggcattcatgacccattg

SEQ ID NO: 47149 - DNA, 201 bp, Homo sapiens
accttttagctcttattacaatgttctgcttaccttcattttatgttaacatatctgtaaagcaaggtcctttatttctcttctcttctaattaactagaygctcttacatattcttccagctgacacttttatgcactattttaatctcttccacaaattttaattacaatcaaaattactggaattttgattgtaatta

SEQ ID NO: 47150 - DNA, 201 bp, Homo sapiens
ccgtaggcatgggaccctccgagccaggtgtgggatataatctcctggtgtgccgtttgctaagaccattggaaaagcgtggtattagggtgggagtgacscgattttccaggtgccgtctgtcacagcttcccttggctaggaaagggaatttcctgaccccttgtgcttcccgggtgaggtgatgcctcgccctgcttt

SEQ ID NO: 47151 - DNA, 201 bp, Homo sapiens
aagtctgaccaacattactataaatgcagaggaaacattagggagataattttgcttggataattataggcattcatgacccattgttgtctctttatttrttgtgcatttacttggataatgggttctaattgttgttcctgaaaaagaaagaaagtctgcaagcattaaaacacaatccatcagtgccaaagggattgg

SEQ ID NO: 47152 - DNA, 201 bp, Homo sapiens
gaattgctatatttacactagtcactcttctctcttcagatattttatgtcttacagtaaactgttttaaggttgtctatatcaagcacgcatttctcatwtaaaaattctttctatgtatcttacattttcattttaatggtagtaaacattacctgttttgtttcaacatagtaaatgtactaactggtcattattggt

SEQ ID NO: 47153 - DNA, 201 bp, Homo sapiens
ttgctgccaccttgcagttcagtctcagactgctgggctagcaatgaacaaggctccgtaggcatgggaccctccgagccaggtgtgggatataatctccyggtgtgccgtttgctaagaccattggaaaagcgtggtattagggtgggagtgacccgattttccaggtgccgtctgtcacagcttcccttggctaggaaa

SEQ ID NO: 47154 - DNA, 201 bp, Homo sapiens
aaaccatactttgcattatggtattttttatcttttattgcctttagccagtatccttaggaatgtgttacagaaaggaagatatagacatcttattattrtaaaactcatccttcagtattggcaggggattggttccaggacccccccccacagatatcaaaattcttgaatactcaagtcccttttataaaatggcat

SEQ ID NO: 47155 - DNA, 201 bp, Homo sapiens
caagcattaaaacacaatccatcagtgccaaagggattgggtttccagtgtccaataatattatttcctaaaagatgtatattctaatttggtataattaygttgatcctgatttttaaaaatgcatataacacagtgataacaataccagtaacaccaagtatttaatgattctttcattttcaaaatgttttcacttag

SEQ ID NO: 47156 - DNA, 201 bp, Homo sapiens
ctggcatttttagcacagttatatttgctttatatgattaatttagaagcatttataaataatgcagtttaatttcaattttgttaggattaaaattaccrtctttatactgtcctcttttgaccaattgactattatgactatttttgttctctaagaattctaaaagcatgtctattttctgaggaatccctagatgaa

SEQ ID NO: 47157 - DNA, 201 bp, Homo sapiens
tccagaccctgtttgcctgggtatcagcagcggaggctgcagaacagcagatattgctgaacagcaaatgttgccgcctgatcgttcctctggaagcttcrtctcagaggggtactcggccgtgtgggatgtcagtctgcccctactgggtggtgcctcacagttaggctattcagggctcagggatccacttgaggaggc

SEQ ID NO: 47158 - DNA, 201 bp, Homo sapiens
tcttcaatcactgataccctttcttccagttgatcgaatcagctcctgaggcttgtgcatttgtcaggtacttctcgtgccatagttttcagctccatcargtcatttaaggacttctctacactggttattctaggtagccatttgtcctatcttttttcaaggtttttagcttctttgtgatgggttcgaacttcctcc

SEQ ID NO: 47159 - DNA, 201 bp, Homo sapiens
aaaggccttttctgcatttattgagataatcatgtggtttttgtttatatgctggattacgtttattgatttgtgtatgttgaaccagccttgcatcccgkggatgaagcccacttgatcgtggtggataagctttttgatgtgctgctgcattcagtttgccattattttattgaggatttttgcattgatgttcatcag

SEQ ID NO: 47160 - DNA, 201 bp, Homo sapiens
caaaggccttttctgcatttattgagataatcatgtggtttttgtttatatgctggattacgtttattgatttgtgtatgttgaaccagccttgcatcccrtggatgaagcccacttgatcgtggtggataagctttttgatgtgctgctgcattcagtttgccattattttattgaggatttttgcattgatgttcatca

SEQ ID NO: 47161 - DNA, 201 bp, Homo sapiens
gggacgcttcttctctagaaagactaaaattaatcaaggctacaatgtagtgtttttttccctaatgactttagcgttaaaagaccagcaatgtttcttargtacaattcttgttacctgctttctttataaaactgtaggattatcaatctgagcattacatgtagactaaattttgaaatattaaaaaacggatacgtt

SEQ ID NO: 47162 - DNA, 201 bp, Homo sapiens
acttgttttcaaacatcgatttcgggttcatgccatcaaattaaaaaattcacttaactgagtttaatttgctttcacttaggaagcagctgcctttcaakataataaaataaacagatacaataatatttggtcagctgtggcttttaatttaaatgtttgatttaatgttgtttagtttgctggattccaaaatattct

SEQ ID NO: 47163 - DNA, 201 bp, Homo sapiens
attgttttatagtaaagatgcttgtaatatcaaaacaagtatgtttttaaaaaattaatttcatcctattacatttcacattttatatttgatgtgggttrgaggagccccttagagattcttttttctttgtagagaagttttgtagagatcaatagtgtaagaatcatacaagtgtaaatagttttgtttccttttaat

SEQ ID NO: 47164 - DNA, 201 bp, Homo sapiens
aattgagagattatatccttccctgtttttcattatatggtcagctttcactggcctgagtccacattttaagctcaactatatacaaataatttttcagwatactgagagtaggattaatgaaaccagtctggagagcagtcacagaatgagaatagatctttcccatagtatcactatgtgactaactgattgtactga

SEQ ID NO: 47165 - DNA, 201 bp, Homo sapiens
gtgtcctctttctcccccaccctcaggcggcggcccggccaaagccagagggggctgtctcctcctcttccccagcagctgctgctcgctcagctcacaarccaaggccaggggacagggcggcagcgactcctctggctcccgagaagtggatccggtcgcggccactacgatgccgggagccgccggggtcctcctcct

SEQ ID NO: 47166 - DNA, 201 bp, Homo sapiens
aaagactgaccatactcagtactggcagaaggtggagacactggaactcatacactgctgctgaggatataaagtggcataacattggaagaggttggccmtttcttaaaagactaaatatacatctaccatacaaaccaatcatttcactcctaattattcacccaggacacaagaaagcatattttttatagaaagact

SEQ ID NO: 47167 - DNA, 201 bp, Homo sapiens
tagatcagtataatatagttctactttgctggaaaagaaatatatttgaaaagcattacgttgagtaattatctagataggactaacatcccataaatatragatctgatataaaagctatagctcaacagagaagaatgagattaaatgtattattaagtatagaagagttcaaagcttaacaatacagaagagtcctct

SEQ ID NO: 47168 - DNA, 201 bp, Homo sapiens
aaaagcatggtgaaacatcctattatcattaccaagtatctttaaagatcttggaggtgaaaaaagagcaaattgcttgcttgcatcctaggaacatctgyccaaaatacatcttcactagaggtcaaatggaacttttaaaacaatgatgaacttgggctcagtgagagaagaaccttcctattcttcataattcctaat

SEQ ID NO: 47169 - DNA, 201 bp, Homo sapiens
ctaagaaatctttatatctatatatctctatctgtatctatctttctgacatgccttcttctcttctcctcgcttacctctctctctctgtatatatatawtatatatataaaatatatatagcaggtagatatatacttatatgtaatctacataaaggtaaaaatatatattatttatatttatttatattatttttaa

SEQ ID NO: 47170 - DNA, 201 bp, Homo sapiens
ctcccaacgtgtccctcccacaacacatggggattacaggcgctacaattcaagatgagatttgggtagggacacagccaaaccatatccaccattatgtwtattcaatgtgtaacctatatgtatctgtatctatagccacatctatatccagacaattacataatcttatatgttgaaacaattacagattcaagtact

SEQ ID NO: 47171 - DNA, 201 bp, Homo sapiens; identical to SEQ ID NO: 8777

SEQ ID NO: 47172 - DNA, 201 bp, Homo sapiens
taaaaattgtatcacaatttggaatgacgtttatgcaagtggatagtctgccagttattttatagtctaaaaaaatgaacctgtaaggctacagtataaartccaagtctttatagttgtatatttgtagtgaaaacaaccgtgggggaataatataagcttaatcatttggtgattagtctaccaactattaatgatgag

SEQ ID NO: 47173 - DNA, 201 bp, Homo sapiens
agacacttaatgacctagggaaactatcctttttaaaaatattttataaaaaacattactgttataatgtgagctagaaactctgagatatgaattgaatmtttgcatacaatcctgaagacgagattttaatttccacaggttattcagagaaaaaaaaaaagggagctaaaggttgacgcaaccttcatgggaagtcta

SEQ ID NO: 47174 - DNA, 201 bp, Homo sapiens
gcaaataacaatgtaactatttcgaatgtttatattctttaatttctggcatcacatagcttataggttaaataaaatatgaaagagacatgtgaatctcwgcctttgaatacttaggatgtgtttgaatatataatattattgaagttgttatagattttcatcagttatataataaaatatattattggcacaaggctg

SEQ ID NO: 47175 - DNA, 201 bp, Homo sapiens
gttgacctttgggctcactcaagagatcatattgaatgcacgttgttaaaattaatatagagaaatgtattccaagacaataggtaaatttaaggaaacawtcaattcagccatattctctagaaaattgagaatgctctagatgttttagtgctctttcctacacattgttttatgtgcacatgggagattatgatgggt

SEQ ID NO: 47176 - DNA, 201 bp, Homo sapiens
agctatgttaatataagggactagagcaggatgagaaaactgcagatttaattctttaactattaactaaatacctttcacgttaaatcaacatatcttawtttgtttaaaaatttgtaaaaaaaaaaaaaaggcaaagttttttaaaaaattaataagtcgtatctataatttattatggcaatatgctttcatactttt

SEQ ID NO: 47177 - DNA, 201 bp, Homo sapiens
aaaataattcattatgcaattattttactgcaaaagcaaaaggctgaaaattattgttgaagatcccatgtatttttggcacattcatctctataaaatawgttcttaaaacactccccagttaacacttattcatcagcatgacaccttgctgaatgacttgaaattataattcatagataattattttatcttggagcc

SEQ ID NO: 47178 - DNA, 201 bp, Homo sapiens
atggcaatatgctttcatactttttcagtataaaagggtttatcaaatcaatcatattattccattttgcagaatgggaaacaggtttagagaaatatatygttcaaagacatacttagaaaataaatcaagtctaattaagaaatgcaattgtggagattaaatcagatttcatagtacttaaaggtaattaaagaaata

SEQ ID NO: 47179 - DNA, 201 bp, Homo sapiens
agcttcaagtgagatggaatccctactccctccagaagaccttttatgtgatataaggaaacagtgcaatccaccataatatcataatttgaaaaaaattrtatcaactattcaagaattactacattcctatacagtaaacactttattatttttttattgacatttcattattttactataacgaaatgtaatttaatc

SEQ ID NO: 47180 - DNA, 201 bp, Homo sapiens
agcaataagagagtgaatcttcagtttatgttgttgaaagaatatcaaagcacaaatacagatatattttatgagaaagttttatttggatgcgttatgtygagtatctatattactagaaacttaaacttacttaattcttaccagtaggtttcaatgacaattggttataggaagaagagaatatcacattaagaatct

SEQ ID NO: 47181 - DNA, 201 bp, Homo sapiens
ttcctacttcctttgctataatcctcttgagggcatttttatattccctgtgatatctcatatgtcttgtatatagtagttcagctatgagttgatgaacraataatataaagaataaagcaacgataagaaataatgagcagagcatttattaataatttgatattgataacagaggaagttaaattattcaaagagctc

SEQ ID NO: 47182 - DNA, 201 bp, Homo sapiens
agcatcccagaccagcctttatctccttgacccagcagattcatttagactttccactgagttgaaatgtttaaaatgatagacttacctggtcctaataycttgctagtatcccaaaaataggaagaactattaaatctttacagaactaccctgagttaagccagagaaatactattcagaaatagtgttcatgatctg

SEQ ID NO: 47183 - DNA, 201 bp, Homo sapiens
atgattgggttaaacaagagatgagaaactgcaggatagaaaatcagaaatataggcctgaaaaaattacctataaattgacatagggaagtaaataaatrtgatgctaactgactcacagaattgtaaaattgaacagaagtttagcagaagttgccaaagaagagattagaagaagttgagggaaacaatattcaaaaa

SEQ ID NO: 47184 - DNA, 201 bp, Homo sapiens
aagttaagaaagtatttcaaagtaattcaagtgtcaggagcaggatcaaatcaggacttggaatgtttaatttgttgttatgtctttaattcatttagccrtcaagcaagtctctattgaattgccctgtcatatataatagaaaacaaatctacttagggaaaacataataagagaaagattaattgagggcatttccct

SEQ ID NO: 47185 - DNA, 201 bp, Homo sapiens
agaaagtatgtgaggctgcatatgtgccaggcctggaggaatttctaaaaagcagctatacatttccacttgttactgatgatcactactcagagcagtcraaagtcagttaataacatgtcacagggatactgctctccactgggctatattcacgtctgcagaaatagcaatgtcatttcatcctccattggccagacc

SEQ ID NO: 47186 - DNA, 201 bp, Homo sapiens
ttattctttcagaagccttgaatttacatgaagttatgtgataatgacctaccttatataggacctagaattttttgttgttcttctgtaaaaccatgctycctgaactgtagtctagtcatcagaatttgccagtcaactccaggaaagacattgttttaaagaatgacgtaagctttctagaagtcaattttgtagttt

SEQ ID NO: 47187 - DNA, 201 bp, Homo sapiens
aaaagagcttcattaggaagtcttgggcctaattgttttttgttttataaattttaaatgactgctctgtgatgagcccatttcagttgaggctgtattayttttcctgtgggtaaaatgacatactgagctgatatggacatcacttctcccacttttgctattttaaaaatacagatatgctgcataaacatagcaaat

SEQ ID NO: 47188 - DNA, 201 bp, Homo sapiens
tttctagtttatttgcatagaggtgtttgtagtattctctgattttagtttgtatttctgtgggatccgtggtgatatcccctttatcattttttattgcwtctattagattcttctctctttttttctttattagtcttgctagcggtctatcaattttgttgaccctttcaaaaaaccagctcctggattcattaattt

SEQ ID NO: 47189 - DNA, 201 bp, Homo sapiens
ataggaatactattttataaaataaatggattaaactttttttgcaatccttttctttctgattcagtttcagcccctcttgtgtcgcagaaggacttgaygactaccgctgcacggcttgtccacggggatatgaaggccagtactgtgaaaggtaccaacagccatgaaacgtacagagtaatgatatgtagggactat

SEQ ID NO: 47190 - DNA, 201 bp, Homo sapiens
cctggtttagtcttgggagagtgtatgtgtcgaggaatttatccatttcttctagattttctagtttatttgcatagaggtgtttgtagtattctctgatkttagtttgtatttctgtgggatccgtggtgatatcccctttatcattttttattgcatctattagattcttctctctttttttctttattagtcttgcta

SEQ ID NO: 47191 - DNA, 201 bp, Homo sapiens
gtacaattcttgttacctgctttctttataaaactgtaggattatcaatctgagcattacatgtagactaaattttgaaatattaaaaaacggatacgttwtgatagtcgaatgatgaattactgagctcacttttcgttttaagccttttctctttgtgtttacaagtaaatcacaatgttgttttcattaatatcattt

SEQ ID NO: 47192 - DNA, 201 bp, Homo sapiens
gtagcaacaaatatggagcatttagaacagtgtctggcattgagaaaacctatgttttagttgttattagtattaaaagaaaggaattatattatacatayttttctttacccacaggctctaatacagaaatttccatatggtagtaattcattacagattacctagctgttaatcattcagtgccatcattgaataatt

SEQ ID NO: 47193 - DNA, 201 bp, Homo sapiens
cagatatctaaattccaactgctatttcaccttctttttgtttgtttgtttgtttgtctgttttttgagatggagtttcactcttgctacccaggctggastgtaatgtcacaatctcgtctcactgcaacctccacctcctgggttcaagcaattctcctgcttcagcctcccgagtagctgggattacgggcatgcacc

SEQ ID NO: 47194 - DNA, 201 bp, Homo sapiens
ataccaatccttctcaaaatcctccaaataactgaagatgagggagtacttccaaacttattttatgaggccagccattagcctgataccaaagccaaagrcactgcaagaaaagtacattacagatcaatatttttgatgaacatagatgcaaaactcctcaagaaaatactaacaaaccaaattcagcagcacattaaa

SEQ ID NO: 47195 - DNA, 201 bp, Homo sapiens
gggtgggatatgccaggtcaaggaaagggccatgggagtgggtgcctgatgcggagaggaggaaaagaggtcagcgaggaggtaaagagcctgggcacagkcatgttggtagattttacagttacataaggagaggtaggaaggaagatggcgaaccagaaagtaagtcattaataatggctggaaggtggttttatgagg

SEQ ID NO: 47196 - DNA, 201 bp, Homo sapiens
agaattctttacactaaattaaagatgataaagcaatctgcttttcatactaaacagtgaagtgaaaagcattattttaaagaaatatttctgttttgttrgtgtacgaaattctgtaatagtggctaacttctttaggaacctttttaggtgaaacttatgattgactatgaaatctattctaggacaaaataaaatgag

SEQ ID NO: 47197 - DNA, 201 bp, Homo sapiens
tgaaaggagtgtgaagtgaatactgttgacattcctgagaaatgtatctggggggccttaaaatctgtaaatatcataaatatcatacgaatcctaagaarttctgggatttaaggatgagtgggagacttaggttcttggttctgtgttgtaagtcattctccaagtgtagcaggaccatagcactgatgaaaatgattt

SEQ ID NO: 47198 - DNA, 201 bp, Homo sapiens
taaaaataatatatttaaacaactataacttaatttaaacattttagacattatctcttcctttcctagtatggaagacaaagattgagcactctcatctraccctcacacatttctgcctacatcctgcaacatatacttaaaataaatatttaatgctaacattgttaaaaccatataaatattactcacagctgagct

SEQ ID NO: 47199 - DNA, 201 bp, Homo sapiens
caaaccaagttatttcatgtcttaagatgtataattctagatgttttcatatgttataactattaaaaagttgaggctggacatggtggctcatgcctgtwatcccaacactttggaattacactttgggcatagatggggagatctcttgagcccaggagttggagagcagcctgggcaacacggcgaagggaggatcgc

SEQ ID NO: 47200 - DNA, 201 bp, Homo sapiens
agagttgctgtctgtggactgccgtcttgcttcgccttcagagagtgcgctctggggcaagaggaacttgaagcaagttcaagttcaatgccatgagagcrtagtgtagggggaattacctaagtcctgcaaaaggaacggggagtgcttttcattgttctttagtttcgaagaggtcttgctatcacgatacatcccgta

SEQ ID NO: 47201 - DNA, 201 bp, Homo sapiens; identical to SEQ ID NO: 8806

SEQ ID NO: 47202 - DNA, 201 bp, Homo sapiens
aggccataaaaaacaaatgaaaaaacaacaaaaactaggaatggcagtagttctgttgagttaaagaggagaaagaggagaaaccaggactggaagagatraaattgtgagtctggaaggaaactattgcaaaggcctttattacctttaagtaaatgtctcctaactgaactgaaagccttcattctaaccattagtttg

SEQ ID NO: 47203 - DNA, 201 bp, Homo sapiens
aaaagtcagttaataacatgtcacagggatactgctctccactgggctatattcacgtctgcagaaatagcaatgtcatttcatcctccattggccagacmctaatctctgtctctggggtgagaatgaccagcctgtactcttttgtcagagcagtagtggagagagagaaatgagaaaatgctaatgactttgtgtatg

SEQ ID NO: 47204 - DNA, 201 bp, Homo sapiens
atcgattgccgttggctcaaagtaatatttgaaagaaaatgcagccagtgggagcttatctagctgtagcttcatcatctctattaattatgtgtttcccraatttggatcattaggctaccaaagtgacagcagatggcgagcagaccggacaggatgctgagaggaccaacacaagagcaaagtccctgggagaattca

SEQ ID NO: 47205 - DNA, 201 bp, Homo sapiens
aaatataaaaaatacaagtaattctgaggtacagatgagcctgactgtgtaactcatcctttagcatgctaacccgcattaagttgatgcttttggtgccrggaacctcacgtctcctcctcttctggaatagcctagagaggaagctcttcttctgtgtttagagggaaggtatctccttcagtaagcactgtgctggcc

SEQ ID NO: 47206 - DNA, 201 bp, Homo sapiens
aaaaaaaaatgaaacaagcagcatttatttgcaatcaagaaactagatatctttaattgtgtgtgtgtgtctgtgtgtgtgtttaaagaaaggcatgtgcrtattacttactataataggagaacatatcattgccaagacagatttacatcaagtgcctaaaccccccagttcactacaggcaacctttttttagcaact

SEQ ID NO: 47207 - DNA, 201 bp, Homo sapiens
tcatataaacttttaaatatagatttccttctagcagttctttagctgtttctcatgaattcaggaatgctttatgttcattgtcatttatttaacataayttctaatttctcttgtgatttattttttgttaatttccaaatatttgagctttattaaatattatatttttgatttctacactggatgtttatgatctga

SEQ ID NO: 47208 - DNA, 201 bp, Homo sapiens
ttttgaaaaacaatttcaacaaataattgaaaatgttctcttcaaagtattatcattagtcatccagttagattattattattaggaattctgaggtggtrgaataattcattttccaatgtgttaacttctcatgagtttaatgtgagtataaaaagtctgttttaactgagggcagagtattcctttttctcttataat

SEQ ID NO: 47209 - DNA, 201 bp, Homo sapiens
caagtttgatatattgtatttttcattatcatttattttaaaatatattctaattttcatagtaaatttttctgtggcctctgagttatatagaagtgaartgcttaatttctgaacaattgagtatttttctaatcgttttgtttttgttgttattcctttcctcactaattccactatggtcagtgtattttcaattct

SEQ ID NO: 47210 - DNA, 201 bp, Homo sapiens
gagatttgggtggggacacagagccaaaccatatcactgtctttctgaagaaaaaaaaggaattcttgtatgttgccctaaagatataaaactgcttacartgcctagtgatttgtattgattactatgtgttccctaaagtttgaaactctccattaacatagcaaaactactatattctaaatcaaatgtcagcaggtt

SEQ ID NO: 47211 - DNA, 201 bp, Homo sapiens
tcttagttctaagatcagggctaaagtttggagttttaatgccctcactaggacttgacactaggatttggacccacagacggaaattgcagctgaactcmctgaagcagggacactagaaatgctttcagacagtgaaatgggggctagaaaattcttcctgcaagcctacagaggcagctagaaaatttttctcttagg

SEQ ID NO: 47212 - DNA, 201 bp, Homo sapiens
gatcaaaggggaagagggagcaggcacatcttacatggtacaggagagagaggagaaagtgaatggggaagagccccttataaaaccatcagatcttgtamgaactcactcactatcatgaggacagcatgggggagctgcccccttgatccagtctcctccctccctccatacgtggagattacaatttcaaatgagatt

SEQ ID NO: 47213 - DNA, 201 bp, Homo sapiens
tcatttgtatctaagtatcattgctttaaaaatatatctgaggcaaatataaaatataaatattttgttacctctaggttgcatgggtaatgcatgttatrtgtgctttttgaatgtcttaatataatttctaatttaaaatttctttaattgaatgtaaaaaagaattccagatttaaaaagaggagaatgaaattttta

SEQ ID NO: 47214 - DNA, 201 bp, Homo sapiens
aaatagtaagttgctgatgatagagaaaaaacatggctttgtgatcagttactagccatattcttgaaggttacagacagagcggggtaggctgcagcctrcagacagaaagtggggctgtaggtgtagggtcctggctgcacagagtgtgtgatggaccgtttatttggcatcagggttttacatatagtagctcatagt

SEQ ID NO: 47215 - DNA, 201 bp, Homo sapiens
gacttgattcctgggcatttttacaaatggacttcaatgtgtacatttaatcctgaatctaaattacagatgtagaatttttggcataaaaggttcatgcrtgaatgaatttatctcttgcaacccctacagttcaaataatattatgttagtcaattttttacatggacagactctctccttgaccaaattttggaaagt

SEQ ID NO: 47216 - DNA, 201 bp, Homo sapiens
gctgtcttccagtgttaaacaggaatttgtgggattacaagatagatgatcaacccagattgctatgagtgataaccgtgcttcctcctgtctaccttctmccatattcactggtttatggcacctcccacatatgctgctacacaaccaaggcattattaccagggaagtcaattcagccataactctataaagtaaact

SEQ ID NO: 47217 - DNA, 201 bp, Homo sapiens
tgagcttacagggttttatcaggatcagactaagtaaaaatgtataattattttataaataaaaatgttttggggtttcagatttaaaaatcaagagtaasaagttttacaatatttactaaagattacgattagtataccacaaaacatctgaactttagatattatttatgtgaccttaaaagtcagacctttccctgc

SEQ ID NO: 47218 - DNA, 201 bp, Homo sapiens
gaagaggcagaaaggcctgaatgtttacccgcccttcctgcagtggcccatgactaaccagcgtgagagtacaaaagtccagctctttggcccctaagtgraacaagttttgagatcttattttatgctccagagcactccatggaatcaggctaagactgggacatcacctgaaatcatacccttgattagagcttttct

SEQ ID NO: 47219 - DNA, 201 bp, Homo sapiens
gaaatagggtaagaaataaaagcaagcattagcatttactagcatttcctggtagaacccacttcatcgctatcactcatgaaggatagagtaaagcactycctttaagtcagtaaaaatatgccatcctgtctctctgccagttaccttttgggccagtgaatttcaattcaattgtgttgctgctctttaatcatgttt

SEQ ID NO: 47220 - DNA, 201 bp, Homo sapiens
aaaagtgtgttattgtttttaattgcttccctaaagaatgagagaaggcgaagctgggaccctagtggtattgatgggctgttgctccttatccatgatgygtaagagtgaggaactaagtctgaaaactttttaaggggaaaatagcagtatagcatactgaaagttttgttgtaatatttaaaaatgccaattaaaaaa

SEQ ID NO: 47221 - DNA, 201 bp, Homo sapiens
aaaggaggaaggaaagaagagagggagaaagaatggaagaaagaaagaaagaagaaagaaagaaggaaggaagagagggagaaagaaagagaaagagaagkaaagaaagaaaaaggaaggaaggaaggaaaagggagggagggagggaaggaaggagggagggaggaaggaaggaagaggaagcagggagggcaaggaaag

SEQ ID NO: 47222 - DNA, 201 bp, Homo sapiens
atttcatcaaaattgagaacttcttcccttcaaaaaaaaaaaagcacttttaagaaaatgaaaagataactacaaactagtagaatatatttccaaattayatatctgataaaggacccatatccagattattcatatgtatcattcaaaactcaaaaataagagcaaataacccaagaaaatttgaacaaaagatttaaa

SEQ ID NO: 47223 - DNA, 201 bp, Homo sapiens
ctgctacttgctagctgtaatcaggggcgagttacttaacacctctctgccttcttaataaaatagagataatagtggtatgaagctcatgtggatgtttygtgtagcaaatcattgtaggaacagtgtctgacaatagtgcttggcacattgcaaacattcaacgatgctggctattatgattataattattattattat

SEQ ID NO: 47224 - DNA, 201 bp, Homo sapiens
gatgaagtggtctgctctctctctttctgtctctctctttctctctctctctgtctctctctttctctctctctctctctctctctctctctctctctctmtatatatatatatatatatatatatatggcaactagatgtatactttggaattcctttaaggtgaaaagagttctctaaatgtaaagtgttgagtgaaat

SEQ ID NO: 47225 - DNA, 201 bp, Homo sapiens
agtgcaagggcctttgaaatcaggcctggtttggaatcttggtccagcaatcaatagctgtgtaatcttaggtaactctttgaagtttagtttccgcatcyaagaatgaggaagtataaatacatatctgcccacgttggttgtattaaatgagatactttacataacacatccgactaaggtgcagatgtaataaatgac

SEQ ID NO: 47226 - DNA, 201 bp, Homo sapiens
ccacactctagcctggatgacagagtgagactctgtctcaaaactttttttaaaaaagagtatcaattttgcaaggacataaactttagtatctatatccyctgtccatttgattctgttaaaagcaatccctcaactgcccagatttaagcatcatacctcttattgccttggtattctttaatatcttcaatcacattt

SEQ ID NO: 47227 - DNA, 201 bp, Homo sapiens
gagcctacaaaggcaggcaggcctccttgagctgtggtgggctacacccagttcgagcttcccggctgctttgtttacctaatcaagcctgggcaatggcrgacgcccctcccccagcctcgctgccgccttgcagtttgatctcagactgctgtgctagcaatcagtgagactccgtgggcgtagtaccttcccagccag

SEQ ID NO: 47228 - DNA, 201 bp, Homo sapiens
atctcagctcactgcaacctctgcctcttgggttcaagcaattctcctgactcagcctcctgagtagctgggactacaggcacatgccaccaccatggccrgctaatttttgtatttttagtagagacagggtttcaccatgttggccaggatggtctggatctcctgacctcatgatccgcccatctcagcctcccaaag

SEQ ID NO: 47229 - DNA, 201 bp, Homo sapiens
aataatcctaaagaatcaacatataaactacttacaagtgatttcaacaactttttaggatccgatgtatataacctatatcacttatattactatgaaaytaaatttatgaaaaattaaattgaaaaatatttacaatagcactcaaaaacttgaaacacaagttaaattttagaaattatgttgacatgtacatgaatg

SEQ ID NO: 47230 - DNA, 201 bp, Homo sapiens
aacacatacatgtgcatgcatgtacacacctacacacagacacatacccatcttcataccttaataaaaggatataaatacagctaatttgggttctaccyatacactatttttttgtgaatcttgggcaagtcgtaaacctctcaaaaagtaaaatgaagggactgatttaactgacttttaagtacccattctatccct

SEQ ID NO: 47231 - DNA, 201 bp, Homo sapiens
acattttacagaggagaaacagagaaacatatacagctaaaaacatatggaaggatcttgagtcttatagcaatattgatgagcaaatcaatatgtagaakagcaaatcagtatcattatcaaagagataatggatatctctttatactcaatttattggcaataattaagaatttaaactacagaaatattgaaaagtat

SEQ ID NO: 47232 - DNA, 201 bp, Homo sapiens
aggaaaaaataaaatttgtgattatgactcattatcatgatgcctattgcaaaattacagctcactcttaaaattatgtgaaaaaagatcattaaatgttytagacatttcttaaaacttataagcaaaactttcaagttttttaaactgatttactggttgtatatgtagctaattgactatgaaaacttgaagcttaac

SEQ ID NO: 47233 - DNA, 201 bp, Homo sapiens
agcactttgggaggttgaggtgggaggattgcttaagcccaggtattcgagaccagcaaccagcccgggcaacaaagtgagacccctatctctacaaaaaraagcaaaaaattagccaggcatagtagtcccagctactcaggaggttgaggcaggagaatcacttgggtccaggaggtcaaggctgcagtgagccatatt

SEQ ID NO: 47234 - DNA, 201 bp, Homo sapiens
gacgcaggcctgaggacagttacagtgttataaagggagaggcttaagtatcattataatatgagcagaaattgcaaagagtgagaagctaaaatggaagrgagacgataaatagctcagcaaggtttttagggaagcagaaatgactcagatttgaaatataggtgacagaattagccttaaggaggagaaagaaaagat

SEQ ID NO: 47235 - DNA, 201 bp, Homo sapiens
taaatttaagtgaggattgtaggagtttaacagctatttaaaatacgccctgctgctttccttcctaggttctccacaccttcaaagctcatcacttggayaagattgcctctttactttttccaaatcaatctggttcatccattttttgcaaaaatgaaaactcccctctttcactaaggtatttgagccatcaagaac

SEQ ID NO: 47236 - DNA, 201 bp, Homo sapiens
attctacttttaatagaccatggtaggctattgagagtgtttccagtttttcactattagaaactatactctgatgagctcctctatgcatcaagcttttycattatttccagttattcttaaaatagataagtagttaggaaattataaggccaaaagatgaatatgtctaaggttttcaatacacatacctgaattgtt

SEQ ID NO: 47237 - DNA, 201 bp, Homo sapiens
attgctgatccctcatacaaagttttgattcctcctttagagtgtgaatggtggaaataaaaaaataaaaccagggtggacttccattagagaaaaaacartaagtggcaaaatagtggcaaatatagaggggcaggttctattggaaagattatccctaagagcgagacgtagcttgtcatatccaaccccaccatgtga

SEQ ID NO: 47238 - DNA, 201 bp, Homo sapiens
ccatttacactggaaatgtcttagatgtcttagtgcttttcaatcaggtatatccaaacaacaaacaaacaaataaaataagactaatgcagaatgaattmcatagttcagattcttcaagataatggaaaattatcacataatctccacctgttttgaaacattatcttctttccttcctttcctccctttctccctttc

SEQ ID NO: 47239 - DNA, 201 bp, Homo sapiens
cattgccacacatttctttattttgccttaaaggtaatctacctctccctacattttgttaatttctgttaactccaatttacctttcaaatctcagctcrtgaaagccctctgtgccatcgcaggggttccaagattcctcctgtgcttatcttataccactatttttcctctagtttgtagttataaatttatctacat

SEQ ID NO: 47240 - DNA, 201 bp, Homo sapiens
ccaggaagagtctgtcaaaacaagtatatcaagtaaaacaaacaaatatattttacctatatatgttaattaaactaatttgtgcatgtacatagaattcyttctgtattcagatggtgctaattcagactccagactgaattttaattcaagttctttctcaagtctataaataatattaaactgattatttcattctaa

SEQ ID NO: 47241 - DNA, 201 bp, Homo sapiens
gaaaataaaatgtaggaaactgattgtcatctccagtgaaacttaagtattgcttacttaacaaatatctgtcaactgtggaaaaaataaacagtgctcaytaggaatcagaataggttcactttgtcagaggcaatggctcatgcctgtaatcctagcacttttggaggccaagagcggaggatccaggagttcgagacc

SEQ ID NO: 47242 - DNA, 201 bp, Homo sapiens
ctaaagcaatcttgagcaaaaagaacaaagctggaagcatcacactatctgactttaaaatatactacaaagctgtagtaatcaaaacagtatgctgctawcttaaaaacagatacgtagaccaacagaatagaataggagcccagaaataaatctaagcatttatggtcaattgatttttgacaaagatgccaagaacac

SEQ ID NO: 47243 - DNA, 201 bp, Homo sapiens
aaggtaaaaaggatttttcccctcagatagttctgaaaaatcaattccaggataaatgcagtttaaactgtgtcagaggtatcttttcaagataaaatctrtgcaaaaagggacagaggaaacaggaagataaaatctgggtagtggttgttaaaatggccttgagaattgaggaaaatggcagtttctaccatcaagggc

SEQ ID NO: 47244 - DNA, 201 bp, Homo sapiens
ttgctcagttttaacttcattcagtgtttgttatacctgcttcattaagctaaacaaacagatggacaaaatctcattgccagacatggagttttcattgrtatgcatttgttggcataccgataaacactgcttttctagagcttattttcaacccaaacccacctttttttctagttggtggagatgatctattttcaa

SEQ ID NO: 47245 - DNA, 201 bp, Homo sapiens
gaagctattaaaataagcttcttatccttagggaaactatttcaacactagagctatcatcaaaagtccttgagacaagtaacccaggagtggaatggttrtgattacactttataagcaaacttaaaaagatatcaggagctgctttactaggcccctgctatgaagtgaaaactggagaaaaatctacagcaaagcatt

SEQ ID NO: 47246 - DNA, 201 bp, Homo sapiens
caggatccactgatatggaacagaagggtaagcttctgttaagctaggtaaggaagcttagggttgtgaaagaaggtacaaagacactgcacactgacttytggggaattacctggatttggctttcaggtagctctgccaaggattaacaatagggttcagaaagaagagtaaaccatctaatatgtgccccagccagtt

SEQ ID NO: 47247 - DNA, 201 bp, Homo sapiens
atcaacaaatgttagagaactgggttcaactactaccaagaaagagcttaaccctgaaacctagcatcctaggcctgcacccaaagggagaagagaagctyattctgagctatgagataatcgtaaggtatcaagtctcagggcctggcaaaggagggataatggaggatataggcaagataataatatgactgggtatgt

SEQ ID NO: 47248 - DNA, 201 bp, Homo sapiens
agttgacttttaaaagttgacaatcgctaaacttaaaaatggttcagaggagatacaatattgctggatctaatgtaagtagaaagaatcctaattctgakatatcatggcatagaaaaagacacaaggaattagaagacctggattctggtactggttccagttatttgtgggaccttggtcaaatgatttaatctctct

SEQ ID NO: 47249 - DNA, 201 bp, Homo sapiens
agtaacaatacctctttatttcaccccttttcttgcatgtttaccttttgtaaagagaaggtacagaaacccttcatttaatgtgtttcaggttcaatccrttgtcttcataacactggaatttctcctccattattttctatttggggatgtaaaggaatggacatttattgaggatttactgccacaatgctagaacca

SEQ ID NO: 47250 - DNA, 201 bp, Homo sapiens
catgatgtctatgatcctttctggttctgatattgtataactctcatcacttaatgaaagccaccgttcctatttggataaataagagaattgaaaaacgyactattagaactgagagtacagatgagctttccaaatatattagagatggcatcacagtacatggaaatgttaaaatccataacatgggcaagagcacat

SEQ ID NO: 47251 - DNA, 201 bp, Homo sapiens
attaactcaggacccctcttgtatcagttttcaacccatccacatcctactccacccctccagattattgggaagcaaattccatatgtattactcgcttygtaactacttcattatgtatctctgaaggataagactcttttataaaggaaaccattgtcacatctaaaaattaatactattatactgattctttaatat

SEQ ID NO: 47252 - DNA, 201 bp, Homo sapiens
ggtatttctccagggtgaataaattttagaaggcaaatttaaactgtcatatttctgattgcctgtgattcacaccattgttgtactctgtgacagtttcmttgaaaggactgtcatgttccatgaggaactcagcctacctgctcttttaccagtagctggtgggaaagccatactgtgccaatgacttattcacaggag

SEQ ID NO: 47253 - DNA, 201 bp, Homo sapiens
tcagaaaaattgggagaaaatacaaggagaagaatttgcagggtgattgttgtaagatttttatcatgtcctcttaaaaatggtagcttttcagaaacttktgttaactgctttgcattccatcttgagaaaatgtctgtatagttagatgagcatcatctcctctccttgtttttaaatcacatccaaaatgacatcagg

SEQ ID NO: 47254 - DNA, 201 bp, Homo sapiens
ttccacgggtccttttgagcttcagaaatccagctctcagcacttcataaatcatttctgacctgatgtcactgaagttgtattattatgtggttagtatmaaattcagaaaaattgggagaaaatacaaggagaagaatttgcagggtgattgttgtaagatttttatcatgtcctcttaaaaatggtagcttttcagaa

SEQ ID NO: 47255 - DNA, 201 bp, Homo sapiens
ttttgtgaaggccttttctttaccaaattagtaatatggtgaatattaaactaaacctgagtcatactacatttgtttttaaattttgtagggaagggggraatagcaaataatattttatgctagtaatcaggcattatatcagttgttgtaaggaactacatgaaagttggtggtatacaggttaccagtagtaagttt

SEQ ID NO: 47256 - DNA, 201 bp, Homo sapiens
caagaaaagaacaaaattatggttttactgtgtgtatttatttatttatttatttcaataaatgccctttagtagatatttttacatctggagacattctyacatctggaagaggacactgcaacagtagcctattttaatcttgtcatgaaaatcttgggatacatcttttttgctcaactccctggtttttctgtctta

SEQ ID NO: 47257 - DNA, 201 bp, Homo sapiens
gagattttcttgtaaaagatcgcaagcacttgacaatgacttcaactcccactgctttcttacgactcctccaagatgtggctagataaaactgtacttcygattttctccaaacagctttgacctatgcttccatctcatgaattccaagacagtattaaactgatgcatattttcataagtcgctcccggcgtctcttc

SEQ ID NO: 47258 - DNA, 201 bp, Homo sapiens
tggggactctcttccatgacttctaagacaacactttttaattctcttccaccattttaggtttgtctttgtaggtaacctttatagattcttctgtgtartccttacataccaatgttctgaattccattctgctcctctttttccattccatagagtctgattgtgtacttgcaaacacttccatggtatctatttcaa

SEQ ID NO: 47259 - DNA, 201 bp, Homo sapiens
tttctttattttcaattaaagagggacccttattaaaaatatttttattaacctgttagtcttatcttggcagctataaaatattatatagttatatttgrtacatgtgagcatatgtgtacatatacaaccattaagccataatataagtagtaaatattagttttaatgaagtgtttatgaattgggacaagaatgtct

SEQ ID NO: 47260 - DNA, 201 bp, Homo sapiens
gatgcaattcaactttcatgctagatagaagtcaggatactagttatctttggaaagggtagagatagggaggattcttagtatgggcaatattctctttwgatctatatgatggttacataggtttttatatgtaggttattaaaataatatactgataatatgatcatacattgaggtttttatttattacaataagtt

SEQ ID NO: 47261 - DNA, 201 bp, Homo sapiens
tttctttgagctctacagggttggactacagttaagttcctcactgcctgcctcttcaccaattctacaaaatctatagccatatgaaggtaaattttgcwatcagaaaaagccaaaaccacttcagtttttacctcaggtctagtctaggagagtgataccatttctttttaagggggaagaaatccagaaaagcttctt

SEQ ID NO: 47262 - DNA, 201 bp, Homo sapiens
ccactaatcggcaccttatattaatttttatgaaataataaaaaccttatttcatagcaggagcgggtacccaaaaagtagttaaatggctaatcctttayagtttttatgtttttggaaatttgtgatctcaagactatccctcaagaatgtcaaggttttgctgaagttaaagacatttgttattctgtggtcagatta

SEQ ID NO: 47263 - DNA, 201 bp, Homo sapiens
tagagagacacccgattacaaatgctattgatggaaagaacacttggtggcagagtcccagtattaagaatggaatcgaataccattatgtgacaattacmctggatttacagcaggtatagttcctctttttttgtcatttccacttttgaaattgcattttacatttgctatttgtttagttagtggtttgtgggtgaa

SEQ ID NO: 47264 - DNA, 201 bp, Homo sapiens
ggactcccagggattcacagatctttctttgagctctacagggttggactacagttaagttcctcactgcctgcctcttcaccaattctacaaaatctatrgccatatgaaggtaaattttgcaatcagaaaaagccaaaaccacttcagtttttacctcaggtctagtctaggagagtgataccatttctttttaagggg

SEQ ID NO: 47265 - DNA, 201 bp, Homo sapiens
cccatttacactggaaatgtcttagatgtcttagtgcttttcaatcaggtatatccaaacaacaaacaaacaaataaaataagactaatgcagaatgaatwccatagttcagattcttcaagataatggaaaattatcacataatctccacctgttttgaaacattatcttctttccttcctttcctccctttctcccttt

SEQ ID NO: 47266 - DNA, 201 bp, Homo sapiens
ggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacct

SEQ ID NO: 47267 - DNA, 201 bp, Homo sapiens
cagactaaatattacaatatcttggcaagaaaattaaagtaatgataatggcaatatagcaactaaattccatctcacaattacagctattaaaaggatcyagagtcagcatgaacttaaagaaaagcttaactgttccagtgacgtgtatataaaaactcaatataattgcgaacaaaaatatacaacaatttaaaggag

SEQ ID NO: 47268 - DNA, 201 bp, Homo sapiens
ttaggatatgaatcagatttgataacatgaactatcttatttaattattctaaattgaaaacatcatgaaagataattgggatttttccatttttattttmctcttgtttcttgcttatttgaatcattcgttttattcttctttctacttaggctaagctctcaaaaggaaaggagatgtaattcaatgtatgtaagttt

SEQ ID NO: 47269 - DNA, 201 bp, Homo sapiens
atctcttcctttcctagtatggaagacaaagattgagcactctcatctgaccctcacacatttctgcctacatcctgcaacatatacttaaaataaatatwtaatgctaacattgttaaaaccatataaatattactcacagctgagctctgtggtgcactgtgtctctcttttcttttttgtacatcgttgcctggcatt

SEQ ID NO: 47270 - DNA, 201 bp, Homo sapiens
ccaatcatctcccaccaggcccctcccctaacattggagattacatttcaatacgagatttgggtaggatcacacatcctatatcacttttggagaaagartggaggtagctctgaaggtttgttacatcacagcatttgaggaatggctggggtgatggcaaatatcatacagaagagcaggcgtagacaagatatacca

SEQ ID NO: 47271 - DNA, 201 bp, Homo sapiens
catgtttttaaaaaaggacttttactctgttggaaccaattaggccaatgtgaggaactttggaaggaccatgagcagccaaacttgctaacagcaaaacrtatttttctgaaggcagcatgaaaaggacggaggagttctctaaggactgtgagttccacgggtccttttgagcttcagaaatccagctctcagcacttc

SEQ ID NO: 47272 - DNA, 201 bp, Homo sapiens
taaactagacacttgattttctccaatggtaacatgtttttaaaaaaggacttttactctgttggaaccaattaggccaatgtgaggaactttggaaggamcatgagcagccaaacttgctaacagcaaaacatatttttctgaaggcagcatgaaaaggacggaggagttctctaaggactgtgagttccacgggtcctt

SEQ ID NO: 47273 - DNA, 201 bp, Homo sapiens
aatgtattctgttcatctttaaataatttcatttatgtttaagctgcaaaaattgatctgaagttagtctggtatattgtgtactttaagcatgtgatacrtttctaaaatgttcatgtcaagaatatctacaattcaaatcatgaccttcttttggcttgtattctaattttgaagtttctgacctagacacaaaaatga

SEQ ID NO: 47274 - DNA, 201 bp, Homo sapiens
tgaaatagttactttattcattcttaagaaaatgtttatcaaacaaatgagtcttaaaaaccatagttagatcctttttgtagtacatagggtattccacraaaaaagtggctagtttagcttgcagctgaaaacaactgtacaaatgcttttcctcaaatcaaccatcatgcttcagtatacagttgatgttaaaaagat

SEQ ID NO: 47275 - DNA, 201 bp, Homo sapiens
atactcaagaaaattaaactagtgacaaaatagatttatttaacttataagctaattcataaattaatggcaaaatttatcacagtatacataactgagaytttgcagatttttttgtaaatagataacattctgatacaattaacagatctccatcagctgcattagatttcaagttgccctgctaccactgtatatatg

SEQ ID NO: 47276 - DNA, 201 bp, Homo sapiens
aaagagagagactccatctcaaaaaaaaaaaaattttttttgaataaatagaataatgtgatagcaaatggctagacagctattaaggtggtcaaggaaarcccactaaaagaaaccagcatagtattttgtatgagcatagaaggtgtgggttagagaaatccaatgtctctattttagaaagaaatgtcatcaaggtgg

SEQ ID NO: 47277 - DNA, 201 bp, Homo sapiens
gactattgatctcaccagaaaagtccctaaatattagaagctgttaatctcacaatggtagagacaaatttttcagaatttttattttcatttgtaagttyctgtagttattgacaaattttgttatttttcttgaaatagttactttattcattcttaagaaaatgtttatcaaacaaatgagtcttaaaaaccatagtt

SEQ ID NO: 47278 - DNA, 201 bp, Homo sapiens
tttgtttgttttcacaaatattttaatgtggattttgagtcaaattttctgtaggaaggtcatggtagattaatgtcaaattagctgaaacaataaacacratgaaaagaaaaatcagccttgtaagacagtacaactaaggagatcagtttaaaacactaatgaggagttgcctctcagcactgggtcattatgattata

SEQ ID NO: 47279 - DNA, 201 bp, Homo sapiens
tgtctttggggtgtacttgattcatcagatgatggagatcctgctggcgtttcatgcaacctgctatggtatgtgggctttattggcttcccagcagcgayactgacacaaattgtcagattttatgggcagttttaaacctaatgaaatacatccttgagaagcttccttcaccattttagtagctgtacaatttgaaag

SEQ ID NO: 47280 - DNA, 201 bp, Homo sapiens
gtaagtggtagttttcaaaagattggctgcagtgtggtatctgaaactgcatcaacgatatttttgtacgcttttatattaaaatctacggatctatcttrcacctggaaagaattttacccatgtgtgatgttatagtatcattcatagatcatttggaagatactgatttactagttatgcagatcagccacaacttga

SEQ ID NO: 47281 - DNA, 201 bp, Homo sapiens
tttctaaatgcaatttttttgtgcgtggagctatttgttgttgtaatcattgctttctaagcacttagaatagtgcccaacatataggaagcattcaatgygtttgtattaagttaataaatgactgaatgaataactagtacaaaccaccaatccataatttaagaatcttattgaatctgagaattaaaggattaagtg

SEQ ID NO: 47282 - DNA, 201 bp, Homo sapiens
cctaagagctgttatacattgagcatacctaaattgcctttctgaaatacaggaacacactgtattgtcagtaaaatggtctgtgttgattagtttgtctytggggtgtacttgattcatcagatgatggagatcctgctggcgtttcatgcaacctgctatggtatgtgggctttattggcttcccagcagcgacactga

SEQ ID NO: 47283 - DNA, 201 bp, Homo sapiens
ttactgttcagttgaatatttatctttctaaatgcaatttttttgtgcgtggagctatttgttgttgtaatcattgctttctaagcacttagaatagtgcmcaacatataggaagcattcaatgcgtttgtattaagttaataaatgactgaatgaataactagtacaaaccaccaatccataatttaagaatcttattga

SEQ ID NO: 47284 - DNA, 201 bp, Homo sapiens
gttctttacctgctttagttgtatatagatttttaagatcatttgttcagtatcacaagtagaatctgtggttaattagaaaatatattttccctttaaawgaatttgtgctgacttttaaaattattaataaaggtgacagctagctttggtgtctatattgaagaaaatgttcatcctaattggtttccgtttgtctac

SEQ ID NO: 47285 - DNA, 201 bp, Homo sapiens
aagctgcattttaaataaataactcccttataactgtgtccacaatgaaggtaacacaattaatacccaactcaaaaactttttatttattttaaggtggyatgtaattttctttttaaaaattttatcaagcctctaattcattcaggaaacgtgctagacaccaaaattgattgtgtcagtgatgagcccccttagagc

SEQ ID NO: 47286 - DNA, 201 bp, Homo sapiens
gagattataatatacatgttccaaatgtagattataccttacctgagtataccttgtttaagtacaacagaatatagttaaaatcacagttctttacctgytttagttgtatatagatttttaagatcatttgttcagtatcacaagtagaatctgtggttaattagaaaatatattttccctttaaaagaatttgtgctg

SEQ ID NO: 47287 - DNA, 201 bp, Homo sapiens
ggtacacctcccagatggggtggcggctgggcagaggggctcctcacttcccagaaggggtggccggtagaggcgccccccacctccctcccagacggggyggctggccaggcgggggctgccccctacctccctcctggacggggcggctggcagggtgggggctgcccccacctccctcccggacggggtggctgccgg

SEQ ID NO: 47288 - DNA, 201 bp, Homo sapiens
gaactcttttattatttgtataaattatagtttttataatataaatgtaacatatgaatacttgtgtctggaattacaatagacacatttttatctccagrgagttactactggcactttttgaaatcctgttttgtcctagacactggacaaaatattttacataaattatcttatagaacttttcaactccgtaagaaa

SEQ ID NO: 47289 - DNA, 201 bp, Homo sapiens
gggtttcaccgttttagccgggatggtctcgatctcctgacctcgtgatccgcccgcctcggcctcccaaagtgctgggattacaggcgtgagccaccgcrcccggcctcaggtatgtctttatcagcagtgtaaaaacagactaatacagagatgaaagactggtacactgaaaactgtaaaacagtgatgaaataaatt

SEQ ID NO: 47290 - DNA, 201 bp, Homo sapiens
aaccattttcacttctttcgatatgatgtgcaaaatcatgcattttaaatgggaaatgggaaatttcatagcttcttagcaatgatgtgagctctgtggtytgggtggatgcagggcatgtgggtgcttttgctcatttaaggaaattgcatttgaaacattctcaatacattatgtagccacaagaaaatttatagtgat

SEQ ID NO: 47291 - DNA, 201 bp, Homo sapiens
gtgacatggctgatgataacatgtgataggtgtttcccaagagagtccctttaaacaaggtttttttcctgtcttcatattgatgaagtgttttttctaamgccattatttcatttattctatgaaagacaaaattggcattttaaaagtagaacacggtcttttgatacctgtcatctgagatacctaaaggattttttt

SEQ ID NO: 47292 - DNA, 201 bp, Homo sapiens
gctgcagttacacttctttgtttttgctttcattgcctgtgcttcgggtgtcgtaccccaaaaatcatgaccaagactgatggcaaggagccttttctttrtatttattttagaagctttatggtttcaggtcatacatttcagtcttgaatccattttcagttgatttttgtatatggaataagataaacatccaaaatc

SEQ ID NO: 47293 - DNA, 201 bp, Homo sapiens
cccatcacccctttctttgactaggaaagggaactccctgaccccttgcgcttcccgagtgaggcaatgcctcaccctgcttcggctcacgcacggtgcgygcacccactgacctgcgcccactgtctggcattccttagtgagatgaacccggtacctcagatggaaaagcagaaatcacctgtcttctgcgtcgctcac

SEQ ID NO: 47294 - DNA, 201 bp, Homo sapiens
agtgccttcccaaggaaagatcagactctttgagcattagaaaccctctgtaatctgactacctttccaggctccaagccctcaactccattctatataawgccaagtttggcatttcttgcacttatctagacatcattagcagtctgctcttgctattccctcagacaatccctgtgaaatctaatttatttttaaagg

SEQ ID NO: 47295 - DNA, 201 bp, Homo sapiens
aagatgttctcactggtccgtggcaaagtaagaaaatgagaacaactttccacatttttcataaaaatagaaaggatacaatttaaataattgtcctccawtttgatattatgggttttaaaaactaatgatggtttttaaatgccctttgtttcatgaaataataatgatgctttattaaatgatagaaatatattggag

SEQ ID NO: 47296 - DNA, 201 bp, Homo sapiens
atgtaaatctgggttacctgctgaggaaagaagcaaacatttagattatgagcctctcaggggaataggaggggatcactgagccgtaatcagaataaagyggcaattccatatggagtaaaataaagaatcaaacgtgtggactgatactcttggagcattacagggaaagtagaatggaaagagaagatggcaagaaaa

SEQ ID NO: 47297 - DNA, 201 bp, Homo sapiens
aagaagaagaggggactatagaaatattctgtcaagtatccttgatgtgaaagagaatgaaggacagaggaggttgtggagttgcaaaggttttcaaagayaagagacatttgagttggtttagatgcttggggggaaaggcagggaagttgaagaccaagtggtggtgggcatggtgtctctctagaagtaaaaacatat

SEQ ID NO: 47298 - DNA, 201 bp, Homo sapiens
agggaggggaagaggagaagtcatgccaggaagagaaatcagaattagacagaaaatcctagttactcggggagctacaagtaggaatgactagaactgamagtgccaaagggcagagagtagagatgagactagagcaaaaggctggagccagattatgaaggcatttaacaaccacaggagaagtgatttagggagagg

SEQ ID NO: 47299 - DNA, 201 bp, Homo sapiens
caaaagcctgccttgggctgcttgagaacctctgctgagtcagcactcactggggcagcggcccagccagagctattaagtgcagatcttaaaaacagatrtgttggtgagagtgtgcaggttattttctcatgtactgcatgttctaagagatgtcataagcagcctgtatatcgacctatcttgtgaaaatagagaaca

SEQ ID NO: 47300 - DNA, 201 bp, Homo sapiens
gcttttgctctctttatttatttaattatgtgggataattggtacataatccaattctatattttctgaacatacaacataaagaaaatactttatccctsgtctcttttcttggcttcctcccatgattgctgaggcctgggaaagtacaggcctggcctgctccaatcaggtctttcagggcagaccaaagcagggcac

SEQ ID NO: 47301 - DNA, 201 bp, Homo sapiens
ctgtaccataagagacactagtggtattgatacattaatccgtaaggtaagatattggaagatgaccaaaatatagatcaagttccttattatggtgttcrgtaatatgtgaaagtaagagtggtaccataaagttcagtcaagtctagactagaaaaatatccaaagcagtttagactacgaacatcttttttttttctt

SEQ ID NO: 47302 - DNA, 201 bp, Homo sapiens
caaattggtcattcattagcaactaattggagacctttgctgaccaatatgcttaaccgatttttaaaaataaacagcaaaatagcaatgaaatttcatawagcaactattccctgaccataaaacaaggcaattaaattgtgcaaaggttaattttgagcacataatcagtaactgtaatagaaacaaatcaaagaaaag

SEQ ID NO: 47303 - DNA, 201 bp, Homo sapiens
ctgcaggaagtgtggaaacctaggtagcaccctgggaatggccacgctaaggagaagcacttaaactgaaagctgatgggtaacaaggacccagtctttamaggtgttgaggagaagctcattctaggtaaagacaatgggatacaagaaggtgctaagaagggatgagttttgcatatttaatatactaaaactatgcca

SEQ ID NO: 47304 - DNA, 201 bp, Homo sapiens
catgctgaagattcaataaaagctcagatattgattcattcttcaaattggtcattcattagcaactaattggagacctttgctgaccaatatgcttaacygatttttaaaaataaacagcaaaatagcaatgaaatttcataaagcaactattccctgaccataaaacaaggcaattaaattgtgcaaaggttaattttg

SEQ ID NO: 47305 - DNA, 201 bp, Homo sapiens
tttagccattgtgtcttcttagggttcctctagactgtgacgacactgtcaaaaatactgtaacagtgtttctgatgactttgagagtttggacaggttcrtgtgtttggtaagctgtccctcaattggggtttgcctcatatctttctcatgattagaatggaattatgagtttttgtgggaaaaacttcagaggtaaag

SEQ ID NO: 47306 - DNA, 201 bp, Homo sapiens
aggacttgtaaagctatgatggaagttagcccatgagtgtgtttacagaaggcagagctagatggcataagactcagggatgatgcaggaggtgataaatrtttttgtttagagtagtgagaagagtgaaacacagtagatctttaataataaaattttcactcatttggaattatgaaaattgtgtttgaaaaccagctg

SEQ ID NO: 47307 - DNA, 201 bp, Homo sapiens
caggaatggtcacttcattaacttgtagacttgattcctgggcatttttacaaatggacttcaatgtgtacatttaatcctgaatctaaattacagatgtrgaatttttggcataaaaggttcatgcatgaatgaatttatctcttgcaacccctacagttcaaataatattatgttagtcaattttttacatggacagac

SEQ ID NO: 47308 - DNA, 201 bp, Homo sapiens
ccccagtgattttatgaatccattgaggagatctgcagaagtgttgtcactgctggagaaaaccaaggcttcacttgcaaaaaggagtactttcttaaaaytgagaaatttggaaatatatcataggacttgtaaagctatgatggaagttagcccatgagtgtgtttacagaaggcagagctagatggcataagactcag

SEQ ID NO: 47309 - DNA, 201 bp, Homo sapiens
aagtgcaaatgacaccaccaatgaggtatcaccacacaagcactagaatggctaaaatgtaacaatattagatgttaataaagccatagagcatctggaamtcctatatattgctgtgggaggaatgtaaaattataaaacaacattggaaaagaggttcacagttttgtatagcgctaattacatacctgataatataac

SEQ ID NO: 47310 - DNA, 201 bp, Homo sapiens
gaccggacaggatgctgagaggaccaacacaagagcaaagtccctgggagaattcattaaggagcttgcccgggatgcagaaggtattagaaagaatcacrttttaatcatcatttctcccaacagaaaaacacagaaagggatgacacaggactggaatttctcttgttataagtgacatctgtaaaatcaaaggtagag

SEQ ID NO: 47311 - DNA, 201 bp, Homo sapiens
gaaatatgagaatagttataatctatagtgacaaaattagatcagcagttgcctttttctgggaatggaggttgggggatttattgcaaaaggtcagatgytgatagcagttgtatcaataattgtcaaaacttggaaccaaccaaggtgtttttcattagatgaatggatgagtaaactgtggtacttcaagataacgaa

SEQ ID NO: 47312 - DNA, 201 bp, Homo sapiens
ggtatttttattcccccctccttttttttattacaaatgaagagctaatgagtatccccaaagataaatcttttacaggtatattgaagggtaaatttctrtcagtagaattgccaaaccaaatacatgtctatttaaaattctaataaacttattaacttgctcttcaaacaatggaatcaatctgcacgtccactagca

SEQ ID NO: 47313 - DNA, 201 bp, Homo sapiens
tcagagaaaaaaaatcaatgaaaataaattagtgttctttctatcatctcttgcaggaggtagagtgggggttggggtacacatctattatttataacttyatcgtacatgagtctttaaaataatgcagtataagtcaacatataaatatgttttttgaaagtactcaagttcaataaacactcatttaaatatataaaa

SEQ ID NO: 47314 - DNA, 201 bp, Homo sapiens
catgctatattttcgggtattggtttctgagcctcaatatctcatagaatgaatttaacagcattttatgttaaaaccagatatatattggactccctacrtcttaataataatgaatgtgtcagaagggcaagtgttcaagtgtatttcaaccacaagtcaggattttatgtttctgttaacaaggttgatggcatacta

SEQ ID NO: 47315 - DNA, 201 bp, Homo sapiens
taatccgtacagcataaacaaattagaaatgaacttaaaataaatatacaaacaaaatagtaaactttgtagtacccgaatataaggtgttacagttaacrtggaatctgataacaccaattctttcctttcttaaacttcataggaaagctaaaaatactttaacttttgaaattaataaatgaaatacatcttatattt

SEQ ID NO: 47316 - DNA, 201 bp, Homo sapiens
atataataatatgccaagtacggacaatgaagacagctactccacaatattcatttaatttaatttttttttttttttttgagacggagtctcgctctgtygcccaggctggatggagtgcagtggcgcgatctctgctcactgcaagctccgcctcccaggttcacgccattctcccgcctcagcctcccgagtagctgc

SEQ ID NO: 47317 - DNA, 201 bp, Homo sapiens
aaacagatgcagaaaaagcatttaccaaaatttaatattattttgtcacagaaactctcaacaaaagaagagaattccctccactttgtactgagcatctrttgaaaacctggagccatcatcataacggtgaacgaatgttttttccctctgataagaaattaggcaaaaatgtccactcttaccatttctattcaactt

SEQ ID NO: 47318 - DNA, 201 bp, Homo sapiens
aatcactgtgccctagtacatagagaatgattgagacaaggataggtgctattttagataggtaatcagaggagtggctattaccagaatggagggaggamacaagccaaagagtaggaagagcacatagtgggaatatctgcaagtgcaaaggcttagaggcaggaactagttgtatgtacctggcaacatactgaattg

SEQ ID NO: 47319 - DNA, 201 bp, Homo sapiens
tagcaatatttgtctctcactgattttactcttctaggccaggattgagtttcatgtacttttgagacaagctatatgttccaaagaaaaattataatctrttctctcatgaaacagtccattaggttgattcttccatgtgatggtttctctatttcttaaaaagtattttccctaagtttccttaaaaatctcacttca

SEQ ID NO: 47320 - DNA, 201 bp, Homo sapiens
tttccctaagtttccttaaaaatctcacttcaaatttcacagaactcccattgaatacatctgcttatgtttatgctcacaaagtactcatttgtatatarattctagaattcaatatgtagtaccaatataactattcagcacttatattttagttagaaatggatgctccatctttctttaaaagtagttttaattcct

SEQ ID NO: 47321 - DNA, 201 bp, Homo sapiens
gttatgttcctctgaagagtttgaattggttctaattagtaataaacttgctgagtgatcaccatgaagtcatgaaagtttactttcatactttgttaggrcagattagtggaaaactccaggtattcatcaaacatttctaatgtagttaacttaaagtctgaattctctttactttatggttggtagcacctgaaaact

SEQ ID NO: 47322 - DNA, 201 bp, Homo sapiens
ttaaaaatctcacttcaaatttcacagaactcccattgaatacatctgcttatgtttatgctcacaaagtactcatttgtatatagattctagaattcaayatgtagtaccaatataactattcagcacttatattttagttagaaatggatgctccatctttctttaaaagtagttttaattccttaactagtatcgcat

SEQ ID NO: 47323 - DNA, 201 bp, Homo sapiens
tgtagggaatattacaaatctgtttcctggaaagcaggatgccttcctttagaattattagttaagattaaccactctttaaattgagagattatatcctwccctgtttttcattatatggtcagctttcactggcctgagtccacattttaagctcaactatatacaaataatttttcagtatactgagagtaggattaa

SEQ ID NO: 47324 - DNA, 201 bp, Homo sapiens
aatagagaagctacaaatgaaatattataaaacccagttcaaatgtacatattttaaagatctgtaaatatacagtaaaacattaacatttgccagatacrgatgatgggaatagaggtgtctgtattaatttctaatcgtatctatcttatttcctacttaaatagtttaattaaaatgaacctcagaggagatagaaaa

SEQ ID NO: 47325 - DNA, 201 bp, Homo sapiens
catatatttttcagtttctaaatttctctggttcattttctttttttctttctttcttttttttttttttttgagaccgagtctcgctctgtcacccaggytggagtgcagtggcgccatctcagctcactgtaacctccgcctcccgggttcccgggttcaagtggttctcctgcctcagcctcctgagtagctgggatt

SEQ ID NO: 47326 - DNA, 201 bp, Homo sapiens
gttagtaagtttgaagtttcattttaaaactaaacatgtgggccaggcacggtggctcatgcctgtaatcccagcactttgggaggccgaggtgggcagaytgcctgagctcgggagttcaaaaccagcctgggcaacatggcgaaaccccgtctctattaaatattcaaaaaattagctgggtgtggtggtgggcacctg

SEQ ID NO: 47327 - DNA, 201 bp, Homo sapiens
gagaccctgtcttaaaaaaattaaacaaattaaaaagaaatgaagttattgagtgacagttaaagaaactgatttgcaagtggccttcaggaggcagaagraggctacttgtctttccccagtgattttatgaatccattgaggagatctgcagaagtgttgtcactgctggagaaaaccaaggcttcacttgcaaaaagg

SEQ ID NO: 47328 - DNA, 201 bp, Homo sapiens
aaatagagaagctacaaatgaaatattataaaacccagttcaaatgtacatattttaaagatctgtaaatatacagtaaaacattaacatttgccagatayagatgatgggaatagaggtgtctgtattaatttctaatcgtatctatcttatttcctacttaaatagtttaattaaaatgaacctcagaggagatagaaa

SEQ ID NO: 47329 - DNA, 201 bp, Homo sapiens
attaaatgctattcattggtcaatttaagtaatcttcttttaagaaatcattcagaaattgtaggtccttgatcgtaattctttttgggtaatttcaattkcaataggttaaacactgtgctggaagatttgagaaagattatcattggtccattttgtcaaaatcatttccagaagtttaagtccttttttcttcatttt

SEQ ID NO: 47330 - DNA, 201 bp, Homo sapiens
tgtgtttgtgtggcggggagcggtgtgtgtagctgaatttgaggtagagacaaaaagtaattaaactggaagcagaaatcttagaatggggaaaagtaagrcatatttgttcacaaagtatcttttaacattttctggtttctgtggagtcacattttattaatgctggttgacatttatctacctagaaaaaaatgacag

SEQ ID NO: 47331 - DNA, 201 bp, Homo sapiens
tgatgtgtttgtgtggcggggagcggtgtgtgtagctgaatttgaggtagagacaaaaagtaattaaactggaagcagaaatcttagaatggggaaaagtmaggcatatttgttcacaaagtatcttttaacattttctggtttctgtggagtcacattttattaatgctggttgacatttatctacctagaaaaaaatga

SEQ ID NO: 47332 - DNA, 201 bp, Homo sapiens
aggatgctactgtaataaatgtaaagtaaggttaggatatctgaatataaatgttgatgtgtttgtgtggcggggagcggtgtgtgtagctgaatttgagrtagagacaaaaagtaattaaactggaagcagaaatcttagaatggggaaaagtaaggcatatttgttcacaaagtatcttttaacattttctggtttctg

SEQ ID NO: 47333 - DNA, 201 bp, Homo sapiens
tgcttcaggttgtcttcataataaatgcaaacattaaaattgacaggttactatgattttcatattggattaaaatgtctaaaacaaagggattcgtctakgtatgacttacacaaatactgcaaatcttaggggaacagaaagactgaaaatgagagataagatacactatgcaaactctaaccagaagaaagctggtat

SEQ ID NO: 47334 - DNA, 201 bp, Homo sapiens
gtactggtctgcagccctggggttggggaccccgggttaggatgctactgtaataaatgtaaagtaaggttaggatatctgaatataaatgttgatgtgtktgtgtggcggggagcggtgtgtgtagctgaatttgaggtagagacaaaaagtaattaaactggaagcagaaatcttagaatggggaaaagtaaggcatat

SEQ ID NO: 47335 - DNA, 201 bp, Homo sapiens
attctggggaggaaagcaaaaagctaattaactttagttttcactaagaatatgtattaaacattgaaaaaaaatctggaaaaataaaattgacaatattygagttctccagagaaacagaacaaattggaagtgtatatatacacagatatattatatattttaaagaattgactcatgagattgtggggtctggctgca

SEQ ID NO: 47336 - DNA, 201 bp, Homo sapiens
aaaagtctttaaaaaagaaagtgagttttagggaagataatttcaacaacaatggggaagattaatgggagtagagtcacgcaggaagactaggaagggcwgtggtgctcaacctgtttggcaccagggaccagttttgtggaagacaatttttccattgacagggataggggtggatggtttcaggatgaaactgttcca

SEQ ID NO: 47337 - DNA, 201 bp, Homo sapiens
tgtacaaatctaagtaagcattatggaaagcataatgataataattattaaatatgtggaattaaaaacaaagtggaactaaaacacaagagactaataamatggaaaatggggcaggtagtcagttatttaataaaagtttttaatattcttgaattctggggaggaaagcaaaaagctaattaactttagttttcacta

SEQ ID NO: 47338 - DNA, 201 bp, Homo sapiens
ggatatatgataaacaaaacagaccaagttctcacccccttagagcttaccttacagttggagaggttgtcaataaataggtgagccaattactaagtaaktctcaaatccatggtgctatgaaggaaacgtcctgctgcaggaagtgtggaaacctaggtagcaccctgggaatggccacgctaaggagaagcacttaaa

SEQ ID NO: 47339 - DNA, 201 bp, Homo sapiens
aggaaagagggaaggagggagagagggagggagggagggaggaaggaaggaaggaaaggaaggaaggaagggaggaaagagggagggagggaaggagggarggagggaggaaggaaggaagagagagagagaaagaaaggaagaaagggagaaagacctggagtttgctaatagagttggcaggcacagttcagtatcacc

SEQ ID NO: 47340 - DNA, 201 bp, Homo sapiens
actcgaagtctattccccaatttagagtaggagaaaaatttacatagagattgattcagggaaaagagaatagcaactcttattgtcagtgtagctacgayagcacagtattagtttctcaaatcaaagagttcctttaaaaatatttatatcaaagactgagttctctgtcagtgataaagtgtgtgtgtgagtgtgtgt

SEQ ID NO: 47341 - DNA, 201 bp, Homo sapiens
gtattcttgcattaattaatgtattcattaaatatgtcttcagtactttttttgggtccagcattacattaggcagatatattattcagcaagttttcaayttagttcagggaaagagggatgataaatattattatgagtgtttagaaatattaagaacccgaatccatttatcagtttcataacaatgattttcaagct

SEQ ID NO: 47342 - DNA, 201 bp, Homo sapiens
tattgtgttaaatataattctgcttcatgaaaattttaatttgaagctatttgcacactattctgaagctattctcatttctttgtggaaaggtgttaaarggtatcaccccaatgtctcttattatgcaagcataagaaagaagatatcgatctgagattgctagttttagattgactcctctgtatttatgaagaacca

SEQ ID NO: 47343 - DNA, 201 bp, Homo sapiens
gaggaatggggacttctgtggagtttaatctatagtaatgcacatgaatctgataaattattataatctttgcttttagtagaaatggggatttagagtayatcagtacaggtggcgaaaaatgtgaatttaaaacatattttgaaaaacaaggataagaattagtgtttaaaagctaaaagagaagaatttgtgtcagct

SEQ ID NO: 47344 - DNA, 201 bp, Homo sapiens
atctttgtttccatgtgtatccattgtttagctcccacttagaagtgaaaatgtcatattcaattttctgcttctgagttatttcacttaggataatggcytccagctccatccatgttgctgcaaaggacatgatttcattattttttatggctgcacagtattccatggtgttcatataccacaccacattttctttgt

SEQ ID NO: 47345 - DNA, 201 bp, Homo sapiens
agcaacaaagatcttatgggtcatcctggtattatgtttaatggtgaaaccagaagcctgtttaaagggagaatgggagatgaagaagtagagaccaggartgtaaacaatgtctttttaaaagcttatcgaaaataggatagaaattgtcaagcaatttgagacctcacagattttttttttaagacaggaaaggcttga

SEQ ID NO: 47346 - DNA, 201 bp, Homo sapiens
gcaggaggcagaataataactcaacaaaataaatagaatctctaatttcaaaatactattatccccaaaagtaatgggaattttaaaaattatttagtgtytccagtttagatatttaagaacaccactcacatctacatgccaaataaattgactccaccctccacccgttatatcagggccccactccatccattgtct

SEQ ID NO: 47347 - DNA, 201 bp, Homo sapiens
tatttctctgttcagccataactaaaattgaacatttttcaaatgttccaggtagtttcaattttaagataacagaaaactagtattcaatggttaaaaaraaaaaaagcaatacctatctttggcttagtaataacccctaaattgaaagttaatttcttataaatagcagtgcaaaatgaacaaactttgagaacagag

SEQ ID NO: 47348 - DNA, 201 bp, Homo sapiens
ggaggagaaaaaagagatgaggaccaaagttagaattaagggcgtcaattatattgaacagaaagggaaggaagagtcgataaaggagaattcgagtagcygcagaagtaggagaaacatcaactggcttactcttaaagaagccatgggggctgggcacggcagctcccgcctgtaatcccaacactttgggaggccagg

SEQ ID NO: 47349 - DNA, 201 bp, Homo sapiens
tgtttgtgttaaggatttaaaaaaatagtggcgtgagaatggttattgctcttcaataaagatagagataccacgttttgctttaacatatctagaggcamctttttcatcgatagctttattagtaggtcaaggagaaatcatacctaagtagaaaggtccgtggagaaaagagacaaaccatatcagagttaaaattaa

SEQ ID NO: 47350 - DNA, 201 bp, Homo sapiens
actgcaatgtggaaaatgaattggaaaagtcagaagaggaaaattcattaaaaggatgtgaagtaattaaagggatttaggataatggcctgaactaagawagtggcagtgggaatgaataatatgaatggactgacaggattttttttgtattttgactcagcaggtgttggtagcattagatatagagagtggggagga

SEQ ID NO: 47351 - DNA, 201 bp, Homo sapiens
cgctttgtgagccttgttagtgagtttcagggaaatccctctaactgcaatgtggaaaatgaattggaaaagtcagaagaggaaaattcattaaaaggatrtgaagtaattaaagggatttaggataatggcctgaactaagaaagtggcagtgggaatgaataatatgaatggactgacaggattttttttgtattttga

SEQ ID NO: 47352 - DNA, 201 bp, Homo sapiens
tttccctagagaattgtattagggttctgtagagggacagaactaatatgatatatatatatatatatatatatatatatatatatatatatatatatatwagtttattaagtattaacttatacgactgcatatatatacatatatatatgtatatatcatgggagtttattaagtgttaacttactcgatcacaaggtc

SEQ ID NO: 47353 - DNA, 201 bp, Homo sapiens
tcataggaaagctaaaaatactttaacttttgaaattaataaatgaaatacatcttatatttattgaacagctcctttctgaaatacattgtactataatrtaaaagatgaatgaagtaagtttttatttccaaatatccttaagtgtagaactgaaaagaaaataagacaaaccaacacaatataaaactcaacactttg

SEQ ID NO: 47354 - DNA, 201 bp, Homo sapiens
acccctgaaatctcacatgatggacataattcaagtttatgtctcacatcacaacacaatgtgagttataccaccttttgcatcttgtagtgacaccatayagtgtagcctccaaggcagggaagagaaaaaatgaagagacatgtaggcccctaccatactggctcatgaagcctggaccacgtctggtctgagtcattg

SEQ ID NO: 47355 - DNA, 201 bp, Homo sapiens
tgattttatttatttcttttaaaatctagccattatctccgtcatgccctttgatttgtttcagaagaaagctgattggcaggcggggtaaaacagagggrggcagcttttcagtagacttttcaaacacatattgaggtgatactcactcctggctaatccaggaatgccattaattagttaagctcatgtcttaactag

SEQ ID NO: 47356 - DNA, 201 bp, Homo sapiens
aaattttatgagcctgagttgcattgtgtgggtaaaagtcttgtgctctgtggatcaggaggaagttagatgttttggatatttacatagaaacaaagaayttgaagactggaaagaacttgagcaggactctattaaatgtgttttgtgtgagatggttttcaccctgtgttcttgtggttcctccatgctaggggcagg

SEQ ID NO: 47357 - DNA, 201 bp, Homo sapiens
ccaatattcagcttttaataaaatttttcttttaaagatgattttactttctatcagattcctattgcattgaggacttagttttgctttatttttattgktttttcaaatgttttaccaagtacaacttgtctctaagattcaaaacagtgtacattttgaatagatgtatcatttattttatgtatatgcataataatg

SEQ ID NO: 47358 - DNA, 201 bp, Homo sapiens
ctccccttggccacatctcccatcacttgtgcccctggccatctgcactccagccatactgtcccccagccactttgtcccaccacaaagcattgccacayatttctttattttgccttaaaggtaatctacctctccctacattttgttaatttctgttaactccaatttacctttcaaatctcagctcgtgaaagccct

SEQ ID NO: 47359 - DNA, 201 bp, Homo sapiens
atgtagagctttgatattattttgatttcctatgtgacagaattttatatatacagacagaatatttttcttcctcttttcatcatctgacattatggtgrtccttagaattgcaaatacaggagaaggaagacacaaacccaagactgtattaaaaaatgtttcagaaattctcctttgatataacattgttaaggttat

SEQ ID NO: 47360 - DNA, 201 bp, Homo sapiens
tatatcagggccccactccatccattgtcttttttcttagttatatcttgatatgtcaccctattagttttttccttgcagcatttcacttgcttcttgcyttttttaaacaaaaatttatgcactaccctccctgcatccatgttcctgctgcctcatattcattcattcttcagctggtggcaatcagcattcagtttc

SEQ ID NO: 47361 - DNA, 201 bp, Homo sapiens
ttctaagaagcactagtggcatatatgatcacggtagaagagcaagaaaaggagccctcacttagaaccccataagacaggaaagatacagcatcaacctstcctctccagtttatctgtgttatggattgtaagagtgttttgaaataatattttacttagtaaagtaatatccacaagcatttcaccatgaaaaacatt

SEQ ID NO: 47362 - DNA, 201 bp, Homo sapiens
agatgacatccatgaaacatatgacagaataccttgccatagtggctactcagcatgtaagttttttgtttgtttctttgagacagagtctccctctgtcrccaggctggagtgcagtggcgagatctctgctcactgcaacctctgcctgctggattcaagtgattctcctcccaaatagctgggattacaggcatccgg

SEQ ID NO: 47363 - DNA, 201 bp, Homo sapiens
atattgcagttattctccttttgggcatatagtaggattacatttgctcacccctgaaattaggcatagacaccgtcaatgaaatgtgaacagaactgacwtgctttactcttagattgaatacgagttttacaagccagtgcataattcgccatgctatagagacagatgatcttccagatggatgcctgagtgtagaat

SEQ ID NO: 47364 - DNA, 201 bp, Homo sapiens
ggatctatcctttgaccaaatttttcactcttcaagggcctcatactgctctgatttcagatgtatagatatattgcttatcaaacactgatgggtctgarcatgagtggtagtaagatatttccagattaagtagacaaattgtgcagaactttttagtatcactatttaaatgactaaatttttgaggtttatgtgtat

SEQ ID NO: 47365 - DNA, 201 bp, Homo sapiens
cagctcaggaaagtcaggaatacaaggggtaggattttatgaaaatgcaattttgatgtcttgttcataatggtctacagaaaaagaaggaggctgttgaragcggcaaacgacaaattgagaacactttaaaagagggcaatgacatactcgatgaagccaaccgtcttgcagatgaaatcaactccatcatagacgtga

SEQ ID NO: 47366 - DNA, 201 bp, Homo sapiens
tatcaacttaaatgtaaagaaaattcaaaggcacaaaacaccacacttaatactggaagcttcaagaacatatgaaaagaaatagtagcatgtataatggrtcttaaacaattaatttcaggattttcactggtgggaatagtaggaaattatatgggcaaatgcttacaaaatacaaggcatgtgcaaaacctaataagt

SEQ ID NO: 47367 - DNA, 201 bp, Homo sapiens
ggaagggaggaaagagggaaggagggagagagggagggagggagggaggaaggaaggaaggaaaggaaggaaggaagggaggaaagagggagggagggaargagggaaggagggaggaaggaaggaagagagagagagaaagaaaggaagaaagggagaaagacctggagtttgctaatagagttggcaggcacagttcag

SEQ ID NO: 47368 - DNA, 201 bp, Homo sapiens
aggaagggaggaaagagggaaggagggagagagggagggagggagggaggaaggaaggaaggaaaggaaggaaggaagggaggaaagagggagggagggarggagggaaggagggaggaaggaaggaagagagagagagaaagaaaggaagaaagggagaaagacctggagtttgctaatagagttggcaggcacagttca

SEQ ID NO: 47369 - DNA, 201 bp, Homo sapiens
aaacaaaggaaaaaaaagagtcagagagtgaggggagaaggtattcatgatgatacctttgctaagattctagacttttatcatctggacaagaggagaayaaaaataacaaagagacagaatcttgaagggctaaaagagattaagtaagcaattggaatatcaagagcaattaaaaagactgttgagctaaaagtgagt

SEQ ID NO: 47370 - DNA, 201 bp, Homo sapiens
tggtgaaaataataatggattctgaatttaaatatttgtttttatctttaccacaagtatcagagtgagaaaggctttggtctcaaaattagacttaattwgaattggtaaaattaacaaacatgcctgagcattatggactttttttttttttgctttaaggatataaaaataaaatattattttaataatgtataataa

SEQ ID NO: 47371 - DNA, 201 bp, Homo sapiens
gggggtggcaggtaatgaagctcttccttgccatgctaatgatttgttattcatcctgactgcatttgggagctagtgtaggctttcaagcaagagaaggkcatggtttgatatgttcataggatgatcactctgattgcagtgtggagaaatcaccagataagaaaatatggagacaggatctttagctaaaaggctatt

SEQ ID NO: 47372 - DNA, 201 bp, Homo sapiens
tttgtttttatctttaccacaagtatcagagtgagaaaggctttggtctcaaaattagacttaatttgaattggtaaaattaacaaacatgcctgagcatwatggactttttttttttttgctttaaggatataaaaataaaatattattttaataatgtataataataaataatattatttgacaagtattatcatgaag

SEQ ID NO: 47373 - DNA, 201 bp, Homo sapiens
aataacttgcttaagtcataaaacagcagaggccatatccatgtttcaaatgctggtttgtttaaatagatgtttgatgagctatttcatagtatccttgygcacaagattgaaaatatgagccagatgttagccagctgataggttgatgggcatatacgttgctaaaaaaatgtgacccagagtacactctagtgatat

SEQ ID NO: 47374 - DNA, 201 bp, Homo sapiens
caggtaccagttttcaacttgatttagcacacagtgaatctattttacatgttttcttattttctcattcttttcatgttagcatctctttgtaacatggyttaataccaataaaccctaaggcagtgacatgagctcattgtctattattgggctgggggtggttacagagctgcagaagcccttctgaaaaaagtgaag

SEQ ID NO: 47375 - DNA, 201 bp, Homo sapiens
gaatggtacatttattatagtcgataaacctaagttgacacctcctcatcacccaaagtccatagtttacattagggttccctcttggtattgtacattcyatgggtttggaaaaatgcattatgacatgtgtccaccgttgttgtaaaatatagaaaagttttactgcccgaaaactcctctatgcttcacctattcata

SEQ ID NO: 47376 - DNA, 201 bp, Homo sapiens
ggaaaaatgcattatgacatgtgtccaccgttgttgtaaaatatagaaaagttttactgcccgaaaactcctctatgcttcacctattcatacctccctcytccttgacccctggcaaccactcatatttttactacatccatagttttgccttttttggaatatatagctggaatcatacagtgtggtactttttcatat

SEQ ID NO: 47377 - DNA, 201 bp, Homo sapiens
gtggaagcccaaagcccaaacccagcatctacatcagctgacacaaatgaccctgtgtttgttggaggcttcccaggtgagtgttggctaccccagcaacmatttctttgctctcttatgttactggttttgaaaacatttatatttacatgtgtctaagaatgtgtgcttatgtgtacttgcttcctagctttagaatct

SEQ ID NO: 47378 - DNA, 201 bp, Homo sapiens
tccagtgcaatctaatggagcaccacacatttagactctggagcatgttttattccctgtggacaggttcctttcgattgctcatgtagggatttaggggrtacttttaatgttatattctatgccttaaaggaaatcttcaatacttgtgcaatacactttttctccccaaatctatttgctcctcctctttggtccctc

SEQ ID NO: 47379 - DNA, 201 bp, Homo sapiens
ttcacacaggcagagcaggaggaagtgggggctggaggtggcacacacttttaaataaccaggtcttatgagaactctgtcatgagaacatcactagggcrgtggtgctaagccattaaaaccactccagtgattcaatacctcccacgaggccccatatccagtattggggatgacatttcaatatgagatttggatggg

SEQ ID NO: 47380 - DNA, 201 bp, Homo sapiens
cagtgtttactgaatgtttttttactgtttcaggatcccatgcaggatactacattacatttagccattgtgtcttcttagggttcctctagactgtgacracactgtcaaaaatactgtaacagtgtttctgatgactttgagagtttggacaggttcgtgtgtttggtaagctgtccctcaattggggtttgcctcata

SEQ ID NO: 47381 - DNA, 201 bp, Homo sapiens
tggtaagctgtccctcaattggggtttgcctcatatctttctcatgattagaatggaattatgagtttttgtgggaaaaacttcagaggtaaagtaccatkttcatcacatcaagaacccatgtgaccaatatgacttattactgtggatattgaccctgatcacctgactaacatagtgtttgccagatttttccactgt

SEQ ID NO: 47382 - DNA, 201 bp, Homo sapiens
tgagtagtagatcaatttgttcacatattttgcaaaagttagagcttattactcattcatgtactattgatgtaacgcattagaagacagttaacattagktcctaatggcacctgaccaaaaggagctgtgggcctggcctatacaccttattgcctgttttcagcatcaactgatttagtgaagcagcaaaaagaaaaa

SEQ ID NO: 47383 - DNA, 201 bp, Homo sapiens
accatatcaaggtactgttggtaaccagggtatttgaggttgaatagaaatgattcctggcctcaaagaatttacaacctcctgaaaaattcagacatgtyaacctttcactctacataatactatgataatattgactgggagattcagcaaaagtttcacaaaaataacagcatcatagcagaagtggagaggaattgg

SEQ ID NO: 47384 - DNA, 201 bp, Homo sapiens
cctttgagtgcaaacacgtgcaggaagccaagtttaaggaaattaatggaacataattacaacactcaccagaaaagcaaggatttgagtaacctagggaytggatgcacagtttatcccaaaaaaatttttaaatccaaaagtgaaaataattccattattaatgttttagaagaataaatccagagcattataatactt

SEQ ID NO: 47385 - DNA, 201 bp, Homo sapiens
aagctaaggaattggtttttatcctgagagccataggaagcaattgaaatattgcagtcatgggttaaaataaaatgttgcagaatttgagtggctcactkaaactgaataaatggttttttatcggaaaatagtgtgatattaggctagaaaagtaggctgggataatatttatctacatatctgtcaggtacctaccat

SEQ ID NO: 47386 - DNA, 201 bp, Homo sapiens
tgagccaattactaagtaattctcaaatccatggtgctatgaaggaaacgtcctgctgcaggaagtgtggaaacctaggtagcaccctgggaatggccacrctaaggagaagcacttaaactgaaagctgatgggtaacaaggacccagtctttacaggtgttgaggagaagctcattctaggtaaagacaatgggataca

SEQ ID NO: 47387 - DNA, 201 bp, Homo sapiens
ttcctatatataaacacacatagacaatcaagaatcacactgaaaggaaaatatgagtgagaaggaagtggatcctttataagcaggagaaagctaatacsatttgtttgtactgcagtattattttgtaaagagtaatagctacttgtcttgcataactaatttctttaaatatcagaatgaaatgttattttaagaatt

SEQ ID NO: 47388 - DNA, 201 bp, Homo sapiens
aagcgtggtattagggtgggagtgacccgattttccaggtgccgtctgtcacagcttcccttggctaggaaagggaatttcctgaccccttgtgcttcccrggtgaggtgatgcctcgccctgctttggctgacacttgatgggctgcaaccactgtcctgcacccactgtcagacaagccccagtgaggtgaccctggta

SEQ ID NO: 47389 - DNA, 201 bp, Homo sapiens
gtcttcctatatataaacacacatagacaatcaagaatcacactgaaaggaaaatatgagtgagaaggaagtggatcctttataagcaggagaaagctaayacgatttgtttgtactgcagtattattttgtaaagagtaatagctacttgtcttgcataactaatttctttaaatatcagaatgaaatgttattttaaga

SEQ ID NO: 47390 - DNA, 201 bp, Homo sapiens
ctctgtgatatgtcgccaatgcaaggcccatgaaaactcaaaaagagtcagttagtaaatgaactcttttattatttgtataaattatagtttttataatwtaaatgtaacatatgaatacttgtgtctggaattacaatagacacatttttatctccagggagttactactggcactttttgaaatcctgttttgtccta

SEQ ID NO: 47391 - DNA, 201 bp, Homo sapiens
aaatccatcttgaggaagatatggcaaaaagaaaagatgaataaaagtaaacagaaaatctgagtagcctattgccacttaacttgcctcttttgcctcaytggtaaaattaatgggttgtattatttggttattttgagatctgaaattcatgagtatagggaagcccagaagtcaatatagaattgcactcatctctaa

SEQ ID NO: 47392 - DNA, 201 bp, Homo sapiens
ctagccctataaagaaggaagaatgttttcaataacttaaaaggaaaaacaaagaaacaatttatacatttgcaggagaaaaggaaaaggtcaagtagtasagcaaccaacgaccactatgaagaaagtggaggtcagacaatttgagaagaaaaaaagcattgaaaataccataagaaaagaaacaaagaaatgatagaa

SEQ ID NO: 47393 - DNA, 201 bp, Homo sapiens
tataaataatcccttttttctgctggattcaatcttttattacatacatttactggatttttaatttttgtatttttattttttagttttagaatatccawttgatactttaaaaaaattagactccaaatatctctccacttagtcatctggaacatattaataacagttattttaaattatatgtctgataactctgac

SEQ ID NO: 47394 - DNA, 201 bp, Homo sapiens
agcaggaaagaagaatttgcatattagatagacaccatgtatccatttttttatctcaattctaatcacttgctttaaataattttttctgcccatgatayttcagtagtagccatcagaaggtgttaatcagttatgctttcatatgttaactttacagtgtcgtattttgtaataggtataaaattctgccaatatttt

SEQ ID NO: 47395 - DNA, 201 bp, Homo sapiens
ctttattttgaaggtgccaaattagagctaacatgcatcgcttcatgtcttcccaagaaaattacatgacaaatatctatctctgcttcactgacaacctrgcagtgaaagggatttgaggtttgtgcccatcagtaactaattagagaagtaaatgttataactagtcagtattctgtggctacaatgtggcaagttaaa

SEQ ID NO: 47396 - DNA, 201 bp, Homo sapiens
agagtcctctactcctttgagtctagccctataaagaaggaagaatgttttcaataacttaaaaggaaaaacaaagaaacaatttatacatttgcaggagraaaggaaaaggtcaagtagtagagcaaccaacgaccactatgaagaaagtggaggtcagacaatttgagaagaaaaaaagcattgaaaataccataagaa

SEQ ID NO: 47397 - DNA, 201 bp, Homo sapiens
actttggcaggacgagagattactttttggatagaatcagttgcaggaattttccaaacgattcacacagcatcaacttaatcttctggaaaacattttarggaccacaaatacatattgtacccaggatgtagtgtacttactgcagtgtggtctatgatttttcttggcatgcataattcaaagacccagatagaaatg

SEQ ID NO: 47398 - DNA, 201 bp, Homo sapiens
gcctgtgacactgcatttttcattgacagggttcctcagtgaggggggaaaaaagcatttaatgattttcaaatgacacatgtaacctaaacactataggrcagtgatatttgcctaatctagaaccttctaccaggttgtccaagatgtgcccctagagaatatagcactcaattaatagtgttggatgagtttatttac

SEQ ID NO: 47399 - DNA, 201 bp, Homo sapiens
atcctgttaatttggtttagcaagaatcccccctacctacccctgatgtctcctcttaatgattgttcgcccctgatccttgctcgtggctataaatctcyacccttttccttggcactgaatccctacttgttcatgttgtattgggaatggaggctagttctttactaaggttgctttttctctattgccatagtttct

SEQ ID NO: 47400 - DNA, 201 bp, Homo sapiens
tattggataagaaaaagaagacaatctgtcccagaaattttgttggaatgtttttcatgaacagaatgaataaaattttagtttaatagatcagtataatrtagttctactttgctggaaaagaaatatatttgaaaagcattacgttgagtaattatctagataggactaacatcccataaatataagatctgatataaa

SEQ ID NO: 47401 - DNA, 201 bp, Homo sapiens
gggaaattccactgttgtttctttagtgtttgatgagggattgtaatctaatcagtttaaacgactataaacacagcgatgatcatttaagttggattttkattcgaaaagtaagttcttggaatttagggtattgcacaatctgtcccatacaggggaaaaaaaaatcacctacttgtgatttttactaatttttttccg

SEQ ID NO: 47402 - DNA, 201 bp, Homo sapiens
aacctgaaaaatatagctgtctatttaaagaagacattttcttgtttggcagaatattatcatcatacagcatatgtacaatatggtcctaatttgtgtcratatgtgctaggcttagaaaactcactttaagttttactaaatttattttggagtttaactcttacttttgacatgatttatattctaaggagatctcag

SEQ ID NO: 47403 - DNA, 201 bp, Homo sapiens
ccacttatgtttaggtttaacagagtcttggcttcataatgaaatacttcattaaagtatttttatgatatctgtttacacatatgttcatagtagaattrcatggtgttctgttatccagtctttgccattcacatggactcagtttatagtgtctggttatgctactgaagatcttcccgctttaccatttgctgttaa

SEQ ID NO: 47404 - DNA, 201 bp, Homo sapiens
ttattccttctctctttccacaatcatttaaaaataattaaatgtctgaaaaattacaaaataagtgctatagagaatcagtgatttattaaatgactatyggataagaaaaagaagacaatctgtcccagaaattttgttggaatgtttttcatgaacagaatgaataaaattttagtttaatagatcagtataatatag

SEQ ID NO: 47405 - DNA, 201 bp, Homo sapiens
ttatttccttgagcagtggtttgtagttctccttgaagaggtccttcacatcccttgtaagttggattcctaggtattttagaatgtctgttgttttaagycacctagtttgtggtcatttattatggcagtcctagaaaactaagatacctaaattaggaaacaaatataactatattaaaaggggatagtatatccaat

SEQ ID NO: 47406 - DNA, 201 bp, Homo sapiens
aattagctgggtgtgtgcctgtagtcccagctattctggagtctgaggtgggagaatcacttcaacccaggaggtagaggttgtggtgagccgagattacrccactgcactccagcctgggtgacagagctggacatcagaccctgtctaaaaaaaagcaaagaaaagaatgcagattctatagttgttggttgcagtact

SEQ ID NO: 47407 - DNA, 201 bp, Homo sapiens
aacctcaaacagagagtgatggtgagttgtaatgcattacaccatgtctgctgttatcattattccttctctctttccacaatcatttaaaaataattaartgtctgaaaaattacaaaataagtgctatagagaatcagtgatttattaaatgactattggataagaaaaagaagacaatctgtcccagaaattttgttg

SEQ ID NO: 47408 - DNA, 201 bp, Homo sapiens
gtttcttttttcttttctttctttctttctttctttctttctttctttctttctttctttctttccttccttccttccttccttccttccttccttccttyctttctttctttctctctctctctctctttctttctccttccttctttgcttccttccttcctttctctctctctctctctctctctttcttgacagagt

SEQ ID NO: 47409 - DNA, 201 bp, Homo sapiens
tttttgaagacctcttttaaaatttgcctaaaataaattctcggtatgctataattatagcagaactcttttctcagtcacccactaccactgttagggtsttaaaattatctcagaaaccaagcaagtttgtgctaccaactcacaaaataaaacaggcaaagacaacactctggatagggaattttatcaccattatct

SEQ ID NO: 47410 - DNA, 201 bp, Homo sapiens
caccttgtaactatgctcttcatcatacctaatgatacttgcaagataattgttgcttcatcctaggcattaataaatcctgtacataggcatgttattaygaatagctcagtgacattgctccttaagaaaaaaaatttttttgaagactaaaacctatgtaatactgagtccaaggggatagcgggaggtaagtgaact

SEQ ID NO: 47411 - DNA, 201 bp, Homo sapiens
tgtgcttatattagtataatctgtagtataacagaagtttaaggtgtctgcctataaaaccctttatatgaagtggagtgaatcattaattaatatgtccmgtactcttcttcacatccagacaccgatagttcagaatcctccatctatccacctttccctttgctattcttcacagatgcaggccaacaaagatgagga

SEQ ID NO: 47412 - DNA, 201 bp, Homo sapiens
ctttggaaaaaccaaatgcattttctgaagctataaataagaaaaatccctccctctgcccctcttaaatattacctcctcaaataaggtatgcacacagyaaaactcacaaatcagctccactggagccagcaggctttggcggtttctatctcattcaggttccaaagcagttatggcagctgcttagctgtcacagat

SEQ ID NO: 47413 - DNA, 201 bp, Homo sapiens
tttggaaaaaccaaatgcattttctgaagctataaataagaaaaatccctccctctgcccctcttaaatattacctcctcaaataaggtatgcacacagcraaactcacaaatcagctccactggagccagcaggctttggcggtttctatctcattcaggttccaaagcagttatggcagctgcttagctgtcacagata

SEQ ID NO: 47414 - DNA, 201 bp, Homo sapiens
accatgaaactgggtagtttataaataaacaaacatttatttctcacaattcttgaagctaagaagtctgagatcaaggtactggcagatttggtgtttastgagagccagtttttcatagaaggaggcttcttgctgttctcacatagtagaaagagtgaacaagctcctttggacctattttataagggcactaatttc

SEQ ID NO: 47415 - DNA, 201 bp, Homo sapiens
ccaaaggccccacttcctaatcctatcaccttgaggattaggatttcaacatatgaattttcaggggacacagacattcaggccactgccctttacttatycaatttcccacttatgtaaaaagtgatcaacatgggatccaaagattggaataacaaaatgcttacaaactgtctggcacatattgagatctaaatgaat

SEQ ID NO: 47416 - DNA, 201 bp, Homo sapiens
tagtacaattcttcaggctgtgtattacaggtgaaataaaactccctacacacataattctgctcagcaggtacctcttattacaatctgaagaatgactrtaagaagccaaaacctgtgttcctattggacaaatggactcaatcccgtgactttgcggtcactccttcctatctcatacccttgcccagggctgggaat

SEQ ID NO: 47417 - DNA, 201 bp, Homo sapiens
cccaccccaccagcgtggaacttcgtgtgtattcaaaggtccagtttgaattactgtgaggccagtggctagaaagcagtgtagttgggactggagattcwcatgcctggctcttctcccaagcttcaactgtagctcttgagcagcagcttcctctgagcttctaaaaaatgcccagaaaattgcccagccaaccacatt

SEQ ID NO: 47418 - DNA, 201 bp, Homo sapiens
atacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcg

SEQ ID NO: 47419 - DNA, 201 bp, Homo sapiens
gtggaacttcgtgtgtattcaaaggtccagtttgaattactgtgaggccagtggctagaaagcagtgtagttgggactggagattcacatgcctggctctyctcccaagcttcaactgtagctcttgagcagcagcttcctctgagcttctaaaaaatgcccagaaaattgcccagccaaccacatttcctggcaagcata

SEQ ID NO: 47420 - DNA, 201 bp, Homo sapiens
agttgggactggagattcacatgcctggctcttctcccaagcttcaactgtagctcttgagcagcagcttcctctgagcttctaaaaaatgcccagaaaaytgcccagccaaccacatttcctggcaagcatagcaccaggcatatggtcagtttgagtgctattagataggctttagaacttccaagggatcattggttt

SEQ ID NO: 47421 - DNA, 201 bp, Homo sapiens
tctgttctgttttttccccatctttgtggttttatctacttttggtctttgatgatggtgatgtacagatgggttcttggtgtggatgtcctttctgtttrttagttttccttctaacagacaggaccctcaactgcaggtctgttggagtaccctgccatgtgaggtgtcagtgtgcccctgctggggggtgcctcccag

SEQ ID NO: 47422 - DNA, 201 bp, Homo sapiens
catctgaaggccagaatataataagcattgttaatttagttaaaggaaaaggctgctgttgaaggttagacttcttgtgtatgtgtgggagataacagaayaacgtctcttttccaagatgcatatggttttcttttgcttatgtgccaattttaatcaatggagaaattaatatgttaaatgaaataattaaccatttta

SEQ ID NO: 47423 - DNA, 201 bp, Homo sapiens
ccttttccagtcttcctacacttaacagccagtacaaacttagtccatagaacgtatttgttgtgcacagacctgcacaaacacacacacatgcaaggttkcacgaatcaggtatgtattttgtgtatgtgtcaaacttagccatcaactggaatttgtgttttagtttggatgctgatttacctcatcagtaaaatgccc

SEQ ID NO: 47424 - DNA, 201 bp, Homo sapiens
gcttagttttgcaaatgcgtgcatttaaaatcaccatttgtattttgaactcttctggcttttaactgtagtggaaatttggattgaagacaatggaaacygtgaggtacaatatataaacttgcatccaaccgagaaaaaccactactcttatctgcacttcaatcagcaggaggttctttttcagtttgtttagaaaaa

SEQ ID NO: 47425 - DNA, 201 bp, Homo sapiens
acagtgcagccttcagtctgtggttaaaggcctgacagcccctggcaaacccctggtgtaagtccaggaatccaaaagctgaagaacttggagtgtgatgktcaagggcaggaagtatccagcatgggtgaaagatgaaggctggaagagtcagaagatctactctttccactttcttctgcctgcttttattctagccac

SEQ ID NO: 47426 - DNA, 201 bp, Homo sapiens
cacattgagggtgggtctgcctcttccagtccagtgactcaaattttaatctcctttggcaacaccctcacagagacacccaggaacaatactttgcatcsttcaatccaatcaagctgatactcaatattagtcatcacaagtccaccccttgtcaacttgaacccatacacatctcctgaaatcatacataatctccaa

SEQ ID NO: 47427 - DNA, 201 bp, Homo sapiens
aaaaatgaagaaagaattttattttcagccattttttttccaagagaaaaagaaatctaaagacaagcattgtaggaagggttaggagacagaaatgttcrttagtttaaatttattttttttgtagttcaggtagtacattatttaaagtaatgaaaacccacaaactactcaagtaataattcctctagaaaaccaagc

SEQ ID NO: 47428 - DNA, 201 bp, Homo sapiens
ggttatagaaaactataggacaatataataagtagatacttcactattatttggaattgtcatagatatattggccatgatcatttggaagccagatttcrtataattaggacgttcttcatttgagtaccattgagtgccctgacattccttttttgaatcatcccaccagaatccttgatgaggctaaaaacatctcct

SEQ ID NO: 47429 - DNA, 201 bp, Homo sapiens
tctcttctgggaagtgcacctaccccagaaagattttgtgaaattaattccagtaatgtagtacaagtgctctgaatctcacagcatgcttcacaaataargtgaagaattgtctcatatcacacacctgctagagcacctggttgcagagacttttggaggatgctatgggtatttaagatatgttggtagtatttcata

SEQ ID NO: 47430 - DNA, 201 bp, Homo sapiens
agcattgtaggaagggttaggagacagaaatgttcattagtttaaatttattttttttgtagttcaggtagtacattatttaaagtaatgaaaacccacaractactcaagtaataattcctctagaaaaccaagccaaggctatgacggagatgggaatgttttcttgctacattatgacatttctctgatttgtggcca

SEQ ID NO: 47431 - DNA, 201 bp, Homo sapiens
aggaagggttaggagacagaaatgttcattagtttaaatttattttttttgtagttcaggtagtacattatttaaagtaatgaaaacccacaaactactcragtaataattcctctagaaaaccaagccaaggctatgacggagatgggaatgttttcttgctacattatgacatttctctgatttgtggccaattacgga

SEQ ID NO: 47432 - DNA, 201 bp, Homo sapiens
ttgttttaaccatttttttttactttaaagaaaaagctataaactagttatatgatcttttcttcttcctttcatatgatgctgctaactcaatagagagmcacccgattacaaatgctattgatggaaagaacacttggtggcagagtcccagtattaagaatggaatcgaataccattatgtgacaattacactggatt

SEQ ID NO: 47433 - DNA, 201 bp, Homo sapiens
tttaagttttttaaaacattgaaaaacagaaatatatgcacacagaaagcaatttagccagcacaaccgggtataaaatgagaagttttagtacattgtcyctcacggcactattaactgcctcattcattcccagtttctacccactattaattactgtaaaggtttttggcatgttcttctctacccagctcccaccag

SEQ ID NO: 47434 - DNA, 201 bp, Homo sapiens
gtctgtaatatctttctacctattagaactgctggaaatttttgcatggtattagttcctgaaagcacacgttattttaaagatactacttttactatttytatattgttaaagcatgatataataacaacaaagattataaacacttattgagtacttaatatacttatgttaagtgtatgtaatcctcataccaattgg

SEQ ID NO: 47435 - DNA, 201 bp, Homo sapiens
agaaattgagtgtcatgcagttccaaagctggaatccaagtcttctagctctgccccggtgcttttttcctctgaaatttttccagttgagaagagattasgaattctcaaggtgtgcctaacattcagcagagagatgcaaaacactttttaatccgtgtgtgtaattaaaaacacagttgtacttgggtaattatatcc

SEQ ID NO: 47436 - DNA, 201 bp, Homo sapiens
aatagagtttacaaacttttcacctatttacttgcatttttaatctttcttcttaagacttcatttcttttcttttaccttgtcgaatgtcttgccaaacygactaatgtttttagtgtttcaatatgtttcgtttcttcaccagcttcaaaagaattctgtcatctcaaatttcaggggcttttccacattactaaaaac

SEQ ID NO: 47437 - DNA, 201 bp, Homo sapiens
acagccacgactctttatacagcagccaccctcttctgtgcctttgccaatacgttccctctgcctggaagattgcagccctttcactcctccacccgagwctaactaatccctgttcagctcccaaaagtcagcactatcatcctgaaaatgtccttgattgggcctaatctgagttggttgcccttttgtgtgctgcca

SEQ ID NO: 47438 - DNA, 201 bp, Homo sapiens
atcttcttctcataccgtaataaacagtctcctaactttaactaccgaatatgtgctaataatttacaattctatatctgcagcccagagctctttcctaraggcaaactctgtgtaccaactgccttctggatccctccactccattattctatggttttagatgtatgacatttgtttttctgtccacaggcaacaggt

SEQ ID NO: 47439 - DNA, 201 bp, Homo sapiens
ggtatacgtgataatatgatgcttagtgataggttctcagatgatcacagcatgatggtctttataagcaataacatttttgagcaaacatatatttgctraaattatctttttaaaaatgtaagaaaataatataaacacaaaattcagcatgtcagggttatgctgcagggtaacggggtggtgaggattgtatagata

SEQ ID NO: 47440 - DNA, 201 bp, Homo sapiens
tgaaatgtttcaactctggttggaatacacagagcagctgaaatattttgaaatgacacacacataaaatacataatttatttaaggtaatttattgttayattttaaaaatacatctttttaataaaataaagataaaattaagaggattatattcctcctttttctttgttgatcagttactagactcccttactcctc

SEQ ID NO: 47441 - DNA, 201 bp, Homo sapiens
aggtttttccctatttaattattccatttcttctttcattagcttgtcttctgtgaagtcttttattactcatactaattaccataaatatggtaacttgygtccttcatttatcagaactttgtaatattttacctcagtcccacctccccatcagatttaattctatagttctcatatgtttaattctatgtatatatt

SEQ ID NO: 47442 - DNA, 201 bp, Homo sapiens
aaggaagcaaaaaaacgaaaataaaaaaatcttatttattacattctattagccccatggactttgcaaggcctgtgtccttcaaaaatgctgacattggwcgctgtgcccatcagaaactccgtgaagatgaagatggagcagctccagctgaaatagttatccagcctgagccagttcccaccccagcctttcctacgc

SEQ ID NO: 47443 - DNA, 201 bp, Homo sapiens
ggtcagaaataaggacattttggttgggcacggtggctcacgcctgtaatcccagcactttgggaggctgaagcaggtggaccacctgaggtcaggagttsaagaccagcctggccaacatggtgaaaccccatctctactaacaatacaaaaattaaccaggtgtggtggcaggcacctgtaatctcagctactcgggag

SEQ ID NO: 47444 - DNA, 201 bp, Homo sapiens
accatacaaaccctagaagaaaacctaggcattaccattcaggacataggcatgggcaaggacttcatgtctaaaacaccaaaagcaatggcaacaaaagycaaaattgacaaatgggatctaattaaactaaagagcttctgcacagcaaaagaaactaccagcagagcgaacaggcaacctacagaatgggagaaaatt

SEQ ID NO: 47445 - DNA, 201 bp, Homo sapiens
ctcttaatatttggtgcaggacatttcaaagctgagccctcttgcattgcctttttcagatgacctcaagcagtttggcctaacaaccagtattccgttcygaggttgcatcagatccctgaagctcaccaaaggcacaggcaagccactggaggttaattttgccaaggccctggaactgaggggcgttcaacctgtatc

SEQ ID NO: 47446 - DNA, 201 bp, Homo sapiens
atactaaaaatacaaaaaattagccaggcatggtagcaggtgcctataatcccagttacttgggaggctgaggcaggagaattgcttgaacctgggaggcygaggttgcagtgagccgagattgtgccattgcactccagcctgcgcgacaatgtgagactccgactcgaaaaaaaaaaaaaaagaaaaagaaaaaaaaga

SEQ ID NO: 47447 - DNA, 201 bp, Homo sapiens
aggtcaggatttcgagaccagcctggccaacatagtgaaatcctgtctaatttgtatactaaaaatacaaaaaattagccaggcatggtagcaggtgcctrtaatcccagttacttgggaggctgaggcaggagaattgcttgaacctgggaggccgaggttgcagtgagccgagattgtgccattgcactccagcctgcg

SEQ ID NO: 47448 - DNA, 201 bp, Homo sapiens
catacaaaatgtattttaacatgcatagcatggaagaatcacaggaggatgattacccaataacccaataggagcatagatgtagatatacccttcttcaygggggagggaagatggggaaaatatggcaatttggaaaatagtaaatgattttttaggggaattcaagaacctacaatggcctgggacaaagtctgttgg

SEQ ID NO: 47449 - DNA, 201 bp, Homo sapiens
aatctcctttggcaacaccctcacagagacacccaggaacaatactttgcatcgttcaatccaatcaagctgatactcaatattagtcatcacaagtccamcccttgtcaacttgaacccatacacatctcctgaaatcatacataatctccaaataaagacaataataacatcataattatacctaacataatacagcta

SEQ ID NO: 47450 - DNA, 201 bp, Homo sapiens
tttcctaagcctggttttgtggagctctcccctgtgccaattgatgtaggaacagaaatcaacctgtcattcagcaccaagaatgagtccggcatcattcytttgggaagtggagggacaccagcaccacctaggagaaaacgaaggcagactggacaggtaccctcacacctagctgataatgcattttccctaatgctt

SEQ ID NO: 47451 - DNA, 201 bp, Homo sapiens
tgcaggaaatggaaatctgaaaattgcaggagcagatgaaggaagagatatgttaataagtgaattaaagttggataagatttcccaggctaatgttatcyaaggcgagtatatagaaagaatgaaagacaggactttatgttgggaaaggagaaaaagaagagccaaggcaggagcagtcagaagagagggaacccaggc

SEQ ID NO: 47452 - DNA, 201 bp, Homo sapiens
ataatacagctatcccttgtacaatcagaagcacactaatccttaacctaaatgctattacataaagttaacaacacttaaatgctgatatgaagtcaatraattttatgtcacatgataaaggaaaaagaaagcaaatgaagatattttcctagtacaagtgtatacatgcacaaacatattcttaacagaataaggagg

SEQ ID NO: 47453 - DNA, 201 bp, Homo sapiens
aacggtatttctttctgcagaaggctgatgctgtacgtgtgattacattcactggctgcatgggagaaacatactttgacaacaaacctataggtttgtgraatttccgagaaaaagaaggtgactgcaaaggatgcactgtcaggttagttgagatgagaactctcccagggtctgtcctgtgcataataaaagcttcga

SEQ ID NO: 47454 - DNA, 201 bp, Homo sapiens
gtagcatgctaatgagccagggcagagttgctaagtggcaacgtgaaactttagtcaaaggaaggaagtaagggaaggggaggagaggggaggggaggggrgggaggcgaggggaggggaggggaggggaggggaggggaggggtggtagaaagaaagaaggaagggcagttttcttgtttgaacaagaaaggcttgaact

SEQ ID NO: 47455 - DNA, 201 bp, Homo sapiens
gactcatcatttatgaaaatatacaattttgttctgcaaaataatttaattttttaaaattccttgtgcaatgagaaaagatcagagaggcctacagtttscttttacagagctaggccaggggctgtatttagagtaattgaacacatgattttacttgaatgcggagaaacttgaccaactgtgaatatgcaatttcac

SEQ ID NO: 47456 - DNA, 201 bp, Homo sapiens
tccacttgattattaaaatcctcctcagctgaggtcacccgttggtgagcactcacataggatacaaatatcttcacagtttttgaccactcagagaggtycatccacatacctcttccccagattactttgccaccaattttttaatcatgcttcttccaagtccctgaccatccagccaaaccattggctacagcacat

SEQ ID NO: 47457 - DNA, 201 bp, Homo sapiens
agtccctgaccatccagccaaaccattggctacagcacattaattagtatataattacacatctggccatttcttcttccaagcaagtgcacaaccaggtrccctgctcaaaattctgccccctgggaagacttccctttgctactgtccttcagggatgtcctagaaaggggctgtagtgctgcagctgtccacttttgg

SEQ ID NO: 47458 - DNA, 201 bp, Homo sapiens
agcagctgctgctcgctcagctcacaagccaaggccaggggacagggcggcagcgactcctctggctcccgagaagtggatccggtcgcggccactacgaygccgggagccgccggggtcctcctccttctgctgctctccggaggcctcgggggcgtacaggcgcagcggccgcagcagcagcggcagtcacaggcacat

SEQ ID NO: 47459 - DNA, 201 bp, Homo sapiens
ttagatgtcttagtgcttttcaatcaggtatatccaaacaacaaacaaacaaataaaataagactaatgcagaatgaattccatagttcagattcttcaasataatggaaaattatcacataatctccacctgttttgaaacattatcttctttccttcctttcctccctttctccctttctctaagtcagtggaatagtc

SEQ ID NO: 47460 - DNA, 201 bp, Homo sapiens
tgtggaaaatgctgaaacaacttgctattaaaaaccatttatcagaaacttgtttaattaatatgtcaaatatctgggtttttaaatcatgtataacaatsaaaatattcctaaaaacatattgagaactttaacaaaacattttacagttggaatgaaattagtactggatgattggattaaaagccagtagaaattata

SEQ ID NO: 47461 - DNA, 201 bp, Homo sapiens
ctaagtaacaaatatataggaatttattattctattatctttacttttgtgtaagcatgtaaaagaactggattttagaaattataaacatgtattaaagrtaattcttatagttttctcaataatttgctgctctgtattattaaaactactttgtctataaaagtttgctgaagtgaaaaatattgctgtttctattac

SEQ ID NO: 47462 - DNA, 201 bp, Homo sapiens
aagggggaacttcagagaaagcctctccctgtgcttgaggagaggcagaggggcgagagatgggagtggaaggcaagtcagagagaacttggttctaaggyggcttctttagtccaaagtgctcagctcctcaaagcgccatactttggagtactattttctgagccctaacagccacaaatggaagaagtattcccctgt

SEQ ID NO: 47463 - DNA, 201 bp, Homo sapiens
tggcaggttttcttgggccatcaattttactcaagggcattttaaaataatattttaatattaaaggaagcatatgatactgtagaataaaatttatttgmatttttaaaatctccaacctgactcttctgtgaaatttcagagctgtggctgttaaattggaactatgccaccagaccctggggtatgtctatttattct

SEQ ID NO: 47464 - DNA, 201 bp, Homo sapiens
atttgcttttctttaattccccattgtgttccagaaaggattttagatgggactcaaaaagtaacttttttgcttccaattccaacataatcattctcacraacttttgtctcagttcaccaagaggaaaaacattcaatattgacaaacaccctaaaaattatttaaattgaaagaatagtgcaaaataatcaaggaaaa

SEQ ID NO: 47465 - DNA, 201 bp, Homo sapiens
ttttcttgattttttccaaatgttttgaagaaagtttttgtattattaaatgctattcattggtcaatttaagtaatcttcttttaagaaatcattcagarattgtaggtccttgatcgtaattctttttgggtaatttcaatttcaataggttaaacactgtgctggaagatttgagaaagattatcattggtccatttt

SEQ ID NO: 47466 - DNA, 201 bp, Homo sapiens
atttattttatgtatatgcataataatggttagaatgctcacagttatactgttcatcagtaaccctgtgaatacagggttcacatccaagatgttctcaytggtccgtggcaaagtaagaaaatgagaacaactttccacatttttcataaaaatagaaaggatacaatttaaataattgtcctccattttgatattatg

SEQ ID NO: 47467 - DNA, 201 bp, Homo sapiens
attagattatgcgtgatcattattttctaggtggttttctaaagttcctgaaaggtcattcagagcattgggaagaagaaatttgggatagtagtaaattmaaagcaatttcaccagtgcctgtacgaaataattgaatggggaatgaccttgggttgtctgtttgcaagaatataaatgtctaattaattggccgtgtct

SEQ ID NO: 47468 - DNA, 201 bp, Homo sapiens
gtgttttttctaaagccattatttcatttattctatgaaagacaaaattggcattttaaaagtagaacacggtcttttgatacctgtcatctgagataccyaaaggattttttttttaagttagcatcaagggtaaataataacaaatgaagttattttatgttagatcttgtaggtctaaatatatgcacagcaatattt

SEQ ID NO: 47469 - DNA, 201 bp, Homo sapiens
ttatcgtcaggcatatggctgctcctctgattggccaattgacaaggcatgaaattgaaatgacagaggtaaagttagtcattgtttggtgcaaagatacyaatcaatggttttgcattcagttttgtcatagtgatttctcttcttgttaacagaaagaatggaaatattatggggatgatcctcgagtccatagaactg

SEQ ID NO: 47470 - DNA, 201 bp, Homo sapiens
atctaattttaaacacctttaacttttttgtttattttttgttagtatactttgtttatttatttatttctgttagtaaacttccatcaagaaagtatccyatttcttttctgccttttttaaatgaaagcctgctagtgataaatctctcatcttttgtttgttttttcacttttctttacttttgagacttattttcca

SEQ ID NO: 47471 - DNA, 201 bp, Homo sapiens
catcttttaagtaggaatattttgggctattatatgccagactcatcactggtgctatttaatttctcctcccatcaatgagagctctccctgagacacaytgtgagatctttctgaggatgaaatcacttaaccccagcaacgccactgattattttcagctacaacaaccacacttctatgcacacacatcaatcacgc

SEQ ID NO: 47472 - DNA, 201 bp, Homo sapiens
agttgactcagaatcagttccttcctttcagatccttatctttaattactttgtcttctaacctggggtcctaatctttgcctaggaatttaaagtaaagrttggccgaatcttatttctcttgacttgtatctacctttactttagctcaccctctgggcgtggcctctagccagtctcactttgagtatctttgaaact

SEQ ID NO: 47473 - DNA, 201 bp, Homo sapiens
gtgtatatgtgccacattttcttaatctagtctatctttgttggacatttgggttggttccaagtctttgctattgtgaaaaatgccacaataaacatacstgtgtatgtgtctttatagcagcatgatttatagtcctttgggtatatacccagtaatgggatggctgggtcaaatggtatttctagttctagatccctg

SEQ ID NO: 47474 - DNA, 201 bp, Homo sapiens
aggtttttttcctgtcttcatattgatgaagtgttttttctaaagccattatttcatttattctatgaaagacaaaattggcattttaaaagtagaacacrgtcttttgatacctgtcatctgagatacctaaaggattttttttttaagttagcatcaagggtaaataataacaaatgaagttattttatgttagatctt

SEQ ID NO: 47475 - DNA, 201 bp, Homo sapiens
catttcactttgcaaaccgacttactattctttgtacctctctccttctctttttgctctgtcactaatagagctttcagctactaagacacacaggagtsctttctagagagtaactgaaattaaccacatacatcattttggtggcaaacctcacagccaccagtcatttatagtaccaagtccctgctctttgggtaa

SEQ ID NO: 47476 - DNA, 201 bp, Homo sapiens
gtaggagcactagcatttattgaacaccttctgtatatcaggcactgagattggtgtcataaataaattatctaactttattctcacaaaaattccacatyacagacaaaagaatagaattgtggagaaggtcagcagctcacctaaagttagaagctaggaagtgtttatttactgatgatgaaaactggtatagcaaaa

SEQ ID NO: 47477 - DNA, 201 bp, Homo sapiens
attttccaaacgattcacacagcatcaacttaatcttctggaaaacattttagggaccacaaatacatattgtacccaggatgtagtgtacttactgcagygtggtctatgatttttcttggcatgcataattcaaagacccagatagaaatgactgattttagcacttctaacaataaaacaaaagctcttctacaagag

SEQ ID NO: 47478 - DNA, 201 bp, Homo sapiens
aattcttatgtaacataccaggtccaccctacttaaaatgggaagtaactgagaactgattcagttattctatctttggagctttaatgcaattatcaacrtctagtaccatatagattacttatagaactatccctgtcttcagcacttccctcccattttctcttcttgttttcccaattctcaactccctgttaaacc

SEQ ID NO: 47479 - DNA, 201 bp, Homo sapiens
acccagcatctacatcagctgacacaaatgaccctgtgtttgttggaggcttcccaggtgagtgttggctaccccagcaacaatttctttgctctcttatrttactggttttgaaaacatttatatttacatgtgtctaagaatgtgtgcttatgtgtacttgcttcctagctttagaatctgcttagaatctgcacctta

SEQ ID NO: 47480 - DNA, 201 bp, Homo sapiens
cctgcagcctaagcatttaaacatttcctgctaccttgtatggtgctatgagacagctgtcattgaagaaattctgttgagaatctgaattactctccttytgtattattttaatgtttgatattcacatgatggttgttttaaccatttttttttactttaaagaaaaagctataaactagttatatgatcttttcttct

SEQ ID NO: 47481 - DNA, 201 bp, Homo sapiens
ctcaaagcagtcattttactaaatttttgatctttattaaacatagatgcaaaagtaataataatatttccacaaataaagggatgttaaccaaaattaaygttcaagaatcctttcagtgtttctctacctctttaaatattccagaaatggtgatacagtcaggagcaatatattgccaggaactttggcaggacgaga

SEQ ID NO: 47482 - DNA, 201 bp, Homo sapiens
tagcagtattatattctctgaccctcaaattactttttaattcctaacggaacaccttcagaaatctctaatactgttctctgtatagaaacacacacccrtacaccagtaatgtgctgaagtgttgcagaaaatagtcccactttcagtaacatggcatatgaattttctatcacgtatattcacaaattttccttacat

SEQ ID NO: 47483 - DNA, 201 bp, Homo sapiens
atatttaaattatacatatatatcaacttcatcaactatttatggtgatcactatgcttggccttctcatcttgttgatgtatatattctagctataggtygtaactaggcagtaaaagttatctggagagaagcaaataacaatgtaactatttcgaatgtttatattctttaatttctggcatcacatagcttataggt

SEQ ID NO: 47484 - DNA, 201 bp, Homo sapiens
ttgcaattaggatggaaagtggacaaatgccacattccatcctatttgtatgcctaaataatgtgcaggggtgatggtcaggatagttaatgacagacacyatacactgtaaaggtcatggtttttataagttatcactgtgtggggaagcccccagccagtgggccagatcagcacaagacattttcctaatggatgcca

SEQ ID NO: 47485 - DNA, 201 bp, Homo sapiens
ttctctcatcatgtttgatattcagaactaatttaatcttaatttttgtggcatttgatacacatctaaaagtagtaatttatgttaagaaaataagcctkagataatttctgctttgataattgagtattttttatagtcaatcacaaactatggtaaatatttagttatataccacataatatgtaatttgatattatt

SEQ ID NO: 47486 - DNA, 201 bp, Homo sapiens
tgcagtgactcatgccggtaatcccagcactttgggaggctgaggtgggaagattgcttgagcccaggagtttgagaccagcctggacaacatggcgaaamcccatctctactaaaaatacaaaaattagccaggcatggtgacacatgcctgtaatccaggctactcaggaggctgaggtgggaggatcccctgagcctg

SEQ ID NO: 47487 - DNA, 201 bp, Homo sapiens
agcatgagtacaatctccctcctccagtgtctaggttcattttggtgagggctgcatatattcaagagccacagaaagctggctggagcaaacaagctggyggattgcacggtagacctgccttccacccatatgggcctcctcgggatatgaggaactggtggcggcaggggctcagtgctgcagcttatatcaccaaat

SEQ ID NO: 47488 - DNA, 201 bp, Homo sapiens
cattccccgatcacatgccttgtgccaagtaccattctaaatgccttgcatcttgtaactcattaaacctttacagtaacctcatgcaatgtacactcttrttgttcccattttgcaaataagaaaactgatgggcaatattaccttgcccaagtttatacagctggtaagtggcagagtcaggatttgaacccaggctga

SEQ ID NO: 47489 - DNA, 201 bp, Homo sapiens
ctatggagaaagcttaaaaagtgtcacttgtgcattgaaactcttttgtaacagcttctttactcttctgttgttgtcatgatatcctccagattacttaratttttaaccaagaagtaaccttacttattactagtatgctctttccttaaaagcttttctgatttatgttattttaattatatcaatcttgttattatg

SEQ ID NO: 47490 - DNA, 201 bp, Homo sapiens
aagatggccagagaaactgaatgagaatggaatcctgaggagaaaacaccaatatttaagagacctggttctctcagtgttgtggaacaggatccactgakatggaacagaagggtaagcttctgttaagctaggtaaggaagcttagggttgtgaaagaaggtacaaagacactgcacactgacttttggggaattacct

SEQ ID NO: 47491 - DNA, 201 bp, Homo sapiens
ttttttttcttttttttttttttttgagacgcagtctcgctctgtcgcccaggctggagtgcagtggcgggatctcggctcactgcaagctccgcctcccrggttcatgccattctcctgcctcagcctcccaagtagctgggactacaggcgcccgccactacgcccggctaattttttgtatttttagtagagacgggg

SEQ ID NO: 47492 - DNA, 201 bp, Homo sapiens
ggctgaggcaggagaatggtgtgaacctgggaggcagagcttgcagtgagccaagattgctccactgcactccagcctgggcgacagagtgagactccgtytcagaaaaaaaaaaaaaaaaaaaaaaaaattatttaacctcttgatcatcatttctgattgagtatgctaagaagcacattttgatctttgcttttacaa

SEQ ID NO: 47493 - DNA, 201 bp, Homo sapiens
acttataagtcatgttctttgttagctcattaggtaccaattttatatcaatattatttttctgtttgtcattcagtccatttttgttgttgttgttttgktttggttttagagacgaggcaggtgaataggtatagactgaatgctcctaagctagatgataatgaccaaatgattactgagacagggatgagcgatggt

SEQ ID NO: 47494 - DNA, 201 bp, Homo sapiens
ttaagctaagtcattcattttaagaaatgatcccctttaccccaactatagaggtatatactaccttatatactaccatacttaaaaggttagtgaagagrcatagaaagagtagtgaaacagtgaaaccttctagatgccagatgctatacaaatgtgaagcatatgacaccagcatggtgaaaaaggaagctaattaag

SEQ ID NO: 47495 - DNA, 201 bp, Homo sapiens
aattagaaaagatattattttattccaagtgaaacatgtattcacacttcacgtcttgaagcaccagtggccatttgggctgagttttcaagaaaaaaaawttatatagattttatgccctttttttaacctaagagatattaagtaatagctattccactatcagacaatgtgcataaattctagtcagatttttctttt

SEQ ID NO: 47496 - DNA, 201 bp, Homo sapiens
aaaccccatctctactaaaaatacaaaaaattagcctggcgtggtggtatgtgcctgtagtaccagctactcgggaaggtgaggcaggagaatccctttaytcaggaggcagaggttgcagtgagccaagatggtgccactgcactccagcctgggcgacagagctctgtctcaaaaaaaaaaaaaaaaaaaaagagaaaa

SEQ ID NO: 47497 - DNA, 201 bp, Homo sapiens
gggaggccagggcaggcagatcacggggtcaagagatggagacgatcctggccagcatggtgaaaccccgtctttactgaaaatacaaaaattaactgggyatggttacgcatgcctgtaatctcagctactcaggaggctgaggcaggagaatcgcttgaacctgggaggcagaggttgcagtgagctgagatggtgcca

SEQ ID NO: 47498 - DNA, 201 bp, Homo sapiens
atgttgttaaatgaagaaatgtttaaaataattttttttcaaaaacaaatgcatacatttacaataaaagaaaaagataataactgattaaaatgtctccwaaatataaatttagcagaaagtcaacgttcattcaagccctacatatcttacagtactattgtatgaagcagggttttgtcccgagactattttttcctc

SEQ ID NO: 47499 - DNA, 201 bp, Homo sapiens
aatcccaacactttgggaggccagggcaggcagatcacggggtcaagagatggagacgatcctggccagcatggtgaaaccccgtctttactgaaaatacraaaattaactgggcatggttacgcatgcctgtaatctcagctactcaggaggctgaggcaggagaatcgcttgaacctgggaggcagaggttgcagtgag

SEQ ID NO: 47500 - DNA, 201 bp, Homo sapiens
gatagatagatagatagatagatagatagataatagattagatgatagacagaaagaataagagatttattatgaagaattggcttacgtgattatggagsctgcaaagtcccagtatctgtgagctgcagatccatgatatagttcactttgagtccaaaggccagagaatcacgggagctgatggtacaaaccacagtt

SEQ ID NO: 47501 - DNA, 201 bp, Homo sapiens
caggaggctgaggcaggagaatcacttgaacctggtaggcggaggttgtagtgagccaagattatgccactacactccagcctgggtgacagagtgagacwctgtctcaaataaataaataaataaataaataaataaaaagaaaaaagaaaagaaaagaataggaagagcaaatatattaagtggaagtggatcattgta

SEQ ID NO: 47502 - DNA, 201 bp, Homo sapiens
atggttttgcattcagttttgtcatagtgatttctcttcttgttaacagaaagaatggaaatattatggggatgatcctcgagtccatagaactgtgaccygagaagacttcttggatatactatatgatattcattacattcttatcaaagctacttatggaaatttcatgcgacaaagcaggtaaactctaatagaaaa

SEQ ID NO: 47503 - DNA, 201 bp, Homo sapiens
ttcacttgcccaaactatagtagagatagtgtacttacccacagttggacatatgatgttattcctaatagacttaaaaagtgaactcatggcggggcgcrgtggctcacgcctgtaatcccagcactttgggaggccggggcgggtggatcacgaggtcaggagatcgagaccatcctggctaacatggtgaaaccctgt

SEQ ID NO: 47504 - DNA, 201 bp, Homo sapiens
accatttcagttgacaggtctaattttaagttccaccttttcataattgattattcatttgtacacaagtatttgttgagtaccagaaatagcatttagtyatttcaagctttagtttttcatcatcctattctccagatttcagcagcatcagaagccatataaacactgccttcggatggcccttagatggccaccaag

SEQ ID NO: 47505 - DNA, 201 bp, Homo sapiens
cccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatac

SEQ ID NO: 47506 - DNA, 201 bp, Homo sapiens
aagtttcttctctagtattttttaattaatttctgacctcaaaaatcaaattagttcttatcccaaaacaagataaaatatttcctctacccaaccttgtsccctcaatgatttcctcacctcctgccacccacagcaattatgaagaaagcagaagacttttcacttattttccaaacacccactcctaccaggttgtca

SEQ ID NO: 47507 - DNA, 201 bp, Homo sapiens
taactgtagatacattatagattgaaaaataaaaatggatatattggaggatatgcgcaattttattcaaacacatttgaatacttaggtgaagtaaacartaagtttagagcaaaatttactcaaaaagaaatagtacacctgagaactataaccgttaaataaattgcatcagtagttaatacaacaaaataacaatat

SEQ ID NO: 47508 - DNA, 201 bp, Homo sapiens
agacttaaacgttagacctaaaaccatacaaaccctagaagaaaacctaggcattaccattcaggacataggcatgggcaaggacttcatgtctaaaacaycaaaagcaatggcaacaaaagccaaaattgacaaatgggatctaattaaactaaagagcttctgcacagcaaaagaaactaccagcagagcgaacaggca

SEQ ID NO: 47509 - DNA, 201 bp, Homo sapiens
aaggcagttagagaaggaaaatcaaggatagattctagatttttgtcttgagcaactgcatggatggtgatgtcattgaatgtgatggaatagatcgggargggtgcaagatttttcatggagggaaggccagagaagaaacagttctgctatagccatactgaattttaggcaccttttagacatctaaatagaactatt

SEQ ID NO: 47510 - DNA, 201 bp, Homo sapiens
ggaaatgtcttagatgtcttagtgcttttcaatcaggtatatccaaacaacaaacaaacaaataaaataagactaatgcagaatgaattccatagttcagrttcttcaagataatggaaaattatcacataatctccacctgttttgaaacattatcttctttccttcctttcctccctttctccctttctctaagtcagt

SEQ ID NO: 47511 - DNA, 201 bp, Homo sapiens
gctgggtgtggtggtgggcacctgtaatcccagctactcaggaggctgaggcaggagaattgcttgaaccagggaggcagaggttgcagtgagctgagatygcaccactgcattccagcctgggtgacagagcaagactctgtctcaaaaaaaaaaaaaaaaaaactaaactaaacgtgtagttatgtctcatagagaaat

SEQ ID NO: 47512 - DNA, 201 bp, Homo sapiens
aggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctc

SEQ ID NO: 47513 - DNA, 201 bp, Homo sapiens
ataacttttaaatttagcatgtcaattctttaccaaaaagcctgctaggatttggctgaaattatattgaattgatagatcaatttgggaagaattgacakcttaaaagtattagatatcccagtgtatgaacatggcataactctgcatttttttaggttgttataattttttctcagaaatgtttgtagtttttgatgt

SEQ ID NO: 47514 - DNA, 201 bp, Homo sapiens
catgtatcagcagtttgttctaaaaattgcttaataatattccatttgtgtaatgtacagtgacttgcttacctgtttaccatttaatgggtgtttgggtmatttctagtttggggttacaattttgctgtgaacattagcatacaagtcaaaagcatatttatggacaaatgttttctcttttttttcttaagaacactc

SEQ ID NO: 47515 - DNA, 201 bp, Homo sapiens
ccaggataaacgtgaaactcctgagagttggatctacttcctttcagcatctcacccttgcctgcacttctagcctccactctcaaaactctttcacacaycatttgaacctgagacattaaaaatgccttccagggcttggtgcagtggcacacacctgtaatcccagcactttgggaggccaaggccagcagatcactt

SEQ ID NO: 47516 - DNA, 201 bp, Homo sapiens
cagcgaacaaaatgtaaagtgagcaactaagaaatacttataagagctcacttgtattatttaactgtgtaatcctctatctcatatatatgtaatacttkcttcaagttcattatagctcccgggcccagtacatcctagtccagttccaaccatgtctaattttaaaatagctatgctcacttcaaacgaagatgttgc

SEQ ID NO: 47517 - DNA, 201 bp, Homo sapiens
tgtgagcagtctacctaatggaagtttcagtagagaagttaatcaagatatttttaaagatgcattattttgctaaaacaaaatattcaattaaaatacarcatgttgttctcagtccctgaacataccgattgccctgctttcagtatggcaagcaacttcagattcctccatgagggtggacagatttgctctagcgct

SEQ ID NO: 47518 - DNA, 201 bp, Homo sapiens
gacctccttgagacacagttttctagtctacaaagagagtcatgaattttctgtggggactaaaggatttggcacatagagggtatccagtgagttcccargtcctggagatgctcacacatggtagctgtctttggtagcagtgctcatagtagctgtgcatatcagttgttcaccagtgaattctaaggctaagttagt

SEQ ID NO: 47519 - DNA, 201 bp, Homo sapiens
tgcactctggcctgggcgaaagagcgagactccgtctcaaaaaaaaaaaaaaaaaaaaaaaaagtacaatacctttagtcttatatctatttaaaaataargcatttttaaaagatccatgaactcctaacaatgaggttaactacatgtgccatttgagatgtgagtctaatactcagtgttcttctgttttgttttaaa

SEQ ID NO: 47520 - DNA, 201 bp, Homo sapiens
cactgcactctggcctgggcgaaagagcgagactccgtctcaaaaaaaaaaaaaaaaaaaaaaaaagtacaatacctttagtcttatatctatttaaaaakaaagcatttttaaaagatccatgaactcctaacaatgaggttaactacatgtgccatttgagatgtgagtctaatactcagtgttcttctgttttgtttt

SEQ ID NO: 47521 - DNA, 201 bp, Homo sapiens
tatctaagcataataggtgctcaataaattctaggcattgttatcatcattgttattatgtgaccatttttttccccaaagacctgatgttttgtgcaacscatcagtttctgatgaaatattttctttagtttaggctgactttcagtttcctgttactatctctaattctaggttcttcaagtcactgaaaaccacttt

SEQ ID NO: 47522 - DNA, 201 bp, Homo sapiens
aaattagctgggcgcggtggcgggcgcctgtagtcccatctactcggaaggctgaggccggagaatggtgtgaacctgggaggcggagcttgcagtgagcmgagatagcgccactgcactctggcctgggcgaaagagcgagactccgtctcaaaaaaaaaaaaaaaaaaaaaaaaagtacaatacctttagtcttatatc

SEQ ID NO: 47523 - DNA, 201 bp, Homo sapiens
ctcccaactaaaggcacacctgggattctttctgggccactgggctcccgtgctaaataatacaaaaataatgatgaagattctttttttttttttagacrgagccttgctctgtcgcctaggctggagtgcagtggcgcgatctcggctcactgcaagctgcacctcctgggttcacgccattctcctgcctcagcctca

SEQ ID NO: 47524 - DNA, 201 bp, Homo sapiens
gataacttgcatgaaaagaacattccttcttttgcttactttgagtttaattttctcttgtgttccaagtttttttgttttttgttttttgtttttgagayggagtcttgctctgacccccaggctcgagtgcagtggcagatcttggctcactgccagctccgcctcccgggttcacgccattctcctgcctcagcctcc

SEQ ID NO: 47525 - DNA, 201 bp, Homo sapiens
gttcatgaaaaaaaaagcataagattataataagattatagacggtgatgaaagagctaatttacatgtatgttctatgtatgcatttttcaggaagtgayatttgagctgagaattaaaaaccagaaaataccagtcatagaaaaatctgggtagagtttattaccagcaggaataaatgtggggtgctgaggaaaggaa

SEQ ID NO: 47526 - DNA, 201 bp, Homo sapiens
tcaaatttttactatttttccccttctttgttttccctcttataccggtgaagcttgtgaatgttctcatctgggtaataattgtgacccaaagactgggygatgcatttgccctcccaataccattggagagaaatgttctaaatgtgcacccaatacctggggccacagcattaccactggttgtaaggtgagtgaacc

SEQ ID NO: 47527 - DNA, 201 bp, Homo sapiens
ttttgttttgttttgtttttttccagcactctaaatatatcctatcattattacttgtttttcattatttctatcatgaagtaagcggaaagtcttattgytggttcttggaaacaagatcatttttcctttcactccattgaaggctattttttttaattttgcttttggtgttcaggggtttaccacaatgtacttagg

SEQ ID NO: 47528 - DNA, 201 bp, Homo sapiens
caggctgggacctttggcctacaatcagcaaggggctgtgttccctgcaactgcaattcttttgggtctaagtcattcgactgtgaagagagtggacaatrttggtgccaacctggagtcacagggaagaaatgtgaccgctgtgcccacggctatttcaacttccaagaaggaggctgcacaggtctgtaaatatgactt

SEQ ID NO: 47529 - DNA, 201 bp, Homo sapiens
atcaaactctagatatgatgttttgctaacttttgttttttgttgctttggttttttggagtttttttgcacttcaagaagtctttttgatctgaggtagkgtagtcaactctaatttattaagcatgaagtgattggttacaggtattttaacaagtatttggaggagtttggggaagttgaagtacgaacacattattt

SEQ ID NO: 47530 - DNA, 201 bp, Homo sapiens
aaagtgtcaaggccaggtgcaatggctcatgcctgtaatcctagcactttgggaggccaaggcaggtggatcacttgaggtcaggagttcaagaccagccyggccaatatggtgagaccccatttctactaaaaatacaaaaatgggccaggcctggtagcacctgcctgcaatcccagctactcaggaggctgagacact

SEQ ID NO: 47531 - DNA, 201 bp, Homo sapiens
caaatgcgtgcatttaaaatcaccatttgtattttgaactcttctggcttttaactgtagtggaaatttggattgaagacaatggaaaccgtgaggtacartatataaacttgcatccaaccgagaaaaaccactactcttatctgcacttcaatcagcaggaggttctttttcagtttgtttagaaaaagtagggcctgt

SEQ ID NO: 47532 - DNA, 201 bp, Homo sapiens
gctccttatgagagtctaactgatgcctgatgatctgacgtggaacagttttatcccaaactcctcccctgcgtctgtggaaaaattgtctccaacaaaasaagtacctggtgccaaaaattttggggaccactggttaatgtatgttagtgatcagaacatttccagggcctaaggcatgagcctgaatgggctcaaaac

SEQ ID NO: 47533 - DNA, 201 bp, Homo sapiens
tctagtcttttgctgctacaaataatcttgcaatcagttgttttgtgcacgtgtcttttgctttttgtcattgcatctttaggatagtttgtttttttttktttgttttttttttttttttgaggcagagtctctctctgtcacccaggctggagtgcagtggcaggatctcagctcactgtaaactcttgcttcccaggt

SEQ ID NO: 47534 - DNA, 201 bp, Homo sapiens
ggtatcatcagatccaggctctaagtccttacttggggacatattggtcatttggcctgaaacaggccatttaaccttctgaaattcacttggtctcttcygggaagtgcacctaccccagaaagattttgtgaaattaattccagtaatgtagtacaagtgctctgaatctcacagcatgcttcacaaataaggtgaaga

SEQ ID NO: 47535 - DNA, 201 bp, Homo sapiens
tttgcttgttgtaccccctaaatgtcatcctctctctgctcgtactcactgctcaagtaagttcttatttgaaaggacagtaagtatgtcatagttttctrtagtctaagctgtgtcatgttgttcacatccaggtgttaggcaatctataaaacatcttctgttcaccttgtttgcaccttctactcatttgttttgtta

SEQ ID NO: 47536 - DNA, 201 bp, Homo sapiens
acaaaagtccagctctttggcccctaagtggaacaagttttgagatcttattttatgctccagagcactccatggaatcaggctaagactgggacatcacytgaaatcatacccttgattagagcttttcttttccatgtcctgcttcacccactcctttgctagattctcctaggaacacttaaatggtaagcttctttg

SEQ ID NO: 47537 - DNA, 201 bp, Homo sapiens
cttaccctcaaactgcctgtgtttgcataatcatgtggatactacaggatagattctttagactcatcttatgtaggaggaatagtgacatgaaccatcawaagaggagcattaactaaactttgcttgtcttacccatgaaagaacatcagtgtgactccctgccaaatatctgataatgaaaagaaatgcattgtgatc

SEQ ID NO: 47538 - DNA, 201 bp, Homo sapiens
acagttttaaaaacaaaaatcagcatattatctgataaaattattattgctttttgtgaatttaaggaatgttctgaattattgcttcaatattaaaacartaattattggaacattttgatggattatgaagaaagaatatgtaaaattgggatcgtgtggaaaatctggtatgcatgaaattggcatataaagtaggcc

SEQ ID NO: 47539 - DNA, 201 bp, Homo sapiens
aaattttaggctattttttttatttttacttattttttttaggcttttgtttaaaacctgttttttgaccagtgtttttccttctctttctaggactccarctgcatgtgtgctagggcgttcattgtatctgaggcagtgctaagtaattttttttctttctccgttctttagattggatcatttccattcatctgtcat

SEQ ID NO: 47540 - DNA, 201 bp, Homo sapiens
ctgataatgaaaagaaatgcattgtgatcagcaagataaaatgaagaaaataaaaatgtacactgaaatagctgaacgaatgaattaacaacctattttayagcattgtgctggagaagaatgctcatcttacagaggtgattgtgtctaataaaaactgcactggatttgaagtaaaaaataaaaaacaaaaactggatc

SEQ ID NO: 47541 - DNA, 201 bp, Homo sapiens
tcttgtcttcaatatacctaccatagactgtaagggattatttcgagtagtcagttggggtttgatatggtgttaattctttatgcatttacatcattctrtcaatttcaagtgtgttcttttattctttttcttttttctttaatttttccaggctgaaatagttatcttttaaagtctgttctacagcagctgctccac

SEQ ID NO: 47542 - DNA, 201 bp, Homo sapiens
cttcagctaggaagtcatagtcatgactctgctccacatttttacaatctaagaatagtcagatgcccctcttaactgcaaggggctgagaagtgtagggwacacaagaatattttttgagagctactatctctgcttacatataatggcagaagaaatatcctcctaaatctattaaaatcatactatgctctcaaagat

SEQ ID NO: 47543 - DNA, 201 bp, Homo sapiens
ctgcagcctcaaactcctgagctcaagtgatcctcctgcctcagcctcctgagtagctgggactacaggtgtataccaccatgcccagctatttttttttktttgttttaatagagacaagatctcaatatgttgcacaggctgatctcgaactcctgagctcaagcaatcctcccacctcagcctcccaaagttctgggg

SEQ ID NO: 47544 - DNA, 201 bp, Homo sapiens
aaattagccagacatggtggcacgtgtcagtaatcccagctactcaggaggctgaggcagtagaatcacttgaacccgggatgtggaggttgcagtgagcygagatcgcgccattgcactccagcctgggtgacagagggagactctgtctcaaaaaaaaaaaaaaaaaaaaaaaaaaaaaagcctggaatactgatttag

SEQ ID NO: 47545 - DNA, 201 bp, Homo sapiens
tgagggtggttctgtctttcccagccctctgactcaaatgttaatctcctttggcaacaccctcacagacacactcaggtacagtactttgcatacttcartcaagtagacagtcaatattaatcaccacattctccaacgctttctcatacaggttctatttctccactatgaacagtgagattttttttctggtatact

SEQ ID NO: 47546 - DNA, 201 bp, Homo sapiens
ggaaacttctaattaaattgagggaagatgctagcaggccagaatttgggaattagatgatctggctccaaattcaatacatattgtctatgtaattagckgtgtcacctaatgtaccaataatgccttttcaagaaacactgtgcagtctgttctgattcctccattggcttaattcctataataaatatagtttccaaa

SEQ ID NO: 47547 - DNA, 201 bp, Homo sapiens
atggtgcctacccagaatgagggtggttctgtctttcccagccctctgactcaaatgttaatctcctttggcaacaccctcacagacacactcaggtacartactttgcatacttcaatcaagtagacagtcaatattaatcaccacattctccaacgctttctcatacaggttctatttctccactatgaacagtgagat

SEQ ID NO: 47548 - DNA, 201 bp, Homo sapiens
gtaatatcattgtatatctactcatatcttttcctatgcaaatagtttttctacaaatgggtgatatttatataactgtttcataacttactatgggaatkaacatcacatacgtattttaaaaaatattctcaaaaatatatttttaaaatgtatattgaactagattctgagaatttacatcattattatagtaagaac

SEQ ID NO: 47549 - DNA, 201 bp, Homo sapiens
gttaattcttacacagggttttctggagggacagaactaataggattgatgtatatatgaaggggagtttgttaggagaattggctcacatgatcacaagrtgaagtcccacaataggccatctgcaagctgagtagcaagaaagccagttcgattcccagaacctcaaaattagggaagccagcggtgcagccttcagtc

SEQ ID NO: 47550 - DNA, 201 bp, Homo sapiens
tgctttggctgacacttgatgggctgcaaccactgtcctgcacccactgtcagacaagccccagtgaggtgaccctggtacctcaattggaaatgtggaartcacccatattctgtgtcgctcatgctgggagctgtagactggagctgttcctattcgaattatactggtttctaaaaaagattgtaatatattgttgag

SEQ ID NO: 47551 - DNA, 201 bp, Homo sapiens
gcttcccgggtgaggtgatgcctcgccctgctttggctgacacttgatgggctgcaaccactgtcctgcacccactgtcagacaagccccagtgaggtgamcctggtacctcaattggaaatgtggaaatcacccatattctgtgtcgctcatgctgggagctgtagactggagctgttcctattcgaattatactggttt

SEQ ID NO: 47552 - DNA, 201 bp, Homo sapiens
cttcctcctttagctcagagaagtttgatcgtctgaagccttcttctctcaactcctcaaagtcattctccatccagctttgttccattgctggcaaggarcttcattcctttggaggaggagaggcgctctgatttttagagttttcagcttctctgctctgttttttccccatctttgtggttttatctacctttggtc

SEQ ID NO: 47553 - DNA, 201 bp, Homo sapiens
cttgagtctttatccaatttgccagtctgtgtcttttaattggagcatttagcccatttacatttaaggttaatattatgtgtgaatgtgatcctgtcatkatgatgttagctggttattttgctcgttagttgtttcagtttcttcctagcatcgatggtctttacaatttggcatgtttttgcagtggctggtactggt

SEQ ID NO: 47554 - DNA, 201 bp, Homo sapiens
tgcttcttgagaactactatcaacaataaaaaaagctttgattttaacgtgtatatcttaagatttcttttgatcaatactaatgaaaataaacctgaaamgcgaatcattggacaaatgtgagatttttcctttaatttatacattaattgatgtaagatagtatttagaaagtttcaatcctttccagttacaattgta

SEQ ID NO: 47555 - DNA, 201 bp, Homo sapiens
tgcacaaatacgcgtagtctgctgacagtaacctgccaggttctagacttccatattgattactgttagcaaaatgtgtaggtgaaatttttgtagggtaygcacgtgaccattcacagaaggcaagaggttctctttggaatttaattttctgtgtgaaaaataaatcacttttttgtgtgtgtggaacatttctcatgg

SEQ ID NO: 47556 - DNA, 201 bp, Homo sapiens
attttactctctatatcaatatcacacacactaacacttggtgtgcattttagaatatcttgctggttcccagtaaatatgtcaactttttgcactatatrccgcttgaaatgtcaatactgcacaaatacgcgtagtctgctgacagtaacctgccaggttctagacttccatattgattactgttagcaaaatgtgtag

SEQ ID NO: 47557 - DNA, 201 bp, Homo sapiens
gaataaatgccaaaaaacaatatactagatgttacttctcttcaagctctccttggattccccaagtctagtctgatgccctttgtatgttcacatagcaytttggacttctcctattatataatgcttattctatcatgttatgctaacatatttacttgtctccctctactagaccgtaaggtatgtctccaaataaat

SEQ ID NO: 47558 - DNA, 201 bp, Homo sapiens
gactttaattttatatagaatattaggtcagagatctgaaggtgactaggaaaaagttatgtgggtatctggagcaagagcatcttaggacaaagagaaartaagtgaaaaggccctaagatatgaatgtggctggcatgttcaaagaccctcaaggatggggtaagagtggggaagagttgaaggatatggggaagggga

SEQ ID NO: 47559 - DNA, 201 bp, Homo sapiens
gtaatcccaacactttgtgaggctgaggcaagtggatcacctgaggttaggagtttgagaccagccttaccaatatggtgaaactccatctctactaaatmcaaaaaaaaaaaaaaaaaaaattagccaggcgcagtggcacctgcctgtaatccagctacttgggaggctgaggcaggagaattgcttgaacctgggagg

SEQ ID NO: 47560 - DNA, 201 bp, Homo sapiens
ttacactgaaggataattagagcatgaaatgaccatgaaaaaatatatttgcatagttgtgcagaaacattaacatgcaattatgtcttgatactagatayaaaatatctgaaatggaagatggaagatttagtgggatcttttaccaataacttcaacagaagatttgtgttttagaatgtgtcctagagacaggacctt

SEQ ID NO: 47561 - DNA, 201 bp, Homo sapiens
gttttcatctgactttatagtttaaaattgatagccattttgatggcaacacacatggtttagttaaattttactccgtcctcagttttcctgagggagtrtcagctactgtgttttctttacaaaacaacataaattccatgtatccaccctgggaatcacttcactgcgttgaatctggataggaaataaagattcatg

SEQ ID NO: 47562 - DNA, 201 bp, Homo sapiens
caaagttaatatatttcctgggtactcattcacactcttctgccaatagtattaatgctttgggaaatgtttgagaagtgttgttccagtggaaatgagcytgtgggttcactgattcatttatccattcattcatttattccttcatacagtatatagctttcaagccacttttatggactattttattaactttgaata

SEQ ID NO: 47563 - DNA, 201 bp, Homo sapiens
tataatcacattttatgaataagttttatttcacttaacagatttatttattttttaaaaccacaactttaattcccaagtaactcttagaagtttctccyttttggattttcattttgatgtttagtaggcttaaattccagtgtttaacacaacccccagcttttgagtcacagtttatttcattatagtagacccctg

SEQ ID NO: 47564 - DNA, 201 bp, Homo sapiens
gcctacaaaggcaggcaggcctccttgagctgtggtgggctacacccagttcgagcttcccggctgctttgtttacctaatcaagcctgggcaatggcagrcgcccctcccccagcctcgctgccgccttgcagtttgatctcagactgctgtgctagcaatcagtgagactccgtgggcgtagtaccttcccagccaggt

SEQ ID NO: 47565 - DNA, 201 bp, Homo sapiens
aaacttaaattaggtttcaaatataaggcaaggttttgttgttttgtttgtttgtttactcactacataaatgaccagtggcccattcagaagtctaaggrcaaaatatgttgtaggactgtcctgaccactgagggacagctcacaccctgacccaacagtacactaatgcctgcagtacccaccgttcccggagtaaac

SEQ ID NO: 47566 - DNA, 201 bp, Homo sapiens
aaagtcaggggatgtgtttagttcttaatttgcttgacttctgtagcacgtcataatgctgctcagttatgtccttacaacaccgccagttatcatgcatygagtcacttctgcatctcttaatttccatagtgttatgctctcctaatttctccttttcctctgtggaatgccagtcaccttgccagctccactttctct

SEQ ID NO: 47567 - DNA, 201 bp, Homo sapiens
ccctttcatggaggtaatgatgatgctagttggttttcttccaaatgtgcaaattacatgagtagcacaaaatgctagaagaaatgaaaaaatggaaattmactgctagtgaaggccaagagggcatttgaacaaatggcaaagagagattttacatcttcccctctctctgcctccttctggagcgctatcaatgaacaa

SEQ ID NO: 47568 - DNA, 201 bp, Homo sapiens
gctaagaaatgaaatttctacagttccattttcttaagtgttgaagactttcaagctaatatcaaaagagcagccctttattctcaaagaatttgtatagmtatcacagtcataatcagactggctttatttcagagagtatgcttttggtagcctatccaaagattttattttagtataaacagtaaaaataacagaagt

SEQ ID NO: 47569 - DNA, 201 bp, Homo sapiens
aacttggaccttattcaaaactatattgagacagtttgtgattctctaattcattatctgtagttagactatccatatctttttagtaaaagagaagaagrcttatatattagcatatgcaacacatagaaaaatgaagtataaacctttcagggtactctaaaccttgtaatttttaaagaaacaatgttatacacacac

SEQ ID NO: 47570 - DNA, 201 bp, Homo sapiens
cttccatttgaattcaagtatttgggtttcttccctcacttacatttctttgacatgaaacgctgcactagaaatattcttagtagctgggtcaactgccrctatgtggcatgcattccttgtcttggatggctttgaagatattctcaaacattatttttgcaatctttgaaaaagtacaaaaggtagataactttgtac

SEQ ID NO: 47571 - DNA, 201 bp, Homo sapiens
cacactgatgggtcttgagtctttatccaatttgccagtctgtgtcttttaattggagcatttagcccatttacatttaaggttaatattatgtgtgaatrtgatcctgtcattatgatgttagctggttattttgctcgttagttgtttcagtttcttcctagcatcgatggtctttacaatttggcatgtttttgcagt

SEQ ID NO: 47572 - DNA, 201 bp, Homo sapiens
gtatcagtttctgtcagttactgctcttactcgatgtgggattgaaaatgtttaaagaaaatatcttgctatatatatataaaaaacaaattatatagcawatatatatatatatatatatatatatatatatatagtgggtagaaaaaagacaattgtaacatcaagggtatttttgttgttttaaagtgtcatgttttg

SEQ ID NO: 47573 - DNA, 201 bp, Homo sapiens
agaccgaggtgggcagatcacctgaggtaaggagtttgagaccagcatggccagcgtggtgaaaccctgtctctactaaaaacgcaaaaattagctgggcwtggtggtgggtgcctgtaatcccagctactcaggaggctgaggtaggagaattgctggaacccaggatacggaggttacagtgagctgagattgcgccac

SEQ ID NO: 47574 - DNA, 201 bp, Homo sapiens
acatgagatgggtctcttgaatacagcacactgatgggtcttgagtctttatccaatttgccagtctgtgtcttttaattggagcatttagcccatttacrtttaaggttaatattatgtgtgaatgtgatcctgtcattatgatgttagctggttattttgctcgttagttgtttcagtttcttcctagcatcgatggtc

SEQ ID NO: 47575 - DNA, 201 bp, Homo sapiens
gagcctgtgtgtgtctctgcacatgagatgggtctcttgaatacagcacactgatgggtcttgagtctttatccaatttgccagtctgtgtcttttaattrgagcatttagcccatttacatttaaggttaatattatgtgtgaatgtgatcctgtcattatgatgttagctggttattttgctcgttagttgtttcagtt

SEQ ID NO: 47576 - DNA, 201 bp, Homo sapiens
acttttacactgttggtgggactgtaaactagttcaaccattgtggaagtcagtgtggccattcctcagggatctagaactagaaataccatttgacccasccatcccattactgggtatatacccaaaggactataaatcatgctgctataaagacacatgcacatgtatgtttattgcggcactattcacaatagcaaa

SEQ ID NO: 47577 - DNA, 201 bp, Homo sapiens
tatgtaatggccttctttgtctcttttgatctttgttggtttaatgtctgttttatcagagactaggtttgcaacccctgcctttttttgttttctatttscttggtagatcttcctccatccctttattttgagcctgtgtgtgtctctgcacatgagatgggtctcttgaatacagcacactgatgggtcttgagtctt

SEQ ID NO: 47578 - DNA, 201 bp, Homo sapiens
catagtattccatggtgtatacatgccacattttcttaatccagtctatcattgatggacatttgggttggttccaagtctttgctattatgaatagtgcygcaataaacatacatgtgcatgtgtctttatagcagcatgatttataatcctttgggtatatacccagtaatgggatgactgggtcaaatggtatttcta

SEQ ID NO: 47579 - DNA, 201 bp, Homo sapiens
atctcctggattcactgatttgttgaagggttttttgtgactctatctccttcagttctgctctgatcttagttatttcttgccttctgctagcttttgartgtgtttgctcttgcttctctagttcttttaattgtgatgttagggtgtcaattttggatctttcctgctttctcttgtgggcatttagtgctataaatt

SEQ ID NO: 47580 - DNA, 201 bp, Homo sapiens
ttctgtaggttgccagttcactctgatggtagtttcttttgctgtgcagaagctctttagtttaattagatcccatttgtcaactttggcttttgttgccmttgcttttcgtgttttagacaaaaagtccttacccatgcctatgtcctcaatggtattgcctaggttttcttctagggtttttatggttttatgtctaac

SEQ ID NO: 47581 - DNA, 201 bp, Homo sapiens
catgagaaaaggcgataatcatctttcatatcaaatattagaacaatgcaagagaaatatggtgattttactctctatatcaatatcacacacactaacayttggtgtgcattttagaatatcttgctggttcccagtaaatatgtcaactttttgcactatataccgcttgaaatgtcaatactgcacaaatacgcgtag

SEQ ID NO: 47582 - DNA, 201 bp, Homo sapiens
taatttgcatagaggtgtttatagtattctctgatggtagtttgtatttctgtgggatcggtggtgatatcccctttatcattttttattgcatctatttsattcttctctcttttcttctttattagtcttgctagcagtctatcaattttgttgatcttttcaaaaaatcatctcctggattcactgatttgttgaagg

SEQ ID NO: 47583 - DNA, 201 bp, Homo sapiens
ctgggtacttgagatcagggagtggtgatgactcttaacgagcatgctgccttcaagcatctgtttaacaaagcacatcttgcacggcccttaatccattyaaccctgagtggacacagcacatgtttcagagagcacggggttgggagtaaggtcatagatcaacagcatcccaaggcagaagaatctttcttagtacag

SEQ ID NO: 47584 - DNA, 201 bp, Homo sapiens
cctgttattggtctattcagagattcaacttcttccttgtttagtattgggagggtgtatgtgtccaggaatctatccatttcttcaagattttctagttwatttgcatagaggtgtttatagtattctctgatggtagtttgtatttctgtgggatcggtggtgatatcccctttatcattttttattgcatctatttga

SEQ ID NO: 47585 - DNA, 201 bp, Homo sapiens
ttggctattatgataaaaacttctatgaacatttttgtttaggtctttttaaggacatgtaatgtcatttatcttggatatgtacctaacaggggaaaatktgaaggacttttatatttattaaaaactacctgttttctaaaagggttgtgctaatttacattcccaacagcaatgcagcagacttttgattgttttaca

SEQ ID NO: 47586 - DNA, 201 bp, Homo sapiens
ttaccccaattcctggcaaccaccattcattccaccattctactctctgcttctatgagttcaactttttagattccacatgtgagtgagatcatactgtrtttgtttttctatgtgtggcttatctcacctagcacaatgcccttcaggcttatccatgtcattgcaaatagcaggatttccttctcttttatggctgaa

SEQ ID NO: 47587 - DNA, 201 bp, Homo sapiens
ccatttattaaatagggaatccattccccattgcttgtttttgtcaggtttgtcaaagatcagatggttgtagatgtgtggtattatttctgagggctctwttctgttccattgatctacatctctcttttggtaccagtaccatgctgttttggttactgtagccttgtagtatagtttgaagtcaggtagcatgatgcc

SEQ ID NO: 47588 - DNA, 201 bp, Homo sapiens
acattcctaactcatagaaataactgttgacattttgtcatgttttcttttcttactagagaaagaaaatgagataaaactaacctgcatttctatcctasttttctgcctgtcttagaggcaaacaccaacacaggtttgttgtcaatttccttcccattaaaaatacttttacatacctactgtgtatctatagccaac

SEQ ID NO: 47589 - DNA, 201 bp, Homo sapiens
tttttcttgtaagtttgtttgagttctttgtagattctggatattagccctttgtcagatgagtagattgcaaaaatcttctcccattctgtaggttgccwgttcactctgatggtagtttcttttgctgtgcagaagctctttagtttaattagatcccatttgtcaactttggcttttgttgcccttgcttttcgtgtt

SEQ ID NO: 47590 - DNA, 201 bp, Homo sapiens
tgtggatgcagatatctccttgagatactgatatcaccttttaaaatatatagctagaaatgggattgctgggtcatattgtagtactattttcatttttkgaagaatctctatgcttaatgctgttttccatagtggctatgcctatttacattcccaccaaaagtgtagaagggtttctttttctctgtttcctcacca

SEQ ID NO: 47591 - DNA, 201 bp, Homo sapiens
cgggcatggtggcacatgcctgtaatcccagctactcgtgaggctgaggcaggagaatcgcttgaacctgggagacaagaggttgcagtgagccaagatcrcaccactgcactccagcctgggagacagagcaagactccatctcaaaaaaaaaaaataaaaattaaaaaaaaagcctgaacctagaaacggacctacaaa

SEQ ID NO: 47592 - DNA, 201 bp, Homo sapiens
caagtaatttatttatgagcatgtgttttactgtttttaaaactgggatgactttaatttaaatgaacagtgatttgagatttatagcttccctttctttrtgtcatggataatttctctgtgctaaggtgtgagcatacacatcatttgggctgttattgaagtagaatacgaagcctgccttctttcactagcagggga

SEQ ID NO: 47593 - DNA, 201 bp, Homo sapiens
cttttcagctgtgaaaactattattactaagtattaaaacaaactgagggcaaggcacggtggctcatgcccgtattcccagcactgtgggaggccgaggmgggtggatcacttcagatcaggagttcaagaccagccttgccaacgcggtgaaaccctgtctctactaaaaatacaaaaattagccgggcatggtggcac

SEQ ID NO: 47594 - DNA, 201 bp, Homo sapiens
gccataaaaaatgatgagttcatgtcctttgtagggacatggatgaaattggaaatcatcattctcagtaaactatcacaaggacaaaaaaccaaacaccrcatgttctcactcataggtgggaattgaacaatgagaacacatggacacaggaaggggaacatcacactctggggactgttgtggggtgggggggagggg

SEQ ID NO: 47595 - DNA, 201 bp, Homo sapiens
tactatgcagccataaaaaatgatgagttcatgtcctttgtagggacatggatgaaattggaaatcatcattctcagtaaactatcacaaggacaaaaaamcaaacaccgcatgttctcactcataggtgggaattgaacaatgagaacacatggacacaggaaggggaacatcacactctggggactgttgtggggtggg

SEQ ID NO: 47596 - DNA, 201 bp, Homo sapiens
ataaagacacatgcacacgtatgtttattgtggcactattcacaatagcaaagacttggaaccaacccaaatgtccaacaatgatagactggattaagaamatgtggcacatatacaccatggaatactatgcagccataaaaaatgatgagttcatgtcctttgtagggacatggatgaaattggaaatcatcattctca

SEQ ID NO: 47597 - DNA, 201 bp, Homo sapiens
gcattttgaggtcaggagttcgagagcagcctggccaacatggtgaaaccctgtctctactaaaaaacatccaaaaattagccaggcatagtggtgcacgyctgtaatcccagctacttgggaggctgaggcagaagaattgtgtgaaccgggcaggcagaggttgcagtgaactgagatggtgccactgcacttcagcct

SEQ ID NO: 47598 - DNA, 201 bp, Homo sapiens
atcaggaggagaatatagcaacttcgtcttctggaaacaactttggtcttgacttgaaagcagatgacaaaatatattttggtggcctgccaacgctgagwaacttgaggtaatttagtttatatgtaaagctaaggattaagttttaattaaatgaccactatgctcactagagttctgaagtttaattacaataagaat

SEQ ID NO: 47599 - DNA, 201 bp, Homo sapiens
tagaatggcagtcattaaaaagtcaggaaacaacagatgctggagaggatgtggagaaataggaacacttttacactgttggtgggactgtaaactagttyaaccattgtggaagtcagtgtggtgattcctcagggatctagaacttgaaataccatttgacccagccatcccattactgggtatgtacccaaaggacta

SEQ ID NO: 47600 - DNA, 201 bp, Homo sapiens
actgtgttgttttggctcacagaatataaagcgtgtatgtatatacctgtgtttccacatagacacactctgttacccttatatgtattgtataatcacaygtgtagatgttcattgtatctggagtgacagttgacaccttttaggggcattttacatgttttaaaacctgacatccacttacagcacttatctactact

SEQ ID NO: 47601 - DNA, 201 bp, Homo sapiens
agacatttatacagccaaaaaacacatgaaaaaatgctcaccatcactggccatcagagaaatgcaaatcaaaaccacaatgagataccatctcacaccarttagaatggcagtcattaaaaagtcaggaaacaacagatgctggagaggatgtggagaaataggaacacttttacactgttggtgggactgtaaactagt

SEQ ID NO: 47602 - DNA, 201 bp, Homo sapiens
gttttcatgtggcatgtttgtttactaatttacaaaatttgttttaccccctgcagctgtaaatgaaaaagctataaaactaaatgaaactctaggaactygagacgaggcctttgagagaaatttggaagggcttcagaaagagattgaccagatgattaaagaactgaggaggaaaaatctagagacacaaaaggaaat

SEQ ID NO: 47603 - DNA, 201 bp, Homo sapiens
attatagatcttgaaactgtgactaaaaaccccatgcacagagaaaattcttgagtcaaatggcttcattgatgaatagaagttagaatactggttattgytacaaggagagggaagataatgactgggagagggtatgtggaaagtttcatttcttatttttgattatataattgtacaataataatgtgttagtacata

SEQ ID NO: 47604 - DNA, 201 bp, Homo sapiens
gcagtctccaagaacccaggaagtatgtgatccataggagtgtacatattttattttctttaaaaaataagacagacacttctcaaaagaagacatttatrcagccaaaaaacacatgaaaaaatgctcaccatcactggccatcagagaaatgcaaatcaaaaccacaatgagataccatctcacaccaattagaatggc

SEQ ID NO: 47605 - DNA, 201 bp, Homo sapiens
gttcgaatcagaaccattgccagaatctgacagaaatagcgtatcaagatacaagtgcatctgcttaaatattgaattttatttacatccatgaccaggastctatggtacataatccttcctctgcttttttagtgttatttcctaattggaaaaaattatgagatgctattagcttttcctaaatatttatatacagac

SEQ ID NO: 47606 - DNA, 201 bp, Homo sapiens
gaaggcctgtggcagtcattgggtttactaactccagataccaaagtggtttctgagggtgtggttattaactcaggctatcatcattcattggtaatttmtgtgccagatattgtgcctgagatccaggaggaataaggtaggatatcgtctttgagctactgatatatagtgtggtaagtacaaaggaaagaatgagca

SEQ ID NO: 47607 - DNA, 201 bp, Homo sapiens
ctggactggaagtgtttatattctttttaaaagaatagcagtttttattccagaaaaaaatattaaattataggattgtttttgatatctagactcttttkctaaagcacagttaattatcttataattatgctgtatagattttccatatactgctcttaagcattagtgatttccacttacttctaggaatgttttctc

SEQ ID NO: 47608 - DNA, 201 bp, Homo sapiens
gcagtgtttgtgtccctgggtacttgagatcagggagtggtgatgactcttaacgagcatgctgccttcaagcatctgtttaacaaagcacatcttgcacsgcccttaatccattcaaccctgagtggacacagcacatgtttcagagagcacggggttgggagtaaggtcatagatcaacagcatcccaaggcagaagaa

SEQ ID NO: 47609 - DNA, 201 bp, Homo sapiens
aataaataaacgttttcagatttttttttctaacttttgagcaaggtttttaaaaactttttggtatatagtttgtttatgctgcctatgcaattatcttstctttggtgaaaaaaataaaacttatttcattacacatgtaaagcatcaataagaagtcagttaattcctgtacctcatgtttaaatgctgtgggtgaga

SEQ ID NO: 47610 - DNA, 201 bp, Homo sapiens
acttgtcccatgtgatattaagaaaagggccaatcctccagttacaaagctacaccagttttataattcttatttgctttattcttgccccacaaggaaaygtatttacaggggttatacatggtatttagttcagttgctggactggaagtgtttatattctttttaaaagaatagcagtttttattccagaaaaaaata

SEQ ID NO: 47611 - DNA, 201 bp, Homo sapiens
gaatcgcttgaacccaggaggcggaggttgcagtgagctgagatcgtgcctctgcactccagcctggtgacagagcgagactccatctcaaaaaaaaaaawaataataataataagggtaaatacaaggagtgtgttttgaatacaaaatatctatttttagaatctcaaacccatgagttactttcttccatatataagt

SEQ ID NO: 47612 - DNA, 201 bp, Homo sapiens
ctttttataaaacattacattttctaatgaaataaataatactttatgaatgtttaatatttctctaaccaacaattacattagctttccttatgtcacaytgacagaatgtctcattgtgttggggccagagagcacagagatgaggggggaataaatgtatcaggaacaataaatgagatagtgattaagtgaaaaagt

SEQ ID NO: 47613 - DNA, 201 bp, Homo sapiens
agcaaggtttttaaaaactttttggtatatagtttgtttatgctgcctatgcaattatcttgtctttggtgaaaaaaataaaacttatttcattacacatrtaaagcatcaataagaagtcagttaattcctgtacctcatgtttaaatgctgtgggtgagattattgttaaaggggagaaggactacaaaaagactcctt

SEQ ID NO: 47614 - DNA, 201 bp, Homo sapiens
tccagctctttggcccctaagtggaacaagttttgagatcttattttatgctccagagcactccatggaatcaggctaagactgggacatcacctgaaatyatacccttgattagagcttttcttttccatgtcctgcttcacccactcctttgctagattctcctaggaacacttaaatggtaagcttctttgtaaatat

SEQ ID NO: 47615 - DNA, 201 bp, Homo sapiens
ctgtcctctccagtttatctgtgttatggattgtaagagtgttttgaaataatattttacttagtaaagtaatatccacaagcatttcaccatgaaaaacrttaaacattttaagtatataatatgaaatataccatctctgatgattatttttattgaccatattcttgccaactctaaggtactctaacactagaattt

SEQ ID NO: 47616 - DNA, 201 bp, Homo sapiens
gtgaaaaaaataaaacttatttcattacacatgtaaagcatcaataagaagtcagttaattcctgtacctcatgtttaaatgctgtgggtgagattattgytaaaggggagaaggactacaaaaagactccttctgcaggataacatgaacatccatttagaccaaccagtagataatggaaaccagagtttgctgggtac

SEQ ID NO: 47617 - DNA, 201 bp, Homo sapiens
actatgcttgagtcattccaaattacacaccttcctctaaacattagtgtgaaattaggacatttgggaaatgtgattgatatgatttgcatgtttgcccycttcaaatcgcatgttgaaatggtattcccagtattggacgtggggactggtgggaggtgattggatcatggggacagatccctcatgaatggtgtagca

SEQ ID NO: 47618 - DNA, 201 bp, Homo sapiens
aatttatactcccctcttagatattaataaaagctcaatgtacaggtagctagggtgccccccgtcttccctgctggatttgtaggtcctgctcatgcagrggggttatttcccagcatgtggatgctctatttgactccactgtaggccaaccaccccttctcatcaatcatgttgcaattattttttacacaattacgt

SEQ ID NO: 47619 - DNA, 201 bp, Homo sapiens
tttaaatgctgtgggtgagattattgttaaaggggagaaggactacaaaaagactccttctgcaggataacatgaacatccatttagaccaaccagtagayaatggaaaccagagtttgctgggtacacgtgtgcacagtttgatagacatgtgcctgcatgtgtctgctccacaaggcttccttcccatagtcagagact

SEQ ID NO: 47620 - DNA, 201 bp, Homo sapiens
gtcttttatataatagccatgctaataggtatgaggtgatatctcactgtggttttgatttgtatttccctgatgattaatgatgttgaacactttttaayatacctgttggccatttgtatgtctctttttggaaacatgtctattttttagatatgtttaggtcctttgtccattttgaaattggcttattttgtgttt

SEQ ID NO: 47621 - DNA, 201 bp, Homo sapiens
ctcttaaaatatccataagcaagagtcaatagtcaacagcaaatattagcaagaattttatagaaactcaatagtgatcagcttgtttttaaaatgaaaaygttaaatatgtcattctcatacatttttaattatcctatcataatacaattattcattttgtctgctgcttctaatcaaaattatcttaaaccactccaa

SEQ ID NO: 47622 - DNA, 201 bp, Homo sapiens
acccccaaatcttaaaatcttagcattatagaggtttatttctcaatgatgcaatgacaaatacaggtccatctggtgactcagggtcccagttgtcctcygcttatgatgtttccaactcaggaaatgccttttatggttgctatggcagaggaagagaggagtggggagctggcacctaggtcttcagtgcttcagcta

SEQ ID NO: 47623 - DNA, 201 bp, Homo sapiens
tggcaggtcaaagcaggaggatcgtttgagcccaggagtttgaaactaggctaggcagcatgataagaccctttctctacaaaaaatgtttaaaaattaamtgggcatggtcgtgcacaactgtgattccagctattcaggactgctattcagctgttcacgccaccacactctagcctggatgacagagtgagactctgt

SEQ ID NO: 47624 - DNA, 201 bp, Homo sapiens
ctggatgacagagtgagactctgtctcaaaactttttttaaaaaagagtatcaattttgcaaggacataaactttagtatctatatcccctgtccatttgrttctgttaaaagcaatccctcaactgcccagatttaagcatcatacctcttattgccttggtattctttaatatcttcaatcacattttttaaaacgtaa

SEQ ID NO: 47625 - DNA, 201 bp, Homo sapiens
ttcgagaccagcctggccaacatagtgaaatcctgtctaatttgtatactaaaaatacaaaaaattagccaggcatggtagcaggtgcctataatcccagytacttgggaggctgaggcaggagaattgcttgaacctgggaggccgaggttgcagtgagccgagattgtgccattgcactccagcctgcgcgacaatgtg

SEQ ID NO: 47626 - DNA, 201 bp, Homo sapiens
aaaattctaataaacttattaacttgctcttcaaacaatggaatcaatctgcacgtccactagcactcttgtgaacacttggcattatcatacatttaatwttccccaatctcaaaaataagaaatgacatcttactgttgcttagttttacagttctttatgataatcttgagtgctttttacgaatttcataaatgatt

SEQ ID NO: 47627 - DNA, 201 bp, Homo sapiens
accttttaaaatatatagctagaaatgggattgctgggtcatattgtagtactattttcatttttggaagaatctctatgcttaatgctgttttccatagyggctatgcctatttacattcccaccaaaagtgtagaagggtttctttttctctgtttcctcaccaacatgtgttatcttttgtcttttatataatagcca

SEQ ID NO: 47628 - DNA, 201 bp, Homo sapiens
ttatgaaaatgcaattttgatgtcttgttcataatggtctacagaaaaagaaggaggctgttgaaagcggcaaacgacaaattgagaacactttaaaagarggcaatgacatactcgatgaagccaaccgtcttgcagatgaaatcaactccatcatagacgtgagtattgggtaaaactcaaaagagagatgataatgaa

SEQ ID NO: 47629 - DNA, 201 bp, Homo sapiens
aagggtttagaattttagaattgtgctttgcaaaaaggaagcacaatatatgaatgctagttcttattaccccgagagagacacatttatgggaacctatmcagtttctcactgggtctggatagccactctctcccatatttattttacctcattaatctcaattactgaccatgaatgtctgctccttaagtttgttta

SEQ ID NO: 47630 - DNA, 201 bp, Homo sapiens
ttgactccacaattggttagctcatgaccttaggcaacttacttaacctttctgtgcctcagtttcaccactcaataaaaaagtggtgagaatgacaactstctgccagggttgtcctgaggagtaaatgagtacatatttgtaaagagtttagatttgtaaagggtttagaattttagaattgtgctttgcaaaaaggaa

SEQ ID NO: 47631 - DNA, 201 bp, Homo sapiens
agtaattttgtttcattttccatctgcaaaattcatctattaaattaagataataatagtatctaccacacatggtttttgttacaattagttgagttagyggctataaaatatttagagtaatgcctagcatgtaagtgctatggaagcatttatcattattattattatctttattagttttattaattgtgttataca

SEQ ID NO: 47632 - DNA, 201 bp, Homo sapiens
tatagtaacaaattataaatgagaccaagaatattattttaaattatagaaagatgacagcatttaataaatgcagacctactagcattctggcccaaagmaacaccatagaaaaaaaaaagcacaaaacaggaagaatagtaatatgactgaggacatgacttgcacaaaatagcctggatttgtctaaatggctccttc

SEQ ID NO: 47633 - DNA, 201 bp, Homo sapiens
aacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgacaa

SEQ ID NO: 47634 - DNA, 201 bp, Homo sapiens
tgcagatgaaagtaaagagtgaacattagccttgatttatatgctgctaatttcgaactgacccttattccaacaatcactagtttgaatattacctttgyttactaatgtcatggattcaacctggataatgctcacatactctcagcaccatggtaagattttaaaacattgttattcactgttgtggcaaatttaagt

SEQ ID NO: 47635 - DNA, 201 bp, Homo sapiens
gaacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgaca

SEQ ID NO: 47636 - DNA, 201 bp, Homo sapiens
aatgttcgatttttctggtaccagtcttatcttagtttaagctcaaaccccacgccaatgcatttcaactttccctttttcctattgcaaaattggtatcyggatcaagaaaagtcaaggtgttttttttttcctggtaccccaaaaacatcttttcatctacttttggctgccttgaaaactatgatgttctaagagaga

SEQ ID NO: 47637 - DNA, 201 bp, Homo sapiens
agaacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgac

SEQ ID NO: 47638 - DNA, 201 bp, Homo sapiens
ctttcaggtctagaaagtctctcaactactttcattccattcttagaggcacaggaatcattcagcttctttcattccatgctaagacccaccaacatctstaccatcatcatttttccatctgcctttccaaatccatcccattttctatttgaaaaaggatgagctacatttgtggaactggtggctttcagagctcgg

SEQ ID NO: 47639 - DNA, 201 bp, Homo sapiens
ctctctggctgcccttaacattttttccttcatttcagctttggtgaatctgacaattatgtgtcttggagttgctcttctcgaggagtatctttgtggcrttctctgtatttcctgaatctgaacgttggcctgccttgctagattggggaagttctcctggataatatcctgcagagtgttttccaacttggttccatt

SEQ ID NO: 47640 - DNA, 201 bp, Homo sapiens
aagaacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtga

SEQ ID NO: 47641 - DNA, 201 bp, Homo sapiens
gatttaattctttaactattaactaaatacctttcacgttaaatcaacatatcttaatttgtttaaaaatttgtaaaaaaaaaaaaaaggcaaagtttttwaaaaaattaataagtcgtatctataatttattatggcaatatgctttcatactttttcagtataaaagggtttatcaaatcaatcatattattccatttt

SEQ ID NO: 47642 - DNA, 201 bp, Homo sapiens
ggccagaacttccaacactatgttgaataggagcggtgagagagggcatccctgtcttgtgccagttttcaaagggaatgcttccagtttttgcccattcwgtatgatactggctgtgggtttgtcatagatagctcttaatattttgaattacgtcccatcaatacctaatttattgagagtttttagcatgaagggttg

SEQ ID NO: 47643 - DNA, 201 bp, Homo sapiens
accagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaact

SEQ ID NO: 47644 - DNA, 201 bp, Homo sapiens
tagcatggtttttagcatgaaaaataaatttataaatttataaagcttaacttgctttaaaatttgattataaattatctgaaaaatatttttggcaccaraacaaaatctaaacttctgcaatagtgtaggtctatatttaaaagacattttaactcaaagtccatttgaagtaagccaggaagtattcaatgtcacatg

SEQ ID NO: 47645 - DNA, 201 bp, Homo sapiens
aatgtttgtaacaaaagcagctggagaagatgatcatagcaattatgcagacagccatagaaatgagcaaaaccagccatcgaatgctgccatcaaaaaayggacctatgacaacagggggcatgtgggttgcaaatactggttacataaattggtccgacaacattctattgtccggcgtagctgggcttttggagaatc

SEQ ID NO: 47646 - DNA, 201 bp, Homo sapiens
caccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaac

SEQ ID NO: 47647 - DNA, 201 bp, Homo sapiens
actgttcagctgaccctgcattttagcttcttgtttatttttcatggttttaacccaccattaagtagcatggtttttagcatgaaaaataaatttataawtttataaagcttaacttgctttaaaatttgattataaattatctgaaaaatatttttggcaccagaacaaaatctaaacttctgcaatagtgtaggtcta

SEQ ID NO: 47648 - DNA, 201 bp, Homo sapiens
ccagcacttctggagccaggtagcgtttggtgcccaccctggtattcaagggcacatcaacttcatttgtgtcactgttgaatttaacagcaaggcccagrtcagcaatgcagcaactcccatttttcttgatgaggatgtttttgctctttaggtctcgatgagcaattgcgggctttccttgggtgccatacgtttctg

SEQ ID NO: 47649 - DNA, 201 bp, Homo sapiens
gcattcttactgttcagctgaccctgcattttagcttcttgtttatttttcatggttttaacccaccattaagtagcatggtttttagcatgaaaaataawtttataaatttataaagcttaacttgctttaaaatttgattataaattatctgaaaaatatttttggcaccagaacaaaatctaaacttctgcaatagtg

SEQ ID NO: 47650 - DNA, 201 bp, Homo sapiens
acaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaa

SEQ ID NO: 47651 - DNA, 201 bp, Homo sapiens
ggcattcttactgttcagctgaccctgcattttagcttcttgtttatttttcatggttttaacccaccattaagtagcatggtttttagcatgaaaaatawatttataaatttataaagcttaacttgctttaaaatttgattataaattatctgaaaaatatttttggcaccagaacaaaatctaaacttctgcaatagt

SEQ ID NO: 47652 - DNA, 201 bp, Homo sapiens
ctgtgacagatgccggcctggcaaattcggactcgatgccaagaatccacttggctgcagcagctgctattgcttcggcactactacccagtgctctgaarcaaaaggactgatccggacgtgggtgagtagggaactgctgagccatgtaatggtataatgttagttcctgctggtgtcttttagtcaggcactgagggg

SEQ ID NO: 47653 - DNA, 201 bp, Homo sapiens
cacctcccgggttcatgccattctcccacctcagcctcctgagtagctaggactacaggcgcccgccaccacgcctggctaattttttgtatttttagtaragacggggtttcactgtgttagccaggatggtctcgatctcctgacctcgtgatcggcccgcctcggcctcccaaagtgctgggattacaggcgtgagcc

SEQ ID NO: 47654 - DNA, 201 bp, Homo sapiens
tacaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtaca

SEQ ID NO: 47655 - DNA, 201 bp, Homo sapiens
gctgaggcaggagaattgcttgaacctgggaggccgaggttgcagtgagccgagattgtgccattgcactccagcctgcgcgacaatgtgagactccgacycgaaaaaaaaaaaaaaagaaaaagaaaaaaaagaaaatctaaaaataatataatcttgtcaatagatagtaaaaacatttggtaaaatttaacagtcatt

SEQ ID NO: 47656 - DNA, 201 bp, Homo sapiens
aaatcttaaacccacattccaaacaaataagaaatagggtataagtaatcaggtaattatgaaactctaagaatcagccattgaaactgtaaaaaaaaaaataaagctgacctattacaatactaaagtaatacaaagtttaatgtacctttttgcacatagcaggcctcagtaaaaagctgttaaataaatactttttaa

SEQ ID NO: 47657 - DNA, 201 bp, Homo sapiens
ggaccagaaggaataggtgagggtctcagtgctaatgtagggttaatccagggccaagtagacaaaaataataataaaaccacaacaataataataataayaaatgatggctagcatttgttgcacatttattttatggagggtgttaatctaagaaatttcccatgtataaattcatatatactaatacttgtcgcattt

SEQ ID NO: 47658 - DNA, 201 bp, Homo sapiens
tgaggcaggagaattgcttgaacctgggaggccgaggttgcagtgagccgagattgtgccattgcactccagcctgcgcgacaatgtgagactccgactcsaaaaaaaaaaaaaaagaaaaagaaaaaaaagaaaatctaaaaataatataatcttgtcaatagatagtaaaaacatttggtaaaatttaacagtcattca

SEQ ID NO: 47659 - DNA, 201 bp, Homo sapiens
aaggaataagcaaagcaaaaaaccacaagcttgctgaagttggaggaccagaaggaataggtgagggtctcagtgctaatgtagggttaatccagggccargtagacaaaaataataataaaaccacaacaataataataataataaatgatggctagcatttgttgcacatttattttatggagggtgttaatctaagaa

SEQ ID NO: 47660 - DNA, 201 bp, Homo sapiens
aatgtacagtatatataatctacagggaatacagtccttgtccccaaaaggggaaaagctcactgcagtttataatgggatatcgaaaccatactggttgytatagtattagaaagaacagtattggaaagatgtgaatcaaagagtgcccttgatcactgctggtagaaaaagtaaatttctaaagtcactttggaaaac

SEQ ID NO: 47661 - DNA, 201 bp, Homo sapiens
gtacagacccagatttttgcacatgggcataataagacatgtacaagaatgtttatagaagtattctttataatagcagagaaactagaaacaacccaagwgttcatcagctggagaacagagaggcaaactgtggcacttttgcataatgggatatcaaggaataagaaaaaggaataaattataactaaatataacaac

SEQ ID NO: 47662 - DNA, 201 bp, Homo sapiens
ctttgcagagaactgctatattaatatatccactttccagatcatctcacaagcaaaaatggtaaatgattagaaagatatttccagctgttttcaaaacsgtttgagaaaataaagtcttaatttctcaggtaagatctcagagcagacgaacctgtggttctgccagggaatctctaaagctaagccataaatgagact

SEQ ID NO: 47663 - DNA, 201 bp, Homo sapiens
attgcaaggattatttatatattctggatacatgttctttaacgtatgttaaagcttgcttttcatatagattgctttttacctagtttcatcatctaatytttataaacactagcttattatctttttcttctatagtccatactttttatgttctacccaagaaagacaaggtccaaagatttctctcccatgttttct

SEQ ID NO: 47664 - DNA, 201 bp, Homo sapiens
agacgaacctgtggttctgccagggaatctctaaagctaagccataaatgagacttctgtttaatcttcaataaccacttgctgttgcaggcctattatgyaatactcctcaacaggggccgtctggaagtgcatctctccacaggggcacgaacaatgaggaaaattgtgatcagaccagagccaaatctgtttcatgat

SEQ ID NO: 47665 - DNA, 201 bp, Homo sapiens
ataaccacttgctgttgcaggcctattatgcaatactcctcaacaggggccgtctggaagtgcatctctccacaggggcacgaacaatgaggaaaattgtsatcagaccagagccaaatctgtttcatgatggaagagaacattccgttcatgtagagcgaactagagggtaacaatagcactaaaatatttattattgta

SEQ ID NO: 47666 - DNA, 201 bp, Homo sapiens
gtgtttacaaagcttatgcccatttctattttgagttgtttgtttccttagtaatgcattgcaaggattatttatatattctggatacatgttctttaacrtatgttaaagcttgcttttcatatagattgctttttacctagtttcatcatctaatttttataaacactagcttattatctttttcttctatagtccata

SEQ ID NO: 47667 - DNA, 201 bp, Homo sapiens
taacaatagcactaaaatatttattattgtaactcaggtgaacttcctttgctagcatcggtatctatcagtatctgcctgaacctctgtgtgtgtggacmtactatgcattgcaaaaggataccgtagcttaattccctcttctttacttttcatacttcgggaacctcatttgcctcagcccttaggagttctaccctt

SEQ ID NO: 47668 - DNA, 201 bp, Homo sapiens
aatcatcccttgtgccccattgcagtgaagtccccatcaccccccatgtgcctactgttttgccttctagcattataattttccaatttctacaacttctkaaaaatagaatcgtagtctgtttttttgagggggggtttgtttgtttctttgtttggcttccttcacttggtgttacgtttttgtaattcatccatattg

SEQ ID NO: 47669 - DNA, 201 bp, Homo sapiens
aaggatctagtttgttaagaaacataggcatcataacaaataaatgttcttgaattcaaaaaaaattaaagcttgattgttcagaaagcaatttcatctayatttaggagatgtttacaggtgttatattttataatgcagatctgagttcactttttgtacaagtagaagagtcacacttttatattaatagtgataata

SEQ ID NO: 47670 - DNA, 201 bp, Homo sapiens
gcctgaacctctgtgtgtgtggacctactatgcattgcaaaaggataccgtagcttaattccctcttctttacttttcatacttcgggaacctcatttgcytcagcccttaggagttctacccttaacatttttattcgtgcagttatctccacctttggaaaaaccaaatgcattttctgaagctataaataagaaaaat

SEQ ID NO: 47671 - DNA, 201 bp, Homo sapiens
gggtttcagatttaaaaatcaagagtaagaagttttacaatatttactaaagattacgattagtataccacaaaacatctgaactttagatattatttatrtgaccttaaaagtcagacctttccctgccaatgacttaacttctgtctttagtgctattttgtttgaaggcttatttatctgctatgaagtgatttttct

SEQ ID NO: 47672 - DNA, 201 bp, Homo sapiens
tatccactcactttattgtgatatcaaaataagatagcatatgtgcatatccttggagattttaaagctatctgaaaatgtgccatatttaaacatactgwacatagttaaaagacatgcatctgattaatgtaaaaactataccaatttattgtagtccacttggaaagacaagtagcttacttaaagatctattttgtt

SEQ ID NO: 47673 - DNA, 201 bp, Homo sapiens
atgtttagcagcataaggaatagaaacatttggagttttagctttagcttatacaatgcatcctgttttataattgttttccaacaatgtttacataatgkgagggtcactctttaacatgaggggctctgtcactagaattgcagtgtgttagcccctcattttctccagtgtttttgtaaatctttccattgacaatct

SEQ ID NO: 47674 - DNA, 201 bp, Homo sapiens
atatgggttctgatacaatacacaaagaggagaatatttgaatgttgctcatcaagggcattcttactgttcagctgaccctgcattttagcttcttgttyatttttcatggttttaacccaccattaagtagcatggtttttagcatgaaaaataaatttataaatttataaagcttaacttgctttaaaatttgattat

SEQ ID NO: 47675 - DNA, 201 bp, Homo sapiens
agtatatgggttctgatacaatacacaaagaggagaatatttgaatgttgctcatcaagggcattcttactgttcagctgaccctgcattttagcttcttktttatttttcatggttttaacccaccattaagtagcatggtttttagcatgaaaaataaatttataaatttataaagcttaacttgctttaaaatttgat

SEQ ID NO: 47676 - DNA, 201 bp, Homo sapiens
attaggaatgaacatgtctatcaagattcattttaaatacagggaggaggagagaggaagatggcaaggttgtgaaagagtgaatgaatgaatgaatgaawgaattatagaaagctatatgcttctgcacagctttgagattgagatggggagctgattttctcccttttgcaccttatttacatttctacttgaaatgta

SEQ ID NO: 47677 - DNA, 201 bp, Homo sapiens
tgataactaagtgctgatattccattttgagtatatgggttctgatacaatacacaaagaggagaatatttgaatgttgctcatcaagggcattcttactsttcagctgaccctgcattttagcttcttgtttatttttcatggttttaacccaccattaagtagcatggtttttagcatgaaaaataaatttataaattt

SEQ ID NO: 47678 - DNA, 201 bp, Homo sapiens
tacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttggtg

SEQ ID NO: 47679 - DNA, 201 bp, Homo sapiens
gcttttcatgatatatgatgttgtactcgaccatccagaaatatagtaaataacccacaagatgcaatttcactggagggtgatcataagctcttagaggscagcagtatttgcctcatgcttattttgcatctcatccattttgtagtaatccccacagatggaaaacttaattaaggatgatggggaacttagagcagg

SEQ ID NO: 47680 - DNA, 201 bp, Homo sapiens
ttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttggt

SEQ ID NO: 47681 - DNA, 201 bp, Homo sapiens
agctgttttttttctatcaataattacacaaataatgtgtatcacttaaaaacaaaacttgaatatctaccaaaagctgtggctttcaattagagtattamccacataatttcattttgtaactctttctctctgagatattttgcctataactgaaaatctgatgtttctgtctttgctacatatttgatctattgtatg

SEQ ID NO: 47682 - DNA, 201 bp, Homo sapiens
caataagtaactgcagatttgagaaattagtttaccgaaatcactcaaaatgtgttattttgttgagaaagaattctggaattcccaaatgcattacactrttgtaccactatgccactatgtccttttaacaggtgcttcttcaagaagggcattttattatgccaacttcacagctgttgaccatcaatccaaccttta

SEQ ID NO: 47683 - DNA, 201 bp, Homo sapiens
tttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttgg

SEQ ID NO: 47684 - DNA, 201 bp, Homo sapiens
tctgctttccttgtttaagcactaaaagaaatcaagcagtcattggaatgttttcttttttaaaagaccctttaactatatgattttaaaaatgtctgtckccaaaaaatgaaaatcaaaacacatagccaagagccaagagacgaggaagaacattctcatatcttttcagcatttggaggtggtggtgattgtgagcac

SEQ ID NO: 47685 - DNA, 201 bp, Homo sapiens
cccctgtttctctccagaacacagtgtcctcttcatggagatacaatttgattagcagatcaggtgaggcaacaacaataaacaaataaatgacttatgcrgtctgtgggagacgtaacagatcttctgtatccccagaaggtctcaaatctatatgaatttacctattgcaaaaatccctctttagccttctcttttgaa

SEQ ID NO: 47686 - DNA, 201 bp, Homo sapiens
ttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttg

SEQ ID NO: 47687 - DNA, 201 bp, Homo sapiens
aatttattttcatgcactaaaatgatttggagatacaaatagtgaaaagtatatttcttgtaatgttttgtagtaatttttatttggtttcaacagtcaaygaaaataggttaataaaatgtctagtatttcataataacctactgtgtgttacatattataccaagaagtttatattcatttccttttaaatcaagctca

SEQ ID NO: 47688 - DNA, 201 bp, Homo sapiens
ataaatgcaaacattaaaattgacaggttactatgattttcatattggattaaaatgtctaaaacaaagggattcgtctatgtatgacttacacaaatacygcaaatcttaggggaacagaaagactgaaaatgagagataagatacactatgcaaactctaaccagaagaaagctggtatgctaccattaatagcaatca

SEQ ID NO: 47689 - DNA, 201 bp, Homo sapiens
atgagtcaatagtagtcatttaattatgtgctcttagagtttatttaaaatttattttcatgcactaaaatgatttggagatacaaatagtgaaaagtatrtttcttgtaatgttttgtagtaatttttatttggtttcaacagtcaatgaaaataggttaataaaatgtctagtatttcataataacctactgtgtgtta

SEQ ID NO: 47690 - DNA, 201 bp, Homo sapiens
gtccaggaatccaaaagctgaagaacttggagtgtgatgttcaagggcaggaagtatccagcatgggtgaaagatgaaggctggaagagtcagaagatctrctctttccactttcttctgcctgcttttattctagccacactggcagcttattagatggtgcccacccacattgagggtgggtctgcctcttccagtcca

SEQ ID NO: 47691 - DNA, 201 bp, Homo sapiens
aactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaaca

SEQ ID NO: 47692 - DNA, 201 bp, Homo sapiens
ctttcttatggttacaagatgccatatcatatgctataaaatgtctatcggtaatttttaaaactgtgattattatgagtcaatagtagtcatttaattawgtgctcttagagtttatttaaaatttattttcatgcactaaaatgatttggagatacaaatagtgaaaagtatatttcttgtaatgttttgtagtaattt

SEQ ID NO: 47693 - DNA, 201 bp, Homo sapiens
ttttgtgaattttgctttggcagtgataccactatctatcaccactacccataggtgatagtgcatttgtcataggcttctttatgaagtctctcgtgggwatttttgaccagggtgaatcttcaacttaattactgtgtaatgagacatgatttttaaaaatatatctagatgatgttctgatatgattttgaaatgtgt

SEQ ID NO: 47694 - DNA, 201 bp, Homo sapiens
caaatcatagctctgctacttgctagctgtaatcaggggcgagttacttaacacctctctgccttcttaataaaatagagataatagtggtatgaagctcrtgtggatgttttgtgtagcaaatcattgtaggaacagtgtctgacaatagtgcttggcacattgcaaacattcaacgatgctggctattatgattataat

SEQ ID NO: 47695 - DNA, 201 bp, Homo sapiens
taactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaac

SEQ ID NO: 47696 - DNA, 201 bp, Homo sapiens
gtaagttcctttaaaataatagcttaattcagttttaagtttctttccctattgttctacacaacccacatccatctacagtttgaaatatgtaactttcrtgcacttttttcaattcaaggtgtttgtaatcacatatatgtttatgagttgtcaggtagctattattttagttaacagggaactaaggtcatgccaaac

SEQ ID NO: 47697 - DNA, 201 bp, Homo sapiens
tagcttaattccctcttctttacttttcatacttcgggaacctcatttgcctcagcccttaggagttctacccttaacatttttattcgtgcagttatctmcacctttggaaaaaccaaatgcattttctgaagctataaataagaaaaatccctccctctgcccctcttaaatattacctcctcaaataaggtatgcaca

SEQ ID NO: 47698 - DNA, 201 bp, Homo sapiens
gtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaa

SEQ ID NO: 47699 - DNA, 201 bp, Homo sapiens
agtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaa

SEQ ID NO: 47700 - DNA, 201 bp, Homo sapiens
ttgcaacctactcatctgacaaagggctaatatccagaatctacaatgaactcaaacaaatttacaagaaaaaaacaaacaaccccatcaaaaagtgggcraaggacatgaacagacacttctcaaaagaagacatttatgcagccaaaaaacacatgaagaaatgctcatcatcactggccatcagagaaatgcaaatca

SEQ ID NO: 47701 - DNA, 201 bp, Homo sapiens
aagtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaattttta

SEQ ID NO: 47702 - DNA, 201 bp, Homo sapiens
aatatcgtgaaaatggccatactgcccaaggtaatttacagattcaatgccatccccatcaagctaccaatgactttcttcacagaattggaaaaaactastttaaagttcatatggaaccaaaaaagagcctgcattgccaagtcaatcctaagccaaaagaacaaagctggaggcatcacactacctgacttcaaacta

SEQ ID NO: 47703 - DNA, 201 bp, Homo sapiens
atgataacagtttccatttatcttctatgtcaaatcaaacaagtaatttgtcttttacttttctgattttattcatctgaaatgtggctagtagtctttaytgtatcctttgccatggagtttgttagtcattgtttgtaatagaactgttttccattcatctattcatttattatttaagtatttagtcagttacttttg

SEQ ID NO: 47704 - DNA, 201 bp, Homo sapiens
tctttagaatgctgcaatactttatacttactttattaggaaagtcatctgtatttttcatcaaaatattgtatgacaactcagagagataattagtttaraaggacaattagagaaaaaagaaacagaagcccagagacttcaggggttcagacctccaagccagcaatccatttatcagactgaagacatagaaaagaa

SEQ ID NO: 47705 - DNA, 201 bp, Homo sapiens
aggaaataacctctacataataattttttaatcctttaatttttttgtgggtacacagtgggtgtatatatttatgggtgacctgagatattttgatgtargcatgcaatgcataataatcatatcagggtaaatggggtatccatcacctcaaacatgtatcctttatgtttcaaacaatctgattatactcttttagtt

SEQ ID NO: 47706 - DNA, 201 bp, Homo sapiens
ttatttgatacaggctcgaattgcaaaattggacacatatttgtaggtcatttttatcttcatgcttgctctgataacttatttaggaaagagtgtaagakgtggtctcatggtttgcacttcttcatcagattacataaccagatagtagaaaaggatattttagtgtattactggcattcatttgattacgagggaaat

SEQ ID NO: 47707 - DNA, 201 bp, Homo sapiens
aattccacattacagacaaaagaatagaattgtggagaaggtcagcagctcacctaaagttagaagctaggaagtgtttatttactgatgatgaaaactgrtatagcaaaaagtaatcagcattcgtggattaaatagttgagcttttcccctgttgttgactcatcctgtagtagctctaaggatacggacagactatga

SEQ ID NO: 47708 - DNA, 201 bp, Homo sapiens
gaatctcacatttagccacattttctgacttagtcatcaagtggagaaatctagacatttttattatttcttcattgtaaagatttctgagtgcttttccyctcctcacaaaacggtgaaattcagacatgtaagcatataaaacctgtcttaaagtacaaaataaaagaaaagtataggctgggcatggtggctcaagcc

SEQ ID NO: 47709 - DNA, 201 bp, Homo sapiens
ccaggaaagacattgttttaaagaatgacgtaagctttctagaagtcaattttgtagtttctcatctccaaggggtttctttatttcttgccagcgcaacrattctgttatctgccatctgtctttcgatctatctacctacctacctacctacctacctatctatttttctacgtttaattttattctgtatcttcaact

SEQ ID NO: 47710 - DNA, 201 bp, Homo sapiens
catttgtcttctcttcttttgaggtttctcagtctgtacattttctgggtgacctgttgtttggtataaataatcccttttttctgctggattcaatcttytattacatacatttactggatttttaatttttgtatttttattttttagttttagaatatccaattgatactttaaaaaaattagactccaaatatctct

SEQ ID NO: 47711 - DNA, 201 bp, Homo sapiens
atgatcattcagttcaaagaaggcattgtacagtagagaagacagatatacatatacatactgtacatttatgataatataaatagtgcagaagaagtgtkcacaatgcatataaatagtgcagaagaagtgtgcgcagtgcatactggtagaactaagaaggaagcaatgaattcttgtgttagcatttaatacactttt

SEQ ID NO: 47712 - DNA, 201 bp, Homo sapiens
aagtggtctgctctctctctttctgtctctctctttctctctctctctgtctctctctttctctctctctctctctctctctctctctctctctctatatmtatatatatatatatatatatatggcaactagatgtatactttggaattcctttaaggtgaaaagagttctctaaatgtaaagtgttgagtgaaattatt

SEQ ID NO: 47713 - DNA, 201 bp, Homo sapiens
attaaattatgtttttgcaaccattgaagtatagataaacaaaaaaagaaaaaaattaattatatgttaataactttttaaaattcatcagtacaaataarttatagaatcataaaggaaaatagaaatctcatgatgattaaaataacattcagtctggaaggtacaaaacttttaccttcatcattcgatatttaggtt

SEQ ID NO: 47714 - DNA, 201 bp, Homo sapiens
tgaaaaattcttttctcaaaatggacattttccagtattggatgaagtggtctgctctctctctttctgtctctctctttctctctctctctgtctctctytttctctctctctctctctctctctctctctctctctctatatatatatatatatatatatatatatggcaactagatgtatactttggaattcctttaa

SEQ ID NO: 47715 - DNA, 201 bp, Homo sapiens
attttttagagtgtgattttcatagggtatgttacattcttgatgaatttttatcttcttgacctattaattactaaaaaaaaaaatacagataacgacarcctaaaacaacctattgaaatatctcactgtgatgatagatttgtctagttttccttgtaatttttgttctccatattttaaggctatataatgtgatgt

SEQ ID NO: 47716 - DNA, 201 bp, Homo sapiens
tgacaaaatgaaaaattcttttctcaaaatggacattttccagtattggatgaagtggtctgctctctctctttctgtctctctctttctctctctctctstctctctctttctctctctctctctctctctctctctctctctctctatatatatatatatatatatatatatatggcaactagatgtatactttggaat

SEQ ID NO: 47717 - DNA, 201 bp, Homo sapiens
atgcgttggtacatttaccttaggtaacttgtcccacttttatgctcttcaatttggtctagtgtaaaatggagcaaataggcccacttccttattacgargcatattataaggataaagtgatgtgttataggcaaagagcatagcacactgctgcactttaggtgatactcagaaaatattacttttggtcttccacat

SEQ ID NO: 47718 - DNA, 201 bp, Homo sapiens
aaaatcacaaacattcttatacaccaacaacagacaaacagagagccaaatcatgggtgaactcccattcacaattgcttcaaagagaataaaatacctargaatccaacttacaagggatgtgaaggacctcttcaaggagaactacaaaccactgctcaaggaaataaaagaggagacaaataaatggaagaacattcc

SEQ ID NO: 47719 - DNA, 201 bp, Homo sapiens
atgactctctagtttagtagattgggtgggggggtcataagaccaacaaaaaaaagtaagttaagtaatacagatttgggagttagatgataattattttsatttggaatgtttagcttaaagtacgcaaggaaaatatagatgatggtgtctcacctgttgaatgtggacttttaggcaaaaatcaggtccaagcataca

SEQ ID NO: 47720 - DNA, 201 bp, Homo sapiens
tatgacaaaatgaaaaattcttttctcaaaatggacattttccagtattggatgaagtggtctgctctctctctttctgtctctctctttctctctctctstgtctctctctttctctctctctctctctctctctctctctctctctctatatatatatatatatatatatatatatggcaactagatgtatactttgga

SEQ ID NO: 47721 - DNA, 201 bp, Homo sapiens
aggattgctatgatttggctctgtgtccccacccaaatttcatcttgaattgtactccaataattcccatgtgttgtgggagggacctggtgggagatggytgaatcatgggagtgttttcccccatgctgttgtcgtggtagtgaaaagtctcatgagatctggtagttttatcaggggtttccgcttttgcattttcct

SEQ ID NO: 47722 - DNA, 201 bp, Homo sapiens
aaagtctcaggatacaaaatcaatgtacaaaaatcacaaacattcttatacaccaacaacagacaaacagagagccaaatcatgggtgaactcccattcayaattgcttcaaagagaataaaatacctaggaatccaacttacaagggatgtgaaggacctcttcaaggagaactacaaaccactgctcaaggaaataaaa

SEQ ID NO: 47723 - DNA, 201 bp, Homo sapiens
cactgtgtgggtgatgggtccactagaagcccaaacttcactcttatgcaatatatccatgaaacaaaccttcatatgcaccacctggatctaaaattgtraaataataaaaataaaaataaagacattcggaacactaagctgaattggctaatgctataaactctaaagatagtaatatgcttggtagatgtacggtat

SEQ ID NO: 47724 - DNA, 201 bp, Homo sapiens
tgcatgtgaatctatgacaaaatgaaaaattcttttctcaaaatggacattttccagtattggatgaagtggtctgctctctctctttctgtctctctctytctctctctctctgtctctctctttctctctctctctctctctctctctctctctctctctatatatatatatatatatatatatatatggcaactagat

SEQ ID NO: 47725 - DNA, 201 bp, Homo sapiens
tgaggaagttatagaaatgggtaattccaaggtgaatgttccaaggatagctatgtcttatacataacaagcacttcatcattatttgctgaatgaatgcrtatgttagaatccatatgtaatagcttgtccatttgcacatattttcaccccactgatagtttttaatatgtggaggtacacatacatatctctgtgttt

SEQ ID NO: 47726 - DNA, 201 bp, Homo sapiens
ggccagggcaatcaggcaggagaaggaaataaagggtattcaattaggaaaagaggaagtcaaattgtccctgtttgcagacgacatgattgtttatctaraaaaccccatcgtctcagcccaaaatctccttaagctgataagcaacttcagcaaagtctcaggatacaaaatcaatgtacaaaaatcacaaacattctt

SEQ ID NO: 47727 - DNA, 201 bp, Homo sapiens
gtcagccccaaccctattttcccataagccctgttatttgtaagaataatttttatagaactcctggtgtttgtttgtttgtttgtttgtttatttgttgytttcaggaaaacacttatcacatttgaacataaagagcaatcattcctactaaagagcaggagtgatttcatggagaagatgtaaaagtgaggctaaaag

SEQ ID NO: 47728 - DNA, 201 bp, Homo sapiens
catgcatgtgaatctatgacaaaatgaaaaattcttttctcaaaatggacattttccagtattggatgaagtggtctgctctctctctttctgtctctctytttctctctctctctgtctctctctttctctctctctctctctctctctctctctctctctctatatatatatatatatatatatatatatggcaactag

SEQ ID NO: 47729 - DNA, 201 bp, Homo sapiens
ctctccagtttatctgtgttatggattgtaagagtgttttgaaataatattttacttagtaaagtaatatccacaagcatttcaccatgaaaaacattaarcattttaagtatataatatgaaatataccatctctgatgattatttttattgaccatattcttgccaactctaaggtactctaacactagaattttaaac

SEQ ID NO: 47730 - DNA, 201 bp, Homo sapiens
aaaataataagagctatctatgacaaacccacagccaatatcatactgaatgggcaaaaactggaagcattccctttgaaaactggcacaagacagggatrccctctctcaccgctcctattcaacatagtgttggaagttctggccagggcaatcaggcaggagaaggaaataaagggtattcaattaggaaaagaggaa

SEQ ID NO: 47731 - DNA, 201 bp, Homo sapiens
ctttcctttttagagaagccatattcaagaaaaatagcatgtaattcaaattttaaataatcaaaatagatttgaaagctcaaaattttggaacattatargcctatgtcccaatattcttcccaaacctcctttcaaacgtatttattaatttagaaaattctaaatagttcagtccttgtttgaaatatatacaacata

SEQ ID NO: 47732 - DNA, 201 bp, Homo sapiens
ctttgtgaatcccagaattctttgtatatactgtgatataccatatttttgtcatagtaacaacaatttaattctgattctcctatagatgaatctctgcrttctatctttcatgctactttgaattcggtttttaaaactgaatttaaatatcacagtacttatcatatgatattcaacaacctgactgttttccatttt

SEQ ID NO: 47733 - DNA, 201 bp, Homo sapiens
gcaccatgaaagatttaattaaatgtaggcctttagtctaagggtttttcaacatcaaaatgttcttcaaaagacattttgatagcttctctctttaagaygtgcaaaaaaagacggtgagaaaaagaaagaaaaccaattttgtgtaaaaaccctgatttaaatacagttctggcttggacagactaggtgacattttaa

SEQ ID NO: 47734 - DNA, 201 bp, Homo sapiens
ttggtctgtatattcttagaaaatagaaaataattgagtatgagaacatgggaggaaaatgctgaagattcaaggagaaaagagaaagtatgaaaaagtakccaggaacatagcaaagaacatggaccagacagcattagggatctatgtgagtttagtaatcatgaatttgaagcaaggtcagtcaacaggtactatgag

SEQ ID NO: 47735 - DNA, 201 bp, Homo sapiens
ggctggagtgcagtggcacgatcttggttcactgcaagctccgcctcacgggttcacgccattctcctgcctcggcctccggagtagctgggactacaggygcccaccaccatgcccagctaatttttttgtatttttagtagagacgaggtttcactgtgttagccaggatggtcttgatctcctgacctcgtgatccgc

SEQ ID NO: 47736 - DNA, 201 bp, Homo sapiens
cagcctgggtggcagattgagatgctgtctcaaaaaaaaaaaagggggttatcttggtatccttgttacatggtttcaccaaaggagatgcttgggtaatytgtgcttttcactttcaagagactagccctctttatatgccaacatttttgggggggtatcaaaatatttggagtataaaaacaaaagcactgtaattgg

SEQ ID NO: 47737 - DNA, 201 bp, Homo sapiens
attgagcatctattgacacctctattgatctgtccagggaagtacagaggagacctgccttagccatctgttgaccagaggaccaatcacatcaacaggaytctcccctctctcttctaagctttcctctttgttgtctttattttcactagggttttctctgtaaggtgcctaaaatggctactagtagctacaggttta

SEQ ID NO: 47738 - DNA, 201 bp, Homo sapiens
tgttaagtgtatgtaatcctcataccaattggagcaaaaacatttgcttcatttgcttgcatcaattggtcatatatatatatatatatatatatatctawctcaattggttatatagataacataagtatagataacataggtaacattcagaatagtcacttcactactttaagagctaattaggtattcatacagata

SEQ ID NO: 47739 - DNA, 201 bp, Homo sapiens
agaatctctgggacgcattcaaagcagtgtgtagagggaaatttatagcactaaatgcctacaagagaaagcaggaaagatccaaaattgacaccctaacwtcacaattaaaagaactagaaaagcaagagcaaacacattcaaaagctagcagaaggcaagaaataactaaaatcagagcagaactgaaggaaatagaga

SEQ ID NO: 47740 - DNA, 201 bp, Homo sapiens
ttatgttaagtgtatgtaatcctcataccaattggagcaaaaacatttgcttcatttgcttgcatcaattggtcatatatatatatatatatatatatatmtatctcaattggttatatagataacataagtatagataacataggtaacattcagaatagtcacttcactactttaagagctaattaggtattcatacag

SEQ ID NO: 47741 - DNA, 201 bp, Homo sapiens
ttgttccattgctggcaaggaacttcattcctttggaggaggagaggcgctctgatttttagagttttcagcttctctgctctgttttttccccatctttrtggttttatctacctttggtctttgatgatgatgtacggatggggttttggtgtgggtgtcctttctatttgttagttttccttcttacagtcaggaccc

SEQ ID NO: 47742 - DNA, 201 bp, Homo sapiens
catggaaactgaacaacctgctcctgaatgactactgggtacataacgaaatgaaggcagaaataaagatgttctttgaaaccaacgagaacaaagacacsacataccagaatctctgggacgcattcaaagcagtgtgtagagggaaatttatagcactaaatgcctacaagagaaagcaggaaagatccaaaattgaca

SEQ ID NO: 47743 - DNA, 201 bp, Homo sapiens
atgtatcctttatgtttcaaacaatctgattatactcttttagttatttttaaatgtacaattatttttttttttttactgtagttacccttgtgctagcraatactaaatcttattcaaactatttttgtatcattaaccatccctactcctccctgccactaaccttcccaacctctggtaactatccttctactttct

SEQ ID NO: 47744 - DNA, 201 bp, Homo sapiens
cttatgttaagtgtatgtaatcctcataccaattggagcaaaaacatttgcttcatttgcttgcatcaattggtcatatatatatatatatatatatatatctatctcaattggttatatagataacataagtatagataacataggtaacattcagaatagtcacttcactactttaagagctaattaggtattcataca

SEQ ID NO: 47745 - DNA, 201 bp, Homo sapiens
caacagaatatacatttttttcagcaccacaccacacctattccaaaattgaccacatagttggaagtaaagctctcctcagcaaatgtaaaagaacagarattataacaaactatctctcagaccacagtgcaatcaaactagaactcaggattaagaatctcactcaaagccgctcaactacatggaaactgaacaacc

SEQ ID NO: 47746 - DNA, 201 bp, Homo sapiens
catatccagtatgtatatgtaccacactttctttatccgttcatctgctgatggacacttaggtggcttccaaatctattgtaactagtgctgcaataaaygtgggagtgcagatatctcttcaatattcttttgggtatatatctaagagtggaattgatggatcatatggtagctctatttttggtgttttgaggaacc

SEQ ID NO: 47747 - DNA, 201 bp, Homo sapiens
acttatgttaagtgtatgtaatcctcataccaattggagcaaaaacatttgcttcatttgcttgcatcaattggtcatatatatatatatatatatatatmtctatctcaattggttatatagataacataagtatagataacataggtaacattcagaatagtcacttcactactttaagagctaattaggtattcatac

SEQ ID NO: 47748 - DNA, 201 bp, Homo sapiens
gagaatgaaaccaagttggaaaacactctgcaggatattatccaggagaacttccccaatctagcaaggcaggccaacgttcagattcaggaaatacagakaacgccacaaagatactcctcgagaagagcaactccaagacacataattgtcagattcaccaaagttgaaatgaaggaaaaaatgttaagggcagccaga

SEQ ID NO: 47749 - DNA, 201 bp, Homo sapiens
atgatcagtgatgttgagccccttttgatatacctgtttttcatctgaatatcttcttttgagaaatgtctatccaaatcttgtacccatttttaaatagkattattagatttttttcctatagaattgtttgaattccttttatattctggttattaatcccttctcagatgggtagtttgcaaatattttatcccattc

SEQ ID NO: 47750 - DNA, 201 bp, Homo sapiens
gggatctcctgtattccatgcatgctcttccttgccttcattgtggaatagtagactgatttcaccttgatattctgggtcaattacccagccaacactgmaacccccttcttagcctgttgacttggaggtaggagggccccaattggccaggtggtaatcttaacttccagtttaatggaatcattgttgtatcccttg

SEQ ID NO: 47751 - DNA, 201 bp, Homo sapiens
aatgtgagttataccaccttttgcatcttgtagtgacaccatacagtgtagcctccaaggcagggaagagaaaaaatgaagagacatgtaggcccctaccrtactggctcatgaagcctggaccacgtctggtctgagtcattgaccagaagtagccgtgtgccccaagctaactgtaagggaggtctggaaaagtaggag

SEQ ID NO: 47752 - DNA, 201 bp, Homo sapiens
caggaaaatcaaataggcttctgagcacataatgctaaacaacggccctgatgttacaatagcatactaaacactttttcagaatctcatagcaacaatayagaatgtacagatacaacacggagtttcttgccaaatgtatgtagacattagattaaattgagtgcatttatctcatattaatttaatatgaaataattc

SEQ ID NO: 47753 - DNA, 201 bp, Homo sapiens
catgtgatgtttaaaatagattatgagtggcatagtaaaatgtattactctcctagagaacagaaattaaaattagtatctgttggcaagatattacttcmtaaaaattgcctgaaatagcattttataaatatcaaattggtgttgcctatttttaatcactgcatagtggggtttttgggatatatcagcttttattat

SEQ ID NO: 47754 - DNA, 201 bp, Homo sapiens
gctgccatcaaaaaacggacctatgacaacagggggcatgtgggttgcaaatactggttacataaattggtccgacaacattctattgtccggcgtagctrggcttttggagaatctttgcactgaaaatcagatccttcatatttcatacaccctgaagctaatgtggtttctccctggtcatcttcttctatgatggca

SEQ ID NO: 47755 - DNA, 201 bp, Homo sapiens
tgagggtaacccgacctttctctctggctgcccttaacattttttccttcatttcaactttggtgaatctgacaattatgtgtcttgaagttgctcttctygaggagtatctttgtggcattctctgtgtttcctgaatttgaatgttggcctgccttgctaggttggggaagttctcctggataatatcctgcagaatgt

SEQ ID NO: 47756 - DNA, 201 bp, Homo sapiens
ctagcttttgagtgtgtttgctcttgcttctctagttcttttaattgtgatgttagggtgtcaattttggatctttcctgctttctcttgtgggcatttartgctataaatttccctctacacactgctttaaatgtgtcccagagattctggtatgttgtatctttgttctcattagtttcaaagaacatctttattcca

SEQ ID NO: 47757 - DNA, 201 bp, Homo sapiens
aagattatctattttttttctcaactcatgcaatgtttaacactttggaccatattatcacttatggttagcctcttataatatggtatggctattttttwaaaaagtcatggtaaaatgacataacaaacaattttttatcttagccacttttaagtgtacattgttgtgcaaccatcatcaccattcagctctacaatg

SEQ ID NO: 47758 - DNA, 201 bp, Homo sapiens
acaacaaagattataaacacttattgagtacttaatatacttatgttaagtgtatgtaatcctcataccaattggagcaaaaacatttgcttcatttgctygcatcaattggtcatatatatatatatatatatatatatctatctcaattggttatatagataacataagtatagataacataggtaacattcagaatag

SEQ ID NO: 47759 - DNA, 201 bp, Homo sapiens
ttcttccttgtttagtattgggagggtgtatgtgtccaggaatctatccatttcttcaagattttctagttaatttgcatagaggtgtttatagtattctytgatggtagtttgtatttctgtgggatcggtggtgatatcccctttatcattttttattgcatctatttgattcttctctcttttcttctttattagtct

SEQ ID NO: 47760 - DNA, 201 bp, Homo sapiens
acatagtactgacagcctgtgcttagattttgataaatgtggacaaaatcaatagatagatgcataaggagtgcccagataaaatcatcatacttcaaaakctttttctaacataactcacagctgtagacttttcctttcaataataagcaaaaacaattttcatagctacaaaccgccgacacaactttctatttaaag

SEQ ID NO: 47761 - DNA, 201 bp, Homo sapiens
agtttgagaccagcatggccagcgtggtgaaaccctgtctctactaaaaacgcaaaaattagctgggcatggtggtgggtgcctgtaatcccagctactcrggaggctgaggtaggagaattgctggaacccaggatacggaggttacagtgagctgagattgcgccactgcacttcagcctgggcaacagagtgagactc

SEQ ID NO: 47762 - DNA, 201 bp, Homo sapiens
tatgtatgtgtacatgtgccatgttggtgtgctgcatccattaactcgttatttacgttaggtatatctcctaatgctatccctcccccctccccccaccmtacgacaggccccggtgtgtgatgttccccttcctgtgtccaagtgttttcattgttcagttcccacctatgagtgagaatatgcgatgtttagtttgtt

SEQ ID NO: 47763 - DNA, 201 bp, Homo sapiens
ccaacacaggtttgttgtcaatttccttcccattaaaaatacttttacatacctactgtgtatctatagccaacagatcttatatttatgtggtgtttgcrtttttccaattttagaaatggtttcctacctttcttaacctacgacttctgacaattttatttcaaaattatgccaatatgtatagatctcaaaaacata

SEQ ID NO: 47764 - DNA, 201 bp, Homo sapiens
agcaggggcacactgacacctcacacggcagggtattccaacagacctgcagctgagggtcctgtctgttagaaggaaaactaacaaccagaaaggacatmtacaccgaaaacccatctgtacatcaccatcatcaaagaccaaaagtagataaaaccacaaagatggggaaaaaacagaacagaaaaactggaaactcta

SEQ ID NO: 47765 - DNA, 201 bp, Homo sapiens
aattttattttcagccattttttttccaagagaaaaagaaatctaaagacaagcattgtaggaagggttaggagacagaaatgttcattagtttaaatttmttttttttgtagttcaggtagtacattatttaaagtaatgaaaacccacaaactactcaagtaataattcctctagaaaaccaagccaaggctatgacgg

SEQ ID NO: 47766 - DNA, 201 bp, Homo sapiens
atcgcttgaacctgggagacaagaggttgcagtgagccaagatcgcaccactgcactccagcctgggagacagagcaagactccatctcaaaaaaaaaaawtaaaaattaaaaaaaaagcctgaacctagaaacggacctacaaatgtcaatacttagtaatatttttaattattaagccaagatttccaaaaataagaaa

SEQ ID NO: 47767 - DNA, 201 bp, Homo sapiens
actgggaggctatgccagtctctccttttcacattttctgcctgctttatatttgctggcggctgattagattgtgcccaccagattaagggtgggtctgmctttcccagcccactgactcaaatgttaatttcctttggcaacaccctcacagatacacccacgatcaatactttgtattcttcaatccaatcaagttga

SEQ ID NO: 47768 - DNA, 201 bp, Homo sapiens
agatctgagaatgggcagactgcctcctcaagtgggtccctgactcctgacccccgagcagcctaactgggaggcaccccccagcaggggcacactgacayctcacacggcagggtattccaacagacctgcagctgagggtcctgtctgttagaaggaaaactaacaaccagaaaggacatctacaccgaaaacccatct

SEQ ID NO: 47769 - DNA, 201 bp, Homo sapiens
actcataggtgggaattgaacaatgagaacacatggacacaggaaggggaacatcacactctggggactgttgtggggtgggggggaggggggagagatascattaggagatgctaaatgacgagttaatgggtgcagcacaccagcatggcacatgtatacatatgtaactaactggcacatggtgcacatgtaccctaa

SEQ ID NO: 47770 - DNA, 201 bp, Homo sapiens
gacgtgtagagtacccagatttgactattgatgactcatattggtaccgtatcgtagcatcaaggtaaccaacttaataaagattaagataattaaatgayagaattttgaagtagtttcccagtttataagaaaactcctatttccatttcaataaggtaactgtgtatgcatgtaaacacatgtgtatgaattttatac

SEQ ID NO: 47771 - DNA, 201 bp, Homo sapiens
tcctgtctttaagattttaataataccagggccgtgccctcgcctctatttccccacaaacactggtattataaaaatgaagaaagaattttattttcagscattttttttccaagagaaaaagaaatctaaagacaagcattgtaggaagggttaggagacagaaatgttcattagtttaaatttattttttttgtagtt

SEQ ID NO: 47772 - DNA, 201 bp, Homo sapiens
tccagcctgggtgacagactgagactccatctcaaaaaaaaaagaaaggaaaagaaaaaaaggaagggaagggaagggaaaggaaaggaaaggaggaaggragggagggagggagggaggaaggaaggaaggaaggaaggaaggaaggaaggaaggaaggaaggaaggaaggaaggaaattaaacctaggaacaaagtagt

SEQ ID NO: 47773 - DNA, 201 bp, Homo sapiens
cgggaagctcgaactgggtggagcccaccacagctcaaggaggcctgcctgcctctgtaggctccacctctgggggcagggcacagacaaacaaaaagacrgcagtaacctctgcagacttaagtgtccctgtctgacagctttgaagagagcagtggttctcccagtacgcagctggagatctgagaatgggcagactgc

SEQ ID NO: 47774 - DNA, 201 bp, Homo sapiens
tttcagtaacttcttacactcatgttctatgtgcggctcagtggggaactatctgtatccagtggattgttggttctgacacactagcctacgtgcatatsgggcaacccccaacatgctggcccctgccacttgcaatagatcagacccaccccttgtggttgagtgaggcagtattatgtcaattctaaacctggcatt

SEQ ID NO: 47775 - DNA, 201 bp, Homo sapiens
ggcgcaccacgagactatatcccacacctggctcggagggtcctacgcccacggaatctcgctgattgctagcacagcagtctgagatcaaactgcaaggyggcaacgaggctgggggaggggcgcccgccattgcccaggcttgcttaggtaaacaaagcagccgggaagctcgaactgggtggagcccaccacagctca

SEQ ID NO: 47776 - DNA, 201 bp, Homo sapiens
tcagcaaatcaaccttttctctccactttaatcctgtgcctcactttgcacacctgaagttagctttaaaattatgacttttaaatgcttgtcagattacrttcttacaaaaaggtattcacactccaaggcactggggaaagctgttttctttttttgtctagtttcatctagtactataaatggcctatattatcttga

SEQ ID NO: 47777 - DNA, 201 bp, Homo sapiens
aaaatttcatctctaataaaaaagtaatttggggaacatttaggaaaaaagcaaaatatataaagcaatgtaaacaataacttttaaacttgcttgtttaraaaatcactggggtacaggttagtcagcctgataaactctaacttgccttcacacctccctcctccagcagagcctcctctgacagccaaacatctaggc

SEQ ID NO: 47778 - DNA, 201 bp, Homo sapiens
caggtgaatagcaatgctttgtcactagtgctagctgtcacaagacctctagccagtcatgttttcagctgtagggcctaacaccatggttaaggaatggwtacctaaatacacaaacttaaagtagaacttcaaatacttcctgtataaaattttccctctgaagttttaaaaagaaagactgggttgtaagaagagtat

SEQ ID NO: 47779 - DNA, 201 bp, Homo sapiens
catcttttacagccaactctttcaatgagttcaaaaatttcatctctaataaaaaagtaatttggggaacatttaggaaaaaagcaaaatatataaagcaatgtaaacaataacttttaaacttgcttgtttagaaaatcactggggtacaggttagtcagcctgataaactctaacttgccttcacacctccctcctcca

SEQ ID NO: 47780 - DNA, 201 bp, Homo sapiens
gaaagttcttcaggcaaaagaaaaatgttaccagatggaaatttactcctacaaatagaaattaagtgtatcaaacaggtgaatagcaatgctttgtcackagtgctagctgtcacaagacctctagccagtcatgttttcagctgtagggcctaacaccatggttaaggaatggttacctaaatacacaaacttaaagta

SEQ ID NO: 47781 - DNA, 201 bp, Homo sapiens
ataattgtgccatggcagaatacagaagtcccttctctgaagacattttattccttaaaggactccctttgattttttttcagtgggccatttgatgcttrattgccagttgctctgtgcagaagagaaggggtattttattccataaaataacttgcagtgaattattcctttttattttcacaactgactctcattctc

SEQ ID NO: 47782 - DNA, 201 bp, Homo sapiens
gtcctaacatctactcccctggcctgcttgagtctcaactaaaatattgacatttgccatcacacattttgctttagctgttatggccatgctttgtcacrttaataagatgaaattgtttggttaagcatactgctattctaattctgtgtgtgcacgtgtgtgcatgcatatacatgcacactaattttgttctatgca

SEQ ID NO: 47783 - DNA, 201 bp, Homo sapiens
taactcaggtgaacttcctttgctagcatcggtatctatcagtatctgcctgaacctctgtgtgtgtggacctactatgcattgcaaaaggataccgtagyttaattccctcttctttacttttcatacttcgggaacctcatttgcctcagcccttaggagttctacccttaacatttttattcgtgcagttatctccac

SEQ ID NO: 47784 - DNA, 201 bp, Homo sapiens
cttcctccctgggacagatgccacaacctgtgattcagagactaaaaaatgctcctgtagtgatcaaactgggcagtgcacttgtaaggtatgtgctgctracatgcagctagggaaaacctccctcaattctgtttccattgctcagttttaacttcattcagtgtttgttatacctgcttcattaagctaaacaaacag

SEQ ID NO: 47785 - DNA, 201 bp, Homo sapiens
ttagctatcttaagcaaccaacccactcacaccactagtaaaaggcagagtaagaattttattctagcgagtcagactccaaagtctgactccttatctcyggaacactctgcctttccaatttattctacttttaatagaccatggtaggctattgagagtgtttccagtttttcactattagaaactatactctgatga

SEQ ID NO: 47786 - DNA, 201 bp, Homo sapiens
ttggcactaaaacccagatatctaaattccaactgctatttcaccttctttttgtttgtttgtttgtttgtctgttttttgagatggagtttcactcttgytacccaggctggagtgtaatgtcacaatctcgtctcactgcaacctccacctcctgggttcaagcaattctcctgcttcagcctcccgagtagctgggat

SEQ ID NO: 47787 - DNA, 201 bp, Homo sapiens
attgtagatgccattcagtagagtgattaagaggatagactctggagccagattgctttggttcaaatcatagctctgctacttgctagctgtaatcaggdgcgagttacttaacacctctctgccttcttaataaaatagagataatagtggtatgaagctcatgtggatgttttgtgtagcaaatcattgtaggaacag

SEQ ID NO: 47788 - DNA, 201 bp, Homo sapiens
gtacctgaatctgcgtaactaattgggagaatgggaagttaactttatttttccaagaaaaagaaacaaaatcaatatttaaattttggaaaacataattrttaaattatttttcatattgtgtagattcacatctctttaatcaatgggagaccaagtgccgatgatccttctccagaactgctagaatttacctccgct

SEQ ID NO: 47789 - DNA, 201 bp, Homo sapiens
gttttctcagaaatatacataaatttttagaggataatgaaactatgagttaatcaataaatatgtctgagcacattcctttagccattccagggtgtgayatgagaaaactgattcacacgcactgagcactcaataataagtacttactatgcagtagactacagagatgaataatgtagtttttattcttaaagaatt

SEQ ID NO: 47790 - DNA, 201 bp, Homo sapiens
cccctgaaatctcacatgatggacataattcaagtttatgtctcacatcacaacacaatgtgagttataccaccttttgcatcttgtagtgacaccatacrgtgtagcctccaaggcagggaagagaaaaaatgaagagacatgtaggcccctaccatactggctcatgaagcctggaccacgtctggtctgagtcattga

SEQ ID NO: 47791 - DNA, 201 bp, Homo sapiens
gatggtttcagtgagccgagatcataccactgcactccagcctaagcaacagagcgagagtctgtctcaaaaaaaaaaaaaaaaaaaaaagaaaagaaaasaaaacacaacaggtgcagaggaacaaagataaggaagaatagtttcttgtcagaccctatatgctatggtccaaatgttggtgtccccctaaaacttata

SEQ ID NO: 47792 - DNA, 201 bp, Homo sapiens
gcaagaaaatcatgtcaagatatatcagaatcaaattattaaaaagacagataactggaaaattgtaaaagcaatcagaaaaaaactaacatggccaggcrcggtggctcatgcctgtaatcccagcactttgggaggccaaggcaggtggatcacgaggtcaggagttcaagaccagcctggccaatatggtgaaacccc

SEQ ID NO: 47793 - DNA, 201 bp, Homo sapiens
aatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagctgcagatccatga

SEQ ID NO: 47794 - DNA, 201 bp, Homo sapiens
tttctttatatcaacaacacttttcaaaaaaaatttttaagaggccatgtataatagcaatacatataaatagtaccaaggattaaatttgtagggaaaasccaatggccaagaataatcaaaagaaattatagatggggtgcgatggctcacatatgtaatcccagcactttgggaggccaaggtaggtggatcacctga

SEQ ID NO: 47795 - DNA, 201 bp, Homo sapiens
gatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagctgcagatcc

SEQ ID NO: 47796 - DNA, 201 bp, Homo sapiens
tgtggacagtgcagtagataggaaataaaatatatagggatcagaaaggaagaaataaaactcacttatagatgatatacttatctgcttgtaaaatcaaragaatctacagacaaattcttaatcagtgagtcaataaggagactatatgcaaaattaatatacaaaagtcaatcatgtttctttatatcaacaacactt

SEQ ID NO: 47797 - DNA, 201 bp, Homo sapiens
tagaaatgtaaaaatgggcataactgcaattacttcaaaaataaacaaataaggaagtatcagaaaataaacaaattaagagtattatgaaaatttacacrcaataagaatacaatttagaaaaaggaatatccttctaggaaaatgcaacttaaaaaaactgactcaaagaaaaaaaatctataatgtcagataaacatt

SEQ ID NO: 47798 - DNA, 201 bp, Homo sapiens
agatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagctgcagatc

SEQ ID NO: 47799 - DNA, 201 bp, Homo sapiens
ggatatatctatcttgtgccatttcaatgggcatgtgacaaaggaaaattacactgtcattgtgttcccagtcgacccttgctactctgctgcttccattmcctcattgtgagtcctgcttttgccaaactaattctagcacatttttcttctactctatgaggaggagatgagaaagggagagccagacttaaagacgta

SEQ ID NO: 47800 - DNA, 201 bp, Homo sapiens
ttggaatagagatgctgaagcagcttattcaaaagaaagggaacgacaaagatatgaatttataaaaatacaaatgaatgagatgaataacaaatgtcaayagaggggacacaaatccaacaagttttttaaatggtttcaaagctctggcaagattaatcaagcaaaacgtgggtaaaacacaaataaacaattttagaa

SEQ ID NO: 47801 - DNA, 201 bp, Homo sapiens
tagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagctgcagat

SEQ ID NO: 47802 - DNA, 201 bp, Homo sapiens
ttactccaagataaatgatggcatatgttcacccaaaaatttgtacacagatgtgtacatatccctatgatgaaataattaccaataaaaaggatcaaatrtggatacacacacaacatagataaatgttgaaactatgttgagtgaaagaagccagacaaaaagagagtacatgcagaatgtttccatttgtataaaatt

SEQ ID NO: 47803 - DNA, 201 bp, Homo sapiens
ttcccaatgtctttcttagatgattaggtagttgaaagacgctactgtttacgaggcattgctaaaagcttttgggttccatgagggagagggccatgacmtactcctttgtacatttccccactcctccgtttacatcacataaacatatatgtatggtcttccatgcagtcagccaaatcagacaaatcatgcctagga

SEQ ID NO: 47804 - DNA, 201 bp, Homo sapiens
tgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagc

SEQ ID NO: 47805 - DNA, 201 bp, Homo sapiens
atgatggaaggctgctgtgtatgcccaactttatggctagatgggtcagaaagcatccagttcatgaaaggcagtttaggttgcatggtgacttgatgacytacagtcaaacattcagtttctaccaaagcccagtaacaggccaagagttgtctctcaaatggagagtagtgatctgcagaagatggcagggccttgctc

SEQ ID NO: 47806 - DNA, 201 bp, Homo sapiens
tcactgctgtctatgatgctggggttccagggcatttgtgtgatggacaatggcataaagtcactgccaacaagatcaaacaccgcattgagctcacagtygatgggaaccaggtggaagcccaaagcccaaacccagcatctacatcagctgacacaaatgaccctgtgtttgttggaggcttcccaggtgagtgttggc

SEQ ID NO: 47807 - DNA, 201 bp, Homo sapiens
ctgtgtaatcttaggtaactctttgaagtttagtttccgcatctaagaatgaggaagtataaatacatatctgcccacgttggttgtattaaatgagatamtttacataacacatccgactaaggtgcagatgtaataaatgacagctgttattatcatttatttcagcacgttgcagaaagcaacttacaatttcttctt

SEQ ID NO: 47808 - DNA, 201 bp, Homo sapiens
atgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgag

SEQ ID NO: 47809 - DNA, 201 bp, Homo sapiens
tgatcatgtatataccacttacagttgatgatggaaggctgctgtgtatgcccaactttatggctagatgggtcagaaagcatccagttcatgaaaggcartttaggttgcatggtgacttgatgacctacagtcaaacattcagtttctaccaaagcccagtaacaggccaagagttgtctctcaaatggagagtagtga

SEQ ID NO: 47810 - DNA, 201 bp, Homo sapiens
agtgccagattggaagcacgtttgttttaaagcccacacatatgtaaaaacatacacagataaacaaatgtagcagcctcagaaatacaggcttatttttytctgttgtggattacttctatctagatagatatcctggggtttagaattttattttatcttgcctaatactttgttggaaacaaaatttggtgacttatt

SEQ ID NO: 47811 - DNA, 201 bp, Homo sapiens
ttattctgaaaacagtaattttcaatatactattttcttataaccactttaaagaaattaaggacttgcaggttgtctggttttttactatttttcttatscatagcaaggttggtgctcaataatactagatgagcaactgaatgaagagatgacaaaaataaatgaatttattaccactgcatgttaaagaagtgtact

SEQ ID NO: 47812 - DNA, 201 bp, Homo sapiens
gatgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtga

SEQ ID NO: 47813 - DNA, 201 bp, Homo sapiens
tagatttgcatccatccaataatctttctcaccagtgtaattagaaaggatacagcttaacacatagcttttgagcagatttttaaaaatatcattatacrttaaatatagttgagagggtaaaatgaagaatgtacagttaatattttccttatacagacatggacgcagctcataatgttgaaggatacctctgttgct

SEQ ID NO: 47814 - DNA, 201 bp, Homo sapiens
aattaaggacttgcaggttgtctggttttttactatttttcttatccatagcaaggttggtgctcaataatactagatgagcaactgaatgaagagatgayaaaaataaatgaatttattaccactgcatgttaaagaagtgtacttttttatgcttgtctttgagaaaagtgtcaaggtggcatacatgacaaaacacaa

SEQ ID NO: 47815 - DNA, 201 bp, Homo sapiens
taatgaaactatgagttaatcaataaatatgtctgagcacattcctttagccattccagggtgtgatatgagaaaactgattcacacgcactgagcactcrataataagtacttactatgcagtagactacagagatgaataatgtagtttttattcttaaagaattacgctaatatgtaagaaacaattagacagcatca

SEQ ID NO: 47816 - DNA, 201 bp, Homo sapiens
attgatagatgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagta

SEQ ID NO: 47817 - DNA, 201 bp, Homo sapiens
gtaggaatgctgagaggtttaatagattagactccattttgtttagattaacagttaaaacaactttaaaaatttttattaaattatgtttttgcaaccaytgaagtatagataaacaaaaaaagaaaaaaattaattatatgttaataactttttaaaattcatcagtacaaataaattatagaatcataaaggaaaata

SEQ ID NO: 47818 - DNA, 201 bp, Homo sapiens
gtccctgctgagcaaaagacaaagacctccttctccattgtcccgcactgatggtgggcttgggatgtattttcagaaataattatttgcagggaacttayaaaaacaaatgaatcaccctcatcactgtgcttgttccgttttgggatgtttgtctactagactttctaaattgggagatttagaaattcagtaagaaag

SEQ ID NO: 47819 - DNA, 201 bp, Homo sapiens
agcttatttgtgccactctttctttaattctgcacaagaagggcctgttaggcaaagggatgtagcgtatctgaaattgtgttgggagcccaggctctttsctcaatcaaactaatgcacttttaaaactgtgcatgaattttgctacccacttaatttatgaaagtgctattagtctgcagggttccttacaacattcct

SEQ ID NO: 47820 - DNA, 201 bp, Homo sapiens
attggctacagcacattaattagtatataattacacatctggccatttcttcttccaagcaagtgcacaaccaggtgccctgctcaaaattctgccccctrggaagacttccctttgctactgtccttcagggatgtcctagaaaggggctgtagtgctgcagctgtccacttttgggtgctacctgcatatcttgcagaa

SEQ ID NO: 47821 - DNA, 201 bp, Homo sapiens
agtagtaaattataaacaatatattttgaattcataattaaaattaacgagtcaattttctgaggcattgacctattaaagatttatgagttacctaaaaycccaaatcttccctgaggtaatagcttcagttgagataaagggaaggtatcttatttgtcgcttcactgcaggaaaaaataaaatttgtgattatgactc

SEQ ID NO: 47822 - DNA, 201 bp, Homo sapiens
tcttccaagtccctgaccatccagccaaaccattggctacagcacattaattagtatataattacacatctggccatttcttcttccaagcaagtgcacarccaggtgccctgctcaaaattctgccccctgggaagacttccctttgctactgtccttcagggatgtcctagaaaggggctgtagtgctgcagctgtcca

SEQ ID NO: 47823 - DNA, 201 bp, Homo sapiens
tattgaaggaaataaacttttttctaaccatatttatgcaatcaatatttattaggtagtttttgagaaaatcttatatgagaacttattccttgtatacmaaatgtttcatggaacaccaccagcatagacatttttgtttactctgtgcaactggatttcgttctggggagcttcaatttgtacatgagctcattttca

SEQ ID NO: 47824 - DNA, 201 bp, Homo sapiens
gaacaaaaaggacgaggcaataccttcttaacactgataattaaataagataagcttaaattataaaatcagcacagagggaatgtaaattggttcaaccrttatggaaggaaaaaagtaggaaggttcctcaaaaaattcaaaatgggactgcgaggccgggtgtggtggctcaagcctgtaatctcagcactttgggag

SEQ ID NO: 47825 - DNA, 201 bp, Homo sapiens
acacttcattcactgaactataataaaattcacttcaaaaggaatgtgaacaaaatgaaagaacttggatataaaggggcaaaagtgaacaaaaagatagraaatgtgtacaaatctaagtaagcattatggaaagcataatgataataattattaaatatgtggaattaaaaacaaagtggaactaaaacacaagagact

SEQ ID NO: 47826 - DNA, 201 bp, Homo sapiens
cttctctgcctctgtcaactgatcatggggaactccctgtgaggccatcagtgcaggcttggggagagaaggcagggtggcaggagtggaggccatgggcrtttgagccacttcctcatgcaactgacttgtgcctttaggactggctcgagcctgatcatgtatataccacttacagttgatgatggaaggctgctgtgt

SEQ ID NO: 47827 - DNA, 201 bp, Homo sapiens
aaagaaatcaatattattagattatgcgtgatcattattttctaggtggttttctaaagttcctgaaaggtcattcagagcattgggaagaagaaatttgsgatagtagtaaattaaaagcaatttcaccagtgcctgtacgaaataattgaatggggaatgaccttgggttgtctgtttgcaagaatataaatgtctaat

SEQ ID NO: 47828 - DNA, 201 bp, Homo sapiens
acacgtgaacactggctatgggagaaacagtaccatattttggacactgattcaaggcatacacagccttctggagaactttgccccagtccggcaaagtwttgtcacctagttggcattgtaattatgacttcaaaagggcattccacaattctatcaatccacctgcttcaggatgatgggaaacatgataagaccagt

SEQ ID NO: 47829 - DNA, 201 bp, Homo sapiens
ctgaatttttaaataatcttctaaagtttgaacccagataagccttaaaatactcattatattcaaatttttctgttcaattataaaaaagtacaaagccytaatggaattaattaaaggctcaatattttcttccaagattacttttagaaatgcaactttatttgttgtacatgctcacctaataacaaatcatgttaa

SEQ ID NO: 47830 - DNA, 201 bp, Homo sapiens
ccttggtgacagcattcttccctctggaactaagatgtctaggccagcagaacataatgttgtgggaacaggaagcaaaattttgctagtgggtcactagyggtgatggtgagtggtgccacttccgcttccaccccttgattctgggacacgtgaacactggctatgggagaaacagtaccatattttggacactgattc

SEQ ID NO: 47831 - DNA, 201 bp, Homo sapiens
agagaatcattttcaaatcctgatttctgttaattatgaacacactagctatatggcctttctgtggataggcttaattaggagggtctgggcaaagcttygctacagcagcatcaaaagtctgatttacaagtagactcaaatatggcttagtaggaagtgaacatagccctaggctacacttagaaaaaattattttct

SEQ ID NO: 47832 - DNA, 201 bp, Homo sapiens
tgtgacaaataccataaactgattagcttataaacaatagaaatatatctctcacagttctgaggctgggaagcccaagatcaaggtaccagcaatgttcratgtctagtgaaggcctgttcctcacagagggtgacttcttgctatgaccccacatttaattcatttaatatctggatactgaggaaaaggatagctagc

SEQ ID NO: 47833 - DNA, 201 bp, Homo sapiens
tctaaatcattttgcctcagttttagaataatttgtagaatgtcagaataacaatggagaattaaaggaagggaaaaatgaacaaacggtttattaaaagyatacaaaataaagggatcactgtgtttatgctatctgtatgatgatataacaaacatttctatccagataacatgcatttcaggaagaaaatactgcact

SEQ ID NO: 47834 - DNA, 201 bp, Homo sapiens
aatcaatatcttacagtttacttgtaggaaagatgatgaagtaaatatacatttatgcagctgaacacttgaaatctacaagaggggtaaaaagaacaaarattctgtaataataccagaaaagagctataacctcatacctaggcacaaggacatacatgtgcaaagtatgaggatatgaggaactaattaattttccaa

SEQ ID NO: 47835 - DNA, 201 bp, Homo sapiens
ccatgtgtttaccttataacttcatgagctagacttgtacagaagctttgaaaaaatccccatggctgtcatattcataagtctctctgacccattcagasagatgttagtatattgcttggagcgtactataaaacttacctttcacttatggaaatgtgcttgtactttgttccccaaaaagcaaatacagataccata

SEQ ID NO: 47836 - DNA, 201 bp, Homo sapiens
attgagattcagtgaggtatataaataagtctaattttaacactctgatttatagtagcaaacaagttttcatttgtaaattaagcctagatatatatacrtatgaactatattgaataggtgggcatttcttgggcaaataatttagttttttttttttttcctattacatctggaaaataaatcttgtatatacagtat

SEQ ID NO: 47837 - DNA, 201 bp, Homo sapiens
gcctaagagatcctaatgacatgtatacctatgaagtggcattgtttaaatagataggcttttcttggtctaagttggtttcttaaatttcctagtctatwccattaaataatgactttaattctctattctttttgctatgttagtaagtttgaagtttcattttaaaactaaacatgtgggccaggcacggtggctcat

SEQ ID NO: 47838 - DNA, 201 bp, Homo sapiens
gtgagaccctgtctgtatcactccgttttcacactgctgtaaagatactacccgagactgggtaatttataaaggaaagaggtttagttgactcacccttbtgcatggctaggaggcctcaggaaacttatgatcaaaggggaagagggagcaggcacatcttacatggtacaggagagagaggagaaagtgaatggggaa

SEQ ID NO: 47839 - DNA, 201 bp, Homo sapiens
cttataaagagtaaaatagatggattttttatcctgacaattactgtgtgtttagtccctaaatttaatatagttaataatatgattgggttttgctattwgtttcccatttgtgtcacaaaatttttgttcccattcttccttttctgtctacttttatgttaaacaaatatttttcagtattccattttatttccttta

SEQ ID NO: 47840 - DNA, 201 bp, Homo sapiens
tagccactgctatgactatcttatcagcaatgcagagcttgcgtttccagcctccaagtgttatgctacaggtcactgttttttttaaactcttacctgartatgcttcgacctacttctttattttaattctttctttcttttgaggttagaaacaccatgctttaattgctgtaacccccaaaagaaatataatattga

SEQ ID NO: 47841 - DNA, 201 bp, Homo sapiens
catgctcctataatcccagctactggaaagaagctatggtgggaggatctcttgagcccaggagtttgaggccagcctgggccacatagtgagaccctgtstgtatcactccgttttcacactgctgtaaagatactacccgagactgggtaatttataaaggaaagaggtttagttgactcacccttctgcatggctagg

SEQ ID NO: 47842 - DNA, 201 bp, Homo sapiens
gcttgagatgctcttgcaataatgtttgtaacaaaagcagctggagaagatgatcatagcaattatgcagacagccatagaaatgagcaaaaccagccatsgaatgctgccatcaaaaaacggacctatgacaacagggggcatgtgggttgcaaatactggttacataaattggtccgacaacattctattgtccggcgt

SEQ ID NO: 47843 - DNA, 201 bp, Homo sapiens
acaattatacttagatgggccatctaaaatgtccttccagcttgtggagtaggttgtgtttgtttttcaatgaacatctgtttgacaaattgaaatgctarttatgatttatcatttccatgacatcaaatatccagatagtaataaacgttgatgactaactatatttttcagtttcagccagatgtttggcatcacgta

SEQ ID NO: 47844 - DNA, 201 bp, Homo sapiens
ttcctctatactgcctaggcccagaatctaaattagatcaaatttcaaaagatatttcttatgaaagctgatttatacacgcacacacacacacgcgcgcrcacacacatattcatttaacaaagaaaaaacatacagctttagcaggttgggaagtggcatttattaatatcatcttcattttaaaaagtgagtacaaat

SEQ ID NO: 47845 - DNA, 201 bp, Homo sapiens
gaacagtatttactacctgctgttccttttcactatttgcagtaccattcttagactcactgcaggcataaaccctgggataaggaaaagttaagcctccrttcttcatacctctaataaggctttgccaatggctgcaatcattttacaaccatccacttatgtttaggtttaacagagtcttggcttcataatgaaata

SEQ ID NO: 47846 - DNA, 201 bp, Homo sapiens
ttcagtaatatgtgaaagtaagagtggtaccataaagttcagtcaagtctagactagaaaaatatccaaagcagtttagactacgaacatcttttttttttcttttcttttctttttttttgagacagaggctcgctctgtcgccaggctggagtgcagtggcgtgatctcggctcactgccaagctgttgaccttagtta

SEQ ID NO: 47847 - DNA, 201 bp, Homo sapiens
gaatgaaattagtactggatgattggattaaaagccagtagaaattatatattatcctatttaaatgtaggactatataagttattggtaatcctttttcrtaattttattactttttccagtacctaagtggatactggtgactggtatataataagtaaccaatgaatagatattgaataatgcattgctttgctcaat

SEQ ID NO: 47848 - DNA, 201 bp, Homo sapiens
ttgctgaacacactaagatgtagctttctctataacctcctattcaactgtcagcaaatcagtaaaagtaccctgagaggaaaatggctagcttaccttawtttgcttccctttacttaagtctggctgccttggttgcttgctgatgccttcaaactgctgtttttagtattttatccagcttttatggttgttgtcttt

SEQ ID NO: 47849 - DNA, 201 bp, Homo sapiens
aaagatttaacagtggtgtctgcatttgataaaatgtaaatgagaagctcccaaaagagattgagaagctctattttgacaactcttcttttatctgtgtwattattatatactttaactgaagaaagaaaaacacaaagataaatacaatatttcaacttcgagtactttttaaaaattatttgaaagcatttaaaaata

SEQ ID NO: 47850 - DNA, 201 bp, Homo sapiens
aaaacagcaaatttataaaagtagtgtgtcagtttgataataattgataatcaaattctaaacacctctttcagccctgcagtaagacaactttgcactayaggcagcaggtaaacagagaagggaaaacaagaaatttcacaagttttctatttggttattaaataggaatcgtacttcaactcagttcacgtttccacc

SEQ ID NO: 47851 - DNA, 201 bp, Homo sapiens
caccagtttgataaacactgttctaaattgtggttaaagcttttggtagttaacgaggtaggagaaaacattaaagaaattggggttgtttcacctgatgraaaaagatgaaaggtgtcaacttactatcagtcaattatcagatatttattaagaaattatagaatacctcagcattgcacttggttccctggggatttc

SEQ ID NO: 47852 - DNA, 201 bp, Homo sapiens
acaactatttatatagcatttacattttgttaggtattataagtaatctagagatgatctaaagtgtacaggaggatgtgcataggctgtatgcaagtacyatgccactgtataacaggaacttgagtatccttgaatcttggtgtttgagggaggtcctggaaccattcccatggatattgagggatggctgtattttct

SEQ ID NO: 47853 - DNA, 201 bp, Homo sapiens
atttgaattacccgtgcattactgtttcatatattcatggtactttcatattttataacatttaaaaatatttcaatattccattgatttgaataagattytttaaattacagtgaaagctttctgataaggtatggtaagattatttttcagtaattatgctgatacatataataaagctactgacaattcataaagatg

SEQ ID NO: 47854 - DNA, 201 bp, Homo sapiens
ctggcctaaatcagttttattatgtcacttaaatatgtgcaaacataaaatcaggtataaactctttatacttatagctctataaaattaaaacaaattartccttacaaaaccaataaaattcaaattaaaaacattaatataaagtaacatgattttggctgaatggaaattgctgcttgcaacaagaataggatattg

SEQ ID NO: 47855 - DNA, 201 bp, Homo sapiens
gtaaaaaaatgtgcagggaagtaaatatataagtgacaatggaacaggaggataaaatagggcaggggcaataagggggtggagggggtggagtgggtgaragagtcaagagagtactgatagtggcaagccggaaaatgccagaatgctttttgatagaattttttcattaatgacaatgaattaagtgaacataaccta

SEQ ID NO: 47856 - DNA, 201 bp, Homo sapiens
ttatttttcagtaattatgctgatacatataataaagctactgacaattcataaagatgataatacacttagtacaaactgagcttcaatgggattactaratgagtatgtgaggacagagcagaggaaaaggccaagggttgagcactgtggtgctctattatgagaaagttaggaaggattaaagttggcactgaaggg

SEQ ID NO: 47857 - DNA, 201 bp, Homo sapiens
tcagttgatctccagatgctgattactgatctaacactttgcttgttgtaccccctaaatgtcatcctctctctgctcgtactcactgctcaagtaagttyttatttgaaaggacagtaagtatgtcatagttttctatagtctaagctgtgtcatgttgttcacatccaggtgttaggcaatctataaaacatcttctgt

SEQ ID NO: 47858 - DNA, 201 bp, Homo sapiens
ttaacaattttggtttggttcaatttgttgcataggtaataataatccatttacagaatacaaaaatagtgtaagtatgtgcttcttcctatctgtatgtygagagattcctcattcttttttatggttgcagataattcattatgcagatatacaatttatttaaccagtcccatattgatggatattaggttatttcca

SEQ ID NO: 47859 - DNA, 201 bp, Homo sapiens
tttagccagtatattcaacattaatgaattcagccctttattcatttactgcttccatgtttagagcccattctacctcgattaaaaataaatataaaackagctaaaattacaaaatgagaaattttaagtgtatgtaatctcagtaatgacatttattttctgctaatcattgagactcctctaagatttaaaacatta

SEQ ID NO: 47860 - DNA, 201 bp, Homo sapiens
tttacagaatacaaaaatagtgtaagtatgtgcttcttcctatctgtatgttgagagattcctcattcttttttatggttgcagataattcattatgcagwtatacaatttatttaaccagtcccatattgatggatattaggttatttccagtcctttgatgtgaccaaaaaagattataataaaaaatgctgaaagaat

SEQ ID NO: 47861 - DNA, 201 bp, Homo sapiens
tgcacccctagaggcctaggaatcaactccctccttcttgccatatccaaaaatattaacaacattttgaggggagccttaaaacaagctaatcgaccccmaaaaaacacatagatcccaggcatcagagaaggagaattcagtcttcaagaccactcccagctgggccttcctgctttcttctgagcctaaacccagtga

SEQ ID NO: 47862 - DNA, 201 bp, Homo sapiens
tatttttcttgtagcgttgtcgtcgggatgaggtactgcaagcttcatgaaatggattcagaagtattccctcctcataatttataaaagcgttttcacartcaatgaggtagaaaacagaaatactttagaggaacccaaaagctcactatttgaaaagatcagtaaagttggtaatattctagaaaggttaatcaagaa

SEQ ID NO: 47863 - DNA, 201 bp, Homo sapiens
gaaggggccaagatagtagggggctagagtgtcagtgctgccccgagcatatgcacacctggctgggttgcaacagcctcagctttgctctgaaatcagcytgggtgccgggaacagtgagagaccaggaagaaggagcgggcacttctgagcctgtaggggaagagaggtggctgagggcacagggatgcctgggtccac

SEQ ID NO: 47864 - DNA, 201 bp, Homo sapiens
gtagatcctctaagaatctgtatatctctaagccaatatctgtataacttaaaaattataaagctgtattttaaaatatactctgttctttaaatccaaarctcactgacatttttacttaatatgaattaatgaggtagtattatacatttaaatacatatagtaacaaattataaatgagaccaagaatattattttaa

SEQ ID NO: 47865 - DNA, 201 bp, Homo sapiens
gagaagaccaagggagaagaattctaggtagagaagacagcaagcaaaaggacctcttccaaatccttgctcccttgaagattgagcatccctataatttrtcacctggtccagtggttttatcctttggctacatggtttttcaattactggaatatttttaaaatacagtggttcacgcctatgatcccagcacttggg

SEQ ID NO: 47866 - DNA, 201 bp, Homo sapiens
cagtttcacagaggagttggaatttggactgagttttgaacagaagagaatttcgatgggcagatcaggaaaagagcagttcaggaggagggaatggtggrctgtggagcatgggcgaccagaaaggcagattaagttaaaacagggttgacaaattgggagaacacaggattaagggactggaatttaagtttagatttg

SEQ ID NO: 47867 - DNA, 201 bp, Homo sapiens
ttcttattgtctctttctggaaatcattttttgtatgttgggccaattgatattttcccccatctcactgaggttcttatttttttaattatttttgtatytgtattttttatttctgatagtttctattgttaagtgtccaaagtcactgattttttaatgcagcctaacctgtttttaatccaattgagtctatttttt

SEQ ID NO: 47868 - DNA, 201 bp, Homo sapiens
acatttctcctttcccagaaggccctcactgtttttttgctgtcttcttccacagccctgaaactcttatctgattagtttcatctgtcttagaatttccyttatatgaaacaccaactaagtacttttttctgtctgccttctttcacccagtctactgtctgtaaaaatcattcatgtttttgcatccatcaatatttt

SEQ ID NO: 47869 - DNA, 201 bp, Homo sapiens
tcaaacctgtgttgttcaggtgtcaactgtatatgaaggctttcttctttaaacagaaaggaagtattttgtgcccaagatttggagaaagcaatgggatmaaaatatcatagagattttatggtatttgtcctttttttccttttccccttcactaagggtcttgaaaaactggtctgaaactccgctccagtagagcaa

SEQ ID NO: 47870 - DNA, 201 bp, Homo sapiens
tcctgctgtctcttgtgggcatttagtgctataaatttccctctacacactgctttgaatgtgtcccagagattctggtatgttgtgtctttgttcttgtyggtttcaaagaacatctttatttctgccttcatttcgttatgtacccagtagtcattcaggagcaggttgttcagtttccatgtagttgagcagttttga

SEQ ID NO: 47871 - DNA, 201 bp, Homo sapiens
tctgctttttagagtttccagtttttctgttctgttttttccccatctttgtggttttatctacttttggtctttgatgatggtgatgtacagatgggttyttggtgtggatgtcctttctgtttattagttttccttctaacagacaggaccctcaactgcaggtctgttggagtaccctgccatgtgaggtgtcagtgt

SEQ ID NO: 47872 - DNA, 201 bp, Homo sapiens
ccctctttgactttctcactaaactgcaaattcctggtgagtgacaactggattctattcttcttctaacctctagaacctagcagattgctttggagacsttaggaacttaataattctttgttgagtgaataaagggatgctttttgtggacagcagttatttctgtttacacaaaagataagagaaaatacaggtaaa

SEQ ID NO: 47873 - DNA, 201 bp, Homo sapiens
ccaacactatattgaataggagtggtgagagagggcatccctgtcttgtgccagttttcaaagggaatgcttccagtttttgccaattcagtatgatattygctgtgggtttgtcatagatagctcttattattttgaaatatgtcccatcaatacctaatttattgagagtttttagcatgaagtgtggttgaattttgt

SEQ ID NO: 47874 - DNA, 201 bp, Homo sapiens
ttctagttctagatccctgaggaatcgccacactgacttccacaatggttgaactagtttacagtcccaccaacagtgtaaaagtgttcctatttctccayatcctctccagcacctgttgtttcctgactttttaatgactgccattctaactggtgtgagatggtatctcattgtggttttgatttgcatttctctgat

SEQ ID NO: 47875 - DNA, 201 bp, Homo sapiens
attaaacatttccattaaaatttataaaaatcgtcccgatatttagttgaaaagtgaggaatatatacataggtatacatatgtttaggaaatataaaaasgaaataaacttaggttctggaccaagtaatttaaataaaaaaggaataaagtcataaatagcattattataataaaaactggtaaaacacaccaggacaa

SEQ ID NO: 47876 - DNA, 201 bp, Homo sapiens
cattttaaaggtataatttcttttttgtttgtttttttcgtttttttattttttatttttatttttttcttttattattatactttaagttttagggtacrtgtgcacattgtgcaggttagttacatatgtatacatgtgccatgctggtgcgctgcacccactaactcgtcatctagcattaggtatatctcccaatgc

SEQ ID NO: 47877 - DNA, 201 bp, Homo sapiens
aattttaaacttccattctacttcactacaaatggaatttcattatatctgactccacaataagtgggttccagaatcgttgacatttagtagaattacasatcttagtgtctttgtacattctgtattaaaatgcattatgtgtgctttcaattctgttttaaagaaattgccattgatttacatggttgtatggaagag

SEQ ID NO: 47878 - DNA, 201 bp, Homo sapiens
aaggggcagcaaggaggtaccaccttggaagcagagagcaagccctcaccacacatcaaatctgctgatgcctggatcttggatttcctagtctccagcaytgtgagcagtatatttttaatgcttaaaaactacctagtccctgttattttgttgtagcagcctgaatgcatcagtacactttgcaagccagaatacaat

SEQ ID NO: 47879 - DNA, 201 bp, Homo sapiens
tcagtggaatagtctagtttaactttgatgtagaaaatttaggcagtcctcaacctctctaggtatgctgaattaaaaaaaaaaaagaatgacatttttamttcccatggcaaatggagttctcctctttcttctgttcctcttcttcaccttgcaatgactgtcattttgtaaaactttctctctgtctctgtctctctt

SEQ ID NO: 47880 - DNA, 201 bp, Homo sapiens
tttttcctttgtctctatctccctagatagaaatatgtggaggttggatttcctgctgagtttctttatttttttcctttcttttttttttttttttttttaagatggagtctcaccctgttgcccaggctggagtgcaatggcgtgatcttggctcactgcaacctccgcctcccgggttcaagtgattctcctgcctca

SEQ ID NO: 47881 - DNA, 201 bp, Homo sapiens
gccactatcctggttatggatggtaatagaactgcctatttatttgatgtcttcacttagttgtctcctaggtccttcacagcgaacatttgccaggattkaacataggtactctgcatttcctcaactcttttcccatcagcttttcccaactcagaaaatggtaccatcattcaccccttgaatcaaatttgacatcta

SEQ ID NO: 47882 - DNA, 201 bp, Homo sapiens
atcagagactaggattgcaacccctgcctttttttgttttccatttgcttggtagatcttcctccatccttttattttgagcctatgtgtgtctctgcacrtgagatgggtttcctgaatacggaacactgatgggtcttgactctttatccaatttgccagtctgtgtcttttaattggagcatttagtccatttacatt

SEQ ID NO: 47883 - DNA, 201 bp, Homo sapiens
gagagggctgcaacagcttaattccttgtagtgttcataaagaaccaatcctgctgacagcttgatctcacatagcaaaataatacatgactttttttcckccttgatttccatgagaattgggtgaaagctattactcatataagcggatgacctgattctctcatttttgtggttacctttgattagtgttttggtctt

SEQ ID NO: 47884 - DNA, 201 bp, Homo sapiens
taattgattctttattggcttttctgaagtaactttacagaagttacttcagcaagctagaaacaacggtatttattatactgtataatgaaccctttaaraatagtcaatgtgtaaatgtcagtgaatgaaaagaacaagaaccaaacagatatacctaagaatcagagcaagattaatctcaaaattccttctgaaaag

SEQ ID NO: 47885 - DNA, 201 bp, Homo sapiens
aacagaagtgctgtcttccagtgttaaacaggaatttgtgggattacaagatagatgatcaacccagattgctatgagtgataaccgtgcttcctcctgtytaccttctaccatattcactggtttatggcacctcccacatatgctgctacacaaccaaggcattattaccagggaagtcaattcagccataactctata

SEQ ID NO: 47886 - DNA, 201 bp, Homo sapiens
tggattgcacggtagacctgccttccacccatatgggcctcctcgggatatgaggaactggtggcggcaggggctcagtgctgcagcttatatcaccaaayggcatggacttatttctaccctcactaatatacagcagctgaatgtcagtcctgagttaataatatttctcaggaagtctcagagcactatcagagaatg

SEQ ID NO: 47887 - DNA, 201 bp, Homo sapiens
accagcaccaatttgaaagtgtttcaataaactctcaatgtaaaacttcacgttgttttctgtagcttttcagtaacttcttacactcatgttctatgtgmggctcagtggggaactatctgtatccagtggattgttggttctgacacactagcctacgtgcatatggggcaacccccaacatgctggcccctgccactt

SEQ ID NO: 47888 - DNA, 201 bp, Homo sapiens
caagagaagcatacacattctaaagcatttcaaatgtttattatgatgtcctagaggtggctgtctttctgttgctgtgcataccctgagcagacttgacwttgctttggaagcacatattttctgatagacatattactctcataatctaaaatttttcagaagtgacaaaagtggggttgaccattttcttcttcgctg

SEQ ID NO: 47889 - DNA, 201 bp, Homo sapiens
ttttttcctttgtctctatctccctagatagaaatatgtggaggttggatttcctgctgagtttctttatttttttcctttcttttttttttttttttttttaagatggagtctcaccctgttgcccaggctggagtgcaatggcgtgatcttggctcactgcaacctccgcctcccgggttcaagtgattctcctgcctc

SEQ ID NO: 47890 - DNA, 201 bp, Homo sapiens
ttaattgattctttattggcttttctgaagtaactttacagaagttacttcagcaagctagaaacaacggtatttattatactgtataatgaaccctttargaatagtcaatgtgtaaatgtcagtgaatgaaaagaacaagaaccaaacagatatacctaagaatcagagcaagattaatctcaaaattccttctgaaaa

SEQ ID NO: 47891 - DNA, 201 bp, Homo sapiens
tcaattaggtggaacatattcatatttttatcatgaggcattttgagtctattctttgtgacaccagaattagtttctcatctcagagtttgctgtatttstctggtgactcaagtagtttattggcagtcagtttgtaaaaggctccctgggattatctaaatgcaggacgttaggaatggaaatatgtatcattgcctc

SEQ ID NO: 47892 - DNA, 201 bp, Homo sapiens
tgatgtgatgcccccagcgttgatctttttgcttagaattgctttggttatttgggctcctttttgtttccatattaattttagaattgttttttctaatyctgtgaaaaatgacattggtaatttgatagggattgcactgaatctgtagattgttttgggtagcatagtcattttaatgatattgattctttctatcca

SEQ ID NO: 47893 - DNA, 201 bp, Homo sapiens
tgcctagggcctctaggtactatttgtacaatttgtggaccaacaggggtagactggagatggagatttatcccaggcttgctcaccaccccaaatcccamgtctatacaccagagaaaggattacccatcaccaaaggtgtctctcattccctaaattatgcatagatcaggtggtctgattgtgtctgtccagataggg

SEQ ID NO: 47894 - DNA, 201 bp, Homo sapiens
aggaggctgagatgggaagattacttgaacccgggaggtcgaggctgcagtgacccatgatcacaccactgcactttagcctgggcaacagagcaagaccytatctaggaacaataaaaaattcattattcattatttgatccaaaacaaaaacatgttatagactatctatagattcaattttcaaaaatcctatgcttc

SEQ ID NO: 47895 - DNA, 201 bp, Homo sapiens
atttaaaaagatttgcaacttatcatctatccagtttgcagtagggccttatttagcatctagaaaccatgtgaaaaagatcaggaagaaattattgtaartaattattgtaaatggttgcacaagtggtttaacttctaatctagaagattcgggtttaggatttgtttacagttgcaacttgagcctcgatagctaaac

SEQ ID NO: 47896 - DNA, 201 bp, Homo sapiens
gacaagcataataatggaaaatcgtctatacgagaaatctaattattttaggcacaaatcattttttaaaatgtattctaaaataaaaatgccattgaggmacagaggtcttactaatctgtaaagcaaacatgatttatatagtatgcttacattagtaaatcaggattatttgggtgaacagagtataatattgatata

SEQ ID NO: 47897 - DNA, 201 bp, Homo sapiens
taaatctaatgcaggaggcagacagtaactaaacaatataattgtatatgcggtaagtgctatgaaggaattaaacaaggtgacacaacagaaagtagttstgtcgggcaattttagataaaatggcgagtgaatgctgtgcatggaggtgacatcttgccagagacaggagaatgagaaagagtttggcatgtgaagatc

SEQ ID NO: 47898 - DNA, 201 bp, Homo sapiens
ttcctttatattctcggacatatttacagaacttacgttgacttccttgtatgctaatttcaatatctgggtcacctcaggatctgcttttatcaacttcyttttttaataaggtcaacattttcctgtttctttcctgtatatctaatacagtagtcctcctttattcacagaggatatgttccaggaaccccagttgat

SEQ ID NO: 47899 - DNA, 201 bp, Homo sapiens
cacagctataatcccagctctttggaaggccaaggcaggaggatggcttgaggccaggagttcaagaccagcttaggcaaaatagtgagatccctgcctcyacaaaaataaaatgaaaaaattagctgcgtgtggtggcacatgccagtggtcccagctactcaggaggctgagatgggaagattacttgaacccgggagg

SEQ ID NO: 47900 - DNA, 201 bp, Homo sapiens
gcagagcattttgaggtcaggagttcgagagcagcctggccaacatggtgaaaccctgtctctactaaaaaacatccaaaaattagccaggcatagtggtscacgtctgtaatcccagctacttgggaggctgaggcagaagaattgtgtgaaccgggcaggcagaggttgcagtgaactgagatggtgccactgcacttc

SEQ ID NO: 47901 - DNA, 201 bp, Homo sapiens
tctttggcccctaagtggaacaagttttgagatcttattttatgctccagagcactccatggaatcaggctaagactgggacatcacctgaaatcataccyttgattagagcttttcttttccatgtcctgcttcacccactcctttgctagattctcctaggaacacttaaatggtaagcttctttgtaaatataaacta

SEQ ID NO: 47902 - DNA, 201 bp, Homo sapiens
ttgcaatggaagtcctatcggccagtttactagttaacaggagctgtagtactagagctatgactgcatcagaagtccagcagtgtgggcacaaagcagcrcagcacttttgaagttagacatcgagagtttgagtcctagattcacaccttgctggctgagtgctgttgcaatagtgctgttgagtgagttatttaactt

SEQ ID NO: 47903 - DNA, 201 bp, Homo sapiens
accacttaaatgctacatacaataaggaattttattcaaaatagctacaacatacaatctactataggctgctataatctgcattctagtatatattattrtctttgtcatagaccatttacaatatatctggaggttggctcaaggataaatgacttaaacctgttaatgttgaaagtatgtaaaattcatgaaacttta

SEQ ID NO: 47904 - DNA, 201 bp, Homo sapiens
aaagactgatgagaaacctctgaaagctgtgaaaagtgtgttattgtttttaattgcttccctaaagaatgagagaaggcgaagctgggaccctagtggtrttgatgggctgttgctccttatccatgatgtgtaagagtgaggaactaagtctgaaaactttttaaggggaaaatagcagtatagcatactgaaagtttt

SEQ ID NO: 47905 - DNA, 201 bp, Homo sapiens
atagggccctcatatatttgtgcattttgttatggtgttggtgcatttctttattgatttacaagagttctttgagtattaggaacatccttcctttatcygtgccaacagtaccttttattttgtcacacagtttattcttcatcagaattctttgctcttgagaagtccctgtgagagcctgccagccttctacacctt

SEQ ID NO: 47906 - DNA, 201 bp, Homo sapiens
catccagctaccatttcaaaaaacagcaaatttataaaagtagtgtgtcagtttgataataattgataatcaaattctaaacacctctttcagccctgcaktaagacaactttgcactacaggcagcaggtaaacagagaagggaaaacaagaaatttcacaagttttctatttggttattaaataggaatcgtacttcaa

SEQ ID NO: 47907 - DNA, 201 bp, Homo sapiens
tgatttcagatgtatagatatattgcttatcaaacactgatgggtctgaacatgagtggtagtaagatatttccagattaagtagacaaattgtgcagaaytttttagtatcactatttaaatgactaaatttttgaggtttatgtgtatccagcccaatatgtcctctccttatctagtataatttatctttaaaaatta

SEQ ID NO: 47908 - DNA, 201 bp, Homo sapiens
tttttttacattttaacattcaagataagcactagaaaaaataccaatttgtttggaagaaagtagctacttattttataagtagattgttcttagatacrtattactaagggattattaacttttctcattctatttactcatagcatattttgagcaagtgatttaatcatgctgtgcctcaacttctagattagcaga

SEQ ID NO: 47909 - DNA, 201 bp, Homo sapiens
acaaaaaagtctgtattctataatatccaattaccttaattgtgtagtggggaaaatgaagagttgaatttctggttagctagactagggtaggaagacaycagctctttgtttgttttgtgctttgacatttcaattttcccgcttggctttgtccttctgtcttcccttgacattgatgattttgttgtaggtacgtca

SEQ ID NO: 47910 - DNA, 201 bp, Homo sapiens
ttttttgtgtgtgtttctatacaattttagaatcaacttgtcaattacagaaaatattaggattattgcttagactctatatacaaatatggaaaatggakcttgaggagatgttggtcaaagaatataaaatttcagttagatagtaggaatacattgaagatatttattgtacagcatggtgactgtagttaataacaa

SEQ ID NO: 47911 - DNA, 201 bp, Homo sapiens
agtgagccaagatggtgccactgcactccagcctgggcgacagagctctgtctcaaaaaaaaaaaaaaaaaaaaagagaaaaagaaaagaaaagaaaagamaagacttgtaccttgtcatattggaaaaccagattcatttcacattgttataaaatctgtaaatgtcacaatataatttcaaatataacaccaaaaatgt

SEQ ID NO: 47912 - DNA, 201 bp, Homo sapiens
tgggaggccggggcgggtggatcacgaggtcaggagatcgagaccatcctggctaacatggtgaaaccctgtctctactaaaaaaaaaaaaaaaaaaaaaagcaaaaattagccgggcgtggtggcgggcgcttgtagtgccaggtactctggaggctgaggcaggagaatggcgtgaatccgggaggaggagcttgcagt

SEQ ID NO: 47913 - DNA, 201 bp, Homo sapiens
gtcttttgatacctgtcatctgagatacctaaaggattttttttttaagttagcatcaagggtaaataataacaaatgaagttattttatgttagatcttrtaggtctaaatatatgcacagcaatatttaacatcctgaaatcagaaattttgtttctgatggcatctctttccattatgtgatttgaaacattttaggg

SEQ ID NO: 47914 - DNA, 201 bp, Homo sapiens
aattacttgacaggaacttaagcatccgtatttgttgccaggtagtcttctgtgtggttaaagtacagaatgtactcctacaaaagcagagaggcggcccrttgccacacaaaagtgttttttcagatggcttatggttagaaccaatatatttttctagcatacagtttgagtgataatagctcacattccccgatcaca

SEQ ID NO: 47915 - DNA, 201 bp, Homo sapiens
tggatgaacaagataagtctatttatgtcccagaagcttcccatcaacattgtacttacagtttctctctttattaataaaatgtgtggcaacttttgaamcctttcagatgattgtggcaccatttagtgtgccccactaaaactttactgaaaaataactgaaatgtttttctttacccaacagagagacttctaagat

SEQ ID NO: 47916 - DNA, 201 bp, Homo sapiens
gcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctagct

SEQ ID NO: 47917 - DNA, 201 bp, Homo sapiens
cgtgaatgtccttggatgtgtatggtctcttgcttgaagttatcagccagcaaaatggtgaaatacttagaattaatcaaacatctggaggtcaagaaacrcagtacctatattcttctccttactttaagaatgaaactaataaaaaataaggcggagctggcccttcagcaaaggagggatttttattatatgagtgaa

SEQ ID NO: 47918 - DNA, 201 bp, Homo sapiens
aaaagtccttgagacaagtaacccaggagtggaatggttatgattacactttataagcaaacttaaaaagatatcaggagctgctttactaggcccctgcyatgaagtgaaaactggagaaaaatctacagcaaagcattctagcctgaggatgtgtactattttgcaacacagcagactgactacagccaaatattttca

SEQ ID NO: 47919 - DNA, 201 bp, Homo sapiens
ttctattgacacttagaagatgctatgttcacgtaatcatagaaagcttttaattaaaccctctactctttggttttaacttttctttattgatatatatmaaaaatctatttttgtgtcaaaatagcattttaaaggttactgtcattaaaactttaacaactaaattatgtacttgttttagaaatgttgatatgtggc

SEQ ID NO: 47920 - DNA, 201 bp, Homo sapiens
tgcaggcctattatgcaatactcctcaacaggggccgtctggaagtgcatctctccacaggggcacgaacaatgaggaaaattgtgatcagaccagagccraatctgtttcatgatggaagagaacattccgttcatgtagagcgaactagagggtaacaatagcactaaaatatttattattgtaactcaggtgaacttc

SEQ ID NO: 47921 - DNA, 201 bp, Homo sapiens
agcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctagc

SEQ ID NO: 47922 - DNA, 201 bp, Homo sapiens
atcatggggtgggagttaattgaaggggtagtcaagaaaggccctgctaaagaagtgttgggttggttagagcccagcaagggacttttcagctctggagrtgcttgtagagaaatgcagaggtcctaatatgggaatgaacatctcatgtagggtatagcttctcatgtttgaggaacagaaacaaggccctaaaggctc

SEQ ID NO: 47923 - DNA, 201 bp, Homo sapiens
atgtacttactatgatgaaaatgagaaaaataaatagcaaaaataaattgtagtgtttcctttaatctgataaaagaaacagttaaagtggttgaaatagwtcttcatgtataaaccatgataaatttcagaaacttcaggtggaaaaaacaatgtcattatggtattatttatatcaagttgtaaaacataaaacaatgc

SEQ ID NO: 47924 - DNA, 201 bp, Homo sapiens
tagcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctag

SEQ ID NO: 47925 - DNA, 201 bp, Homo sapiens
tcccgggttcaagtgattctcctgcctcagcctcctgagtagctgggattacaggcgagcgccaccatgcctggctaatttattcttgtatttttagtagrgatggggtttcactatgttggccaggctggtctcgaactcatgaccttgtgatctgcctgccttggcctcccaaagttctgggattacaggtgtgaacca

SEQ ID NO: 47926 - DNA, 201 bp, Homo sapiens
ctagttcattaattctcttctcagctatgtaaatattgctattaaagttattcataggattcttaatttcatatatttttcagtttctaaatttctctggktcattttctttttttctttctttcttttttttttttttttgagaccgagtctcgctctgtcacccaggctggagtgcagtggcgccatctcagctcactg

SEQ ID NO: 47927 - DNA, 201 bp, Homo sapiens
gttacctctagagaaacaggaaagggaataaaacagaagtgaaatgagattcatttgtatctaagtatcattgctttaaaaatatatctgaggcaaatatraaatataaatattttgttacctctaggttgcatgggtaatgcatgttatatgtgctttttgaatgtcttaatataatttctaatttaaaatttctttaat

SEQ ID NO: 47928 - DNA, 201 bp, Homo sapiens
atagcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagcta

SEQ ID NO: 47929 - DNA, 201 bp, Homo sapiens
gctggggtcaatcagatggtctcaggggagaggaggcatttgggaggttgggcagcagtgatttgtcaacaagtacagaagcatttcagtattttatccamtagttgttccacaactgtgcctaaaaggctaatactaaccctactttgactcattcgatgggtgatttcccctccatggctctcaagcatgcatgcattc

SEQ ID NO: 47930 - DNA, 201 bp, Homo sapiens
ataatttgatattgataacagaggaagttaaattattcaaagagctcaaccataaagcagatggcttcactttcaagctgggaatcaaaaaactttaagtsctagaatattcatgtcaagaggatcttccaagaataagccaggaatgcaattaggggctgactcatggatgacaatggtcgatgagtcacaaagaaattt

SEQ ID NO: 47931 - DNA, 201 bp, Homo sapiens
attatacagtgcaatgccctctaccttggtatagtggcaagcatgaactctgcagtcagagtgccttgattcaaatcctggcttcaccccttactggtagygtgagcctactcaatttatttaacctgaatgaggtcttagtttcttcatttatataatgaaaacaataatagtggctactcacagagtttttgtaaggat

SEQ ID NO: 47932 - DNA, 201 bp, Homo sapiens
tctcattctatctatgtccacaagttgaatttttaaaccatgcttcaaggatcaggtcaaactccactcctgtcataaagcttccttaagccttatagcaraaattagtgcttcctctatgttcccgtaattatttatttctcagatgcacttaccatattccaccttgcattatagttgattgtgagtatatctttttac

SEQ ID NO: 47933 - DNA, 201 bp, Homo sapiens
atagcaggatttccttctcttttatggctgaataatattcctctatctccctctctccctctctttctgtgtgtgtgtgtgtgtgtgtgtgtgtgtgtgtstctgtgtgtctgtgtatgtgtgtatactatatttactttatccattcattcactgatggatacttaggccatttatttatcttgactgttgtgaatgatg

SEQ ID NO: 47934 - DNA, 201 bp, Homo sapiens
ggctggttgaaacacttttaacttatggccagtttcttatatttaacagaactctgaatgctattacaaaaaatgtgtaaatgtctaaaagacattttcartgaacatgtattttaagagacagagtatgttgcataaaattcaatagctgtaaaataaaaatcgaattaaacttttatttgcaaggccctttacagcaag

SEQ ID NO: 47935 - DNA, 201 bp, Homo sapiens
aacactgaatataaaacatgaaacatctagtaaggcctcaataaatgttcattttcaaaatgcctcaaaaaatgaattaaacctaacaacctaacatgacwttctctggctgaaagaaacactcttctccaacatcatgtggtataccaaattcagttgagactgtttgtgaaggaaggaatttgcttatatacttaaaca

SEQ ID NO: 47936 - DNA, 201 bp, Homo sapiens
caaaagcctgagtcaacggagttaaattttctattcgtaagataggtttaggttagataataaatgtgaaaatacttgccagctaatcagtaaatactagytcttttcttctttattttatgagcataaaactaaaaaaaaagatttgctttgcatatagcatatcctttttgcttaagaacagcaaaatattctaaaaat

SEQ ID NO: 47937 - DNA, 201 bp, Homo sapiens
ctttcatataaaactatttttgccagctgaaatatcatgattgttattctaatatttcctccacaaagacttagtgaactgcatgtccattttagaaagtwggagtagatattttaattttttcttgcttcttgagaactactatcaacaataaaaaaagctttgattttaacgtgtatatcttaagatttcttttgatca

SEQ ID NO: 47938 - DNA, 201 bp, Homo sapiens
tgtttttctatcacatattaaacgcacaatctgtaaaaaagattcaggaggatgtttgggaaatgttttctgtgatatttatttttcttcagaagaagtgycaacaatatttcatttatggttttgattccccatatgccaatttcagcaccctcttatttcaccagggtcatttatttggtatttagttatgcttctgat

SEQ ID NO: 47939 - DNA, 201 bp, Homo sapiens
gaagaagttaagagcaatgatgtggaataagcatggggcttttaagaacttgtctgaaaagaggatattctttggtcaatagttgaaaaaataaaataagscttgctggagtggagcaagtcaatggaaagccttcacagttaggtggagcatttacactaaatgactttatttcgaacattcaacaaacactgactgatt

SEQ ID NO: 47940 - DNA, 201 bp, Homo sapiens
taacaaaagatctgtatgaaatgatgcataatagatggtgatggctgaagctgctgaaaattgatggtctaaatcaaaaggatggattaggaatctttgcrgaattattacagacctgtagttttgtgagaaaagcagagaatgtcaaggtcttttacttcaaggaggatttgaagtatttgggggtatacattattgcat

SEQ ID NO: 47941 - DNA, 201 bp, Homo sapiens
tgtggttcatcctgggactttatggagggtagctgatgcatcaaaaaaaaattatatatatatatatacacacacacacacacacacacacacacacacayatatatatatatataaagttttacagaactttgttttcaacttttaaaacaggatttctaaagaagttatgtggttttttttctttcatggcaatggcgc

SEQ ID NO: 47942 - DNA, 201 bp, Homo sapiens
ctaacacttggtgtgcattttagaatatcttgctggttcccagtaaatatgtcaactttttgcactatataccgcttgaaatgtcaatactgcacaaataygcgtagtctgctgacagtaacctgccaggttctagacttccatattgattactgttagcaaaatgtgtaggtgaaatttttgtagggtacgcacgtgacc

SEQ ID NO: 47943 - DNA, 201 bp, Homo sapiens
ccatcctgcagagaaaggcttcccaagctgtgtggttcatcctgggactttatggagggtagctgatgcatcaaaaaaaaattatatatatatatatacayacacacacacacacacacacacacacacacatatatatatatataaagttttacagaactttgttttcaacttttaaaacaggatttctaaagaagttat

SEQ ID NO: 47944 - DNA, 201 bp, Homo sapiens
ttattgaaaaaacaaaaacaaaacctatgtctgtagtatgtatatttgtgcatttaaatgtttgtgcccatggacttgtgtgtgtgtgtgtgtgtgtgtgkgtgaatgtatgtctatatatatatgtatggtgtttgtgtgagaggcaaagagaagagaaaaaagaatgacgttagcttatcaatatattataataaaatt

SEQ ID NO: 47945 - DNA, 201 bp, Homo sapiens
ccaagtaccagtgaaaatctgtgaaatttgaaatgtttaccatttctattaatagagttaattagtaccacaatttaggagggcaatatggtattatctastatctttgaaggtgataaaaccctgtcaaccagcaattccacatccaaacatttaccccaaaaaactcttacaatgtatagagaaaaaccatctaaaatg

SEQ ID NO: 47946 - DNA, 201 bp, Homo sapiens
tcatgtgtactttaaggccacagtgactagatatacactttggaggactttggaagatggctgtatttaatgtaacttaaataacttattctcctcagagmctcttagtgtttatgtatatatagctctcatttctgaaactttggggagtctttgaagagttattttattatcatgaattttacaggaagcacatgtgca

SEQ ID NO: 47947 - DNA, 201 bp, Homo sapiens
ataagtgtgcagacatgggcagactacattttgcaaatttccacagtaaggtaaaaggattacaaagctttctggtataatattaacagaactaaaagacwtgaataatattaaagaatgggctttggctagtgattttcaatcaattctcttcaaagcaatactctcttaattttactgaaagaaaattcaactttaata

SEQ ID NO: 47948 - DNA, 201 bp, Homo sapiens
agagtatctacctccctgactgattgtgaagatgaaatgaaatagtcagtagaaagtagttagaatagttcacagcatacagtatttattatttttatgawtaactaatgttttatgaggtccttagagtgctagacactgtttgcatgaattattttatatgatctcaccacaaccttataaaaaagtttttattgtccg

SEQ ID NO: 47949 - DNA, 201 bp, Homo sapiens
gactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctt

SEQ ID NO: 47950 - DNA, 201 bp, Homo sapiens
attagatgtacctgaaaaacacttctaggcaaaattagaccaaattaaaaacactggggcttcaattataataaactctcaaatataagttttattattgkttattataataataaataatgtataagtgtgcagacatgggcagactacattttgcaaatttccacagtaaggtaaaaggattacaaagctttctggtat

SEQ ID NO: 47951 - DNA, 201 bp, Homo sapiens
cattgacaaatgggtgtaaaatccaaaaacacaaagtaaattatcttctcaatgtatatagtagatgcatcctagaaaaaaacaaacaaacaaacaaaaamcacacacaaaaatttgatgtggaaacaaacttaaattaggtttcaaatataaggcaaggttttgttgttttgtttgtttgtttactcactacataaatga

SEQ ID NO: 47952 - DNA, 201 bp, Homo sapiens
gagcacagaggaatctcagggcagtaaaattactctatatgatagtgtaatgttggatacatgtcattataaatttaatgtaattataaattacattaaamcctaatgtaaactatgaaatcggagtgataatgatatgtcaatgtaggttttcagttgtgacaaatatatcactctgatggggcatgttgataaaggggg

SEQ ID NO: 47953 - DNA, 201 bp, Homo sapiens
tttaattgtaaattaaatcaaattaaataacaataaatattcagtttctcattgagacaagctacatttcaagtcctaatagccacatgtggctagtaackactgatttggacagtgcagaacagacaatatccatcatcacaggaagttctgtggaatagcactgttataattaaagaagtatcatcatcactgacattc

SEQ ID NO: 47954 - DNA, 201 bp, Homo sapiens
aaaaaaaaaaattaattagctgggtatggtggcatatgcctatagttacagatactcagaaggctgaagtgggaggattgattgaacccaggaggttgacrctgcagtgagccatgactgtgccactgcactagagtctgggtcatatagcgagactcatctcaagaagaagcgcggtggctcacatctgtaatcccagca

SEQ ID NO: 47955 - DNA, 201 bp, Homo sapiens
aggaacttggcatcatgggacaatgaggagagaattaatcatcaccctatcaactacaatatattgatgccgactggacagtttttaccgatgctgattamcaccacataaagaattatctttttcacttctatataccttcactattcaaaatagtagccacaagtcacagtagctatttaattgtaaattaaatcaaat

SEQ ID NO: 47956 - DNA, 201 bp, Homo sapiens
ccattgacaaatgggtgtaaaatccaaaaacacaaagtaaattatcttctcaatgtatatagtagatgcatcctagaaaaaaacaaacaaacaaacaaaaaacacacacaaaaatttgatgtggaaacaaacttaaattaggtttcaaatataaggcaaggttttgttgttttgtttgtttgtttactcactacataaatg

SEQ ID NO: 47957 - DNA, 201 bp, Homo sapiens
caacatataaactacttacaagtgatttcaacaactttttaggatccgatgtatataacctatatcacttatattactatgaaactaaatttatgaaaaaytaaattgaaaaatatttacaatagcactcaaaaacttgaaacacaagttaaattttagaaattatgttgacatgtacatgaatgggaagccaagttggga

SEQ ID NO: 47958 - DNA, 201 bp, Homo sapiens
gttttcctaggcagaggaccctgcggccttccgcagtgtttgtgtccctgggtacttgagatcagggagtggtgatgactcttaacgagcatgctgccttmaagcatctgtttaacaaagcacatcttgcacggcccttaatccattcaaccctgagtggacacagcacatgtttcagagagcacggggttgggagtaagg

SEQ ID NO: 47959 - DNA, 201 bp, Homo sapiens
acaaggaaaaattatcaatgaaaataaagaagttccagaaaggagtgcgggggtggaaacagacagacacctgacatgaaataaatcacctgatatacacygccaaggtctaatttgtttttccacctgtttttcctcatgccatgtgtttttcattaagataaaaaaaggaacttggcatcatgggacaatgaggagaga

SEQ ID NO: 47960 - DNA, 201 bp, Homo sapiens
gaaagtacatctttacacccattgacaaatgggtgtaaaatccaaaaacacaaagtaaattatcttctcaatgtatatagtagatgcatcctagaaaaaarcaaacaaacaaacaaaaaacacacacaaaaatttgatgtggaaacaaacttaaattaggtttcaaatataaggcaaggttttgttgttttgtttgtttgt

SEQ ID NO: 47961 - DNA, 201 bp, Homo sapiens
acaaaggtctctggttttcctaggcagaggaccctgcggccttccgcagtgtttgtgtccctgggtacttgagatcagggagtggtgatgactcttaacgmgcatgctgccttcaagcatctgtttaacaaagcacatcttgcacggcccttaatccattcaaccctgagtggacacagcacatgtttcagagagcacggg

SEQ ID NO: 47962 - DNA, 201 bp, Homo sapiens
ctattgcaaaaagtttcagctttgcatgtactatattttggttttgctttaaacattgcgtagctattctttccactgttacagtattaatggtagatgcrtaaaaggaatcttcctttataaaaaggtcatatgtggataaaggtgatataaaatgtttttaatagtgttataaaaagtttggtcaggcgaagtggctca

SEQ ID NO: 47963 - DNA, 201 bp, Homo sapiens
gtgaaagaagccagacacaaaagattactattttattattgtatttacatgaaatatgagaatagttataatctatagtgacaaaattagatcagcagttrcctttttctgggaatggaggttgggggatttattgcaaaaggtcagaaagaaaactttttgagattatagaaatagactatgtattgggtactttgtcag

SEQ ID NO: 47964 - DNA, 201 bp, Homo sapiens
gcagataaacatgtgaacaaaggtctctggttttcctaggcagaggaccctgcggccttccgcagtgtttgtgtccctgggtacttgagatcagggagtgstgatgactcttaacgagcatgctgccttcaagcatctgtttaacaaagcacatcttgcacggcccttaatccattcaaccctgagtggacacagcacatg

SEQ ID NO: 47965 - DNA, 201 bp, Homo sapiens
tgtccacacaaaaaccttcacatgtgaaatatgagaatagttataatctatagtgacaaaattagatcagcagttgcctttttctgggaatggaggttggrggatttattgcaaaaggtcagatgctgatagcagttgtatcaataattgtcaaaacttggaaccaaccaaggtgtttttcattagatgaatggatgagta

SEQ ID NO: 47966 - DNA, 201 bp, Homo sapiens
agcagataaacatgtgaacaaaggtctctggttttcctaggcagaggaccctgcggccttccgcagtgtttgtgtccctgggtacttgagatcagggagtsgtgatgactcttaacgagcatgctgccttcaagcatctgtttaacaaagcacatcttgcacggcccttaatccattcaaccctgagtggacacagcacat

SEQ ID NO: 47967 - DNA, 201 bp, Homo sapiens
atggaaggacaaaaatctttaaaattcttagaagaaaatataccaggattaaattttgaccttcgggaaaagaacacttgattgaacaaaacaagattatragtggaactgcattaaaattaaactctttggtcatcaaacaacacaaaacacaagcctcagtctggaaatgtacagtatatataatctacagggaataca

SEQ ID NO: 47968 - DNA, 201 bp, Homo sapiens
tgtccatgaacttaactcttccatactcttcactttcagtttcttgtgcctctctggtctccatttgaagcgtttttttgttgttgtttggtttttgtttktttttttttttttttcccactgtgtcgtttctctctagttcacttcttctaaatacttccacttcaatgtgtgtaatctcacaattgatgcacacacttt

SEQ ID NO: 47969 - DNA, 201 bp, Homo sapiens
gcttccaaaagcaattctctttgcatctgtaaagttctgggagaagctagcttggcttgtctgctgttcctgcattaccattaaggtttgaaattctctcyctgaatattattaaattaatcttatgtgatttgttctttaccaaaacctgcttattttctacagcattatgctatctttctgtttctagcttagagaagc

SEQ ID NO: 47970 - DNA, 201 bp, Homo sapiens
ttaatgtccatgaacttaactcttccatactcttcactttcagtttcttgtgcctctctggtctccatttgaagcgtttttttgttgttgtttggtttttktttgtttttttttttttttcccactgtgtcgtttctctctagttcacttcttctaaatacttccacttcaatgtgtgtaatctcacaattgatgcacaca

SEQ ID NO: 47971 - DNA, 201 bp, Homo sapiens
ggaaggtcagcagataaacatgtgaacaaaggtctctggttttcctaggcagaggaccctgcggccttccgcagtgtttgtgtccctgggtacttgagatyagggagtggtgatgactcttaacgagcatgctgccttcaagcatctgtttaacaaagcacatcttgcacggcccttaatccattcaaccctgagtggaca

SEQ ID NO: 47972 - DNA, 201 bp, Homo sapiens
tttctctgatggccagtgatggtgagcattttttcatgtgtcttttggctgcataaatgtcttcttttgagaagtgtctgttcatgtccttcgcccacttkttgatggggttgtttgtttttttcttgtaaatttgtttgagttcattgtagattctggatattagccctttgtcagatgagcaggttgcgaaaattttct

SEQ ID NO: 47973 - DNA, 201 bp, Homo sapiens
aacaaaattagaaccccagcctaggttttatctcttacaggatttttttttaattgacacataggatcctacaagtgcttcaactggaaacctatgggatytaatgattctgcttcaagagagaaggagaacaaggggccgagatagtccaggaggaaagttcctaatacatgacctcaattataagatagagggtagaat

SEQ ID NO: 47974 - DNA, 201 bp, Homo sapiens
aaagtaatctctggtaaactcttttgttttgttgttcttgcttgactttccattctacttcacggatctcaaattaaagctatagatttgaagaaggaaaytgatatttgagatttgtaggacagggtagatctcatcatataaaagaagctcaacaaataccttgtaattgatgctacatgcttaacacaaacaaacaaa

SEQ ID NO: 47975 - DNA, 201 bp, Homo sapiens
atttatatcaaagatgaaattcctagaatagaagaatagcgtagttggggctgttccaccagatatcagcacattagaaggtaaagttttgtattgtggarctatcatgttaattcatgtataactgtgcaaataggaaagaattgagaaccctgaaaatacacaagcatagatggaaacagcatttgacaataagtggca

SEQ ID NO: 47976 - DNA, 201 bp, Homo sapiens
gtgattttaatgtccatgaacttaactcttccatactcttcactttcagtttcttgtgcctctctggtctccatttgaagcgtttttttgttgttgtttgktttttgtttgtttttttttttttttcccactgtgtcgtttctctctagttcacttcttctaaatacttccacttcaatgtgtgtaatctcacaattgatg

SEQ ID NO: 47977 - DNA, 201 bp, Homo sapiens
tttatttattttttttattaatcattcttgggtgtttctcacagagggggatttggcagggtcacaggacaatagtggagggaaggtcagcagataaacawgtgaacaaaggtctctggttttcctaggcagaggaccctgcggccttccgcagtgtttgtgtccctgggtacttgagatcagggagtggtgatgactctt

SEQ ID NO: 47978 - DNA, 201 bp, Homo sapiens
tcctaattaaatttataaagcattagttctaatgttaaaaattgttatataaaaagcattttaatattcacatgcatctgtctacagtgttttacattttrtttataattcgtcaactgaatgaatactagataggagaatgttccatttaataaaaactcttgagaaaaataaaatagcttacttaacagtaatttcaat

SEQ ID NO: 47979 - DNA, 201 bp, Homo sapiens
tacttttgtatttttagtttcgtatcatttatttctgctctcatcttggctagcaaggactgaacattccatatttccatgctggcctcctatttcactcrcatcatctccccaggacaattgtcttctctaggatgttcctgttgatcaattgtaggtgcaaagtcaccctcatatttgcacctatatttcctatgggtt

SEQ ID NO: 47980 - DNA, 201 bp, Homo sapiens
attgtcaaatttcttaggatctaatttctataattgtgaaatattaataggaacagtacgacttaagggaggtggaatgaatagatgagaaactggcctgrgtttgaatctcgacttcaccatacagtaagcctgagaccctgcactgggtgctacacctctttaggctttagcaggtaaacaccaagtccctgagtaact

SEQ ID NO: 47981 - DNA, 201 bp, Homo sapiens
atgatgatatttcttttttttttaatttaattttatttatttattttttttattaatcattcttgggtgtttctcacagagggggatttggcagggtcacrggacaatagtggagggaaggtcagcagataaacatgtgaacaaaggtctctggttttcctaggcagaggaccctgcggccttccgcagtgtttgtgtccc

SEQ ID NO: 47982 - DNA, 201 bp, Homo sapiens
tgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgagatg

SEQ ID NO: 47983 - DNA, 201 bp, Homo sapiens
gggcaatacataagcttggaaatagatgatgatatttcttttttttttaatttaattttatttatttattttttttattaatcattcttgggtgtttctcrcagagggggatttggcagggtcacaggacaatagtggagggaaggtcagcagataaacatgtgaacaaaggtctctggttttcctaggcagaggaccctg

SEQ ID NO: 47984 - DNA, 201 bp, Homo sapiens
ctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgagat

SEQ ID NO: 47985 - DNA, 201 bp, Homo sapiens
gtagccataaaaaatgaagagttcatgtcctttgtagggatatggatgaagctggaaaccatcattctcagcaaactatagcaaggacaggaaaccaaacwccgcatgttctcactcataggagggaaacgaacaatgagaacacttggacacagggtgggtaacatcacacaccggggcctgttgtggggtggggtgagg

SEQ ID NO: 47986 - DNA, 201 bp, Homo sapiens
ctctctggctgcccttaacattttttccttcatttcaactttggtgaatctgacaattatgtgtcttggagttgcttttctcgagaagtatctttgtggcsttctctgtatttcctgaatctgaacgttggcctgccttgctagattggggaagttctcctggataatatcctgcagagtgttttccaacttggtttcatt

SEQ ID NO: 47987 - DNA, 201 bp, Homo sapiens
cctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgaga

SEQ ID NO: 47988 - DNA, 201 bp, Homo sapiens
atgctgctataaagacacatgcacacatatgtttattgtggcactattcacaatagcaaagacttggaaccaacccaaatgtccatcaatgatagactggwttaagaaaatgtggcacatatataccatggaatactatgtagccataaaaaatgaagagttcatgtcctttgtagggatatggatgaagctggaaaccat

SEQ ID NO: 47989 - DNA, 201 bp, Homo sapiens
acctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgag

SEQ ID NO: 47990 - DNA, 201 bp, Homo sapiens
tggttattttgctcgttagttgatgcagtttcttcctagtctcgatggtctttacattttggcatgattttgcagtggcttgtactggttgttcctttccrtgtttagtgcttccttcaggagctcttttagggcaggcctggtggtgacaaaatctctcagcatttgcttgtctgtaaagtattttatttctccttcgct

SEQ ID NO: 47991 - DNA, 201 bp, Homo sapiens
aacctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttga

SEQ ID NO: 47992 - DNA, 201 bp, Homo sapiens
attcttaatcctgagttctagtttgattgcactgtggtctgagagatagtttgttataatttctgttcttttacatttgctgaggagagctttacttccawgtatgtggtcaattttggaataggtgtggtgtggtgctgaaaaaaatgtatattctgttgatttggggtggagagttctgtagatgtctatcaggtccgc

SEQ ID NO: 47993 - DNA, 201 bp, Homo sapiens
gaagttaactccaagcctattgatttgcaagtaatatcaatcaaaattcaaaaatttttaaaaatgcaaaattatacaaactttccagagaatagaacaaytgggacgtactcctcacataattttatgtggcttgatataaaatcttgacaagaggactatgaagaagaaaacccctacccaaagtcactcatgaacgta

SEQ ID NO: 47994 - DNA, 201 bp, Homo sapiens
tcttatttggaacagttattcagcttaccctaagtccagagtgaatttccaaaaaatcaaaggttctgcaacttttcatttctcttcaattccaactcagkttcacacgtttatcacctagtgtagaagggctttcctccacagttttgcttggcaaactccttttcatccttcaagactcaacaaaattgttgccttttc

SEQ ID NO: 47995 - DNA, 201 bp, Homo sapiens
tatcatgaaaatgtaaacattttggagacccagatcctatttcaaatagagtcaagatgactgccctagaaaatgcttcttgaagtcatggaataaattakatgattgtttatttaaaaaaaaagaacaataatacataggagatctgttaaaaaatctgtgaggaaagagctgttaaaatgttgaaaccacatgaattct

SEQ ID NO: 47996 - DNA, 201 bp, Homo sapiens
tgtctaaagcacacatttcttcctaaaagaatgaaaattggttctttgggaacaaaaatatcatattgattttatgtaaaggcaaacattcacatggtgcrtctgtacataaaatatatctggagtattaaagtttcatggtggggatgattatgaaaaaatgactatataggctccatagggacatgatgataaaaaata

SEQ ID NO: 47997 - DNA, 201 bp, Homo sapiens
gaggcagaagaattgtgtgaaccgggcaggcagaggttgcagtgaactgagatggtgccactgcacttcagcctgagcgatagagtaagactctgtctcaraaaaaaaaaaaaaggaactaccatatgatccagccttctcacacatatatatatgtgtgtgagatatatatatatatatattcaaagcaattgaaatcag

SEQ ID NO: 47998 - DNA, 201 bp, Homo sapiens
ttgacaatcttttaataatttccaaaacaatcgggggtaatgttcgaattctaagttcttgtcataaatgaatcaatccagttggcaggagatggatgtastctttttgctggtgttccgtgctaagaaaagcacacacatttttcttgagagtatggctagccgaaaagcatctgagaattgatggaatcctaaggcaga

SEQ ID NO: 47999 - DNA, 201 bp, Homo sapiens
ggctccaatttggaattggccatagacacccactctgagaagtttgggaataagaaaagagaaaacacattaagaactaaaactgtaaggacccatactgkcttcttaaaggaagttttactgagaattttaatcttcaaagcctaactctcattcacattcaaaagatatatacatgaggatggaaactgtccggaaaat

SEQ ID NO: 48000 - DNA, 201 bp, Homo sapiens
actcctacaaaatctaggactttaaaaatgaatattttaagcactttaaattcctaactacatgggcttgcttaaataaatactagcaaattcataaagtrgaaagtcctcctgccattaaaagtgactatctacatttactgagagagtgatatcttccacatatgtaagaaaaaaaagtcattaggaatgaacatgtct

SEQ ID NO: 48001 - DNA, 201 bp, Homo sapiens
catgttttaaaacctgacatccacttacagcacttatctactactctcttcaggataaactacctttattgcaagacttttgctaaaaattcttagattaygtcaagggaaaaaaatcctctattgctttttaaagaaaaaattatcagaatgatttaattttgtgttattttttatctccacattagtttgttatttcag

SEQ ID NO: 48002 - DNA, 201 bp, Homo sapiens
tatggaaatttcatgcgacaaagcaggtaaactctaatagaaaatattcaagctcttattttagagtctgtaaggaaggttattgacctacagatatcagrtaagaaagattggaaagtgattggttttgcagtataatgatagaagataaaccatggaggcttccctgtgacctggaagaagctactaccattcatcaga

SEQ ID NO: 48003 - DNA, 201 bp, Homo sapiens
aagtgactatctacatttactgagagagtgatatcttccacatatgtaagaaaaaaaagtcattaggaatgaacatgtctatcaagattcattttaaatayagggaggaggagagaggaagatggcaaggttgtgaaagagtgaatgaatgaatgaatgaatgaattatagaaagctatatgcttctgcacagctttgaga

SEQ ID NO: 48004 - DNA, 201 bp, Homo sapiens
tatgcatatttttttcttttttattggtttatggggcttgtgcttctattaataggtagatttttaaaatgtttttaatttttatggttacatagtaggtrtatatattttagatagatttttaacgtggacagcagtatctaaatatttactgtgatttgtaatgtatattttttactaagcattgaatggtcattttct

SEQ ID NO: 48005 - DNA, 201 bp, Homo sapiens
gacccagccatcccattactgggtgtatacccaaaggattataaatcatgctgctataaagacacatgcacacatatgtttattgtggcactattcacaakagcaaagacttggaaccaacccaaatgtccatcaatgatagactggtttaagaaaatgtggcacatatataccatggaatactatgtagccataaaaaat

SEQ ID NO: 48006 - DNA, 201 bp, Homo sapiens
acgagttaatggatgcagcacaccaacatggcacatgtatacatatgtaacaaacctgcacattgtgcacatgtatcctataacttaaagcataacaatawaaaaagaaacttaaaaaaaatgaaatgtccgtatattttcttgattttttccaaatgttttgaagaaagtttttgtattattaaatgctattcattggtc

SEQ ID NO: 48007 - DNA, 201 bp, Homo sapiens
agttcactttgagtccaaaggccagagaatcacgggagctgatggtacaaaccacagttcaagaactagagagaaaatgagatgagatgtcccagctcaayctgtaaggcagaaaagaagggaaggaattcctcctttctttgctttttgttctattcagccctcaagagattgggtgatgcacagcaatattgaggaggg

SEQ ID NO: 48008 - DNA, 201 bp, Homo sapiens
ggactgtaaactagttaaaccattgtggaagacagtgtggcgattcctcaaggatctagaactagaaataccatttgacccagccatcccattactgggtrtatacccaaaggattataaatcatgctgctataaagacacatgcacacatatgtttattgtggcactattcacaatagcaaagacttggaaccaacccaa

SEQ ID NO: 48009 - DNA, 201 bp, Homo sapiens
atatatataaaatatatatagcaggtagatatatacttatatgtaatctacataaaggtaaaaatatatattatttatatttatttatattatttttaatraacagatatattattttatttttattttgtttttgaggcagaatctcactctgtcacccaggctggagtgcagtggtgcgatctcagctcactgcaaccg

SEQ ID NO: 48010 - DNA, 201 bp, Homo sapiens
tcttttactgtcatccagaaacaccctcacagacacacccggaaataatgtttaatttaggtgcccatggccagtcaagttgacacatacaatttacaatsacactggccttcaactccagtgcacaatgtggtcttcctctttattctccaaattcaagttctcttacttgctacagttgtccatatttcttgggaacca

SEQ ID NO: 48011 - DNA, 201 bp, Homo sapiens
atgtgtgtatatatatataaatatatataatatattatatataatatataatacatatataatatatcttatatatattatatatatatattatatatatwatatatataaaattagagaatctttaataagaggtgaatggctccaaacacagatttaatttggaagctcccaccctagcaatacctactggtgttcatt

SEQ ID NO: 48012 - DNA, 201 bp, Homo sapiens
tgggctcccgtgctaaataatacaaaaataatgatgaagattctttttttttttttagacagagccttgctctgtcgcctaggctggagtgcagtggcgcratctcggctcactgcaagctgcacctcctgggttcacgccattctcctgcctcagcctcaggagtagctgggactacaggcgtccgccaccacgcccggc

SEQ ID NO: 48013 - DNA, 201 bp, Homo sapiens
atgtgaagtgaaggagcgttaaggaacagagatttctagacaagccctaagcaaggaaaaagcagagctttattctagaatcggactaaaggcagtattckttgaatgtgatcagaggacattgtaagccaggataatcattttgaattttaacctaggtacaattatgatctatttttaagaagactgacttgatcagat

SEQ ID NO: 48014 - DNA, 201 bp, Homo sapiens
tccagtgcacaatgtggtcttcctctttattctccaaattcaagttctcttacttgctacagttgtccatatttcttgggaaccatcattctaaaaaatgytgaccaggcctttcttaggcatttctaggaaaaataatataaaatacagaataaagtgaggggagttcagatataatgcatttctcatagaaaaaatgat

SEQ ID NO: 48015 - DNA, 201 bp, Homo sapiens
tgcagagtatgtaatcctaaatactggtttgcagcaatttaattatgctttttgttttctttttgtgtgtttaataattattttttcatgggattagttaratctgttggccctgtaggattatagttttcatcaaatttggaaatgaaagttgtcagccattatatctttaaatatttttttgttcttcattcttattgt

SEQ ID NO: 48016 - DNA, 201 bp, Homo sapiens
ctgtgaggtacaaattaaaccactcaggtcttggaaatacctaaacatagggggaaaaaacacctaaattgtaatgagtatatgtgtgtatatatatatawatatatataatatattatatataatatataatacatatataatatatcttatatatattatatatatatattatatatataatatatataaaattagaga

SEQ ID NO: 48017 - DNA, 201 bp, Homo sapiens
gttgaccaggcctttcttaggcatttctaggaaaaataatataaaatacagaataaagtgaggggagttcagatataatgcatttctcatagaaaaaatgwtagtgggatggttagtaaagaactgtgctgtgtaagcaagatgtaagctttaaacaaagtgaagaaaaggggagaagcctagaaaaaataacattataca

SEQ ID NO: 48018 - DNA, 201 bp, Homo sapiens
ttatcattttattcctgttgtttcaggtctgctgacaataattttttccttttttttttttttttttttgttccagaaaggttttttttttttttccgaaratgtttttgcagagtatgtaatcctaaatactggtttgcagcaatttaattatgctttttgttttctttttgtgtgtttaataattattttttcatggga

SEQ ID NO: 48019 - DNA, 201 bp, Homo sapiens
ggtataatgagaaacccgcagtggtatttaagcaggtgtaacatgatttcctttatctcattagaagtaacattctgctaaatggagaatgattatagtgwgataagtgtgaaaactaggtggcagtcaggaaaccatagtacttttttagcaaagagatgatggtaacttggaatagagtggtagtagcagagagaagtg

SEQ ID NO: 48020 - DNA, 201 bp, Homo sapiens
cctggattcattaattttttgaagggttttttgtgtctctatttccttcagttctgctctgattttagttatttcttgccttctgctagcttttgaatgtrtttgctcttgcttttctagttcttttaattgtgatgttagggtgtcaattttggatctttcctgctgtctcttgtgggcatttagtgctataaatttccc

SEQ ID NO: 48021 - DNA, 201 bp, Homo sapiens
atgtaagctttaaacaaagtgaagaaaaggggagaagcctagaaaaaataacattatacagaaagagaatattcttaaatatgtcaacttctcttatagcraatttcccagtgttcattcctaatacaaggagagtaaaaactccatagaaacctcaaaaagagctttttcttgcaatggggttaggtgtctaaggaataa

SEQ ID NO: 48022 - DNA, 201 bp, Homo sapiens
aagcataagattataataagattatagacggtgatgaaagagctaatttacatgtatgttctatgtatgcatttttcaggaagtgatatttgagctgagarttaaaaaccagaaaataccagtcatagaaaaatctgggtagagtttattaccagcaggaataaatgtggggtgctgaggaaaggaaagaaggccaatgtg

SEQ ID NO: 48023 - DNA, 201 bp, Homo sapiens
tgtatttgtgataaagacagctaagcagaagcaagcatttctccgatgtcaaactggccttactgtaggaagtttgaaaatatcatctgcttctgtctctkgaataatatcattgctctgttttgtttttattttattttatggttggtttttaaagcccaatatgtggcgggatccagagaagcgattctgtgtgctatg

SEQ ID NO: 48024 - DNA, 201 bp, Homo sapiens
ccaatttggtaaaattcttagccgatattttctcgaatgttgttactgtccattctttctctccactctccctgagacttcagtcacatccctgctagacygtttgccgtgctcattatgtattctatggcttcttttcatttgtcttctcttcttttgaggtttctcagtctgtacattttctgggtgacctgttgtttg

SEQ ID NO: 48025 - DNA, 201 bp, Homo sapiens
atttgtctattcagagattcaacttcttcctggtttagtcttgggagagtgtatgtgtcgaggaatttatccatttcttctagattttctagtttatttgygtagaggtgtttatagtattctctgatggtagtttgtatttctgtgggatcggtggtgatatcccctttatcattttttattgcgtctatttgattcttc

SEQ ID NO: 48026 - DNA, 201 bp, Homo sapiens
ccccagtgaggtgaccctggtacctcaattggaaatgtggaaatcacccatattctgtgtcgctcatgctgggagctgtagactggagctgttcctattcsaattatactggtttctaaaaaagattgtaatatattgttgagagtgaagggagttttatatcaataattaaattattttaaaatattgtttatttcattt

SEQ ID NO: 48027 - DNA, 201 bp, Homo sapiens
catacattatggagaaggcatttcaaaaaggcaggcaagttcatctggtggattctataggacaacatgaaacttaatgggatacatagacttcttaagcyctccccgctccccagctggcaaatttttaacaacttctccttaagtgatgagagaggggtcaaaagccaggactaatctcacaattgccactgaaaatgt

SEQ ID NO: 48028 - DNA, 201 bp, Homo sapiens
ttactacattttcttagcttcttgaaatcgatacctatgttattaatatttcagttcttttttcctaatatatttattaacgcctacaatttgcctctacrtagggctttagttgcctcctacaagtttgatatattgtatttttcattatcatttattttaaaatatattctaattttcatagtaaatttttctgtggcc

SEQ ID NO: 48029 - DNA, 201 bp, Homo sapiens
atattgaaccagccttgcatcccagggatgaagcccacttgatcatggtggataagctttttgatgtgctgctggatttgttttgccagtattttattgakgatttttgcatcaatgttcatcaaggatattggtctaaaattctcttttttggttgtgtctctgcctggctttggtatcagaatgatgctggcctcataa

SEQ ID NO: 48030 - DNA, 201 bp, Homo sapiens
agcactttatggacattaatatttctatggagaaagcttaaaaagtgtcacttgtgcattgaaactcttttgtaacagcttctttactcttctgttgttgkcatgatatcctccagattacttaaatttttaaccaagaagtaaccttacttattactagtatgctctttccttaaaagcttttctgatttatgttatttt

SEQ ID NO: 48031 - DNA, 201 bp, Homo sapiens
tgttgcagcctagaaattgcctctgtacactgcttcatgtttttttccttctctcagaaatcacagtcctgtgcttcctataattcaatatctaaaaacarttgtttcttggtttgtatttttattttagttggttgtgtactttaacagcttaacaaagaagaataaatactgtaaaaactaagaagaggctgttcaaaa

SEQ ID NO: 48032 - DNA, 201 bp, Homo sapiens
aaagtagagcatggagggcctaggaaggatgatagtggttgaatagactttaattttatatagaatattaggtcagagatctgaaggtgactaggaaaaarttatgtgggtatctggagcaagagcatcttaggacaaagagaaagtaagtgaaaaggccctaagatatgaatgtggctggcatgttcaaagaccctcaag

SEQ ID NO: 48033 - DNA, 201 bp, Homo sapiens
taaggcaactattcatagtgaagctgaccttaatgctatcttttaaaaagttttgttaaaaataaatttgagaaagaattttaaataacttagagaaaagmctgttttcaaatatcaccagttactacagaaatacatatccacatttagttgatgaaattggcacgtgatgtttaaaatttttcaattttctccatgttt

SEQ ID NO: 48034 - DNA, 201 bp, Homo sapiens
atggaaaacttaattaaggatgatggggaacttagagcaggcactgacacagggaatctaagactaaaataccctgttttaatcagaattcagtttttatrtaataaagtgtttcacattttaaacaaggaatgaaaaatacaagcaaagttacagaagaatgccataaaataagctatcaagaatgtgagaaataaatca

SEQ ID NO: 48035 - DNA, 201 bp, Homo sapiens
aagaggagttgaggattatttcccaactatggacctgagcaactaaaagacttgtcattgatttagatggggaagactgtggtaaaaacaaattttttacrggagatcatgaactcagcttagctaattatataaagttagagatgcctattatatatcgaggtgtaaatgttaaagtgatagctagtatacaagtctgaa

SEQ ID NO: 48036 - DNA, 201 bp, Homo sapiens
actttttaatgactgccattctaactggtgtgagatggtatctcattgtggttttgatttgcatttctctgatggccagtgatgatgagcattttttcatstgttttttggctgcataaatgtcttcttttgagaagtgtctgttcatgtccttcgcccactttttgatggggttgtttgtttttttcttgtaaatttgtt

SEQ ID NO: 48037 - DNA, 201 bp, Homo sapiens
attctaagtgcccactgaatataaaattacttgaatattacaattgcttaattggctatgcttttagtctcttccttctctccttcaaaaatattttcaayacattctagatatgtttgataaattctgtaaatttacctgtataaattattaataagtacatacaacataatccctgtcctatctgtttagggagacaat

SEQ ID NO: 48038 - DNA, 201 bp, Homo sapiens
atgaactcagcttagctaattatataaagttagagatgcctattatatatcgaggtgtaaatgttaaagtgatagctagtatacaagtctgaagttcattkggtcaggaacatctgaactgaagatgtaaaatgtttgaatcatcaatccatatgtcatttaaaccagaagactagatgtgataaccaagaaaatgaataa

SEQ ID NO: 48039 - DNA, 201 bp, Homo sapiens
gaactagtttacagtcccaccaacagtgtaaaagtgttcctatttctccacatcctctccagcacctgttgtttcctgactttttaatgactgccattctractggtgtgagatggtatctcattgtggttttgatttgcatttctctgatggccagtgatgatgagcattttttcatgtgttttttggctgcataaatgt

SEQ ID NO: 48040 - DNA, 201 bp, Homo sapiens
catctgaactgaagatgtaaaatgtttgaatcatcaatccatatgtcatttaaaccagaagactagatgtgataaccaagaaaatgaataacgagacaaartatgagatctaaggattgggccctatagcaccccaacatttagaggttaggaaactgaggacgaactagaaaggagactaagaatcagtgaccaaaaaag

SEQ ID NO: 48041 - DNA, 201 bp, Homo sapiens
tgcctctactgagaggaagttaagactcatcaactgtctagccatttgtcagttctaagattctaatattatagtctattgcttttagagtgcatacttgyatttaaatttctgaattcttaaaatgtcaagaaaatgttaaatatataaaaatgtgtttttaaatcccttctgggatttaaaataaaaacatgtttgaga

SEQ ID NO: 48042 - DNA, 201 bp, Homo sapiens
gtggatccatagaagaacatgacaaacaaccaggtttgaattttataatatggagaaaatagctcctctcctcacttcctccccatgccattttgagttgytcagaaatagctgaattgtgtttgagcaacttgcttctggaaatgaccatgcagtgatcagatgtacagttagtgagggatgctttatgagggaatgcct

SEQ ID NO: 48043 - DNA, 201 bp, Homo sapiens
tgttcctatttctccatatcctctccagcccctgttgtttcctgactttttaatgattgccattctaactggtgtgagatggtatctcattgtggttttgrtttgcatttctctgatggccagtgatggtgagcattttttcatgtgttttttggctgcataaatgtcttctttgatgaataatgagatttaactttttcc

SEQ ID NO: 48044 - DNA, 201 bp, Homo sapiens
cagtccaggcaaccctggaggctcctgccaagaatgtgagtgtgatccctatggctcactgcctgtgccctgtgaccctgtcacaggattctgcacgtgcygacctggagccacgggaaggaagtgtgacggctgcaagcactggcatgcacgcgagggctgggagtgtgtttgtacgtatactaactttgctgttagttt

SEQ ID NO: 48045 - DNA, 201 bp, Homo sapiens
ccttctctagcacattaaatatagcatgtgaactgtagagatttacctaaagtgcccataaacaagagtggccaacttgatgagaagtaagccaagtgccycttaataagtactgtaataacatagcctcctggaatggtctttcatcattttgtcaagaggaacttttatccctgtttatataaagctcctttgctaaat

SEQ ID NO: 48046 - DNA, 201 bp, Homo sapiens
tgtaaatgctcgagttggaaagaccctcatggtggtgtagtctgccttccttctttcatagattggcctcagaaattgagtgtcatgcagttccaaagctrgaatccaagtcttctagctctgccccggtgcttttttcctctgaaatttttccagttgagaagagattaggaattctcaaggtgtgcctaacattcagca

SEQ ID NO: 48047 - DNA, 201 bp, Homo sapiens
gtgggattgaaaatgtttaaagaaaatatcttgctatatatatataaaaaacaaattatatagcatatatatatatatatatatatatatatatatatatwgtgggtagaaaaaagacaattgtaacatcaagggtatttttgttgttttaaagtgtcatgttttgtgctggttgttttagtgtaatatagcatatcttac

SEQ ID NO: 48048 - DNA, 201 bp, Homo sapiens
attatatattttcaagggctccaaatgtagttcaggttcaagaaatattgcactatcttctcctggcttctatgggataatatagccaacaacctgtttcrttataaagcaggggactagaaccctcattttctagtatactctagtgtgcctctaaaatggcaaagcttctgtcttttctacctaccgcatgaaggatta

SEQ ID NO: 48049 - DNA, 201 bp, Homo sapiens
agtatcagtttctgtcagttactgctcttactcgatgtgggattgaaaatgtttaaagaaaatatcttgctatatatatataaaaaacaaattatatagcatatatatatatatatatatatatatatatatatatagtgggtagaaaaaagacaattgtaacatcaagggtatttttgttgttttaaagtgtcatgtttt

SEQ ID NO: 48050 - DNA, 201 bp, Homo sapiens
ttctggtttattctccatttattcttttagattgcacatagaacaatggggtcaattattaatataatttgcacaaatcacttatagtactctttgagctsaacagcaatattatttacctgttatcaaacatggcagcaattttcccctcctaatttacaactggatggcgcaaccacaagtttttactaaatcatttct

SEQ ID NO: 48051 - DNA, 201 bp, Homo sapiens
cattcagttcaaagaaggcattgtacagtagagaagacagatatacatatacatactgtacatttatgataatataaatagtgcagaagaagtgtgcacartgcatataaatagtgcagaagaagtgtgcgcagtgcatactggtagaactaagaaggaagcaatgaattcttgtgttagcatttaatacacttttaataa

SEQ ID NO: 48052 - DNA, 201 bp, Homo sapiens
tctccaagagcctttaatttaaaataatcagcataccagcatgctatattttcgggtattggtttctgagcctcaatatctcatagaatgaatttaacagsattttatgttaaaaccagatatatattggactccctacgtcttaataataatgaatgtgtcagaagggcaagtgttcaagtgtatttcaaccacaagtca

SEQ ID NO: 48053 - DNA, 201 bp, Homo sapiens
tcagagtaaaacttatttcagcatttgctggtctccaagagcctttaatttaaaataatcagcataccagcatgctatattttcgggtattggtttctgakcctcaatatctcatagaatgaatttaacagcattttatgttaaaaccagatatatattggactccctacgtcttaataataatgaatgtgtcagaagggc

SEQ ID NO: 48054 - DNA, 201 bp, Homo sapiens
tggtgggatcagactgtaagtagatacgggagtatcagagtaaaacttatttcagcatttgctggtctccaagagcctttaatttaaaataatcagcataycagcatgctatattttcgggtattggtttctgagcctcaatatctcatagaatgaatttaacagcattttatgttaaaaccagatatatattggactccc

SEQ ID NO: 48055 - DNA, 201 bp, Homo sapiens
agagttttctgaatttaagttccttatagagccccatgtaatgagctcttagaagacattgcagagctgcaatttaaaatcctgtttaatcagccgtagcragctatgtgccattctctgtggaacactaagaggaatcagggttcttcctcctccatccagtacattcccaaccaggaattgctgtctggtcagggttgg

SEQ ID NO: 48056 - DNA, 201 bp, Homo sapiens
tgaagtggtctgctctctctctttctgtctctctctttctctctctctctgtctctctctttctctctctctctctctctctctctctctctctctctatmtatatatatatatatatatatatatggcaactagatgtatactttggaattcctttaaggtgaaaagagttctctaaatgtaaagtgttgagtgaaatta

SEQ ID NO: 48057 - DNA, 201 bp, Homo sapiens
agagcagatagtggtttgtaacaaaagtctgttcaggtgtgccgacagacttcagtctctcttcatgtgaaatgagttaaattaatgaaaacttaagcaaragggccagaggaaacttttcctcctggtgggatcagactgtaagtagatacgggagtatcagagtaaaacttatttcagcatttgctggtctccaagagc

SEQ ID NO: 48058 - DNA, 201 bp, Homo sapiens
aaactaagcctatttaattgcacagaggaaagtataccttctttgcctgttttgtttgaattttaatataaaataaaatttgctgctaaccttttgttttwctttgaccaataacatttctcagcttagtgtatgggctatgtaaagtgcctgtcaaatggagggatgtctttgttgaaagaatccagactcacagaaagt

SEQ ID NO: 48059 - DNA, 201 bp, Homo sapiens
acacaggagtacagggaagctcacctccactttgtttacatttctatgggcaaatgtgccgactttctagtgagatgtgaggaatttaagtgcccttactrcagccttgggaatagaaacaggatcatcaacagcctccactcctgccatcctcacccatgcatgagcaaggcctgtttagagagggagaaagaaaaagac

SEQ ID NO: 48060 - DNA, 201 bp, Homo sapiens
gcaaaaaattagccaggcttggtggcaggcgcctgtaatctcagctattatggaggctgaggcatgagaatcgcttgaacctgggaggcacaggtggcagygagccgagatcgcgccgttgcactccagcctgggggatagagcgagactctgtctccaaaaaaaaataaataaataaaaaataaacataaatttttaaag

SEQ ID NO: 48061 - DNA, 201 bp, Homo sapiens
agttattgcagtgcccaacagatatttagtattgctgtgtgtccttcaaatgtttacaatattccactgtgcctttgtgagttcactgcagcaccctgggrcacctctacacacagtttgtgaacacaggggtagatagatcctagaggcattgaaactacacggaaacttgaatgacgttagggatcccagagccactgg

SEQ ID NO: 48062 - DNA, 201 bp, Homo sapiens
ccattggttcagggactggtggccttgaaaatttcatagagaatgtgagaaagcccaggggcatgaacggagttgtggggaggaggtgcgagtgtgtagaygtgtatttaggatggactgtgcagacagggagaattagagagataaaatatgtaaaaccataagtgtgtgtatatgtatgcaggtatatacatatactta

SEQ ID NO: 48063 - DNA, 201 bp, Homo sapiens
aggaacttccttctaaatcaggttaagttagacattcaaatgtgaccccagcctgacaacccggtatacctttaatgaaagcaatgtctccaatattggaktttttattgctgacaccaccacctctcacctccctgtccctcatcatttccctgtgctgcctagtttgcctttcactggtaatatttcaacttagtctaa

SEQ ID NO: 48064 - DNA, 201 bp, Homo sapiens
ttttatatagagttctccctgtttggaatcttttagttcccttatttactgtggttgccactgactctgcatcaggctttggaaatatcactaaaaaactgttttttctttagtcttcttactagtcaaatatcagctaaacaaacaaagaaaataagtgtttgaatggtcagagaactataagaatgagaattctggcag

SEQ ID NO: 48065 - DNA, 201 bp, Homo sapiens
gttctaattaatgcacgtgtgaaaggacataattattgtgaaaagaaatgctatcaaaacagtctaatggctacaagaagaaaaagaaaagaagaagaaggaggaggaagaggagaaggagatgaagaagaaagctaaggagaagatgggtaacaggaaaaaaagagggcaggaaaagcagataggaaggaaaaaaaaggt

SEQ ID NO: 48066 - DNA, 201 bp, Homo sapiens
acttagttgacaattctttgatagctcatgcatctctaaaatttagtactatattattgccaacattatgtatttaaatgaatgcagcttgatatcaagaraatgaccatactgaaggggaaaaaaaaataaactgcagccttcttcatgagtaacacttgaaactgttaaacacattaaaatcccatttaacaaatagca

SEQ ID NO: 48067 - DNA, 201 bp, Homo sapiens
tatgtgttcatgaatatgaatagcaatattatttatgatagctcgaaggtagaaacaatccaaatattcatcaactgatgaatgaataaacaaaatgtggyatgtacatgcagtgaacattagtcattaaaaggaatgaaatactgatacatgctgcaatgaagttatctagaataggtaacttcatagcaacaaaagcag

SEQ ID NO: 48068 - DNA, 201 bp, Homo sapiens
aggaaagatttagggaaggcaatcataaggactgtcctcaaattttcagaagagtcgttatgttaaagagggactattctaaaggctgaaggtggatccayagaagaacatgacaaacaaccaggtttgaattttataatatggagaaaatagctcctctcctcacttcctccccatgccattttgagttgttcagaaata

SEQ ID NO: 48069 - DNA, 201 bp, Homo sapiens
agaatgatgcaatcaaaatgattctgcatttcagcaaggcagtgtctaaaatgttttctgatattcttgtgaataatatgtggaaactgaagcataatggyaggtaaattgcaactgattgaaaaatagttcacaaagaatattgcatagtggattaaggtcaatccggaaagaagtctctagcagtgcaacagaggtttt

SEQ ID NO: 48070 - DNA, 201 bp, Homo sapiens
gacccctcatttctgaaggagttccaatgtccaggttttgattttgtccctgtcttgttggttcaaggggaggaatagttggttcctggtgttgttagagktcaaaatttttctattgaacatgcctgggctacatgacttgcagcttttggctctgttatacctaaaaggtaacttgacattttgttatcaacagggtag

SEQ ID NO: 48071 - DNA, 201 bp, Homo sapiens
caaatttgatcacttacagtaaggtatattgaggcagattttagccctggatcttctgggccaatggacccctcatttctgaaggagttccaatgtccagrttttgattttgtccctgtcttgttggttcaaggggaggaatagttggttcctggtgttgttagagttcaaaatttttctattgaacatgcctgggctaca

SEQ ID NO: 48072 - DNA, 201 bp, Homo sapiens
gctaatttttatataagaaaaaatactatgtacactatttcaaagcagacagaaaagtcatatgaaaagggtatgtcaaaaaagtttcaaaaagaggctcytgatttatgtgttgtgtgtttgtggacctaaccaggacatttgattcaattaaccaagtttagtatgtcagcaaccctctgaaagattgagaagattgac

SEQ ID NO: 48073 - DNA, 201 bp, Homo sapiens
aatcttcttggctgtgaacagaaatttaaaaatttacagcagcactaccatagagtgatttatacaagtgcttttaaaaaatctcttctatgtcatcagcrtgtcccctttcttctgatctcaggggaaaaagctttgtgtatgcatggcccaaatttgcccaaagaaaattatgtaggagcactagcatttattgaacac

SEQ ID NO: 48074 - DNA, 201 bp, Homo sapiens
gttggccatttcttaaaagactaaatatacatctaccatacaaaccaatcatttcactcctaattattcacccaggacacaagaaagcatattttttatasaaagacttgtaccaaaatgctcacattacttttatctgtgttactcaaaaactgaaaacaaatcacatatccatcgacaggtaaatagatatacataaat

SEQ ID NO: 48075 - DNA, 201 bp, Homo sapiens
tgaaaggtaaaagaagccagagagcttgacattatggaagccagaagaaatttcctatagggaaggaaatgctaacagcattaaatattgcacaaacatgrattcagataaagtttaaaagaactccactgagtttgggtataggcaggtccctgaggactttagcaagaccagagatgacagagtagtgggagaggaatt

SEQ ID NO: 48076 - DNA, 201 bp, Homo sapiens
ggttaatttagggtgcctctctgctattagatgtacctgaaaaacacttctaggcaaaattagaccaaattaaaaacactggggcttcaattataataaaytctcaaatataagttttattattgtttattataataataaataatgtataagtgtgcagacatgggcagactacattttgcaaatttccacagtaaggta

SEQ ID NO: 48077 - DNA, 201 bp, Homo sapiens
tttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaa

SEQ ID NO: 48078 - DNA, 201 bp, Homo sapiens
acatattatagtaaatgtacttgacaaaggtcttttctctagaatatgtatttaaatcttattaataatctggcaaacaaagcaaaatgagcaaagatttsaagaagaatttcacaaaataagatatacaaatgacgattaagcacatgaaaatatgttcagcatcatcaaagaagtgcaaatgacaccaccaatgaggta

SEQ ID NO: 48079 - DNA, 201 bp, Homo sapiens
atttggaattgtcatagatatattggccatgatcatttggaagccagatttcatataattaggacgttcttcatttgagtaccattgagtgccctgacatwccttttttgaatcatcccaccagaatccttgatgaggctaaaaacatctccttcaatgccactgcagccttcaaagcttacagcaatattaaggactata

SEQ ID NO: 48080 - DNA, 201 bp, Homo sapiens
ctgtatttagagtaattgaacacatgattttacttgaatgcggagaaacttgaccaactgtgaatatgcaatttcactctacagatgaaataaaattaaayggggcaaaagtaaagaagaatggagactaggtaaagtgatggaaagagacaccaaaaaattagtcatgtgaaagcaaaactaagaggagagggaaaggtg

SEQ ID NO: 48081 - DNA, 201 bp, Homo sapiens
gtttgacaaattgaaatgctaattatgatttatcatttccatgacatcaaatatccagatagtaataaacgttgatgactaactatatttttcagtttcasccagatgtttggcatcacgtaagataccaccttagttttacataaaaataaaatgtttcttgagtctggcttatcataatggggaggaaactaatatgaa

SEQ ID NO: 48082 - DNA, 201 bp, Homo sapiens
agaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggat

SEQ ID NO: 48083 - DNA, 201 bp, Homo sapiens
catgggatttgaaaaactgactcctaccttttattcataaatcaagcaatgtctgcagctatgcatgaggagaggactgagcctgaaacacaagacggttytcatcttcgtgccagagctgtggactaccttccagaaagccagagatgtttgttgatacattttcataataaacccaaatgaagatggaagtcttgattt

SEQ ID NO: 48084 - DNA, 201 bp, Homo sapiens
gctgaacttgtgaaaattgagaactaatgtttatgtatttccttctccctccctaacccatcaactattatctagccttggaaaagtgtgttttaggagtwagtcctcaacaaatactgctaattaactaattatccttcttttgttaacttattttaatactaggatgcattagtctaaaggtcataacagaagaaaacc

SEQ ID NO: 48085 - DNA, 201 bp, Homo sapiens
agaaaagcagctgatagatattttttaaaaattaatgatgactgtgtgttttctctaagatacaagatatgagtggctggtatctgactgaccttcctggycgcattcgagtggctccccagcaggacgacttggactcacctcagcagatcagcatcagtaacgcggaggcccggcaagccctgccgcacagctactact

SEQ ID NO: 48086 - DNA, 201 bp, Homo sapiens
aatgtcccttcagtacgggatttctttctaccattttcctgagtaattaccttctagtcatcattcaaaaagcatttaagcattgaattctataggaaatrtttctaatcaccctatcccccagctctggctgagttaggccttctctgcacaattcccatgaaagcacctaccacccagcaggcagaaatatccctcttt

SEQ ID NO: 48087 - DNA, 201 bp, Homo sapiens
tgtttatgggatggaatctttttcagcacttgctgtcacctcagcgggccccagagaggcttattcagctggcagagggcaatctgaatacactcgtgacmgaaatgaacgagctgctgaccagggtaaggtggcaaaattatgaatcttctgaaagcagatagattatgtcaatgaaggaaaattacttcaaagttctga

SEQ ID NO: 48088 - DNA, 201 bp, Homo sapiens
ttggaattgtcatagatatattggccatgatcatttggaagccagatttcatataattaggacgttcttcatttgagtaccattgagtgccctgacattcyttttttgaatcatcccaccagaatccttgatgaggctaaaaacatctccttcaatgccactgcagccttcaaagcttacagcaatattaaggactatatt

SEQ ID NO: 48089 - DNA, 201 bp, Homo sapiens
tttcagattttcagactatgcatgtcagtcatcatttcttttcctaaaatcctggacaaaatgatagctttaataccgcctcacaaaataattggattttyaccaaactgggggccaagcttctcaagaagctccttctcccttgtcctctgcctctctttactcctcctccctcattctctctcccttccaccccttcat

SEQ ID NO: 48090 - DNA, 201 bp, Homo sapiens
cactctatctcggaaatgttcgtggcccacgtcttttccgtcattgtgcatttttgccccatcgctaacacttggcagtgtcagccctttcttataccccytgtcatcaaactatattcacattttccttttaaggtgaagtgatatgtatactgaaataatcctatattttttaatgttttagtgtatctttttgagctg

SEQ ID NO: 48091 - DNA, 201 bp, Homo sapiens
gcccggttttggttggtcctgtagttacactctcagagtcattgatgaattttgaccatcaataatgaaagcagaatttgaatttacagttttaagaaatytcaagaataaaatgatagaatactaccctgattggttagcaggatcaataacagggtgtgttttcatttttgtttcattgttgttttatatgatttgtat

SEQ ID NO: 48092 - DNA, 201 bp, Homo sapiens
cctcttgcctcagcaagctctaggttgtattttaaaggagattaaatatattttcactgaatttaattgtatctaagtaatacctttcgaagagtcaaatratacagaaaagctcataacaaaaagttgcaattcttccatccctccttcactctcagagacatgactgatctatctcagctgtttcttctagcatttacc

SEQ ID NO: 48093 - DNA, 201 bp, Homo sapiens
caatgggcataagatttttaagtgaaaaaaaaaaattctacttaaccaaggtggtaaaatagtccccttgtaattctccatgggatttgaaaaactgactyctaccttttattcataaatcaagcaatgtctgcagctatgcatgaggagaggactgagcctgaaacacaagacggttctcatcttcgtgccagagctgtg

SEQ ID NO: 48094 - DNA, 201 bp, Homo sapiens
ggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactcctaccttttattcataaatcaagcaatgtctgca

SEQ ID NO: 48095 - DNA, 201 bp, Homo sapiens
gttgctcctaggctacagacctgcacagcatgttattggtactgaatacagtaggcaattgtaacataatggtaagtatttgcatatctaaacatatttawacatagcaaaggtacattaaaaatatagttttataatcttatgggaccactgtcgtacacatggtcctatcattgaccaaaatgtcattatgcagcagca

SEQ ID NO: 48096 - DNA, 201 bp, Homo sapiens
tccatgctaggggcaggaggtaggatggagcagatagggagtctcttttcctcttaaaccggatgttttttttaaaatcagttttatatgttgagagtccrtggaatggaatgtggaaactgagaccctgaaagattaagtcacttgaacaaagatatacagcttctccagagaccaggcagacactaggtttatgatttc

SEQ ID NO: 48097 - DNA, 201 bp, Homo sapiens
gattatatatttttttcgggctgaaatctaattactagtgggctggcaggatatcatcttgtatctacactgcagttgtagaaaaacatttttttaatcaygttgcgtttgagaaaaggaacacttaaaaggaaaatccatcatcctgggagaaggggagaatgaaaaatatgtaaacattgccccaactgaggtcccccc

SEQ ID NO: 48098 - DNA, 201 bp, Homo sapiens
tttttttctatcaataattacacaaataatgtgtatcacttaaaaacaaaacttgaatatctaccaaaagctgtggctttcaattagagtattaaccacayaatttcattttgtaactctttctctctgagatattttgcctataactgaaaatctgatgtttctgtctttgctacatatttgatctattgtatgctggat

SEQ ID NO: 48099 - DNA, 201 bp, Homo sapiens
ttagtagagacagggtttggccatgttggccaggctggtcttgaactcctactcaggtgatcctcctgcctcggcctcccaaagtgctgggattacaggcrtgagccaccaggcccatcctctgatatgaatttcttattggagaatccctttatgtgtccagccctgtggtaggctctgagaatatagtaatgaacaagg

SEQ ID NO: 48100 - DNA, 201 bp, Homo sapiens
aaatcaaaaacaaatctgaagaagaaacagtactgaatcaaaacacaattatgttcccaaactgaaagaactatgttccagtaagttgatggaaaaaaaamaacaaacccaagcttcagaaaattctagcaaaaatatgaattatgtaaataaagagaaaatcgtgtatacatcttgggcgaagaaaaacgttactaacag

SEQ ID NO: 48101 - DNA, 201 bp, Homo sapiens
aactaaacagccagttttctcttaaattcttaaaaacaagtctctgcattttatatcttttaaatctggaattaccagaaatgtgatgcatatttcatttyctgtatgttcctccccttcacttcaacacgtacccttgaagaactgggagaaatggaactatttctgtgagagccctggatggacccaaagccagcattg

SEQ ID NO: 48102 - DNA, 201 bp, Homo sapiens
aaaaagtacaaaaggtagataactttgtactctttgaatattgcatgatagcaacaaaaatgaaaaatctatagaaaaaagtcaggtggtaaataaaaatmgaaagtatctttatatataaacagtgtccataattcaaccattttaaagtatttgcaaaattggattattctgttgtgtgcgtttctaactatatacatg

SEQ ID NO: 48103 - DNA, 201 bp, Homo sapiens
agtgaatatttggcacaactggcagaatcaagtgttaattttcccgcctcgttcttgatagtcaaagagaattaaatcaggcacccacagggctatcctargtgcatttcattttcaaaatgcttggcaaatgttaatgcttggttttagggcatttgtttaagcaactaggcagcagtggaaagagctagaggacaaaga

SEQ ID NO: 48104 - DNA, 201 bp, Homo sapiens
aaggcccacccatgtaacaaggcattatgaaataaacatgtctcaattgttacacactagttagacaacaatgttcatgttttaggcttagaacattaatmggaaatagttttcttgtgactaatgccaaatccactgagtctaaagtttattacatttccacttgtctaaagaatttttgagacatgtgccaaaatcttt

SEQ ID NO: 48105 - DNA, 201 bp, Homo sapiens
aaatgacgagttaatggatgcagcacaccaacatggcacatgtatacatatgtaacaaacctgcacattgtgcacatgtatcctataacttaaagcataayaataaaaaaagaaacttaaaaaaaatgaaatgtccgtatattttcttgattttttccaaatgttttgaagaaagtttttgtattattaaatgctattcat

SEQ ID NO: 48106 - DNA, 201 bp, Homo sapiens
tacattgctcccactgtgctgatggtgtgtgcacttaaaggttcttggataacaaggctcttgagcaaattgcctctcattactgagagctgagaaagttktgacagttgctttcaagttaaacttgggtgactaaatgaagtaacaagctttgtagttatacaaaattgatgccggaagttgttcaagtttgtcttgcat

SEQ ID NO: 48107 - DNA, 201 bp, Homo sapiens
cagctctttgggagatcttaagaatgactgagacaagaactgagttgtcacttgatcttttgaattcatttacctgtggaattttttggagtgattacaayaaagatttaaactatttataattgcaatttttactgtactattatctttttttaacagaaaagaaaacttaatagtcaatacatactctaataatcaaat

SEQ ID NO: 48108 - DNA, 201 bp, Homo sapiens
aaatttgaaggacttttatatttattaaaaactacctgttttctaaaagggttgtgctaatttacattcccaacagcaatgcagcagacttttgattgttytacaaactttttaatatttgatgttgtcaatctttttaatataatgccatttaatctaaaacatgagaactttgtcaatatataggtccagttactgtga

SEQ ID NO: 48109 - DNA, 201 bp, Homo sapiens
attaacaacaatagagcaattataacaatttactataataagagttatgtgaatgttgtctctctcactccccctcaaaatatcttattgtattatactcmtctttctccttgtgatgatgtgagatgataaaaggccaccatgattagatgaaatatggtgaacgacataggcattgtaacataaagttaggttattatt

SEQ ID NO: 48110 - DNA, 201 bp, Homo sapiens
tggaattgtcatagatatattggccatgatcatttggaagccagatttcatataattaggacgttcttcatttgagtaccattgagtgccctgacattccktttttgaatcatcccaccagaatccttgatgaggctaaaaacatctccttcaatgccactgcagccttcaaagcttacagcaatattaaggactatattg

SEQ ID NO: 48111 - DNA, 201 bp, Homo sapiens
gaaaaaacagatacattcagtgatttaaaaatggggtaattctttctgtttttatttcacaagtcttttgtaacttattttagagttttaaaactttgtakacatatttaaaatgttcaattttcactaaaacaatcacatttttaaacataagggcatatatttggtgtgacaacctaacatttgccaccaagtgttaaa

SEQ ID NO: 48112 - DNA, 201 bp, Homo sapiens
agtgttgactcttactgtataatctaccataaatagaagcgaagttgcacatgcatttaattttttttattttggaattatgttaagtttacacacatgtrtgaagattatagagaatcctcacattccctcatccagctatccctaggaataatatcttaaataatgacaatgcacatgttaaaactaagaagttagcat

SEQ ID NO: 48113 - DNA, 201 bp, Homo sapiens
ttaaatgaacagtgatttgagatttatagcttccctttctttgtgtcatggataatttctctgtgctaaggtgtgagcatacacatcatttgggctgttaytgaagtagaatacgaagcctgccttctttcactagcaggggaatagtgagtaaattctctattgctaaacaaatattacctctatttatgatttaaattt

SEQ ID NO: 48114 - DNA, 201 bp, Homo sapiens
tcaaccattttaaagtatttgcaaaattggattattctgttgtgtgcgtttctaactatatacatgatgtaccgaatttaagaagcttattaagcttattrgtttttactgcagatcgggctcatcaaggaaaaactaatccgtacagcataaacaaattagaaatgaacttaaaataaatatacaaacaaaatagtaaac

SEQ ID NO: 48115 - DNA, 201 bp, Homo sapiens
gcatgtaagtgctatggaagcatttatcattattattattatctttattagttttattaattgtgttatacattgtgctttggcacaggaaaactagctarttactcaggttttctttctatttagtgttatgattccgctgaagaactacttaagataatttctatttgcaagtaatgatttgcactgtcccatgacatt

SEQ ID NO: 48116 - DNA, 201 bp, Homo sapiens
agtggttattatcaaatttttattttagaattgtagattattattattattattatttgaaatttgacagactttcctttgttcagatccaagctgtgccrcttattacatgtgtaacatttatcaaacattttagccttctcaaactttaatttcttcttttgtaaaatgagaatcacaatgtctacttaataatcttat

SEQ ID NO: 48117 - DNA, 201 bp, Homo sapiens
gatggcttcttcagacccaaaggggtaaagtatgctttttctttcataaagagttatttttttgctttttcatacaaaaatgttttatacaaaaaaataakaattttgaaagcttctgtaaacagttgaacttcaaattaaaaggtaagtaggaacatttcgtagttgaaactgacctaaatctttgaggatgtaagataa

SEQ ID NO: 48118 - DNA, 201 bp, Homo sapiens
ctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggc

SEQ ID NO: 48119 - DNA, 201 bp, Homo sapiens
agagttaaataaactatgatgtgtctatgtttggctttcaagcttaccttgcttgattcacaaagcttctaggaactataaattgagattttattccacawttaggaaattttaggctattttttttatttttacttattttttttaggcttttgtttaaaacctgttttttgaccagtgtttttccttctctttctagga

SEQ ID NO: 48120 - DNA, 201 bp, Homo sapiens
agccctgaattctaatgtttatcttcttatcctgtgagattgctgaacacactaagatgtagctttctctataacctcctattcaactgtcagcaaatcartaaaagtaccctgagaggaaaatggctagcttaccttattttgcttccctttacttaagtctggctgccttggttgcttgctgatgccttcaaactgctg

SEQ ID NO: 48121 - DNA, 201 bp, Homo sapiens
tgatgaagaaattactctgtgtgcaagtgtggagaaaaatagcttgtgataccatagtgatcttagagctcattatacatcagcaatgaagagctttaacwaccatgcaattaaaatactagagagtataaataagattgtaccatgtgtatgtggcagcatataaaaactcagaagtggaaggaattttagtcaagtgtt

SEQ ID NO: 48122 - DNA, 201 bp, Homo sapiens
ccatttatcagtttcataacaatgattttcaagcttgtttcatttctcacagggtagacaaagacaaaatatatatctcataaaagtaataatctaccagkcatgtttgttgtagccaagcaaatatatagaattctaaaaatattgtttatagctcttgtttcaacatgcttgggacaagttaatgtttacagttttgtg

SEQ ID NO: 48123 - DNA, 201 bp, Homo sapiens
gataaggaaataatttgaccagagcatgggattttaattgagaatattaagagataaaattataataaatgtagggaaggtgtatcagagtgagattatgrtatactatacttgaaatatctaaatgaagtatttatgtttactctaaaagtcaagtgagagagattctggagtgagacaagaatgtgaggaatggggact

SEQ ID NO: 48124 - DNA, 201 bp, Homo sapiens
atgtgcccctgacatctgtacatgtgtttaatttccagtgagctcaaaatacttcaagtgatctcatttgagtattaactagggaaatacattcacagtcyagcaattttcttttatgtctacattattttaaatcatagcatagattttccactgtgctttatgaccagaacacatttatttgcaaagtattttcactta

SEQ ID NO: 48125 - DNA, 201 bp, Homo sapiens
ttatcaaatttttattttagaattgtagattattattattattattatttgaaatttgacagactttcctttgttcagatccaagctgtgccgcttattayatgtgtaacatttatcaaacattttagccttctcaaactttaatttcttcttttgtaaaatgagaatcacaatgtctacttaataatcttatttttcaga

SEQ ID NO: 48126 - DNA, 201 bp, Homo sapiens
ctcatcttgaattgcagttcccacaattcccaagggtcatgggagggacctggagggaggcaattcaatcataggggcaggtctttcccatgcttttctcrtgatagtgaataagtctcacgagatctgatgattttataaaggagagttcccctgcacatgccctcttgcctgccaccatgtaagacgtgactttgctct

SEQ ID NO: 48127 - DNA, 201 bp, Homo sapiens
cagcttattttatgaggctgatacaatcttgatggcaagccctacagaggacagtactacaaagaaaaactataggccagttatttaaatagagaagctayaaatgaaatattataaaacccagttcaaatgtacatattttaaagatctgtaaatatacagtaaaacattaacatttgccagatacagatgatgggaata

SEQ ID NO: 48128 - DNA, 201 bp, Homo sapiens
tgaatagattttctatgacgttgactccttggaatgaccaccagaggcaataagcacactctcagtgacacgaggatatgaggccctcctctgcccatttmcactggaaatgtcttagatgtcttagtgcttttcaatcaggtatatccaaacaacaaacaaacaaataaaataagactaatgcagaatgaattccatagt

SEQ ID NO: 48129 - DNA, 201 bp, Homo sapiens
ttatcaagaatatgtgttcaattttgttaaatgacttttctgcatctattgagatgaccatatgatatttctttttaagctgttaatatgacagattatastgattgattttcaacatatcaatccagtcttacaatcctcagattaatcctgcttggccatggggattatccttttaaaattatgttgaatcctgtttgc

SEQ ID NO: 48130 - DNA, 201 bp, Homo sapiens
cttaggcgtccatgttaccatgtggggtatattattatttaacaagcctattaagactattagaaagttttcctgatcacaggtctctcttctctttgcarcctgtcgctgtaatgccggtggctctttctctgaggtttgccacagtcaaactggacagtgtgagtgcagagccaacgttcagggtcagagatgtgacaa

SEQ ID NO: 48131 - DNA, 201 bp, Homo sapiens
aaagtgtgagcaaatgtcattgaaagagaagacagagcagaatataaataggcgctgcctataaggacgtttctgcacacctgtagcagtaagttgcattytaaaacataacatttaggtcagagaaaatttgctgctatcgtttttaaaaatcttctttgccatgccctataaacaaacttttgtttttccaataatata

SEQ ID NO: 48132 - DNA, 201 bp, Homo sapiens
tttccaatttcatccatgtccctacaaaggacatgaactcatcattttttatggctgcatagtattccatggtgtataagtgccacattttcttaatccartctatcattgttggacatttgggttggttccaagtctttgctattgtggataatgccgcaataaacatacgtgtgcatgtgtcttcatagcagcatgatt

SEQ ID NO: 48133 - DNA, 201 bp, Homo sapiens
ttcctttacaaaaaaagaccaaaaatgttctgccattcttgctcatcatgattttgcctcagtttttcaagttatgttttgttcataatggatttttttttgtttgttttctgaatgtgttctgttccttctactgccttaaaaagccctcatcactgagtcttcctactacttccctcacctccacttaccctactgaat

SEQ ID NO: 48134 - DNA, 201 bp, Homo sapiens
ttgtctccctttagtatatgtgacccacctcctttcatgctacctaattatgtatatctccattgatactcatgtctgatattctctcccacatagtccamacatctgaagctagtatcatcatttatatttacattttcagaaaacccatattcacattctatcatgcccaccccagccaatctagggttatctctcaac

SEQ ID NO: 48135 - DNA, 201 bp, Homo sapiens
gacctgttgtttggtataaataatcccttttttctgctggattcaatcttttattacatacatttactggatttttaatttttgtatttttattttttagktttagaatatccaattgatactttaaaaaaattagactccaaatatctctccacttagtcatctggaacatattaataacagttattttaaattatatgt

SEQ ID NO: 48136 - DNA, 201 bp, Homo sapiens
aaagggaaaaaaggccatacaatgatgctgtttaaacaagagtgtaaatgtaggatatgtattttgatctaaaatgttgataaaccaaattctagcaataycatgaaaatgtaaacattttggagacccagatcctatttcaaatagagtcaagatgactgccctagaaaatgcttcttgaagtcatggaataaattagat

SEQ ID NO: 48137 - DNA, 201 bp, Homo sapiens
taaaattcgtatacaacagtaagtaaaatatgatttaatagcccatctcctatcccgtaatgattatgcatcttctgtcttgtagctcccagcagtaggargacagttgacatttaccatatcatatgaccttgaagaagaggaagaagatacagaacgtgttctccagcttatgattatcttagaggtagagtactgaga

SEQ ID NO: 48138 - DNA, 201 bp, Homo sapiens
ttgggcctgactcatcccatcctctctggacacaaagaagggcagaaaatggatctgggagaaagcaagtagaacacaaccaacacagacagggacaattwtatcccaatagcattcaaggatgttaaagcctaaagaatgtcaaccagccgggtgtagtggcccatgtctgtaatcccagcactttggcaggtcaaagca

SEQ ID NO: 48139 - DNA, 201 bp, Homo sapiens
aaaagctttttctaacataactcacagctgtagacttttcctttcaataataagcaaaaacaattttcatagctacaaaccgccgacacaactttctattyaaagaggacttctttgcaggaggcagaataataactcaacaaaataaatagaatctctaatttcaaaatactattatccccaaaagtaatgggaatttta

SEQ ID NO: 48140 - DNA, 201 bp, Homo sapiens
aagtccgactccttaccaaatctgtagacagtcagcttcggtcccttaaatttaaatgtaaattcctctaagatcattttcccagttgcacaagctgaagwaatagtcttttgggcctgactcatcccatcctctctggacacaaagaagggcagaaaatggatctgggagaaagcaagtagaacacaaccaacacagaca

SEQ ID NO: 48141 - DNA, 201 bp, Homo sapiens
atctgtaaaacataaacaattaagtgatagagtttattcaagagatattcgttacagtgttttcaaaggaaacttagggacaatctccctagacatgtacytgcttgtgtgtcagtttgacttaaatctttggtttaaacaacaacaacaaaaaaaggtacctaacagtgataatcttctatatttaaaatcaaaagctct

SEQ ID NO: 48142 - DNA, 201 bp, Homo sapiens
tttctttgtcaggaacagtgtggcaacaataataaatcagatttagactggctactgaaggggtttgtttaaaagatttaaaaatctcttcagagtcaaakatgttaattctacctggtgaaccagaatgatcctgcatatatcttgggacagacttatattttctaaatctgggtaatgatcatacatgcactgaaaaga

SEQ ID NO: 48143 - DNA, 201 bp, Homo sapiens
tttacatttctacttgaaatgtaactgttttaattttatactgagcaaggacaatggtattactttaatattgagaaaaaactagactatgcgatgtttgktttatttatttttaaggtttggtcttatcactggggaaaaatgcagacacagataatggtcatacccatctgtaaaacataaacaattaagtgatagagt

SEQ ID NO: 48144 - DNA, 201 bp, Homo sapiens
tcaatgttattctgcagcacttgtttgccagcagctgttagggattattgcaggtttctttgtcaggaacagtgtggcaacaataataaatcagatttagwctggctactgaaggggtttgtttaaaagatttaaaaatctcttcagagtcaaagatgttaattctacctggtgaaccagaatgatcctgcatatatcttg

SEQ ID NO: 48145 - DNA, 201 bp, Homo sapiens
taccaggtccaccctacttaaaatgggaagtaactgagaactgattcagttattctatctttggagctttaatgcaattatcaacatctagtaccatatakattacttatagaactatccctgtcttcagcacttccctcccattttctcttcttgttttcccaattctcaactccctgttaaacccaaagcagctaacag

SEQ ID NO: 48146 - DNA, 201 bp, Homo sapiens
ccaagctataaagcatttattaaataaaaatgaagtaaactacatacagtcgctttgactactaattcagccccattcagaattggatatgattgtctgcyagggataacgcactatgctattcagttctactcatgaattccagtcagatcttgatttcttgttcactttgatcctcttatgatgtcaatggtacgtata

SEQ ID NO: 48147 - DNA, 201 bp, Homo sapiens
tgtaggttcagggccagaggacaaaaactgttgaaattgccttgatatagattcatagattgcaaatgagcactttttaaaatttaaacccttgaatatgrtatctcaggcacagagtgagttctttatatatacaaaatgtgattcttaccgcctaccagctgtcttccgatttcaccagatgaccttccctataagttt

SEQ ID NO: 48148 - DNA, 201 bp, Homo sapiens
tgactctttagtcaaactgaggatcagtattttaaaagtctataaaatacttaagccatcttgtagaaataaatagtcttcccacccagaccataatctcygaaataattattaggaattttctttttctttcaaacactttggaattataatttagattctttaaaaactgagttttatgactgttttttcaaaaaagct

SEQ ID NO: 48149 - DNA, 201 bp, Homo sapiens
ataaggctgctgaacttaaaaaaaaaatgctcaaagtgagtgaaggtaagagatgttcattttcttccagtactgaaaattaagagtacagacccacatgytattatacaagagaaagtagtcctatgactgctggataatttacatacattatctaatttatcataaccctgggagagtggaaatattgctattcttatt

SEQ ID NO: 48150 - DNA, 201 bp, Homo sapiens
ccaggaaggagagagtgaaatcaaggagaaggtgatggataggagaaaggaccctgagttattataacagagtccaagagtcagagagctgcacagatggkgtgggatatgccaggtcaaggaaagggccatgggagtgggtgcctgatgcggagaggaggaaaagaggtcagcgaggaggtaaagagcctgggcacaggc

SEQ ID NO: 48151 - DNA, 201 bp, Homo sapiens
ttggaatagatcatggggtgggagttaattgaaggggtagtcaagaaaggccctgctaaagaagtgttgggttggttagagcccagcaagggacttttcakctctggagatgcttgtagagaaatgcagaggtcctaatatgggaatgaacatctcatgtagggtatagcttctcatgtttgaggaacagaaacaaggccc

SEQ ID NO: 48152 - DNA, 201 bp, Homo sapiens
gtcctttttccttatactgttgatctcagaactgttctgcagtcctgaagtatgaaacactattgccattttttggtacagccagtgctctaaaaaatgtraatggatgaaagcgattcaatctattatggaagcagaaacatcttcctatttgctttacaaatttttccgagtaaaatgcagtcaggtttgtaacattgc

SEQ ID NO: 48153 - DNA, 201 bp, Homo sapiens
gcatatacttgatgatttgattggtggtttgattccagttatattaacttgccagaaactttctagtttccaaacagtgaatacaacttagacctcatgamgcttacattctagttagaagagagaatattaattagataagcacataaaatatacatgtgttagatagtgataaatgacaagaaaaaaagtagagcatgg

SEQ ID NO: 48154 - DNA, 201 bp, Homo sapiens
gattgctcagtgagtactaatgtggaatattactgggaaagatgtttgagtgttgaagtttctcatagctcagaatggttacacagattaaggagaggaaygtctgttgttcaaaagacaaatgaaatttgtcagttcactgaaaatatttttgtttttgtatcttttttaaaactgtttcttaaagtagtcaactgctca

SEQ ID NO: 48155 - DNA, 201 bp, Homo sapiens
acttatggattataaatatgtttgtgcaaattttctctagcagtaattctaaaacctttgtggacattaagctgtaattgtagctttctcttgcaagcttytttatcctctgctttattattcccttgtaggaaattaagtattttatataataatgcttagaacatctttctcttttaaagagggaaattaagataaaga

SEQ ID NO: 48156 - DNA, 201 bp, Homo sapiens
cagttacctaactgagcatgatgtttgtgccattattgatatgagggtgttatgggctgaactgtgtccccacaaaactcatgtgtcagagttcgaaaccscagtacttcaaaaagtgactctatttggagacaggacctttaaagaggtaattaaggtgaaatgaggtcacatggatgggctctgattcaatatgactga

SEQ ID NO: 48157 - DNA, 201 bp, Homo sapiens
atgaagtcacatggctgcagttgccatttattggagaaactgaatttcagggatttggatcaggtcaaggtatgttatgcacataaaccaaatattaatgrtatttatttagtgtgcaccagtgatatttgttttttccttcgctaaactgaagattaaggcaatcagaacctagtaaacattgctgaattcaccattgta

SEQ ID NO: 48158 - DNA, 201 bp, Homo sapiens
gtggaagagagaaatgaatgcaggcaggcaggatgttttcctcgaggttttttatttatatcccctggactgcataactcagtttattcccttctaaaccracttttctagaatgtgttgtctctgttcgacacctacaactctggttcattttctatgcattaaggatgatgtaactttaaaacctctcatgtaaattct

SEQ ID NO: 48159 - DNA, 201 bp, Homo sapiens
agaacacccaaaaacaaacaaaataaaggattcaaatgggtgacatggccagtcctggttacagtatgagacagatgccggttacggtgggcaacagaacwgatgctggctacagtggtcgacagagttcattttagttcaagcagaaggtagggctggtgcttgttacagtggccagtaggcctggtttctggttatagc

SEQ ID NO: 48160 - DNA, 201 bp, Homo sapiens
aaagcttaattacttgattttcttatttgataatgatttatgggctttggggagatgccaaaaccaagcttatgaatgacaaccaagcacacatttgatastacagtactaagaaagatttggggctctctaagcctacagtgaatatcacaatttacacctaggtggagaggaataatgctgaaatgcatttgtacttat

SEQ ID NO: 48161 - DNA, 201 bp, Homo sapiens
ttcagcacttgctgtcacctcagcgggccccagagaggcttattcagctggcagagggcaatctgaatacactcgtgaccgaaatgaacgagctgctgacsagggtaaggtggcaaaattatgaatcttctgaaagcagatagattatgtcaatgaaggaaaattacttcaaagttctgaaatgcaaatcaccttcttcct

SEQ ID NO: 48162 - DNA, 201 bp, Homo sapiens
acatctagcatttgcatcaaggtgagtttgtctcaaaagctctgttctagtgccccactcaagaacagatattgtcaaatttgtaaaagatattttaactrgaatagacttgatttttattgctgatttaatctattacaaactattgcttttctattctaagctgttgtaaaaattattgctttaatatgatcacttaat

SEQ ID NO: 48163 - DNA, 201 bp, Homo sapiens
cttctgtccaagccactgacagcaagtgaatttggcatgtgtgattgggaggaaatcagttcccttactctatttatgaaagaattattagcaaatcattktcctgacccaagttcattattagagagtttaactagccgtatgagtgaatagctttttatgctgaaggtagagggtatagaccagattcaggccagaaag

SEQ ID NO: 48164 - DNA, 201 bp, Homo sapiens
aatagtattcttttgataacacatagtatttatgtagtatactgaattgtcaggtatttatcattaattatctcatgttgggttactttaatgctccgaaraatattttatctcaattgcttttaaaatgtatcaaaatcctaactttgtttctggtctacacaccttcatttgtccatctttttcaggtttattccctgc

SEQ ID NO: 48165 - DNA, 201 bp, Homo sapiens
agacaaaaaaagcacagttctgtagatacttagaaaaaaagattaattttgtttgggggatatcaggaaacgtttcatggaggaatcagcatttgagcaargcttcaggtgattttaacactcccatacaaagtagtgggtgatagaagagtaggaccctccaccaaaatataggtaggaaaccccacctacagggaagca

SEQ ID NO: 48166 - DNA, 201 bp, Homo sapiens
aatacgtgtatgttcattagaaataaactaataagcacataatatgtggagattatgatgggaaacagaaataagtaacatagttctttctatcaagaatrtattatcaactggtaagaaattgaaagaaggcaagtaaaaatgattaaagacaaaaaaagcacagttctgtagatacttagaaaaaaagattaattttgt

SEQ ID NO: 48167 - DNA, 201 bp, Homo sapiens
atggctgtggttttcaaacatctacccataaactgaggccaggtggctgaagacatttccactgctctaagtgagaaacgtagaacagagtgtgttcaccmtcaagctcgatgtattcaattttaaggaataatatttattctgagattatattatagcatttttatggtggctaaaaggcctttctattatgaaatagta

SEQ ID NO: 48168 - DNA, 201 bp, Homo sapiens
gaattgaggggcacgcaggattctgagcaccaggggcagaggcggccagacaacctcagggaggagtgtcctggcgtccccatcctccaaagggcctgggmccgccccgagggggcagcgagaggagcttccccatccccggtcagtccaccctgccccgtccactttcccatctcctcggtataaatcatgtttataagt

SEQ ID NO: 48169 - DNA, 201 bp, Homo sapiens
tgagcaggtgcaggaggagctgctcagctcccaggtcacccaggaactgaggtgagtgtccccatcctggcccttgaccctcctggtgggcggctataccyccccaggtccaggtttcattctgcccctgtcgctaagtcttggggggcctgggtctctgctggttctagcttcctcttcccatttctgactcctggcttt

SEQ ID NO: 48170 - DNA, 201 bp, Homo sapiens; identical to SEQ ID NO: 8947

SEQ ID NO: 48171 - DNA, 201 bp, Homo sapiens; identical to SEQ ID NO: 8948

SEQ ID NO: 48172 - DNA, 201 bp, Homo sapiens
tctgaggcttctgtgctgcttcctggctctgaacagcgatttgacgctctctgggcctcggtttcccccatccttgagataggagttagaagttgttttgwtgttgttgtttgttgttgttgttttgtttttttgagatgaagtctcgctctgtcgcccaggctggagtgcagtggcgggatctcggctcactgcaagctc

SEQ ID NO: 48173 - DNA, 201 bp, Homo sapiens
gaggcttctgtgctgcttcctggctctgaacagcgatttgacgctctctgggcctcggtttcccccatccttgagataggagttagaagttgttttgttgktgttgtttgttgttgttgttttgtttttttgagatgaagtctcgctctgtcgcccaggctggagtgcagtggcgggatctcggctcactgcaagctccgc

SEQ ID NO: 48174 - DNA, 201 bp, Homo sapiens
ctggagcctgggaaggagaaggacaaagagcccccttttttaaattttttttatgtttttgagacggagtctcactctgtcacccaagctggagtgcagtrgcacaatcttggctcactgcaacctccacctcatgggttcaaacgactctcctgcctcagcctcctgagtagctgggaccacaggtgcacaccaccatgc

SEQ ID NO: 48175 - DNA, 201 bp, Homo sapiens
cttttcagagggcaggggtcactgagcggagagcagaggaggagtgagccatttgctccagcgtgaagttgttggtgtgatggggtttcagggtggcaggmgcagtgtggttaaaggtctggaagctgtcggcatgtggctggtatccaaggtggccaggaactctgcatggatatggtgggaagctggcacgcctctcac

SEQ ID NO: 48176 - DNA, 201 bp, Homo sapiens
ggtagagacggagtttcaccatgttggccaggcaggtctcgaactcctgacctcaagtgctccgcccaccttggcctcccaaagttctgggaatacaggcktgagccactgcaaccagccagtagcccccatctttgcccctcgctgagccctactggatgttcttggttatgcgacagtttccccatctattaaagagaa

SEQ ID NO: 48177 - DNA, 201 bp, Homo sapiens; identical to SEQ ID NO: 8949

SEQ ID NO: 48178 - DNA, 201 bp, Homo sapiens
gtcactgagcggagagcagaggaggagtgagccatttgctccagcgtgaagttgttggtgtgatggggtttcagggtggcaggagcagtgtggttaaaggyctggaagctgtcggcatgtggctggtatccaaggtggccaggaactctgcatggatatggtgggaagctggcacgcctctcacctcagctcttccctgca

SEQ ID NO: 48179 - DNA, 201 bp, Homo sapiens
taaaatgaggactgaattagctcataaatggaacacggcgcttaactgtgaggttggagcttagaatgtgaagggagaatgaggaatgcgagactgggacwgagatggaaccggcggtggggagggggtggggggatggaatttgaaccccgggagaggaagatggaattttctatggaggccgacctggggatggggaga

SEQ ID NO: 48180 - DNA, 201 bp, Homo sapiens
tgcctggacggggtcagaaggaccctgacccaccttgaacttgttccacacaggatgccaggccaaggtggagcaagcggtggagacagagccggagcccragctgcgccagcagaccgagtggcagagcggccagcgctgggaactggcactgggtcgcttttgggattacctgcgctgggtgcagacactgtctgagca

SEQ ID NO: 48181 - DNA, 201 bp, Homo sapiens
tcctgaatcaccgcaagaacaagtttcagtgtggctttggcctcaccatcggctgagccctcctggcccccgccttccacgcccttccgattccacctccrcctccacctccccctgccacagaggggagacctgagcccccctcccttccctccccccttgggggtcgggggggacattggaaaggagggaccccgccac

SEQ ID NO: 48182 - DNA, 201 bp, Homo sapiens
gggattctggaactgaatggcgcttcgggattctgagtagcaggggcagcatgcccagtgggcctggggtcccgggagggattccagaattgaggggcacrcaggattctgagcaccaggggcagaggcggccagacaacctcagggaggagtgtcctggcgtccccatcctccaaagggcctgggcccgccccgaggggg

SEQ ID NO: 48183 - DNA, 201 bp, Homo sapiens
gaggctcttcctgtcgctcccggtcctggtggtggttctgtcgatcgtcttggaaggtaaaagtgggatgggagaattgcggagttggagatttggaagartgaaggtggctacaggcctggggtcccggcttagaggacctctgagagctccggggccccttctgggtcgtggttgcctcatcgtggtcgggtgggtctc

SEQ ID NO: 48184 - DNA, 201 bp, Homo sapiens
tagcaggggcagcatgcccagtgggcctggggtcccgggagggattccagaattgaggggcacgcaggattctgagcaccaggggcagaggcggccagacracctcagggaggagtgtcctggcgtccccatcctccaaagggcctgggcccgccccgagggggcagcgagaggagcttccccatccccggtcagtccacc

SEQ ID NO: 48185 - DNA, 201 bp, Homo sapiens; identical to SEQ ID NO: 8951

SEQ ID NO: 48186 - DNA, 201 bp, Homo sapiens
tgctttcccagtctgatgagcaaaggaacttgatgctcagagaggacaagtcatttgcccaaggtcacacagctggcaactggcagagccaggattcacgycctggcaatttgactccagaatcctaaccttaacccagaagcacggcttcaagcccctggaaaccacaatacctgtggcagccagggggaggtgctggaa

SEQ ID NO: 48187 - DNA, 201 bp, Homo sapiens
cctcttgctgaggctggagtgcagtggcgagatctcggctcactgtaacctccgcctcccgggttcaagcgattctcctgcctcagcctcccaagtagctrggattacaggcgcccgccaccacgcctggctaacttttgtatttttagtagagatggggtttcaccatgttggccaggctggtctcaaactcctgacctt

SEQ ID NO: 48188 - DNA, 201 bp, Homo sapiens
cccaagtagctaggattacaggcgcccgccaccacgcctggctaacttttgtatttttagtagagatggggtttcaccatgttggccaggctggtctcaawctcctgaccttaagtgattcgcccactgtggcctcccaaagtgctgggattacaggcgtgagctaccgcccccagcccctcccatcccacttctgtccag

SEQ ID NO: 48189 - DNA, 201 bp, Homo sapiens
gcctggctaacttttgtatttttagtagagatggggtttcaccatgttggccaggctggtctcaaactcctgaccttaagtgattcgcccactgtggcctyccaaagtgctgggattacaggcgtgagctaccgcccccagcccctcccatcccacttctgtccagccccctagccctactttctttctgggatccaggag

SEQ ID NO: 48190 - DNA, 201 bp, Homo sapiens
cacacaggatgccaggccaaggtggagcaagcggtggagacagagccggagcccgagctgcgccagcagaccgagtggcagagcggccagcgctgggaacyggcactgggtcgcttttgggattacctgcgctgggtgcagacactgtctgagcaggtgcaggaggagctgctcagctcccaggtcacccaggaactgagg

SEQ ID NO: 48191 - DNA, 201 bp, Homo sapiens
agtctcaggagagctactcggggtcgggcttggggagaggaggagcgggggtgaggcaagcagcaggggactggacctgggaagggctgggcagcagagamgacccgacccgctagaaggtggggtggggagagcagctggactgggatgtaagccatagcaggactccacgagttgtcactatcatttatcgagcaccta

SEQ ID NO: 48192 - DNA, 201 bp, Homo sapiens
gatggggtttcaccatgttggccaggctggtctcaaactcctgaccttaagtgattcgcccactgtggcctcccaaagtgctgggattacaggcgtgagcyaccgcccccagcccctcccatcccacttctgtccagccccctagccctactttctttctgggatccaggagtccagatccccagccccctctccagatta

SEQ ID NO: 48193 - DNA, 201 bp, Homo sapiens
cctgacccaccttgaacttgttccacacaggatgccaggccaaggtggagcaagcggtggagacagagccggagcccgagctgcgccagcagaccgagtgrcagagcggccagcgctgggaactggcactgggtcgcttttgggattacctgcgctgggtgcagacactgtctgagcaggtgcaggaggagctgctcagct

SEQ ID NO: 48194 - DNA, 201 bp, Homo sapiens; identical to SEQ ID NO: 8961

SEQ ID NO: 48195 - DNA, 201 bp, Homo sapiens
cactgcagcctccacctcctggactcaagtgataagtgatcctcccgcctcagcctttccagtagctgagactacaggcgcataccactaggattaatttggggggggggtggtgtgtgtggagatggggtctggctttgttggccaggctgatgtggaattcctgggctcaagcgatactcccaccttggcctcctgagt

SEQ ID NO: 48196 - DNA, 201 bp, Homo sapiens
ccagcagctgaggaggggattctggaactgaatggcgcttcgggattctgagtagcaggggcagcatgcccagtgggcctggggtcccgggagggattccrgaattgaggggcacgcaggattctgagcaccaggggcagaggcggccagacaacctcagggaggagtgtcctggcgtccccatcctccaaagggcctggg

SEQ ID NO: 48197 - DNA, 201 bp, Homo sapiens
ggaactgaatggcgcttcgggattctgagtagcaggggcagcatgcccagtgggcctggggtcccgggagggattccagaattgaggggcacgcaggattytgagcaccaggggcagaggcggccagacaacctcagggaggagtgtcctggcgtccccatcctccaaagggcctgggcccgccccgagggggcagcgaga

SEQ ID NO: 48198 - DNA, 201 bp, Homo sapiens; identical to SEQ ID NO: 8946

SEQ ID NO: 48199 - DNA, 201 bp, Homo sapiens
tgcttgtttctcccccaacccccttcatctggatttcttcttctgccattcagtttggtttgagctctctgcttctccggttccctctgagctagctgtcycttcacccactgtgaactgggtttccctgcccaaccctcattctctttctttctttctttttttttttttttttttttttttttgagacagagtcttgct

SEQ ID NO: 48200 - DNA, 201 bp, Homo sapiens
atctgcgcaggagagcactagcaaccgatgacgtattgaggcccacacctctgggattggctgtcctgcttcgacagccttgaaagtgggtaagctgggtrgggggctctgggagaggtcagtgctgagtaaggcaattcccagcagcttgagccccaccaggtcactccagtattcctccccattctttttttttttttt

SEQ ID NO: 48201 - DNA, 201 bp, Homo sapiens
gggaggagtgtcctggcgtccccatcctccaaagggcctgggcccgccccgagggggcagcgagaggagcttccccatccccggtcagtccaccctgcccygtccactttcccatctcctcggtataaatcatgtttataagttatggaagaaccgggacattttacagaaaaaaaacaaaaaacaacaaaaaatatacgt

SEQ ID NO: 48202 - DNA, 201 bp, Homo sapiens
cccccagggtctggggaaggaggctgctgagtagaaccaaccccaggttaccaaccccacctcagccaccccttgccagccaaagcaaacaggcccggccyggcactgggggttccttctcgaaccaggagttcagcctcccctgacccgcagaatcttctgatcccacccgctccaggagccaggaatgagtcccagtct

SEQ ID NO: 48203 - DNA, 201 bp, Homo sapiens
aatttttgaacttttttgtagagatgaggtctccctatattgcccaggctggtctcgaactcccaggctcaagtgatcctccctcttcagcttcccaaagkgctgggattacaggcatgagccaccatgcctggctaatgcaggtgaggtttttgcagtgtcatccagctaaggcgacccgttcccctcccaaaaaaggga

SEQ ID NO: 48204 - DNA, 201 bp, Homo sapiens
gccaccttgcccggcctcctagctccttcttcgtctctgcctctgccctctgcatctgctctctgcatctgtctctgtctccttctctcggcctctgcccsgttccttctctccctcttgggtctctctggctcatccccatctcgcccgccccatcccagcccttctccccgcctcccactgtgcgacaccctcccgccc

SEQ ID NO: 48205 - DNA, 201 bp, Homo sapiens
cctccacctcctggactcaagtgataagtgatcctcccgcctcagcctttccagtagctgagactacaggcgcataccactaggattaatttggggggggkgtggtgtgtgtggagatggggtctggctttgttggccaggctgatgtggaattcctgggctcaagcgatactcccaccttggcctcctgagtagctgaga

SEQ ID NO: 48206 - DNA, 201 bp, Homo sapiens
caggggcagcgacacggtagctagccgtcgattggagaactttaaaatgaggactgaattagctcataaatggaacacggcgcttaactgtgaggttggarcttagaatgtgaagggagaatgaggaatgcgagactgggactgagatggaaccggcggtggggagggggtggggggatggaatttgaaccccgggagagg

SEQ ID NO: 48207 - DNA, 201 bp, Homo sapiens
ttggccaggctgatgtggaattcctgggctcaagcgatactcccaccttggcctcctgagtagctgagactactggctagcaccaccacacccagcttttyattattatttgtagagacaaggtctcaatatgttgcccaggctagtctcaaacccctgggctcaagagatcctccgccatcggcctcccaaagtgctggg

SEQ ID NO: 48208 - DNA, 201 bp, Homo sapiens
ctgaattagctcataaatggaacacggcgcttaactgtgaggttggagcttagaatgtgaagggagaatgaggaatgcgagactgggactgagatggaacyggcggtggggagggggtggggggatggaatttgaaccccgggagaggaagatggaattttctatggaggccgacctggggatggggagataagagaagac

SEQ ID NO: 48209 - DNA, 201 bp, Homo sapiens
agagttgtgagcccttaaaaggaacagggattgctcactcggggagctcggctcttgagacaggaatcttgcccattccccgaacgaataaaccccttccbtaactcagcgtctgaggaattttgtctgcggctcctcctgctacattctgagtggggaaagggactaaggtggtctgaggaccccacagagtcaggaaga

SEQ ID NO: 48210 - DNA, 201 bp, Homo sapiens
gaacttgttccacacaggatgccaggccaaggtggagcaagcggtggagacagagccggagcccgagctgcgccagcagaccgagtggcagagcggccagygctgggaactggcactgggtcgcttttgggattacctgcgctgggtgcagacactgtctgagcaggtgcaggaggagctgctcagctcccaggtcaccca

SEQ ID NO: 48211 - DNA, 201 bp, Homo sapiens
ccctctcagagcctcagtttccccagatgtcaatgagagaatcagcatcagccacatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcct

SEQ ID NO: 48212 - DNA, 201 bp, Homo sapiens
gttgctggtcacattcctggcaggtatgggggcggggcttgctcggttccccccgctcctccccctctcatcctcacctcaacctcctggccccattcagrcagaccctgggccccctcttctgaggcttctgtgctgcttcctggctctgaacagcgatttgacgctctctgggcctcggtttcccccatccttgagata

SEQ ID NO: 48213 - DNA, 201 bp, Homo sapiens
cattgttatgctattcttgtggggtctgggaagcagacatctgggtggatgtttggggggtgctgggcttagttggggaagtaggggggcccctggggctkacagggactggaagctctgagctggccagagggatgttgcaatcctgccagggtcttgtctatgctgtccttttcacaaccatccccctactgccaggct

SEQ ID NO: 48214 - DNA, 201 bp, Homo sapiens; identical to SEQ ID NO: 8958

SEQ ID NO: 48215 - DNA, 201 bp, Homo sapiens; identical to SEQ ID NO: 8959

SEQ ID NO: 48216 - DNA, 201 bp, Homo sapiens; identical to SEQ ID NO: 8963

SEQ ID NO: 48217 - DNA, 201 bp, Homo sapiens
ttcagagggcaggggtcactgagcggagagcagaggaggagtgagccatttgctccagcgtgaagttgttggtgtgatggggtttcagggtggcaggagcwgtgtggttaaaggtctggaagctgtcggcatgtggctggtatccaaggtggccaggaactctgcatggatatggtgggaagctggcacgcctctcacctc

SEQ ID NO: 48218 - DNA, 201 bp, Homo sapiens
gccggggtgagcctagagggcttcctggaggtggagtctagcctggcactcagggtgggtggaaactgatcgtcattttgcccacaggaatcctcgtagcycactacctccagagcatcacgccttgcctggccctgggtggagagctggtctaccaccggcggcctggagaggagggcactgtcatgtctctagctggga

SEQ ID NO: 48219 - DNA, 201 bp, Homo sapiens
ggggagccctataattggacaagtctgggatccttgagtcctactcagccccagcggaggtgaaggacgtccttccccaggagccggtgagaagcgcagtygggggcacggggatgagctcaggggcctctagaaagagctgggaccctgggaagccctggcctccaggtagtctcaggagagctactcggggtcgggctt

SEQ ID NO: 48220 - DNA, 201 bp, Homo sapiens
gagcaccaggggcagaggcggccagacaacctcagggaggagtgtcctggcgtccccatcctccaaagggcctgggcccgccccgagggggcagcgagagsagcttccccatccccggtcagtccaccctgccccgtccactttcccatctcctcggtataaatcatgtttataagttatggaagaaccgggacattttac

SEQ ID NO: 48221 - DNA, 201 bp, Homo sapiens
ccagcctgataaaggtcctgcgggcaggacaggacctcccaaccaagccctccagcaaggattcaggttggtgctgagtgcctgggagggacacccgcctmcactctgcaagaaactcaaaaagggagatgaggggatcgtgggagggaggtagggagggaggagggtgccactgatcccctgaacccctgcctctgcctc

SEQ ID NO: 48222 - DNA, 201 bp, Homo sapiens
tctgcaagaaactcaaaaagggagatgaggggatcgtgggagggaggtagggagggaggagggtgccactgatcccctgaacccctgcctctgcctccagrgtgcccctccggcctcgccatgaggctcttcctgtcgctcccggtcctggtggtggttctgtcgatcgtcttggaaggtaaaagtgggatgggagaattg

SEQ ID NO: 48223 - DNA, 201 bp, Homo sapiens
caggggcagaggcggccagacaacctcagggaggagtgtcctggcgtccccatcctccaaagggcctgggcccgccccgagggggcagcgagaggagcttmcccatccccggtcagtccaccctgccccgtccactttcccatctcctcggtataaatcatgtttataagttatggaagaaccgggacattttacagaaaa

SEQ ID NO: 48224 - DNA, 201 bp, Homo sapiens
gggagggaggtagggagggaggagggtgccactgatcccctgaacccctgcctctgcctccagagtgcccctccggcctcgccatgaggctcttcctgtcrctcccggtcctggtggtggttctgtcgatcgtcttggaaggtaaaagtgggatgggagaattgcggagttggagatttggaagagtgaaggtggctacag

SEQ ID NO: 48225 - DNA, 201 bp, Homo sapiens
ccttcccccagccgcctgcagggggcgccagagggccggagcacggaaagcagcggatccttgatgctgccttaagtccggctcagaggggcgcagcgtgrcctggggtcgctatcttcccatccggaacatctgccctgctgggggacactacgggccttcccttgcctgagggtagggtctcaaggtcacttgccccca

SEQ ID NO: 48226 - DNA, 201 bp, Homo sapiens
ggtctccaggttctcccaggctcagtcccgcaggcgccaaatctgcgcaggagagcactagcaaccgatgacgtattgaggcccacacctctgggattggytgtcctgcttcgacagccttgaaagtgggtaagctgggtggggggctctgggagaggtcagtgctgagtaaggcaattcccagcagcttgagccccacca

SEQ ID NO: 48227 - DNA, 201 bp, Homo sapiens; identical to SEQ ID NO: 8953

SEQ ID NO: 48228 - DNA, 201 bp, Homo sapiens
tggccaggctggtctggaactcctgacctcaggtgatctgcccgtttcgatctcccaaagtgctgggattacaggcgtgagccaccgcacctggctgggarttagaggtttctaatgcattgcaggcagatagtgaataccagacacggggcagctgtgatctttattctccatcacccccacacagccctgcctggggca

SEQ ID NO: 48229 - DNA, 201 bp, Homo sapiens
cagcctcccctgacccgcagaatcttctgatcccacccgctccaggagccaggaatgagtcccagtctctcccagttctcactgtgtggttttgccattcrtcttgctgctgaaccacgggtttctcctctgaaacatctgggatttataacagggcttaggaaagtgacagcgtctgagcgttcactgtggcctgtccat

SEQ ID NO: 48230 - DNA, 201 bp, Homo sapiens; identical to SEQ ID NO: 8957

SEQ ID NO: 48231 - DNA, 201 bp, Homo sapiens; identical to SEQ ID NO: 8956

SEQ ID NO: 48232 - DNA, 201 bp, Homo sapiens
gccgctgcactccagcctgggtgacagagcaagaccctgtttataaatacataatgctttccaagtgattaaaccgactcccccctcaccctgcccaccakggctccaaagaagcatttgtggagcaccttctgtgtgcccctaggtactagatgcctggacggggtcagaaggaccctgacccaccttgaacttgttcca

SEQ ID NO: 48233 - DNA, 201 bp, Homo sapiens
aagctggagctttgtccatcccctcttatttttctgcacttgactctcttatttttctgagactggtctccctctgtcgcccaggctagagtgcagcagtscaactgcggctcactgcagcctccacctcccgggctcaagcagccttcccacctcagcctcctgagtagctaggaccacaggtgtatgccaccaggccca

SEQ ID NO: 48234 - DNA, 201 bp, Homo sapiens
ccagcctgggtgacagagcaagactccatctcaaaaaaaaaaaagtaggtggacaaccctctactatgttttatgcttggaaaaaaaaagtaggtagagcrgccaggcgtggtgactcacgcctgtaatcccagcattttgggaggccaagccaggtagaatacttgaggccaggagttggagaccagcctggccaacgtg

SEQ ID NO: 48235 - DNA, 201 bp, Homo sapiens
ctatagtcccaactactgaggctgaggcgggaaaatggtatgaacccaggaggcggagcttgcggtgagccgagatcgtgccaccgcactccagcctgggygacagagcaagactccatctcaaaaaaaaaaaagtaggtggacaaccctctactatgttttatgcttggaaaaaaaaagtaggtagagcagccaggcgtg

SEQ ID NO: 48236 - DNA, 201 bp, Homo sapiens
  misc_feature (1)...(201): n = A,T,C or G, or insertion/deletion polymorphism (see Tables 1-2)
cgcaacatactaccacaaagccagtgaccaggtgagtgggtgcagggactagctggtgctgccaggggctgctgggcctggaagtccaggtggggccactngctaattctcatgtgttgctccggcccctccagctgcaggtgggtgtggagtttgaggccagcacaaggatgcaggacaccagcgtctccttcgggtacc

SEQ ID NO: 48237 - DNA, 201 bp, Homo sapiens; identical to SEQ ID NO: 8964

SEQ ID NO: 48238 - DNA, 201 bp, Homo sapiens
cggtagggaacccctgggcgatgggttaggagaagggagcccttgagggaggcctgagagcaagcccaagcctccagccggggtgagcctagagggcttcytggaggtggagtctagcctggcactcagggtgggtggaaactgatcgtcattttgcccacaggaatcctcgtagcccactacctccagagcatcacgcct

SEQ ID NO: 48239 - DNA, 201 bp, Homo sapiens
ttgtgtcgaccagatgaggtccttcaggtaatgcagtcatagcagggcctgggacgctgacctcagcggtagggaacccctgggcgatgggttaggagaarggagcccttgagggaggcctgagagcaagcccaagcctccagccggggtgagcctagagggcttcctggaggtggagtctagcctggcactcagggtggg

SEQ ID NO: 48240 - DNA, 201 bp, Homo sapiens
ggcggccagacaacctcagggaggagtgtcctggcgtccccatcctccaaagggcctgggcccgccccgagggggcagcgagaggagcttccccatccccrgtcagtccaccctgccccgtccactttcccatctcctcggtataaatcatgtttataagttatggaagaaccgggacattttacagaaaaaaaacaaaaa

SEQ ID NO: 48241 - DNA, 201 bp, Homo sapiens
cggaggtgaaggacgtccttccccaggagccggtgagaagcgcagtcgggggcacggggatgagctcaggggcctctagaaagagctgggaccctgggaasccctggcctccaggtagtctcaggagagctactcggggtcgggcttggggagaggaggagcgggggtgaggcaagcagcaggggactggacctgggaagg

SEQ ID NO: 48242 - DNA, 201 bp, Homo sapiens
ccaggcacaggaaaggacagggtcaggaaaggaggactctgggcggcagcctccacattccccttccacgcttggcccccagaatggaggagggtgtctgkattactgggcgaggtgtcctcccttcctggggactgtggggggtggtcaaaagacctctatgccccacctccttcctccctctgccctgctgtgcctggg

SEQ ID NO: 48243 - DNA, 201 bp, Homo sapiens
ccaccccttgccagccaaagcaaacaggcccggcccggcactgggggttccttctcgaaccaggagttcagcctcccctgacccgcagaatcttctgatcscacccgctccaggagccaggaatgagtcccagtctctcccagttctcactgtgtggttttgccattcgtcttgctgctgaaccacgggtttctcctctga

SEQ ID NO: 48244 - DNA, 201 bp, Homo sapiens
tggaacagcttcagaacaactagggtactaggaactgctgtgtcagggagaaggggctcaaggactcgcaggcctgggaggaggggcctaggccagccatkggagttgggtcacctgtgtctgaggacttggtgctgtctggattttgccaacctagggctggggtcagctgatgcccaccacgactcccgagcctccagg

SEQ ID NO: 48245 - DNA, 201 bp, Homo sapiens
cgggaaacaggcaggaggtgactcaactctgagtggatgtgtgggccaccacaggtgctggaggacagtgtgctgccaccctgtgggcctccacattaccrgggaacacttgttaaaaggtaggtggggccgggtgcggtggctcacgcctgtaatcccagcactttgggaggccaaggcgggccgaggtaaggagattga

SEQ ID NO: 48246 - DNA, 201 bp, Homo sapiens; identical to SEQ ID NO: 8952

SEQ ID NO: 48247 - DNA, 201 bp, Homo sapiens
ggagtttgaggccagcacaaggatgcaggacaccagcgtctccttcgggtaccagctggacctgcccaaggccaacctcctcttcaaaggtaaaggtctckgttcccctacgcgggaaacaggcaggaggtgactcaactctgagtggatgtgtgggccaccacaggtgctggaggacagtgtgctgccaccctgtgggcc

SEQ ID NO: 48248 - DNA, 201 bp, Homo sapiens
tcttctgtcggagtctgcaccaggcccatgctgagacgagagctggcgctcagagaggggaagcttggatggaagcccaggagccgccggcactctcttcycctcccaccccctcagttctcagagacggggaggagggttcccaccaacgggggacaggctgagacttgagcttgtatctcctgggccagctgcaacatc

SEQ ID NO: 48249 - DNA, 201 bp, Homo sapiens
cccagccctccaaagcattgggattactggcatgagccattgcatctggctttttttttttttttgagatggggtctcaccatgttgcccgggctggcttygaatgcctaggctcaagcaatcctcccttctcagcctcccaaatagctgggattacaggcacgtgccaccacgccaggcttgttttctttccctgtccct

SEQ ID NO: 48250 - DNA, 201 bp, Homo sapiens
aggttccagaacaaaggctggcagggagtcgtatgggacaggagctgacccagcaaccatccacagagacatcctggagcctgggaaggagaaggacaaaragcccccttttttaaattttttttatgtttttgagacggagtctcactctgtcacccaagctggagtgcagtggcacaatcttggctcactgcaacctcc

SEQ ID NO: 48251 - DNA, 201 bp, Homo sapiens
caaggtcacaactaaatccagaacctcatctcaggcacactggtcgtagtcccaatgtccagtcttaagtcttcttggatatctgtggctcacagattttrggtgtttgagcctcctgctgagcactgctggggccacagcggtgaccagccctgtcttcacgggactcagtgagaggaacagattcatccgcagagtggg

SEQ ID NO: 48252 - DNA, 201 bp, Homo sapiens
gctcaaggtcacaaccaaagaggaagctgtgattaaaacccaggtcccatttgcaaagcctcgacttttagcaggtgcatcatactgttcccacccctccyatcccacttctgtccagccgcctagccccactttcttttttttctttttttgagacagtctccctcttgctgaggctggagtgcagtggcgagatctcgg

SEQ ID NO: 48253 - DNA, 201 bp, Homo sapiens
gcagctggtggggaaggcattggactccagccttgggggacggatgtagtgatggtgggaagcaggcttggtgccaggaggggcgtcagagggtgaataaragcagatagagtgtttgggggaggtagccagccaaagggggtgaggcccggtggaagggaagaagggacatacacgcagagctttgcagctgagggtttt

SEQ ID NO: 48254 - DNA, 201 bp, Homo sapiens
ctgcagcctcgaactcctgggctcaagcaatcttcctacctcagcctcttgagtagctgggactacaggcatgcgccaccacgctcggctaatttttgaayttttttgtagagatgaggtctccctatattgcccaggctggtctcgaactcccaggctcaagtgatcctccctcttcagcttcccaaagtgctgggatta

SEQ ID NO: 48255 - DNA, 201 bp, Homo sapiens; identical to SEQ ID NO: 8962

SEQ ID NO: 48256 - DNA, 201 bp, Homo sapiens
aaagtgaatccatctccatcctgaggcttgaaaaggcagcccaaaggtggcagttctcttgttcagcaagcactccctacggtggagggacacaggaacgyagacttggacctcagtgcagcaagtcccagccacagctgagcactcgattcctcacaaccccaagaggcagttaggttcacagagagatgatgccagcgt

SEQ ID NO: 48257 - DNA, 201 bp, Homo sapiens
gccttgcctggccctgggtggagagctggtctaccaccggcggcctggagaggagggcactgtcatgtctctagctgggaaatacacatgtgagcctggcrcctgggtccgagggtggaggggctgggcccctggactcctcctgggtctgagggaggacgggctagggccctggacactcaggtctgagggaggaggcct

SEQ ID NO: 48258 - DNA, 201 bp, Homo sapiens
ttggccctatacttaggccctttttctctctagatgtaataatgaaacttcctggactattttggccaacaatgtctcaaacatcatcacggagatccacycccgagacaggagtaccgtggagggccgtgtgactttcgccaaagtggaggagaccatcgccgtgcgatgcctggctaagaatctccttggagctgagaa

SEQ ID NO: 48259 - DNA, 201 bp, Homo sapiens
ttttgctgtgaggctacaagaattgctggaagacaacatttttatttcgtggaaatttgtgttgtgtttctccttggttgttaatgctttgcatttacatrgtgaacatcttattatcagagctggcctgtgaggagggtagtgggggggcattgatgttcccgtttctgagtgaggagacctatgtcggggccttggtga

SEQ ID NO: 48260 - DNA, 201 bp, Homo sapiens
gaaagaagagtagagcctggctaatcaggagagagatgtgcagtgagttgcttggatccctaccttttaatcagaatggtagattgctctcatctcttaaytggtggtggagttttgaatgagtcacccctcagccacagtttcctcatctacaatgtaggataaacaataccttatgtccttcaaggcaaggaattggat

SEQ ID NO: 48261 - DNA, 201 bp, Homo sapiens
attgaaaagaataaaagctgacaatgtaacaaattttttaaactttaaatttaatagttttaaagaattttcttggtgtgttcctgcagtaaacattttawaaaaaaaataattatttattctgatataatgaacttccttttttattgctgtctttttcttttttaatgaaaatatggtgattgattttttttaatgccc

SEQ ID NO: 48262 - DNA, 201 bp, Homo sapiens
ctggctaatcaggagagagatgtgcagtgagttgcttggatccctaccttttaatcagaatggtagattgctctcatctcttaattggtggtggagttttkaatgagtcacccctcagccacagtttcctcatctacaatgtaggataaacaataccttatgtccttcaaggcaaggaattggatcagatgatatcatgag

SEQ ID NO: 48263 - DNA, 201 bp, Homo sapiens
tggacaaaatttggagcatatgtctttctttttacctgatttctccagaatttgaaaactatttgggagtattcttaactaatagcaatatagttatttgyctaagtgcagtaagaatcttttcttttgtaataggacacaattaaagaaactgcttattttatgaaggctttgactagaatggtgtgctttcagatacaa

SEQ ID NO: 48264 - DNA, 201 bp, Homo sapiens
ccattggatccagcaatcccattactgggtatataaccaaaggaatataaatcattctaccataaagacatgcatacgtatgttcactgcagcactattcaacgatagcaaagacatggaatcatcctaaatgcccattgacagtagactggataaagaacatctggcacatatacaccatggaatactatgtgttgataa

SEQ ID NO: 48265 - DNA, 201 bp, Homo sapiens
cataagattaaaactttatggcaaacaaatttgtcccactatgatttgtctttggtaaaaatggaagctagagagagaatttgtttcaaaaactatgatayaccagttattagattctagtctcgtctgttgtttttgagtttcttctgcaatttaggcagaccctgcttattcctgagaatcaaccagtgatctatggct

SEQ ID NO: 48266 - DNA, 201 bp, Homo sapiens
aataacatgagaaaggtgcccagaagttttctagggctacaacaggctgagctgcagaatttgacacgccaggaattgaactttctcagttgaagttcacrttcaagttaagtaacttgtgtggcatcacacagctagtaagtggggggaccattccagacctaaggctttctgactccagaactcccctttcagccactt

SEQ ID NO: 48267 - DNA, 201 bp, Homo sapiens
gaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatt

SEQ ID NO: 48268 - DNA, 201 bp, Homo sapiens
cctcctgatggcttgctcagagagcctgttttcattgcccactttatatgtcagtaaataatcttccctggcagtgggtccaccatgtctggatgcacacrgggaaatctggtggggtctggccagtgaaaaacactcctcaggttttgcaggaaaagcagtgaacccttcttttaagctcgagaatgctttaaagatgca

SEQ ID NO: 48269 - DNA, 201 bp, Homo sapiens
aggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaattt

SEQ ID NO: 48270 - DNA, 201 bp, Homo sapiens
tgttttcattgcccactttatatgtcagtaaataatcttccctggcagtgggtccaccatgtctggatgcacacagggaaatctggtggggtctggccagkgaaaaacactcctcaggttttgcaggaaaagcagtgaacccttcttttaagctcgagaatgctttaaagatgcatcattggcaagccttgccaaagaaat

SEQ ID NO: 48271 - DNA, 201 bp, Homo sapiens
ggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaattta

SEQ ID NO: 48272 - DNA, 201 bp, Homo sapiens
gagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatttag

SEQ ID NO: 48273 - DNA, 201 bp, Homo sapiens
tgatttcatgaacatttttgcaacatacatatttgcatacaaaaatgtgttttgtagaatggatttctacaaatgaaattgctaggccaaagggtgtgcaraaataaattgatgttgagctgaagtcttcagataggattgatacataagttcttgagcatctgcacgtgaatcactggctttgcacattacatgcagttt

SEQ ID NO: 48274 - DNA, 201 bp, Homo sapiens
tggtgcactgggactttggtaattcaccagttacctgtcctggtcatttatagaaaccgaggtatgaaattcgctggagggtcattgaatcaatcagcccrgatggacatgaatatatttatgtggacccgatgcagctgccttatgactcaagatgggagtttccaagagatggactagtgcttggtaagttccatgggg

SEQ ID NO: 48275 - DNA, 201 bp, Homo sapiens
cctgggcataggccgaactaactttgagaggaacttagtttatagtttgactttgaaaaaaagacaataatagccctttgccaaaacaaaccctctttttscctgggaactagactgcctttgcgggactaacgaattagctacaagattagaaagtatggtttaggggtcactgttgtaaaacctgaggtcagtgcttga

SEQ ID NO: 48276 - DNA, 201 bp, Homo sapiens
ttccctgtgggctcaattccttttttgacacgatgacttggaggagtcattatgattactccaaacaggaaagacactcgcccagctgtccgcccgcagaragctggctacggtgcagaaagctgaggaggcgtctggagtttttgggtgttaatgattctgcctgcccacaggtcgggtcttggggtctggagcgtttgg

SEQ ID NO: 48277 - DNA, 201 bp, Homo sapiens
ctcctttctcccgtctgtgttttctttcccttgcaagtgttattcgacaaaagcaattatgctaatttccttccctgtgggctcaattccttttttgacasgatgacttggaggagtcattatgattactccaaacaggaaagacactcgcccagctgtccgcccgcagagagctggctacggtgcagaaagctgaggagg

SEQ ID NO: 48278 - DNA, 201 bp, Homo sapiens
aacaagtagaagaaagaactttagagctcaaagacaaggtcctcagattaacccaatccaacaaagacaaagaaagaagaataagatgcagccataaaaarggatgagttcatgtcctttgcagagacatggatgaagctggaaaccatcattctaagcaaactattacaaggacagaaaaccaaacaccacatgttctca

SEQ ID NO: 48279 - DNA, 201 bp, Homo sapiens
agcaaaatctgttgccagtccagtcatagccattcatggctctttattaaaaaaaaaaaaaaaaaaaaaaaaagcttttttggtatcttatttttttctgygccatatggtctgcaggacaattcatggcttttctgttcttcattttcatacccatctcctaacggcttttgtccccataggccccatttacatcatcac

SEQ ID NO: 48280 - DNA, 201 bp, Homo sapiens
tgtggcaataatcagtagcttaccaaccaaaaagagtccaggaccagatggattcacagccgaattctaccagaggtacaaggaggaactggtaccattcyttctgaaactattccaatcaatagaaaaagagggaatcctccctaactcattttatgagggcagcatcatcctgataccaaagccaggcagagacacaac

SEQ ID NO: 48281 - DNA, 201 bp, Homo sapiens
caccaagactaaggaccctcatggagtccattgcactgtccaccacctccaccagaacaagcactggtatacatggctgagagacccatagatggttcacrtcacaggactctgtgcagacaacccccagtaccagcccagagctgggtagactaattgggtggctagacccagaagagagaaaacaaccactgcagttta

SEQ ID NO: 48282 - DNA, 201 bp, Homo sapiens
acttttctccccggtcatggaagaaaagcagcacttaggggagaagcagtgtctgcatatgtcacatatcgggaatacctctgctggactcatgaattcargtatttctgggaggttctgggttactctagagtaggcgaggaatccctaggctccaccagctagctttatttttgtagagatggagtcttgccatgttgc

SEQ ID NO: 48283 - DNA, 201 bp, Homo sapiens
atgacacaaattgaaaatgaatttctgtgactaaaaatgagcagatgagaaatgaatgaggacaaccacaaaatgtattttgattcagtacattctgaagwtgcattagatactcctttttacatatttggaatatggaatataaaaatataggtacattttgaggcaaaatatgtaaaaataagcaagccaacttatcac

SEQ ID NO: 48284 - DNA, 201 bp, Homo sapiens
tttagtttaatcataagaattaaagcaatcctgttctatttactttcttagcaacatttgtaggactctatattaggccttttttttttttttcctgagayggagttttgctcttgtcatccaggctggagtgcagtggcgtgatctcagttcactgcaacttctgcctcccgagttcaagcaattctcctgcctcagcct

SEQ ID NO: 48285 - DNA, 201 bp, Homo sapiens
ggctgttctgaaacaccactggaaggaaaatgtgttctttcaagccccaggatgtagacagtgttaagataacctggtgtgaggccagtatgctgcagccrcctcaaaccacatgttgtgccttattgtgtctgagataggcccatgcaggtggagatgggggtttttgttgggggttgcgtctcactcctggcctctgcc

SEQ ID NO: 48286 - DNA, 201 bp, Homo sapiens
ccagtatgctgcagccgcctcaaaccacatgttgtgccttattgtgtctgagataggcccatgcaggtggagatgggggtttttgttgggggttgcgtctyactcctggcctctgcccctcctctcctttgggctatgccagagtgacttcctcccactggaagtggtcccaatgacattcgcatcccagctgctttttca

SEQ ID NO: 48287 - DNA, 201 bp, Homo sapiens; identical to SEQ ID NO: 8976

SEQ ID NO: 48288 - DNA, 201 bp, Homo sapiens
ggtagaaggaattgtatgcccaagccacatgaccacacggctcaagttccaaccaaggcttgtgagttgaaaaactgagaaagaataatgacagacttaaygtagtgaattcttcaaactttaagtgtaatggacttacaggtccatgggagcacagccccactgtcttagatgtggctcttcaggatgtgcgggctcctg

SEQ ID NO: 48289 - DNA, 201 bp, Homo sapiens
tatagttcttatgttacattattgtgtgctacagagttaaccaaatttctttgtcaattgcatctttaatcagctgtcctaagacttttgtcacccacagrcaattgtcttgttttaatccttttcaaaaggtggtttataatcagctataggactctgatgggtactctaaaatgcaagcctctgataactttgaaaatt

SEQ ID NO: 48290 - DNA, 201 bp, Homo sapiens; identical to SEQ ID NO: 8977

SEQ ID NO: 48291 - DNA, 201 bp, Homo sapiens
aaggagatgatgacactgaattttcttgaaaaaaccagtgcttcaaggctataggatctgaaaggttttctaacagtgttctatcatgccaagtgtttcarcaatgcactgagcgtttgttagtcctggtgttttattgtttggcttttaggtggcaccccttaccccggcatgatggtggattctactttctacaataag

SEQ ID NO: 48292 - DNA, 201 bp, Homo sapiens
tatactcactctgggtgttgggactttccagtggtttaatatgatacttaaagtatttagagggaagtgtatagggatggtaagtgaacctggcagcccaygtggtctctaaatgcaggtctgcacaaccagttctgtgacatgtttccaggtttgtggcctgtaaattgaaaagaataaaagctgacaatgtaacaaatt

SEQ ID NO: 48293 - DNA, 201 bp, Homo sapiens
ctctttaccattggtggccccttcttcatgttctatgtctctggggatagttgacatgactctccttcaactaagtcccacatcttccaggtagtttggaratatgtacagttaaataatggtaagttctgagtgtctctattcatttttgaggtttggttgttaacacttgattaaatatgttcaatgaatgtttataga

SEQ ID NO: 48294 - DNA, 201 bp, Homo sapiens
tttaaatggtaatttattacattctttatccttcagcagtatagcacaaacaccttatatgtgtcattaactgtccttttaaaaaatgggctgggtgtggwggctcatgcctgtaatcccagtactttgggaggctgaggcaggagagtcacttgaggccaggagtttgagatcagcctgggcaatgtatcaagactccgt

SEQ ID NO: 48295 - DNA, 201 bp, Homo sapiens
atatgcctaattgttgtacaccatctcacaatcaagccttgtgagattttccaaattttatcttgatcaaactggtttgcaaattatttttcagggttttyttaaaaaaaaaaaaaaaaacccaaactttataagatcctggctatcctgtggatttttaggcccttgtatttgttcttttttatagcaacatcagagctg

SEQ ID NO: 48296 - DNA, 201 bp, Homo sapiens
tatgattgaagaaaagatttgggtgaaatctagtgttcttccctgcaaagggggttgttctcacggattcttatggtgccatgtttctcagaatttgtagyttcagttacttatatttgcacacctgactttagatgagctccagaatagcagttactaattaaggatgagcatttagagtagataaaagtggcaggaaca

SEQ ID NO: 48297 - DNA, 201 bp, Homo sapiens
gtatttctgggaggttctgggttactctagagtaggcgaggaatccctaggctccaccagctagctttatttttgtagagatggagtcttgccatgttgcycaggctggtctcctgggttcaagctatcttcccaccttggcctctcaaagtactgggattacaggtgtgagccactgcacctggcctccaccagcttact

SEQ ID NO: 48298 - DNA, 201 bp, Homo sapiens
gctcaggctggtctcctgggttcaagctatcttcccaccttggcctctcaaagtactgggattacaggtgtgagccactgcacctggcctccaccagcttrcttagcacctgcttctcaatctgagaagagagaagcagatgaccttagattgttctggagagttttgctacaagttttccttatagacattgtacagtgg

SEQ ID NO: 48299 - DNA, 201 bp, Homo sapiens
agagaaacaagaacaaacaaaacctaaacccagtacaagaagaaaataaccaagagcagaactaaataaaattataaccaaaaaaaagataaatgaaacaraaagctgatcctttgagaacataaataaaatagaccattagcaagattaaccaagaaaagaagagagaaaatccaaataacctcactaaaaaacaaaaca

SEQ ID NO: 48300 - DNA, 201 bp, Homo sapiens
aaataaaattataaccaaaaaaaagataaatgaaacaaaaagctgatcctttgagaacataaataaaatagaccattagcaagattaaccaagaaaagaaragagaaaatccaaataacctcactaaaaaacaaaacaggagatattacaactgacaccactgaaatacaaaagatcatttaaggctactatgaacacctt

SEQ ID NO: 48301 - DNA, 201 bp, Homo sapiens
ttgggagggatggaacaccctgtggctttgcagggtttagcccctgcagctgctctcaggggctgttgtcgagtgcctgtggtttttcctggtgcagagtrcaggctgttggtggatatattattcatggaggatggtggccctcccctcgtagcttcacgaggcagtgccccagtggagactctgtgtggggacttcaac

SEQ ID NO: 48302 - DNA, 201 bp, Homo sapiens
tatagacatgagcctctgcgccccagcctcatctcattttaactaaaggaaacctttgcagtgattgtgaaccataaagaacccatatgtgcttgagcccrtgccatcttgggatattttatggttacacataagagtctgaaatatggaattggaatcagacatcctctgtctatttgagtgtttggaggggtgaatcta

SEQ ID NO: 48303 - DNA, 201 bp, Homo sapiens
tttacagtaaaaataaaacttaaattgaagagtacaattgtttaaacaattggaacttacttagctactgcttgttgaaacaaaatcctttttttaaaagstatcgaagcaaattaaagctgatccgtgctaaggaagaagacagtggccattatactattgtagctcaaaatgaagatgctgtgaagagctatacttttg

SEQ ID NO: 48304 - DNA, 201 bp, Homo sapiens
accccacatttcccctctgcagtgccctagtagaggttctctgtgagggctccaatcctgcagcatgcttctgtctggacaccctggttttttaatatatmctccgaaatctaggcagaggctcccaagcctcaactcttaacactctgtacacccacaggctaacaccacatggaagcggccaaggtttatggctgtcac

SEQ ID NO: 48305 - DNA, 201 bp, Homo sapiens
ttttgcaaggatagcaccaaggggatggtgctaaaccatttgtgagaaattcacccccatgatccagtcacctcccaccaggccccacctccaatactggrgattacacttcaacatgagatttgggtggggacacatatccaaactatatcattgcgtgtgtgtgtgtgtgtgtataatttttaaaccagatatatgttt

SEQ ID NO: 48306 - DNA, 201 bp, Homo sapiens
agcttaaaattactaaaggccaaagcttgattacccatgcaagatttcatgtttcatcagttgacttcaaaatactgtaaggaattcttttcttacataarcctcttactttcattcacattcctgactatggcggccctaaaaacaaacatacacccagggggttagatgcctagattaattttagtaacttaagaaaag

SEQ ID NO: 48307 - DNA, 201 bp, Homo sapiens
tccaatcctgcagcatgcttctgtctggacaccctggttttttaatatatactccgaaatctaggcagaggctcccaagcctcaactcttaacactctgtrcacccacaggctaacaccacatggaagcggccaaggtttatggctgtcacaagctgaagcagcagcccaagctgcacctgaactcctttgagccacggct

SEQ ID NO: 48308 - DNA, 201 bp, Homo sapiens
atgatccagtcacctcccaccaggccccacctccaatactggggattacacttcaacatgagatttgggtggggacacatatccaaactatatcattgcgygtgtgtgtgtgtgtgtataatttttaaaccagatatatgtttctgcatatctctttcctttctttcattctttctttctttttttttttttttttttttg

SEQ ID NO: 48309 - DNA, 201 bp, Homo sapiens
cagaaagtacaatgaattcacttcataataaattacttggtggacaccaaatgggtgctaaattgattgggtagaaggaattgtatgcccaagccacatgrccacacggctcaagttccaaccaaggcttgtgagttgaaaaactgagaaagaataatgacagacttaatgtagtgaattcttcaaactttaagtgtaatg

SEQ ID NO: 48310 - DNA, 201 bp, Homo sapiens
acatatccaaactatatcattgcgtgtgtgtgtgtgtgtgtataatttttaaaccagatatatgtttctgcatatctctttcctttctttcattctttctwtctttttttttttttttttttttgagacagagtctcactctgtcacccaggctgcagtgcagtggtgtgatctcggctcactgcaactcattgcaacctc

SEQ ID NO: 48311 - DNA, 201 bp, Homo sapiens
atccagtcctggagcacacccagtatggtccagcctgctgtcttcgtaggtctgagtgccccagtatttgcaaagtgttttggagcctatgaaatgctttsacacatacaatctcctttaattaactctcacaatgactctgtgctatgtgtacaattatcacgttttacacacaaggaaactgaggcatggagcattgta

SEQ ID NO: 48312 - DNA, 201 bp, Homo sapiens
ccagtggctgggcttcatggcggtgctccacgagaccctagtagcaatgatgaatgaaaaccctccccttcccgtggggctttcctttcatcttatatgtrcagtacctgtaagcactattctccagatgtttgagtatcagaagttagtgtgcagttagaagactcagggcatccatggccattacatcactaatttgag

SEQ ID NO: 48313 - DNA, 201 bp, Homo sapiens
atgactctgtgctatgtgtacaattatcacgttttacacacaaggaaactgaggcatggagcattgtaataatacccgagatcttctcactccatgaccartgcttttcttctccattccagttgctttttcaactgtgatgatttataaaggacaatcaaatgggcacatactatatttatgcacatacatacacacaca

SEQ ID NO: 48314 - DNA, 201 bp, Homo sapiens
tttgagtgcacttaaatccatgcgaaattggcttttaccagcggactggaaggaacaacctcagctgttatctgtggcaccagctggttttttgtggaatrggaagcattgttcaaaggaacaaatgtaatttcttggaaccaggcaggatatgtaaatgaatgaaacaactttctgctgaggtgttgagaggaaaactca

SEQ ID NO: 48315 - DNA, 201 bp, Homo sapiens
ttaaccctcagttggtcaaagatgctctgactggtggaaatgtgttggtgggaagagattgaagttattgttgaaaatagggtcttttcacatccaatgtkagacctctccaatgtttaaggatcatgaaggctttgggtattatccacccaatagaaggcctcactgcctctctatgggacccatccaagccctggaaag

SEQ ID NO: 48316 - DNA, 201 bp, Homo sapiens
tacacacacacacacacacacacacacacacaaccagatgtcatttataatccatgtaaaatatttttggggaagtttctctttaataaagtttgaagagrcatatattttttttttttgaagaggcatattttttctaacttttttttttttttttgagatggagtcttgctctgtcacccaggctggagtgcagcggta

SEQ ID NO: 48317 - DNA, 201 bp, Homo sapiens
tggtacattccgctttctaaaatgtcagttgtccatgctgctcgggatccatatgtggtaatcattatttaatggaaactcttccctgtacagagaaaggkttcattgaaatcaaacccaccttcagccagttggaagctgtcaacctgcatgaagtcaaacattttgttgtagaggtgcgggcctacccacctcccagga

SEQ ID NO: 48318 - DNA, 201 bp, Homo sapiens
aatagggtcttttcacatccaatgttagacctctccaatgtttaaggatcatgaaggctttgggtattatccacccaatagaaggcctcactgcctctctrtgggacccatccaagccctggaaaggcaacgtgatggggaccagaaggattctcagttgtagctactgacttggagaaggggctactggtatcttagcac

SEQ ID NO: 48319 - DNA, 201 bp, Homo sapiens
cttgaattgatggaagctcattggtttttgagcaaaatctgttgccagtccagtcatagccattcatggctctttattaaaaaaaaaaaaaaaaaaaaaamaagcttttttggtatcttatttttttctgcgccatatggtctgcaggacaattcatggcttttctgttcttcattttcatacccatctcctaacggcttt

SEQ ID NO: 48320 - DNA, 201 bp, Homo sapiens
atttctgtccatggtacattccgctttctaaaatgtcagttgtccatgctgctcgggatccatatgtggtaatcattatttaatggaaactcttccctgtrcagagaaaggtttcattgaaatcaaacccaccttcagccagttggaagctgtcaacctgcatgaagtcaaacattttgttgtagaggtgcgggcctaccc

SEQ ID NO: 48321 - DNA, 201 bp, Homo sapiens
ggagaaatcggccaaaagaaaggggctacaagccccacagaagttcagaacccagcagggctgaaaactccaaataaactccattgactccatatcccatrtccagagcacactgatgcaaggggtggagctcttgggagggatggaacaccctgtggctttgcagggtttagcccctgcagctgctctcaggggctgttg

SEQ ID NO: 48322 - DNA, 201 bp, Homo sapiens; identical to SEQ ID NO: 8966

SEQ ID NO: 48323 - DNA, 201 bp, Homo sapiens
cctggcctcaagtgatctacctgcctcagcctcccaaagtgctgggatgacaggtgtgagccactgcatctggcaagtgttagctattaatatgtcaattrcgtgtatgcatggacaagcatgcattcccaaggatggtgtctttatattttaagcttttatcagattttcaaaagccatctgtgacccctaaaatagatt

SEQ ID NO: 48324 - DNA, 201 bp, Homo sapiens; identical to SEQ ID NO: 8967

SEQ ID NO: 48325 - DNA, 201 bp, Homo sapiens
cgtcttactgtttgaaccttgaattttaacctgggacatgtttgactaaaatgatgctgttaatattttctgttgtgcaaaacacaaagagaactaggctycagggttgtttctatttgctaatgctgtttctgttgacttttgacttttctagtttcccagagctatggggacttcccatccggcgttcctggtcttagg

SEQ ID NO: 48326 - DNA, 201 bp, Homo sapiens
atgacaggtgtgagccactgcatctggcaagtgttagctattaatatgtcaattgcgtgtatgcatggacaagcatgcattcccaaggatggtgtctttayattttaagcttttatcagattttcaaaagccatctgtgacccctaaaatagattggaaccatttgggtttatgtatcttggaggcacagtttccttaaag

SEQ ID NO: 48327 - DNA, 201 bp, Homo sapiens
taaagtcaggtgttgcttctagagattcggtgcctgttttttaaaacatcaatagatttcaaggggtcagtacactgccttggcagcagattgcccaggtktgagtgccagctccaccacttacttaatttggatttggggctagatacttgactgttctgcccctctgtctccctgattgtagtgggaggtgataatagt

SEQ ID NO: 48328 - DNA, 201 bp, Homo sapiens
agctgctttttcattttgggctttgggtcacatgggttcacccatggagagtgggccctccctcacctggtggcgattgatgctcaggtgaaaaggggtaygtggcgggaagggcagggctctcattcctggttgtcattggccagtcttgacaacccaggtgctgaacaacccaggtgccctgggctatccggtgaggtc

SEQ ID NO: 48329 - DNA, 201 bp, Homo sapiens
atgagctccagaatagcagttactaattaaggatgagcatttagagtagataaaagtggcaggaacagcaagactcactcccagagagcctcactacaggwctaataggtgaggaaattccccatgtttcccatttttcttcattacctccctgtggggcaagcactgccattattcatgagtaaactgtctgagttatag

SEQ ID NO: 48330 - DNA, 201 bp, Homo sapiens; identical to SEQ ID NO: 8978

SEQ ID NO: 48331 - DNA, 201 bp, Homo sapiens
gcgatctctgtgaaaagtatacagaggtattagctccattggatcccattatgtaaatgtaccataatttatgcaatcatggtcttgtaaaatggatttayagtttccagttctttgctattaaaatgatttcatgaacatttttgcaacatacatatttgcatacaaaaatgtgttttgtagaatggatttctacaaatg

SEQ ID NO: 48332 - DNA, 201 bp, Homo sapiens
gctgaagctggtggctcccagtgagttcctcaacagtcaggacaactcatcagctgagccgcatctgccccaggcggaactttgaatcccagataggggtyatatagaaatgaaggtcccaaggcagaaattcagttacgaatgctcttaaaggcatgtgggactttgttttattttgttttgttttttgagacagagttt

SEQ ID NO: 48333 - DNA, 201 bp, Homo sapiens
aggacaactcatcagctgagccgcatctgccccaggcggaactttgaatcccagataggggtcatatagaaatgaaggtcccaaggcagaaattcagttaygaatgctcttaaaggcatgtgggactttgttttattttgttttgttttttgagacagagttttgctctgtggcccaggctggagtgcaatggcacaatat

SEQ ID NO: 48334 - DNA, 201 bp, Homo sapiens
ctgagccgcatctgccccaggcggaactttgaatcccagataggggtcatatagaaatgaaggtcccaaggcagaaattcagttacgaatgctcttaaagkcatgtgggactttgttttattttgttttgttttttgagacagagttttgctctgtggcccaggctggagtgcaatggcacaatattggctcactgcaacc

SEQ ID NO: 48335 - DNA, 201 bp, Homo sapiens
cccttcttcactttctctattgctcctcctttcatgcttgtacctgcttttccatgccctgtttagcctggcttgggatccagcaggttctccaagggttyctgcaagaaccccggctgggtgcccaggtctgagcctggtatgtgcctcagtatcacaaaggcctcctgtaaatgacacacattgttggaagtttcagaa

SEQ ID NO: 48336 - DNA, 201 bp, Homo sapiens
atggggaccagaaggattctcagttgtagctactgacttggagaaggggctactggtatcttagcacctaatggcagaagctctttaccattggtggcccyttcttcatgttctatgtctctggggatagttgacatgactctccttcaactaagtcccacatcttccaggtagtttggaaatatgtacagttaaataatg

SEQ ID NO: 48337 - DNA, 201 bp, Homo sapiens
cttcttcatgttctatgtctctggggatagttgacatgactctccttcaactaagtcccacatcttccaggtagtttggaaatatgtacagttaaataatrgtaagttctgagtgtctctattcatttttgaggtttggttgttaacacttgattaaatatgttcaatgaatgtttatagagttatgaaaaaattcacctg

SEQ ID NO: 48338 - DNA, 201 bp, Homo sapiens; identical to SEQ ID NO: 8973

SEQ ID NO: 48339 - DNA, 201 bp, Homo sapiens
ataagcctctcctgccattgtcttaaatagtcattgaactggggaaaaagtgaagagaggcgggactgggtcctttgacgctataccctacctgtgaattkgaatcacctgcagagatttaaaaactgctgatctacaagcctcacccaaaacaacaaattagaatccctgggggtggtggccaactgctccctggctgat

SEQ ID NO: 48340 - DNA, 201 bp, Homo sapiens
aaaatctcactgagatcaccactgatgtggaaaagattcaggaaataaggtaaagaaactctctgcccaagtatgcctttttttagtgtgcatcagaggcrgactgaggtttgtgtgtgtcttacaacccagacccaaagtcagtctagaaaatgtaacaatctgagttaagagatgcttgaaatcacatccctttaatga

SEQ ID NO: 48341 - DNA, 201 bp, Homo sapiens
agcaaaatcatggaatcaacctaaatgcccatcaatgatagactggataaagaaaatgtgatacatatacaccatggaatacgatgcagccgtaaaaaggwatgagatcatgtcctttgcagggacatggatggagctggaagccgttaccgtcagcaaactaacacaggaacagaaaaccaaacaccacatgttctcact

SEQ ID NO: 48342 - DNA, 201 bp, Homo sapiens
taaacaataccttatgtccttcaaggcaaggaattggatcagatgatatcatgaggcctcttaaggttttaagctgtgattagaacccaagagtcagaagrtacatctcacagcacccagctaaccagccctatacttttgtcagaaatcatctcagaaagacaaagtcagtcctgtatttcaagccttcaggaggaagaa

SEQ ID NO: 48343 - DNA, 201 bp, Homo sapiens
ttatctgtgatcaggatgtaatagtaaagtgtgtcttcctgccccgtctcctttttcatcctagttctccctccatggatgatcacaatggatcatccccsagtggcttaatggagtcctgtactcccttaaaagcagagaggccacaactttgatttttgctttagctatttgaacatacctggtgaaaaagactctctg

SEQ ID NO: 48344 - DNA, 201 bp, Homo sapiens
agcctcctgagtagctgggattacaggcatgtgccaccatgcctggctaatttttttttttttgtatttttagtagagatgggggtttcaccatgtttgtsaggctggtctcgaactcctgacctcaagtgattcacctaccttggcctcccaaagtgctgggattacaggtgtgagtcatcacacccagcctataacttt

SEQ ID NO: 48345 - DNA, 201 bp, Homo sapiens
agcaacgtggatggagccggaggtcactatccttagcaaactaatacgggaacagaagaccagataccgcatgttctcacttataagtgggagctaaaacwacgagaacacatggacacaaagaggggaacaacagacaccagggcatagttgagggtgcagggtgggagaaggaagaggatcagaaaaaatacctatcgg

SEQ ID NO: 48346 - DNA, 201 bp, Homo sapiens
agttaaaaaaaaattatcatacacttgttttgttctgtctgagatccagataagagtcacacattgcacttggttgctatgtctctgtaagttcactatgyctctattttttgccctcttacatattatttgtgaagaaaccatagtgtttgcctgtggagttcccacaatcggcattttgctgattacatccttgaagtg

SEQ ID NO: 48347 - DNA, 201 bp, Homo sapiens
gatcttggggccccattgattctttcatctttcaggcgtcttactgtttgaaccttgaattttaacctgggacatgtttgactaaaatgatgctgttaatrttttctgttgtgcaaaacacaaagagaactaggctccagggttgtttctatttgctaatgctgtttctgttgacttttgacttttctagtttcccagagc

SEQ ID NO: 48348 - DNA, 201 bp, Homo sapiens
ctaacacataaggacttacacagaattaaagtaaaagaatggaaaggggcattttgtgcaaatggacaccaaaatcgagcaggggtaactattcttatatyagaaaaaaacaaacaaacactttaaagcaacagcagttaaaagagacaaagagggacattatataatggtaaaaggccttgtccaacaggaaaatatcac

SEQ ID NO: 48349 - DNA, 201 bp, Homo sapiens
aatcccgtgcttgaaaaataatcaaacaaaaagagaatgcattgtaagaagcctcactgtactcctgtccccagctgcccagttctcccctcctccccacrgggaaacatcttcattagtttcattaggttcttatgaaaccttccagagtttctttaagcaaaatacaagcaagtaggactgtcatatcctgcagaccgc

SEQ ID NO: 48350 - DNA, 201 bp, Homo sapiens
ctaatttttgtatttttagtagaaatggggtttcagcatgttggccaggctggttttgaactcctgacctcaagtgatctgccggtctcggcctcccaagrtgctgggattataggcatgaaccacctcacctggcctagattctttaactcagcaccaaggtggagctaatgcccaggcaggactgagaatcactggttg

SEQ ID NO: 48351 - DNA, 201 bp, Homo sapiens
catgatcttggggccccattgattctttcatctttcaggcgtcttactgtttgaaccttgaattttaacctgggacatgtttgactaaaatgatgctgttmatattttctgttgtgcaaaacacaaagagaactaggctccagggttgtttctatttgctaatgctgtttctgttgacttttgacttttctagtttcccag

SEQ ID NO: 48352 - DNA, 201 bp, Homo sapiens
cccgcttttgccttttattccgcactctgatttttggggggatcgtttgttcccgctcattttctacaaacattacggtatcctgttagcattccgaacarggggctgttcatatatttgccttcaatgatttcctgaagggacatgtggaagtaatagcgagcggtgcagtcacccaagctgaagatgcacgagagcggg

SEQ ID NO: 48353 - DNA, 201 bp, Homo sapiens
tcagcatgttggccaggctggttttgaactcctgacctcaagtgatctgccggtctcggcctcccaaggtgctgggattataggcatgaaccacctcaccyggcctagattctttaactcagcaccaaggtggagctaatgcccaggcaggactgagaatcactggttgacgtggtcagatggaggagaccatgccccagt

SEQ ID NO: 48354 - DNA, 201 bp, Homo sapiens
ccgccatgatcttggggccccattgattctttcatctttcaggcgtcttactgtttgaaccttgaattttaacctgggacatgtttgactaaaatgatgckgttaatattttctgttgtgcaaaacacaaagagaactaggctccagggttgtttctatttgctaatgctgtttctgttgacttttgacttttctagtttc

SEQ ID NO: 48355 - DNA, 201 bp, Homo sapiens
aggtgctgggattataggcatgaaccacctcacctggcctagattctttaactcagcaccaaggtggagctaatgcccaggcaggactgagaatcactggytgacgtggtcagatggaggagaccatgccccagttctccgctgtctttgcatggcccttggacagaggtaggagaaggtgatgatagtggcccctagttc

SEQ ID NO: 48356 - DNA, 201 bp, Homo sapiens
ttgccttcaatgatttcctgaagggacatgtggaagtaatagcgagcggtgcagtcacccaagctgaagatgcacgagagcgggtcgcgtagaagaactgsggcaatgggacccccagcgcagccccaggcgccctgttttcgaggctgacatcccaagatcctgtcctggttaggcacagcaccgcgcccgttggagtac

SEQ ID NO: 48357 - DNA, 201 bp, Homo sapiens
accaacctggagtcctaattaaacttaaggtttgagctggtctctgaagtcaaggagatgatgacactgaattttcttgaaaaaaccagtgcttcaaggcyataggatctgaaaggttttctaacagtgttctatcatgccaagtgtttcagcaatgcactgagcgtttgttagtcctggtgttttattgtttggctttta

SEQ ID NO: 48358 - DNA, 201 bp, Homo sapiens
ttgaccaacctggagtcctaattaaacttaaggtttgagctggtctctgaagtcaaggagatgatgacactgaattttcttgaaaaaaccagtgcttcaasgctataggatctgaaaggttttctaacagtgttctatcatgccaagtgtttcagcaatgcactgagcgtttgttagtcctggtgttttattgtttggctt

SEQ ID NO: 48359 - DNA, 201 bp, Homo sapiens
cccactctgcccaggtctggttcctggagcatcagcgccccctttccctcgccggcaggatcgtttcctcccgacactggcctctcgccttgggcgcaggrtttggggctcagctgtcaattccaaggaattcgtagggttcgacccacgcggcgggagggaacggagggagaatcaaaaggcatcctcccccacgacgcg

SEQ ID NO: 48360 - DNA, 201 bp, Homo sapiens
aggcatatcacatggccagagcaggagcaagtgagagagagagagagagagagagagagagagagagaggtgccatacagttttaaacaggcagatcttgyaagaagtcactcacttttgcaaggatagcaccaaggggatggtgctaaaccatttgtgagaaattcacccccatgatccagtcacctcccaccaggcccc

SEQ ID NO: 48361 - DNA, 201 bp, Homo sapiens
tggtttccatttctgagttacttcacttagaataatagtctctaatcccatccaggttgctgcaaaagccattaattcattcctttttatagctgagttayatatatatatatatatatgcacacctacacatacatatgtatagatacactgcagtttctttatccactccttgattgatgggcatttggggttggttcc

SEQ ID NO: 48362 - DNA, 201 bp, Homo sapiens
aaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctt

SEQ ID NO: 48363 - DNA, 201 bp, Homo sapiens
attagccagtgagagttatcggaaccagtacttcctctcccctcccatattgttaaaaatagtttacattgcttcccaggctgggctggtggagttggcaygagatgtcagaggaacctgagtcatgctcaggcccaagccctgttggcaggcagaccactgctttctggccttccgtgactatctgaaaaaaatcgtgaa

SEQ ID NO: 48364 - DNA, 201 bp, Homo sapiens
ttgcaggggtgatgctatatcagctacagatggcttgatcctgagtcatttcttccttttccatgcagtgtgtccaccgtgatctggctgctcgcaacgtyctcctggcacaaggaaaaattgtgaagatctgtgactttggcctggccagagacatcatgcatgattcgaactatgtgtcgaaaggcagtgtacgtcctc

SEQ ID NO: 48365 - DNA, 201 bp, Homo sapiens
caaaccctctttttgcctgggaactagactgcctttgcgggactaacgaattagctacaagattagaaagtatggtttaggggtcactgttgtaaaacctraggtcagtgcttgagatattttggagaccctgtatttcgatgcaccagctgacaccacccaggtcaataaactggctcatctgatcttggggcccctacc

SEQ ID NO: 48366 - DNA, 201 bp, Homo sapiens
ctcggcctcccaaagtgctgggattacaggtgtgaaccaccacgcctggcctttattaggcttttgatgaaccaatagaatatctaaggtttaagacattmtatgagctagattgttccacgacacagtatttgacttaaagatgattggcacttggctcatctttggtctcatcatttttttgattgttcatctttatcc

SEQ ID NO: 48367 - DNA, 201 bp, Homo sapiens
tttcttcccctgcataaggaatacaggactgcagtaactctgtacaacattcaactgtcgtaaaagtgtaggaagtaaaatgttaaattatttttttcacygtgtcttcttccctgtccctgtcctgtttccaagaggcagagctgcaccacttggtgtgtcttttaaacttccagttccctttgtatgcatctgtgtata

SEQ ID NO: 48368 - DNA, 201 bp, Homo sapiens
taacacataaggacttacacagaattaaagtaaaagaatggaaaggggcattttgtgcaaatggacaccaaaatcgagcaggggtaactattcttatatcrgaaaaaaacaaacaaacactttaaagcaacagcagttaaaagagacaaagagggacattatataatggtaaaaggccttgtccaacaggaaaatatcaca

SEQ ID NO: 48369 - DNA, 201 bp, Homo sapiens
gccagtcttgacaacccaggtgctgaacaacccaggtgccctgggctatccggtgaggtccctaagagaaggatgagccataaccctgacatctggatggytcatctggggagatgagacttacacacttagggataaacagtgtgctgctgatttaaaattgtaatttgagtcttgagtaaagagaaaggagtcctggaa

SEQ ID NO: 48370 - DNA, 201 bp, Homo sapiens
taaactgtctgagttatagataagtaatgacatgaaacttcacaaacacgctgagcacagtggctcacgcctgtaatcccagcactttgggaagccgacgygggtgaatcacgaggtcaggagttcgagatcagcctgaccaacatggtgaaaccctgtctgtactaaaaatacaagaaattagctggccatgatggtggg

SEQ ID NO: 48371 - DNA, 201 bp, Homo sapiens
tcgccggcaggatcgtttcctcccgacactggcctctcgccttgggcgcagggtttggggctcagctgtcaattccaaggaattcgtagggttcgacccamgcggcgggagggaacggagggagaatcaaaaggcatcctcccccacgacgcggaggcggtggtacgattcctcaaacgcccaagcttgagctttttttgt

SEQ ID NO: 48372 - DNA, 201 bp, Homo sapiens
ccgaattgtgctaagacctcaggatgtgcgcaaggagtgcctggaagaacttgccactcactccatcttcctgggtgggaggcaagcatggatggggcccmtatcaggtccctaccgccccgcgtccgaaaagccgcgggctgggcggtgtgggaaatggctttttggctccgaggccaaattgctcaatgttttggaccg

SEQ ID NO: 48373 - DNA, 201 bp, Homo sapiens
ccagcaggttctccaagggttcctgcaagaaccccggctgggtgcccaggtctgagcctggtatgtgcctcagtatcacaaaggcctcctgtaaatgacayacattgttggaagtttcagaaattctaggtcaaaatggcactgaaatattaaggtatttaccccaacccaagcaacttttctaaaagttgtagagagtgt

SEQ ID NO: 48374 - DNA, 201 bp, Homo sapiens
tctctttcctttctttcattctttctttctttttttttttttttttttttgagacagagtctcactctgtcacccaggctgcagtgcagtggtgtgatctyggctcactgcaactcattgcaacctcctcctccctgattcaagcaattcccctgcctcagcctcctgagtagctgggattacaggcacatgccaccatgc

SEQ ID NO: 48375 - DNA, 201 bp, Homo sapiens
gcatcagccaccatgcctagtcgattatgccccttttaatggatgagcaaagagtcgaggttccactggttttccactgcagtgtctctgctgaaggattaaaaaaaaaaaaatcacagggctgtgctggactcctgggacttccagaggacaagtccctctcttcagtgaggctgacctacacagagccagccctccttc

SEQ ID NO: 48376 - DNA, 201 bp, Homo sapiens
ttttattttattttattttatttttttgtgatggagtcttgctctgccgcccaggctggcgtgcagtggcatgaccttggctcactgcaacttctacctcrggggttcaagcgattctcctgtctcagcctcctgagtagctggaattagaggcgcacaccaccacgcctggctaatttttttgtgtttttagtagagatg

SEQ ID NO: 48377 - DNA, 201 bp, Homo sapiens
tgggcaagggtttggggcgctctggagcggtttgttgggtcagtgaggtgccagggagagcgggtgcctgccgggcagtgtgctcgggttgcacgccctakcgcgggggcgacagcggcggcgcgggcgggcggtctggaataatgacaaacacatttggccctgagtgaagaagtcgtcgtcgcctcgcattccagcaac

SEQ ID NO: 48378 - DNA, 201 bp, Homo sapiens
ctttttatacccttgccctcaatttcatgtcgcctgctggcctagacgcgcaaggcggaggacagaactgtcacagtccctacccttttctcccaacttcycggcccggctcaattcgggagttgggcctccttcctctcggctcgcagcctccccgactcccactttggggagaaaacccacattcttaaccccttgata

SEQ ID NO: 48379 - DNA, 201 bp, Homo sapiens
atagaaacttaatatattcataaggaatgtggcccaatatcaggcaaaacaagagttaacagcatggactaaactaataaaagaccaaaacaatcttttartgactttttgcttaaaacattgcatatcctttctgttttgcttttcagagtcaagaaaacttttcctttggaaagtatttactgcttttaacaattgaaa

SEQ ID NO: 48380 - DNA, 201 bp, Homo sapiens
gtcctccgcagtgcatctcaccggacaaacatccccggagccacaggaggggaggaaggggctctccgggcgtgcgcacctccccagccgccgcgctgtcycatccccgacccctaatctggtcaacctggaccccggcactgctgaattgcatcccctcttctccctttctcctcggcctcctcctttccacaaccctca

SEQ ID NO: 48381 - DNA, 201 bp, Homo sapiens
catctcacctcttttttgctccttccgctccggacctttacaagttgtggccattccaaactcctttcacttctgattatctcatgttctctctcacctcyccgcccatgcaatgaggttcctccccaactagattcttattcctcttagattctcagagaagccttccctgaaagaagccgtctcccatctcccagattg

SEQ ID NO: 48382 - DNA, 201 bp, Homo sapiens
gcagagagctggctacggtgcagaaagctgaggaggcgtctggagtttttgggtgttaatgattctgcctgcccacaggtcgggtcttggggtctggagcrtttgggaaggtggttgaaggaacagcctatggattaagccggtcccaacctgtcatgaaagttgcagtgaagatgctaaaacgtaagtgctccttcctgg

SEQ ID NO: 48383 - DNA, 201 bp, Homo sapiens
ttgtctctctccaacattgcttagaacgctaagttgcaactttatgtctaattgattgctccactagtccataaaatctaggaggaaagggctgtatcctkagcccttgacacatggccttgtacatcttaagtttgcatatgaaccgctttatttacctgggatattatcttacttaatccccaagacaaccctatacgt

SEQ ID NO: 48384 - DNA, 201 bp, Homo sapiens
gcatcccctcttctccctttctcctcggcctcctcctttccacaaccctcaagatgaggaggccctgcctcgactccccgacaggcgcaaggccgaccagsctcgctttgacgccctggtcaggccctgcttcggagcttgcagttttgggttgacccaagtgcagctggacctcgttcacaagagtgaggggaagccaag

SEQ ID NO: 48385 - DNA, 201 bp, Homo sapiens
tgcaactttatgtctaattgattgctccactagtccataaaatctaggaggaaagggctgtatccttagcccttgacacatggccttgtacatcttaagtytgcatatgaaccgctttatttacctgggatattatcttacttaatccccaagacaaccctatacgttgtgcatgattattccaatggtcattactgttat

SEQ ID NO: 48386 - DNA, 201 bp, Homo sapiens
atagtgttaggagattgtgtgccgaactggaagttaaatgcttctgtctgttaattatctcactgcccactacaactttcacaggtgaggcagtgaggagrcagaaggaaattaaccctcagttggtcaaagatgctctgactggtggaaatgtgttggtgggaagagattgaagttattgttgaaaatagggtcttttca

SEQ ID NO: 48387 - DNA, 201 bp, Homo sapiens
ctttgacgctataccctacctgtgaatttgaatcacctgcagagatttaaaaactgctgatctacaagcctcacccaaaacaacaaattagaatccctggkggtggtggccaactgctccctggctgatttgtttcttctttcttttaaattttgtattatggaagatttctaacgtgtgcacaattcacatagtatagtg

SEQ ID NO: 48388 - DNA, 201 bp, Homo sapiens
gcaaatgaaagtagaggtagaggttgtgttatgatgaatgatctaacagtatatatgttaaagaatgccaaatgcaggttttaattatccaccggtctcaytgcaaaatacagaagagtttaagtcttcttagagagttaggtaaactgaaatcaagcaaggcaccagagtgaaatcacctttgcaaaaattgtaactgag

SEQ ID NO: 48389 - DNA, 201 bp, Homo sapiens
tggagtccattgcactgtccaccacctccaccagaacaagcactggtatacatggctgagagacccatagatggttcacgtcacaggactctgtgcagacracccccagtaccagcccagagctgggtagactaattgggtggctagacccagaagagagaaaacaaccactgcagtttagctcataggaagccacatcca

SEQ ID NO: 48390 - DNA, 201 bp, Homo sapiens
tgtacacccacaggctaacaccacatggaagcggccaaggtttatggctgtcacaagctgaagcagcagcccaagctgcacctgaactcctttgagccacrgctggagctggagtcatagggatgcagggagcagtgtctcgaggctgcacagggcagtggaccctggggctggcccatgagaccattcttccctcctagg

SEQ ID NO: 48391 - DNA, 201 bp, Homo sapiens
caccacatgttctcactcataggtgggagctgaacaacaagaacacatgaacacaggcgggggggaacatcacacatcagagcctgtcagggggtgggggsccgggggagagatagcattaggagaaacacctaatgtaaatgacgagttgatgggtgcagcaaaccaacatggcacatgtatacctatgtaacaaacccg

SEQ ID NO: 48392 - DNA, 201 bp, Homo sapiens
caaaatggcactgaaatattaaggtatttaccccaacccaagcaacttttctaaaagttgtagagagtgtgacctctttattaattgaaacgtgaaaatcrgctctagtttggaagctgagaaaaaatatatatatatgtatttatttctttgttgtttgaattcttaatataaatggtttaaaggaccattgaaaactgc

SEQ ID NO: 48393 - DNA, 201 bp, Homo sapiens
ggtttaaaggaccattgaaaactgcatgcaatcacagaaggttttggcttcaggcagctcccgccatgatcttggggccccattgattctttcatctttcrggcgtcttactgtttgaaccttgaattttaacctgggacatgtttgactaaaatgatgctgttaatattttctgttgtgcaaaacacaaagagaactagg

SEQ ID NO: 48394 - DNA, 201 bp, Homo sapiens
atcgtttgttcccgctcattttctacaaacattacggtatcctgttagcattccgaacaaggggctgttcatatatttgccttcaatgatttcctgaaggracatgtggaagtaatagcgagcggtgcagtcacccaagctgaagatgcacgagagcgggtcgcgtagaagaactgcggcaatgggacccccagcgcagcc

SEQ ID NO: 48395 - DNA, 201 bp, Homo sapiens
aagtccaagcatgttgtagatgacctatgtaagtcacgataaagtttatacaagagaatttattaaaatttagatgtaattagccataactgaaaggaaawttatttatttatttatttatttatttatttatttatttatgatttattttgagaaggagttttgctcttgttgcccaggctggagtgcaatgtcatgatc

SEQ ID NO: 48396 - DNA, 201 bp, Homo sapiens
ttacaatttataggccttggcagaatagagatctgagcttgtgcttagtaagaactaggcaatggaaatttgctttcagaaatacatttctgtcttgacartaagttaattggatcattgcaatgatttttttaaatctctttccataacaaattatagttaaggaaaattttacaaagggagaagagaatatgaagaggg

SEQ ID NO: 48397 - DNA, 201 bp, Homo sapiens
gcaatggcaacaaaagccaaaattgacaaatgggatctaattaaactaaagagcttctgcacagtgaaagaaactaccatcagagtgaataggcaacctamaaaatgggagaaaatttttgcaacctactcatctgacaaagggctaatatccagactctacaatgaactttaacaaatttacaggaaaaaaacaaacaac

SEQ ID NO: 48398 - DNA, 201 bp, Homo sapiens
actcataggtgggaattgaacaatgagaacaacacggacacaggaaggggaacatcacactctggggactgttgtggggtgggggtagtggggagggatasctttaggagatatacctcgtgctaaatgacgagttaatgggtgcagcacaccagcatggcacatgtatacatatgtaactaacctgcacattgtgcgcat

SEQ ID NO: 48399 - DNA, 201 bp, Homo sapiens
acaatgagaacaacacggacacaggaaggggaacatcacactctggggactgttgtggggtgggggtagtggggagggatacctttaggagatatacctcrtgctaaatgacgagttaatgggtgcagcacaccagcatggcacatgtatacatatgtaactaacctgcacattgtgcgcatgtaccctaaaacttaaagt

SEQ ID NO: 48400 - DNA, 201 bp, Homo sapiens
acggagcccagtcctctctgagttccttgtttgggtgtcttgtttttttaagctttgtgctgcatgggtttattaccagtactctgcatacacagtccaaragagtgaaaagaaatagaaaactataggacgttatccagaatgaccacaaaccttcagttccctttgctgtattgcacttactccatttcaaaaggaatg

SEQ ID NO: 48401 - DNA, 201 bp, Homo sapiens
tatcttccaaataaacactcgatttttcagattcactatcaacatacatttattcttggagagttggaaggaattttctttttccttttaaaaaagttacatatatatatatatatatatatatatatatatttttttttttttggtaacagggtctcactctgttgcccaggctggaatgcagtggcatgatcatcatag

SEQ ID NO: 48402 - DNA, 201 bp, Homo sapiens
atcttccaaataaacactcgatttttcagattcactatcaacatacatttattcttggagagttggaaggaattttctttttccttttaaaaaagttacatatatatatatatatatatatatatatatatttttttttttttggtaacagggtctcactctgttgcccaggctggaatgcagtggcatgatcatcatagc

SEQ ID NO: 48403 - DNA, 201 bp, Homo sapiens
tggtctcgaactcctgacctcaagtgattcacctaccttggcctcccaaagtgctgggattacaggtgtgagtcatcacacccagcctataactttttttwaataggtgatagaatcccgtgcttgaaaaataatcaaacaaaaagagaatgcattgtaagaagcctcactgtactcctgtccccagctgcccagttctcc

SEQ ID NO: 48404 - DNA, 201 bp, Homo sapiens
ttggtttccatttctgagttacttcacttagaataatagtctctaatcccatccaggttgctgcaaaagccattaattcattcctttttatagctgagttwtatatatatatatatatatgcacacctacacatacatatgtatagatacactgcagtttctttatccactccttgattgatgggcatttggggttggttc

SEQ ID NO: 48405 - DNA, 201 bp, Homo sapiens
gagaaagagagaggtgccacacacttctaaacagtcagatcttacaagaagtcacttactattgcgaggacagcaccagaaggatggtgctaaattgttcrtaagaaatctgtccccatgatccattcatctgccaccagtccccacctccaatactggagattacaattcaacatgagatttgggtggggacacatattc

SEQ ID NO: 48406 - DNA, 201 bp, Homo sapiens
tacagtccaacaaatgtacatcttccctgaaatatgaagtgatttggttcttctgttcatacttgattgactttaatccttaacacataaacactgctttytatttataggagacagcaatttttttttccaaaccgaagtacatgctatttggcttacaaatatataatcaaagtattgtttcatacagtatgttttttc

SEQ ID NO: 48407 - DNA, 201 bp, Homo sapiens
aggtttgagctggtctctgaagtcaaggagatgatgacactgaattttcttgaaaaaaccagtgcttcaaggctataggatctgaaaggttttctaacagygttctatcatgccaagtgtttcagcaatgcactgagcgtttgttagtcctggtgttttattgtttggcttttaggtggcaccccttaccccggcatgatg

SEQ ID NO: 48408 - DNA, 201 bp, Homo sapiens
aggctgatcttgctaaatgttcaactctgttcctgtcttgcccctctttaaaccatatacttccatagaattaagcccaggttcttttgtcaattgttttyctttttattaattaattaattttttttttgagattgaatcttgctctgttgcgcaggctggagtgcaatggcgtgatctcggctatccacaacctctgcc

SEQ ID NO: 48409 - DNA, 201 bp, Homo sapiens
ctatcaagttgcccgaggaatggagtttttggcttcaaaaaatgtaagttcaaggaacacagacctttttagacccagatttcagtgagtggagtgtggamggagatgctaggagatagatgttggaaaggccattaataacaggggcctcttacttacctgtctctctccttcatcccctacgcaggtcagggagtctga

SEQ ID NO: 48410 - DNA, 201 bp, Homo sapiens
cctacgacagcagacagggctttaatgggaccttcactgtagggccctatatctgtgaggccaccgtcaaaggaaagaagttccagaccatcccatttaaygtttatgctttaaaaggtacttgtatcatctccttccttctttaaataagagtaacaggcaaaatcataaggtgcgtgtaggatttttttttttttttaa

SEQ ID NO: 48411 - DNA, 201 bp, Homo sapiens
gaagttccagaccatcccatttaatgtttatgctttaaaaggtacttgtatcatctccttccttctttaaataagagtaacaggcaaaatcataaggtgcrtgtaggatttttttttttttttaaatcatcatcactggtgatcctaaattctgatttggggatttaggaccccagctaatacaatgtctgtggctataat

SEQ ID NO: 48412 - DNA, 201 bp, Homo sapiens
tcactatcaacatacatttattcttggagagttggaaggaattttctttttccttttaaaaaagttacatatatatatatatatatatatatatatatatwtttttttttttggtaacagggtctcactctgttgcccaggctggaatgcagtggcatgatcatcatagcttactgcaatctcaactcccttggttcaagc

SEQ ID NO: 48413 - DNA, 201 bp, Homo sapiens; identical to SEQ ID NO: 8972

SEQ ID NO: 48414 - DNA, 201 bp, Homo sapiens
catgaatatatttatgtggacccgatgcagctgccttatgactcaagatgggagtttccaagagatggactagtgcttggtaagttccatggggtaacctyccaagactcccttttcccttgcacacaactttacaatttataggccttggcagaatagagatctgagcttgtgcttagtaagaactaggcaatggaaatt

SEQ ID NO: 48415 - DNA, 201 bp, Homo sapiens
tttttaacaatgaggtggttgaccttcaatggacttaccctggagaagtggtaggtaccctcaaaacgtgcaatggcttggagcagagcaacagggctcaraagacctgcatttgagctcggtctgtcactgatgggcacatcactgagtttctctagaccttagcttcccacctctgggatgaacacatttgattaaatg

SEQ ID NO: 48416 - DNA, 201 bp, Homo sapiens
gcagccagagcgccggtcccgcacttcgctccccgaattgtgctaagacctcaggatgtgcgcaaggagtgcctggaagaacttgccactcactccatctycctgggtgggaggcaagcatggatggggcccatatcaggtccctaccgccccgcgtccgaaaagccgcgggctgggcggtgtgggaaatggctttttggc

SEQ ID NO: 48417 - DNA, 201 bp, Homo sapiens
catatggaaaacagaaggggagagagccaggaggtgtgggtgagagccccgaaggcaagaggatcccaggggctggcccagcacggagctggtagacagcrcgctcacaccagggagggctgcaccctcctttctcccgtctgtgttttctttcccttgcaagtgttattcgacaaaagcaattatgctaatttccttccc

SEQ ID NO: 48418 - DNA, 201 bp, Homo sapiens
ccatgatccagtcacctcccaccaggccccacctccaatactggggattacacttcaacatgagatttgggtggggacacatatccaaactatatcattgygtgtgtgtgtgtgtgtgtataatttttaaaccagatatatgtttctgcatatctctttcctttctttcattctttctttctttttttttttttttttttt

SEQ ID NO: 48419 - DNA, 201 bp, Homo sapiens
ttgaaaagaataaaagctgacaatgtaacaaattttttaaactttaaatttaatagttttaaagaattttcttggtgtgttcctgcagtaaacattttaawaaaaaaataattatttattctgatataatgaacttccttttttattgctgtctttttcttttttaatgaaaatatggtgattgattttttttaatgccct

SEQ ID NO: 48420 - DNA, 201 bp, Homo sapiens
attagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaatta

SEQ ID NO: 48421 - DNA, 201 bp, Homo sapiens
aggcctgggggcagaatcttgccatactgtgcagcccaaatttgaatgccaaaggctttcgtttgtctctggggggccacagtctaggtctagttctgtgyaggagttgtaatatttgctcttctctccctcctccagctcgcagacctctgaagagagtgccattgagacgggttccagcagttccaccttcatcaagag

SEQ ID NO: 48422 - DNA, 201 bp, Homo sapiens
cccttccacttctcagcagatgacatagctccctgtggggatatatctgctccctgtaggtacaattccaaatcacctcactgcactggatgtgagacagyttatggcagctgctgcttccacctagagaaagacatgggcctgcatccatgctgtgtgtgattcatgtactcatgtggccgtgatagctgtaatcggctc

SEQ ID NO: 48423 - DNA, 201 bp, Homo sapiens
tgggtggagtgagaacctgggagaaggccagccctttatatccaggcagacagctccaagtgccaccatggatcagccagtcttgcaggggtgatgctatatcagctacagatggcttgatcctgagtcatttcttccttttccatgcagtgtgtccaccgtgatctggctgctcgcaacgtcctcctggcacaaggaaaa

SEQ ID NO: 48424 - DNA, 201 bp, Homo sapiens
gctatggggattaaatcaatgaattcatgtaaagtgcttaggacagtgcctggcatatagaaacagcactcaataatgttagctattttatttatttattwatttatttatttatttatttatttattttctttttttttgagacagagtctcactctgtcacccaggctggagtgcagtggcgcaatcttggctcactgc

SEQ ID NO: 48425 - DNA, 201 bp, Homo sapiens
ctatggggattaaatcaatgaattcatgtaaagtgcttaggacagtgcctggcatatagaaacagcactcaataatgttagctattttatttatttatttatttatttatttatttatttatttattttctttttttttgagacagagtctcactctgtcacccaggctggagtgcagtggcgcaatcttggctcactgca

SEQ ID NO: 48426 - DNA, 201 bp, Homo sapiens
ctattttatttatttatttatttatttatttatttatttatttattttctttttttttgagacagagtctcactctgtcacccaggctggagtgcagtggygcaatcttggctcactgcaaacttctgcctcccaggttgaagcaattctcctgccttagcctcccgagtaggtgggattacaggcatgcaccaccatgtt

SEQ ID NO: 48427 - DNA, 201 bp, Homo sapiens
ccaggttgaagcaattctcctgccttagcctcccgagtaggtgggattacaggcatgcaccaccatgttcagctaatttttgtatttttagtagagacagsgtttcaccatgttgcccagactggtctcgaactcctggcctcaagtgatctacctgcctcagcctcccaaagtgctgggatgacaggtgtgagccactgc

SEQ ID NO: 48428 - DNA, 201 bp, Homo sapiens
gtgctaggctttctacttccttctctctaattcactcttcattttctccaaactcctgctatcccccaggaacagggaagcatcctctcttgctagattayagcaggagcctccctatctcctgagatcatccaggctgatcttgctaaatgttcaactctgttcctgtcttgcccctctttaaaccatatacttccatag

SEQ ID NO: 48429 - DNA, 201 bp, Homo sapiens
ttcaccccctgctctgccttcccaggcctttggatcaggcattgcttatgttctcttccactaggattgagtagggaaagtagaaattcttgcagcttgtsagtaactttgatgaaagacccagcagaaaagcaggaaagctgaagagtaaaaatgatgggtggaccttggttttccacgtggcctaccacagcatgtcag

SEQ ID NO: 48430 - DNA, 201 bp, Homo sapiens
atcaggcagccagttaaagttcaaattatctcacaaatattatcatactccattaaaaagtgggcagaggacataagcagacacttttcaaaagaagacakacctgcagccaacaagcatatgaaaaaatgctcaacatcactgatcactagagaaatgcaaatcagaaccgtgatgagataccatctcacaccagacaga

SEQ ID NO: 48431 - DNA, 201 bp, Homo sapiens
aattaagcccaggttcttttgtcaattgttttcctttttattaattaattaattttttttttgagattgaatcttgctctgttgcgcaggctggagtgcartggcgtgatctcggctatccacaacctctgcctcctgggttcaagtgattctcctgcctcagcctcctgagtagctgggaccatgggcacacaccaccat

SEQ ID NO: 48432 - DNA, 201 bp, Homo sapiens
aattatctcacaaatattatcatactccattaaaaagtgggcagaggacataagcagacacttttcaaaagaagacatacctgcagccaacaagcatatgaaaaaatgctcaacatcactgatcactagagaaatgcaaatcagaaccgtgatgagataccatctcacaccagacagaatggttattattaaaaagtcaaa

SEQ ID NO: 48433 - DNA, 201 bp, Homo sapiens
gcccaggttcttttgtcaattgttttcctttttattaattaattaattttttttttgagattgaatcttgctctgttgcgcaggctggagtgcaatggcgygatctcggctatccacaacctctgcctcctgggttcaagtgattctcctgcctcagcctcctgagtagctgggaccatgggcacacaccaccatgcctgg

SEQ ID NO: 48434 - DNA, 201 bp, Homo sapiens
acggagggagaatcaaaaggcatcctcccccacgacgcggaggcggtggtacgattcctcaaacgcccaagcttgagctttttttgtatgcgagatagaakccagggcaacctcgcccagataaccccgaaaacaaaggcacgaccagataagtgacttcaagggagtaaaggtcgttctatcggagaacgttccaaacct

SEQ ID NO: 48435 - DNA, 201 bp, Homo sapiens
cgaggagatttagccattttcaacagcagttttcctatttctgcttaaaccccgcgggctttcaactgaggtcaccacgaaagctaaaagtacaacctaargaaggaagagactggaaattaacatttggggtagtggagctcagaattcctcgcagcggcgtctgtgtcgcaacccgtggacgcacgtccttggaccaac

SEQ ID NO: 48436 - DNA, 201 bp, Homo sapiens
agccattttcaacagcagttttcctatttctgcttaaaccccgcgggctttcaactgaggtcaccacgaaagctaaaagtacaacctaaggaaggaagagrctggaaattaacatttggggtagtggagctcagaattcctcgcagcggcgtctgtgtcgcaacccgtggacgcacgtccttggaccaacactgccatctg

SEQ ID NO: 48437 - DNA, 201 bp, Homo sapiens
attcactatcaacatacatttattcttggagagttggaaggaattttctttttccttttaaaaaagttacatatatatatatatatatatatatatatatwtttttttttttttggtaacagggtctcactctgttgcccaggctggaatgcagtggcatgatcatcatagcttactgcaatctcaactcccttggttcaa

SEQ ID NO: 48438 - DNA, 201 bp, Homo sapiens
ctgcctcccaggttcaagcgattctcctgcctcagcctcccgagtaactgggattacaggtgcccgccaccacgccaggctaatttttgtatttttagtasagacggggtttcaccatattggccatgctggtctcgaactcctgacctcaggtgatccgcccacctcggcctcccaaagtgctgggatttacaggcgtaa

SEQ ID NO: 48439 - DNA, 201 bp, Homo sapiens
cgattctcctgcctcagcctcccgagtaactgggattacaggtgcccgccaccacgccaggctaatttttgtatttttagtagagacggggtttcaccatrttggccatgctggtctcgaactcctgacctcaggtgatccgcccacctcggcctcccaaagtgctgggatttacaggcgtaagccaccgcgcccggccag

SEQ ID NO: 48440 - DNA, 201 bp, Homo sapiens
tgaattcttcaaactttaagtgtaatggacttacaggtccatgggagcacagccccactgtcttagatgtggctcttcaggatgtgcgggctcctgctaargatgtgcagggaactggctctgaaaacaagtgaacagtagtcatcatggcagctgacatttgtggagtcctttgtatgtgccaggtgccatgacaaatat

SEQ ID NO: 48441 - DNA, 201 bp, Homo sapiens
ggggtttcaccatattggccatgctggtctcgaactcctgacctcaggtgatccgcccacctcggcctcccaaagtgctgggatttacaggcgtaagccamcgcgcccggccaggaacggttcttaaatgccgagagggcgcatgctagctctcctcagcattcccggtgagccgctacccacggccgtgcggctctcgtg

SEQ ID NO: 48442 - DNA, 201 bp, Homo sapiens
ttaaatgccgagagggcgcatgctagctctcctcagcattcccggtgagccgctacccacggccgtgcggctctcgtgcccataggaggcgctggcgagckcctgtaaccctaaacccctcggcccctttccccccacccgcccggattctcttcccgctctcccccctctctccacacccgcccggccccctctcgggtc

SEQ ID NO: 48443 - DNA, 201 bp, Homo sapiens
atttagatgtaattagccataactgaaaggaaatttatttatttatttatttatttatttatttatttatttatgatttattttgagaaggagttttgctsttgttgcccaggctggagtgcaatgtcatgatcttggttcactgcagcctccgcatcctgggttcaggcatttctcctgtctcagcctcctgagtagcta

SEQ ID NO: 48444 - DNA, 201 bp, Homo sapiens
ttaacaatgaggtggttgaccttcaatggacttaccctggagaagtggtaggtaccctcaaaacgtgcaatggcttggagcagagcaacagggctcagaaracctgcatttgagctcggtctgtcactgatgggcacatcactgagtttctctagaccttagcttcccacctctgggatgaacacatttgattaaatggcc

SEQ ID NO: 48445 - DNA, 201 bp, Homo sapiens
atactctgggcttttcggcatttggatgctccagggtgtttggcactgacattcccctctagcattgtgggttagagtcccacccaggggaaatcttggtyttgccttttcttgttttctactctaaagttatcattttctataaaaacattttcttttcttattgtcactttgtttaatgctttgctccaggaggtggga

SEQ ID NO: 48446 - DNA, 201 bp, Homo sapiens; identical to SEQ ID NO: 8969

SEQ ID NO: 48447 - DNA, 201 bp, Homo sapiens
tcctggtcttaggctgtcttctcacaggtacggagcccagtcctctctgagttccttgtttgggtgtcttgtttttttaagctttgtgctgcatgggtttwttaccagtactctgcatacacagtccaaaagagtgaaaagaaatagaaaactataggacgttatccagaatgaccacaaaccttcagttccctttgctgt

SEQ ID NO: 48448 - DNA, 201 bp, Homo sapiens
tttgtgcgactatttgattaatgctcatttccttgactagatcacctcatgtgaaaggtatggattggttttgcttttacccagttagctcccatgcctayctcagtacctggcacattgtaggtcccccagaatcatcatctactgaaagtggaatgaccacttcagaagggcaccctgggtaagatttctctttctgtt

SEQ ID NO: 48449 - DNA, 201 bp, Homo sapiens
cgagggctataagaaatggaagatgtggaattcttgagcacagatgtgctttgtgttttcttcagtctgtgtccttgcctccattcttattccatgtgggktttttttttttttttttttttttttttgagacagggtctctcgctctattgcccaggttggagtgcagaggctgactgcaacctcaatcccctgggctcc

SEQ ID NO: 48450 - DNA, 201 bp, Homo sapiens
aagtgtctatactcactctgggtgttgggactttccagtggtttaatatgatacttaaagtatttagagggaagtgtatagggatggtaagtgaacctggmagcccacgtggtctctaaatgcaggtctgcacaaccagttctgtgacatgtttccaggtttgtggcctgtaaattgaaaagaataaaagctgacaatgta

SEQ ID NO: 48451 - DNA, 201 bp, Homo sapiens
agtctgaaatcatcaggcatctactcttctctagagctttctctctgttgggagtgggtggagtgagaacctgggagaaggccagccctttatatccaggsagacagctccaagtgccaccatggatcagccagtcttgcaggggtgatgctatatcagctacagatggcttgatcctgagtcatttcttccttttccatg

SEQ ID NO: 48452 - DNA, 201 bp, Homo sapiens
aacacatttgattaaatggcctttaggactccttgatcaatgggagagtttgaaatgatagttcctggaccaggcccttcagaatacataaagagtgtgcmgtaagccttctttttcagaagtcagacagaaataggaaggttctctggctacaagatatcaaccaaaaaattagaagagcaaaaaaaccactggatttta

SEQ ID NO: 48453 - DNA, 201 bp, Homo sapiens
gaattgatggaagctcattggtttttgagcaaaatctgttgccagtccagtcatagccattcatggctctttattaaaaaaaaaaaaaaaaaaaaaaaaavcttttttggtatcttatttttttctgcgccatatggtctgcaggacaattcatggcttttctgttcttcattttcatacccatctcctaacggcttttgt

SEQ ID NO: 48454 - DNA, 201 bp, Homo sapiens
aattgaaaagaataaaagctgacaatgtaacaaattttttaaactttaaatttaatagttttaaagaattttcttggtgtgttcctgcagtaaacattttwaaaaaaaaataattatttattctgatataatgaacttccttttttattgctgtctttttcttttttaatgaaaatatggtgattgattttttttaatgcc

SEQ ID NO: 48455 - DNA, 201 bp, Homo sapiens
catcaccttacgtgaaagttaacgtcataggcttaatctggaacccatttgccctaattgaggactccacaggaaagaagagtagagcctggctaatcagragagagatgtgcagtgagttgcttggatccctaccttttaatcagaatggtagattgctctcatctcttaattggtggtggagttttgaatgagtcaccc

SEQ ID NO: 48456 - DNA, 201 bp, Homo sapiens
gtttcactatgttggccaggctggtcttgaactcctgacctcaagtgatccacccaccttgggctcccaaagtgctgggattacaggcgtgagccactgcrcccggcccagaatgttagcagcagaattttagcattgtgggctgtccacgctgagtggggcttagcatttcaccaatgaggaaacaggcctcgagaaggc

SEQ ID NO: 48457 - DNA, 201 bp, Homo sapiens
  misc_feature (1)...(201): n = A,T,C or G, or insertion/deletion polymorphism (see Tables 1-2)
tggcaccatcttggctcaccacaacctttgcttcctgggttcaagcgattctcctgcctcagccacccgagcagctgggattacaggcatgcaccaccacncctagctaattttgtatttttagtagagacggtgtttctccatattggtcaggctggtctcgaacttctgacctctggtgatccaccctcctcggcctcc

SEQ ID NO: 48458 - DNA, 201 bp, Homo sapiens
gcgactacaggcgtgtgccaccatgcctggctaatttttgtatttttagtagagatggggtttcactatgttggccaggctggtcttgaactcctgacctsaagtgatccacccaccttgggctcccaaagtgctgggattacaggcgtgagccactgcgcccggcccagaatgttagcagcagaattttagcattgtggg

SEQ ID NO: 48459 - DNA, 201 bp, Homo sapiens
attattattattttgagacgaagtctcgtcctgtcgcccaggctggagtgcagtggcgtgatcttggctcactgcagtctgtgtctcccgggctcaagcarttctcctgcctcagcctcccaaatagtggcgactacaggcgtgtgccaccatgcctggctaatttttgtatttttagtagagatggggtttcactatgtt

SEQ ID NO: 48460 - DNA, 201 bp, Homo sapiens
gtggatcacttgaggtcaggagttcaagaccagcctggccaacatgacgaaactccatctctactaaaaatacaaaaattagccaggtgtggtggcaggcrcctgtaatcccagctacttgggaggctgaggtgggagaatcgcttgaccccaggaggtggagactgcagtgagcggagatcataccactgcactccagcc

SEQ ID NO: 48461 - DNA, 201 bp, Homo sapiens
attgcttgaaccctggaggcggaggttgcagtgagcagagattgcgccactgcactccaagcctgggtgacagagcgagtctccgtctcaaaaaaaaaaawaaattcatttaaataaataaataaataaataaataaataaataaataaataaaaggtatcagagactgactccaccccagagctgtcagctccaaaactc

SEQ ID NO: 48462 - DNA, 201 bp, Homo sapiens
cgggtggatcacgaggtcaggagatcgagaccatcctggccaacatggtgaaaccccatctctactaaaaatacaaaaattagctgggcatggtggcatghgcctttagtcccagctgctcgggaggctgaggcaggagaattgcttgaaccctggaggcggaggttgcagtgagcagagattgcgccactgcactccaag

SEQ ID NO: 48463 - DNA, 201 bp, Homo sapiens
agaaaccacttcctcaaggtcacacagctaaaaagtatcacagtcagggctgggcgtggtggctcacacctgtaatcccagcactttgggaggccgaggcrggtggatcacgaggtcaggagatcgagaccatcctggccaacatggtgaaaccccatctctactaaaaatacaaaaattagctgggcatggtggcatgcg

SEQ ID NO: 48464 - DNA, 201 bp, Homo sapiens
ctcttgcatttggggcaaggaaggccagagcaaacagagtggttccccttggtgccagccttagtcgacttgagagatgatgctacatgagagaggaatgyggttaggacctattttacagaggaggaaacaaacctagggggagaaaccacttcctcaaggtcacacagctaaaaagtatcacagtcagggctgggcgtg

SEQ ID NO: 48465 - DNA, 201 bp, Homo sapiens
gacaccccgcagataggggacatggcttactggtcccaccccatcgacctgcacttcgccaccaaaggtcttcaaggtgggtatcacacctggacccgggkccaggctgaggggagggggccagtagcctctgaggtccctggggctgggaacaccaagacctgtccctgctccccataccacgtaggtcccttttgcagc

SEQ ID NO: 48466 - DNA, 201 bp, Homo sapiens
tcgcagggtgttgagtgacaggaggctgcttagccacatgggaggtgctcagtaaaggagagcaattcttacaggtgtctgcctcctgacccttccatccytcaggtgtcctgttgccccctcctcccactgacaccctccggaggcccccatgttgacagaccctcttctcctaccttgtttcccagcctgactctcctt

SEQ ID NO: 48467 - DNA, 201 bp, Homo sapiens
tgcacacagctgctggtggcaccgtgcacctggagatcggcctgctgctccgcaacttcgaccgctacggcgtggagtgctgagggactctgcctccaacrtcaccaccatccacaccccggacacccagtgatgggggaggatggcacagtggtcaagagcacagactctagagactgtcagagctgaccccagctaagg

SEQ ID NO: 48468 - DNA, 201 bp, Homo sapiens
gcaggctatggattttgccatgtgcccagtagcccgggcacccaccagctggcctgccccacgtggcggcccctgggcagttggcgagaacagttggcacrggctttcgtgggtggtgggccgcagctgctgcatggggacaccatctacagtggggccgaccgctatcgcctgcacacagctgctggtggcaccgtgcac

SEQ ID NO: 48469 - DNA, 201 bp, Homo sapiens
caagttcaagcagagtacacacagcatatatatgttcttcaacacatcagagctccgagaagcggtacctgaacccgtgttgctctcccgggcagagctgygtctgctgaggctcaagttaaaagtggagcagcacgtggagctgtaccaggtgaggacatgagccagaaggaaggtcagggcatgggctggagagggtga

SEQ ID NO: 48470 - DNA, 201 bp, Homo sapiens; identical to SEQ ID NO: 9000

SEQ ID NO: 48471 - DNA, 201 bp, Homo sapiens
gtggaccgcttctagagtgcgacagaaacatgcggggtcgtgggggcagtcccctagagggagacaagcaatagggggagggtagaaggctccctcttccmggacgcgttgaatggggggggggtcgtggggtgccaggtgcagagaagggagcctggtgtgggagaagcgaagaccccagcatttgggaaaggagaggcg

SEQ ID NO: 48472 - DNA, 201 bp, Homo sapiens
ctaatttcccactataatactggaatgggttctagagtcactctgtcttgtcttacacctggctcagagagaggaattcacttgcccaaggttacacagcrcttaaattaggagagtctgtgtgggaatgcagggagcttaatgttattgctgtttttcaaagaataacaggaaactgacattcagaaagagggtgttaac

SEQ ID NO: 48473 - DNA, 201 bp, Homo sapiens
ggaccccaaagtcccagttcctctcagggtggctggggaaaccccagcgtccggcggcctcatcctcctcccttccctttccttcccatgcccccggcggrggcggggatcgctcgcggagcccggggcgagacggggcaggtctggtccccgccctcctggctgcggcgcctcccgccctcctcaccccagctacgggcg

SEQ ID NO: 48474 - DNA, 201 bp, Homo sapiens
caggaggaccccgctgcgctaaacgctggcagtctggaccccaaagtcccagttcctctcagggtggctggggaaaccccagcgtccggcggcctcatccycctcccttccctttccttcccatgcccccggcgggggcggggatcgctcgcggagcccggggcgagacggggcaggtctggtccccgccctcctggctgc

SEQ ID NO: 48475 - DNA, 201 bp, Homo sapiens
tgtctggtcttggagaggaggagatagcgaagtggaccgcttctagagtgcgacagaaacatgcggggtcgtgggggcagtcccctagagggagacaagcratagggggagggtagaaggctccctcttccaggacgcgttgaatggggggggggtcgtggggtgccaggtgcagagaagggagcctggtgtgggagaagc

SEQ ID NO: 48476 - DNA, 201 bp, Homo sapiens
actggaacctcgggggtggaggttgcagtgaaccgagatcgcgccactgcactccggcctgggcaatgatgcgagactccatctaaaaaaaaaaaaaaaaaaaaagaaagaaagtgtcagtttgaacctcttgagtgatggctcagaactttggaatgttgggatgcaatactggcatactggaattcaggaatgccaaga

SEQ ID NO: 48477 - DNA, 201 bp, Homo sapiens
gtgtctggtcttggagaggaggagatagcgaagtggaccgcttctagagtgcgacagaaacatgcggggtcgtgggggcagtcccctagagggagacaagmaatagggggagggtagaaggctccctcttccaggacgcgttgaatggggggggggtcgtggggtgccaggtgcagagaagggagcctggtgtgggagaag

SEQ ID NO: 48478 - DNA, 201 bp, Homo sapiens
gaaagagtgagatcccatctcaaaaaaaaaaaaaaaaaaaaaagattccaggcaaagggaacagcctgtgcaaaggcctggaggccagggagagcctaachcatttgatctgtccaggagatgattgtctctgtctggtttctggcagggcccatggtgcccctatctctctccctcacctccctctcatttatgctttta

SEQ ID NO: 48479 - DNA, 201 bp, Homo sapiens
gggtggccggggagagtgcagaaccggagcccgagcctgaggccgactactacgccaaggaggtcacccgcgtgctaatggtggaaacccacaacggtgarctcggaggggcaggggagccgggaggggggcccccagggggcgccggagtgccggggccacgggtaggaagtgactggcagaagaaactggctggaggaa

SEQ ID NO: 48480 - DNA, 201 bp, Homo sapiens
gcctgggaggtcgaggctgcagtgagccataatcacactactgcaatccagcctacatgaaagagtgagatcccatctcaaaaaaaaaaaaaaaaaaaaaagattccaggcaaagggaacagcctgtgcaaaggcctggaggccagggagagcctaactcatttgatctgtccaggagatgattgtctctgtctggtttct

SEQ ID NO: 48481 - DNA, 201 bp, Homo sapiens; identical to SEQ ID NO: 8987

SEQ ID NO: 48482 - DNA, 201 bp, Homo sapiens; identical to SEQ ID NO: 8989

SEQ ID NO: 48483 - DNA, 201 bp, Homo sapiens
agcctgggaggtcgaggctgcagtgagccataatcacactactgcaatccagcctacatgaaagagtgagatcccatctcaaaaaaaaaaaaaaaaaaaaaagattccaggcaaagggaacagcctgtgcaaaggcctggaggccagggagagcctaactcatttgatctgtccaggagatgattgtctctgtctggtttc

SEQ ID NO: 48484 - DNA, 201 bp, Homo sapiens
atgttagcttggcttcttggagtctggggaattcagctttattctgcagtccctggagtggactatccagccccagaaaattcttcttttttttgtgtgtktgtgtgatggagttttgctcctgttgcccaggctggagtgcaatggcaccatcttggctcaccacaacctttgcttcctgggttcaagcgattctcctgc

SEQ ID NO: 48485 - DNA, 201 bp, Homo sapiens
gaggaggcaagcgggagaggagcggagactcgggagggcgcccgggatgcagaggtgtcctcggtgtttcacacagggacgtgagggacagagtggggagmccagcggaggaatcgagcttccagaagacctagagtcctgggtcatgggaagggctttaccgagaggggagacaggcgtgggaaaggtggtgtgagcggg

SEQ ID NO: 48486 - DNA, 201 bp, Homo sapiens; identical to SEQ ID NO: 8990

SEQ ID NO: 48487 - DNA, 201 bp, Homo sapiens; identical to SEQ ID NO: 8991

SEQ ID NO: 48488 - DNA, 201 bp, Homo sapiens
tcttttcgtctccgttagtctttctgtccacgcatgggtctcctggtttttgtctctccgactattttctctccctttctatttttctcctccacggtcckgttgcctcgtctccgtctctgacatctccccgcctctccctctctgcatcaccctccaacccttcctctccctcctctctgtcttcctccctatctgtct

SEQ ID NO: 48489 - DNA, 201 bp, Homo sapiens
gatgcgtgcctctagtcccagctactcagtagtctgaggtgggaggattgattgagcccaggaggtcgaggctgtagtgaactgtgattgcaccactgcaytccagcctgggtgatggagcgagaccgtctcaaaaatatatatatataggccaggcgtggtggctcatgcctgcaatcccagcactttgggaggccaggg

SEQ ID NO: 48490 - DNA, 201 bp, Homo sapiens
ccagaaggaaggtcagggcatgggctggagagggtgagctgtgaccaagggggtggctgtgggtcggctggttacaaggtccacctagatggtccctgaargatagaagaacacaaaccatacaatcctagaactcttttttttttttttgagacagtgtctcactctgttgccaagctggagtgcagtggtatgacctca

SEQ ID NO: 48491 - DNA, 201 bp, Homo sapiens
gaggacatgggcaaagctatggaaggagagaaagatgcttccagatgccaggtggaaggtggattagagaggggcaagaaagaaggccctgggcccaaagrgagcagggcagggacatgaggagggaaggcaggaggtgtccctgacaaggcccatgatggttacctggggactggaggagcaatgggctgccctgacatg

SEQ ID NO: 48492 - DNA, 201 bp, Homo sapiens
tgagctgtgaccaagggggtggctgtgggtcggctggttacaaggtccacctagatggtccctgaaggatagaagaacacaaaccatacaatcctagaackcttttttttttttttgagacagtgtctcactctgttgccaagctggagtgcagtggtatgacctcagctcactgcaatctccgcctcctgggttccagtg

SEQ ID NO: 48493 - DNA, 201 bp, Homo sapiens
tggccgctgccagcttgcaggctatggattttgccatgtgcccagtagcccgggcacccaccagctggcctgccccacgtggcggcccctgggcagttggmgagaacagttggcacgggctttcgtgggtggtgggccgcagctgctgcatggggacaccatctacagtggggccgaccgctatcgcctgcacacagctgc

SEQ ID NO: 48494 - DNA, 201 bp, Homo sapiens
catggaagctcctgtcaggcgtgcgggagggccaaacgcaagtggacaccccgcagataggggacatggcttactggtcccaccccatcgacctgcacttygccaccaaaggtcttcaaggtgggtatcacacctggacccggggccaggctgaggggagggggccagtagcctctgaggtccctggggctgggaacacca

SEQ ID NO: 48495 - DNA, 201 bp, Homo sapiens; identical to SEQ ID NO: 8996

SEQ ID NO: 48496 - DNA, 201 bp, Homo sapiens
aggcaggaagaggtagtgccaggatttgaacccagatacttggttccagagtccatgcttcgtaacccctaccagtagatgccacagagaaacagtcctayagccacagcggcatccccttcccgatggctgcctcccacccctctatgtcccggctctcactgcaggggcggcatggaagctcctgtcaggcgtgcggga

SEQ ID NO: 48497 - DNA, 201 bp, Homo sapiens
ataaaaggtatcagagactgactccaccccagagctgtcagctccaaaactcctagagttgggagcaccagctcccctcacctctgccaaacccctgatckcctcccttcatttctccctgctagaaatctatgacaagttcaagcagagtacacacagcatatatatgttcttcaacacatcagagctccgagaagcggt

SEQ ID NO: 48498 - DNA, 201 bp, Homo sapiens
gaagtgtcagggtgagggtgagcacagacagaccagctgtccaggcaagaaatggcagcagccacaggtgggtctccctctgctgtctccatttcttcccmtctgctatggtcctgcttgtgaattctctcctgcttcctctttctcctgcctctcagtttctgctctttctcctaggtttcacttccccacacccagtga

SEQ ID NO: 48499 - DNA, 201 bp, Homo sapiens; identical to SEQ ID NO: 8982

SEQ ID NO: 48500 - DNA, 201 bp, Homo sapiens
gtggggccgggggcggcttcaaaaccccctgccgacccagccggtccccgccgccgccgcccttcgcgccctgggccatctccctcccacctccctccgcsgagcagccagacagcgagggccccggccgggggcaggggggacgccccgtccggggcacccccccggctctgagccgcccgcggggccggcctcggcccg

SEQ ID NO: 48501 - DNA, 201 bp, Homo sapiens
cctgggtggggccgggggcggcttcaaaaccccctgccgacccagccggtccccgccgccgccgcccttcgcgccctgggccatctccctcccacctcccwccgcggagcagccagacagcgagggccccggccgggggcaggggggacgccccgtccggggcacccccccggctctgagccgcccgcggggccggcctcg

SEQ ID NO: 48502 - DNA, 201 bp, Homo sapiens
tcctgggtggggccgggggcggcttcaaaaccccctgccgacccagccggtccccgccgccgccgcccttcgcgccctgggccatctccctcccacctccytccgcggagcagccagacagcgagggccccggccgggggcaggggggacgccccgtccggggcacccccccggctctgagccgcccgcggggccggcctc

SEQ ID NO: 48503 - DNA, 201 bp, Homo sapiens
gcccccgctcccgccccgtgcgcttcctgggtggggccgggggcggcttcaaaaccccctgccgacccagccggtccccgccgccgccgcccttcgcgccmtgggccatctccctcccacctccctccgcggagcagccagacagcgagggccccggccgggggcaggggggacgccccgtccggggcacccccccggctc

SEQ ID NO: 48504 - DNA, 201 bp, Homo sapiens
agcaattcttacaggtgtctgcctcctgacccttccatccctcaggtgtcctgttgccccctcctcccactgacaccctccggaggcccccatgttgacaraccctcttctcctaccttgtttcccagcctgactctccttccgttctgggtccccctcctctggtcggctcccctgtgtctcatcccccggattaagcct

SEQ ID NO: 48505 - DNA, 201 bp, Homo sapiens
gctaggagcactcttcctctagatggccacatggcctactcccttccttccttttagcatttgctcaaatgtcaccttcttaatgaagcttccttgatccycttcttgctaaagcggtatccccaccctcaccctacccagctctgttttccctcacagcaattaccaccatctaatctaccctataatttgcttatttac

SEQ ID NO: 48506 - DNA, 201 bp, Homo sapiens
ttctgctctagccatgctgtccccaccaggcacactccgtctgggctccagccatactgtccccaccagacagtccccccccagggccttggcacttgctrttccctctggctaggagcactcttcctctagatggccacatggcctactcccttccttccttttagcatttgctcaaatgtcaccttcttaatgaagctt

SEQ ID NO: 48507 - DNA, 201 bp, Homo sapiens
aaaattagccatgcatgctgttacgtgcctgtagttccagctgcttgggagactgaggtgggagaatcacctgagcctgggaggtcgaggctgcagtgagycataatcacactactgcaatccagcctacatgaaagagtgagatcccatctcaaaaaaaaaaaaaaaaaaaaaagattccaggcaaagggaacagcctgt

SEQ ID NO: 48508 - DNA, 201 bp, Homo sapiens
gcctccagtcccccagtggtggcaccagccttgctttctcttttctcaagcccccattttgtccatcaggaaatcttaaactgcctctacttttgaaatayatcctaaatcccacttcttacccttttctcgcccagcaccttgatctgtccaagttcttctctcacatggactatgacaagaatcttgtctctggagtcc

SEQ ID NO: 48509 - DNA, 201 bp, Homo sapiens
agcctgggcaacaacagtgaaactccgtctcaaaaaaaaaaaaagaaaagaaaaagaaaaaatagggattagggagcaggtgggcactgggaggagtgtcmtgggctgttcgacaaaggcctagaaggagctcatctgtcttggtcaatgctgagtcccaagcacacagcacaggcttcggcacattgtaggagcctagaa

SEQ ID NO: 48510 - DNA, 201 bp, Homo sapiens
tgtgttcccatctgccccacgccccacttatctatccctctgagagtgtgtgtgtatgtcccctatcccctgactcccacaccaaagcagggttcactacmggccgccgaggtgacctggccaccattcatggcatgaaccggcctttcctgcttctcatggccaccccgctggagagggcccagcatctgcaaagctccc

SEQ ID NO: 48511 - DNA, 201 bp, Homo sapiens
catgcccagttgtgacgtgtgtgcgtgtgtgtgttcccatctgccccacgccccacttatctatccctctgagagtgtgtgtgtatgtcccctatcccctractcccacaccaaagcagggttcactaccggccgccgaggtgacctggccaccattcatggcatgaaccggcctttcctgcttctcatggccaccccgct

SEQ ID NO: 48512 - DNA, 201 bp, Homo sapiens
tacctagggcatagcactgctgggacaattcagtgatttggggactgatctccatatcaagatgacctgatcctgtctgtgtgcgggacagtggctagcasggagcccttgttaggcccgcctaccatctgacccttctcaaaccttcccgtctgaggacatctgcatgcacacttgtccctccaatgctgtctcactctg

SEQ ID NO: 48513 - DNA, 201 bp, Homo sapiens
ctgcaaagctcccggcaccgccgagccctggacaccaactattgcttcaggtgagccttgtagcctggatggaggccttccaggctgggggcatgactgcyatctgctgaccaggtgctccaggttggacacctggctgctgctgtgcttgggctgagcatctgtctcctttagcttggagggctcaggggatgaggtctg

SEQ ID NO: 48514 - DNA, 201 bp, Homo sapiens
tttcctgtggcccaggccctctgctctttaaaaatggggcacaaatacaggcaggtaagagacagacagctctcatcctgcactcttggctttctgagagrtatgaccccaaggtcctggagtctagctgctgcttcctcctctgggaaatagaggagtgatattggtagtacctagggcatagcactgctgggacaattc

SEQ ID NO: 48515 - DNA, 201 bp, Homo sapiens
cgttctcagcaggggtggatgtgtgtttgtgagcagctgcgagtgtgggtccacattgtgtgctggtgttttcaggggagggggacagggtgcgtccatgragccgcctgcatcatgagcggccagtgcctgttggcctccatacccagcgcaggctgtgtctgcggcgcgtccccttgccggctggtgccacgctggctc

SEQ ID NO: 48516 - DNA, 201 bp, Homo sapiens
atctcggcacactataacctctgcctctcaggttcaagcgattctcatgcctcaacctcccaagtagctgggattagagccgtccggcaccatgcctggcyaatttttgtatttttagtagaaacggggtttcaccatgttggccaggctggtctcgaactcccgacctcaagtaatcaatccacctcggcctcccaaagt

SEQ ID NO: 48517 - DNA, 201 bp, Homo sapiens
gtggtcaggctggtctcgaactcctgacctcaggtgatccacctgcctcggcctcccaaagtgctgggattacaggcatgagccaccgcgcctggctgagrtttcacttttaaataatctttctgtcttttaagctggagctggggaaaaaaaaaatctttccggtgctgtgtgggtgaggtgggcagctctaacctttca

SEQ ID NO: 48518 - DNA, 201 bp, Homo sapiens
gagtcactgcgcctggcttgtttgttcattttttgagatggagtctcactgtgtcacaccagctggagtgcagtggtgcaatctcggctcactgcagcttytccagcgattctcgtgcctcagcctcccgagtacctgggattacaggcacctgccaccactccagactaatttttgtatttttagtagagacgaggtttt

SEQ ID NO: 48519 - DNA, 201 bp, Homo sapiens
ccttgtgatctgcctgccttagtctcccaaagtgctgggattacagacgtggctaattttgtgggtgtgtgtgtgtgtgtttttagtagagacagagtttyaccattttggccaggctggtctcgaacccctgacctcaagtgatccacctgccttggcttcccaaagtgctaggattacagatgtgagccactgcgccca

SEQ ID NO: 48520 - DNA, 201 bp, Homo sapiens
taaactggggggtgaggaggggattaagagtcctagagggtggattaaatgaatggatgcttaaagtacttagcatagcatctgggatttagttagtactyggtgcattttctttttttcttttctttttttttttagatggaatttcgctcttgttgcccaggctggagtgcaatgggaccatcttggctcactgcaacc

SEQ ID NO: 48521 - DNA, 201 bp, Homo sapiens
gacagagggacagagtgactggagctggagggggaagagtgcagggaggcagcttgctttggcaggacgcatggaggtgtcagacgtggggggcggggtgkcggccaggccagcgagccaggccagggccaggacggacaggagacacgggggtgggggccggatgcccacctaggggttgtctcccagcggggcccgccc

SEQ ID NO: 48522 - DNA, 201 bp, Homo sapiens
ggagaggacagagccccccagagggagactccagcagagaaagggatggggaaacgaggtgacaggagctgagaacagagatggagaatggctggggacayggagtggaaaaggtggggaggagagggagggagggagggagggagaggcatgggaaaaacaagggaggagagagaggggagacggaaagtcacggggaga

SEQ ID NO: 48523 - DNA, 201 bp, Homo sapiens
gcgtgtacacatgcagacacactcacacggcgggaaacacggacggtgccccacactacacaaatattcacctctcagagccgccgtggacacacagagaytcctgcagggcccgtaacacatgggctgtgtcatttggcagcagctgcagcccacatatacacagatacaaatagagaaagtgtcagcccatcacgtaaa

SEQ ID NO: 48524 - DNA, 201 bp, Homo sapiens
gggaggagtggggaggcaggagttcactatgcaaggacatgccaacaaatggataggtatagagatgctgaggtctggccccaagaggcagagtcacaagmtaggacacagtgactcggctgtaatcgctgcagccctatgaggatgtggtgcgtgtacacatgcagacacactcacacggcgggaaacacggacggtgcc

SEQ ID NO: 48525 - DNA, 201 bp, Homo sapiens
ttgaacctgggaggtggaggttgcagtgagccgagatcacgccacttcactccagcctgggagacagagtgagactccatctcaaataaataaataaaaawaaaaaatacaaaaaaaaattagtctggcattgtggtgcacacctgtagtcccagctactcaggggcctgaggcaggagaatcgcatgaacaggggaggca

SEQ ID NO: 48526 - DNA, 201 bp, Homo sapiens
gatacagacacagagttaggccaaggagagacaaagacagatacacaacaaggcaagaggcgaagatgaggagggacagagactgagaaagaaaatcaggygggcgcggcggctcacgatggtaataccaacactttgggacgctgaagcaggaggatcgcttgagcccaggagttcgagagtagcccaggcagcagactg

SEQ ID NO: 48527 - DNA, 201 bp, Homo sapiens
agaactgctgcgtgcggcagctgtacattgacttccgcaaggacctcggctggaagtggatccacgagcccaagggctaccatgccaacttctgcctcggrccctgcccctacatttggagcctggacacgcagtacagcaaggtacgtctggcccaccgggctacgagatgcgcttggggggagccaggacggaggaaga

SEQ ID NO: 48528 - DNA, 201 bp, Homo sapiens
tgctaaggtggtgtctgcatgctgtgttcccacatgtaggctggtgactgcagtgtgtggagttgtgtgggtctgttttgcatcatcgttgaggggatttygcgttctcagcaggggtggatgtgtgtttgtgagcagctgcgagtgtgggtccacattgtgtgctggtgttttcaggggagggggacagggtgcgtccat

SEQ ID NO: 48529 - DNA, 201 bp, Homo sapiens
cgtgtgtgtttcttacatatgaggcagatgagttgagttgtttctgggttgcactgtgatcagtgcatgtgtcgctggtattctgagcatgtttgtctacrtggtgtgcatccagcatgcttcctgtggttctcagtgtttgtctgtgtgagggagggctgtacttcggggctgtgtgtccatctcagggactggtgttcc

SEQ ID NO: 48530 - DNA, 201 bp, Homo sapiens
ggcacccaggcccgatgggtggctcagccccgtcgggacaagtctgcccccgcctgtggccgaccgcaggggcagggcagggggtttggggctccccgctycctccccctgccccgcccctgcctctgcaggcggcccggggccacagagggaagtcgtggggggagcctgggttccggctggagccccagcttcctgtcc

SEQ ID NO: 48531 - DNA, 201 bp, Homo sapiens
gcgtggagtgctgagggactctgcctccaacgtcaccaccatccacaccccggacacccagtgatgggggaggatggcacagtggtcaagagcacagactytagagactgtcagagctgaccccagctaaggcatggcaccgcttctgtcctttctaggacctcggggtccctctgggcccagtttccctatctgtaaatt

SEQ ID NO: 48532 - DNA, 201 bp, Homo sapiens; identical to SEQ ID NO: 8984

SEQ ID NO: 48533 - DNA, 201 bp, Homo sapiens
cactggaggaagtgcttaatctgtgttagtgattatcatgactatttgtgttgttattaacacagtgggtgcaagggagacccagatggagatagggctgrgggggcaacctagggtgacacacgcacctggggaggaggggcatgtggcttctatggtggtagcccctccctgcccctgacgcgtctctcctgcctgcag

SEQ ID NO: 48534 - DNA, 201 bp, Homo sapiens
ggactagcaaggcaggcagagggaacagcagatgcaggagccccgaaataagactgtctgaggaacagacaggacgccagtgtggctggagtggagtaggygtgagagagggagttgagatcagccagatttgatagcaccttgtggctcacggtgaggacttgggcatttgccgtgagatggagccaggttcagagcaga

SEQ ID NO: 48535 - DNA, 201 bp, Homo sapiens
aatagaaaaaaaaagaagaaatgaagtgaaggaacaagctggagtgggtatctgtgggactagcaaggcaggcagagggaacagcagatgcaggagccccraaataagactgtctgaggaacagacaggacgccagtgtggctggagtggagtaggcgtgagagagggagttgagatcagccagatttgatagcaccttgt

SEQ ID NO: 48536 - DNA, 201 bp, Homo sapiens
aaggctgaggcaggagaatcgcttgaacctgggaggcggaggttgcagtgagccgagatcatgccactgcactccagcctggcagacagagtgagactctstctcaaaaaaaaaaaaaaaaaaaaaatagaaaaaaaaagaagaaatgaagtgaaggaacaagctggagtgggtatctgtgggactagcaaggcaggcaga

SEQ ID NO: 48537 - DNA, 201 bp, Homo sapiens
ggaaggctgaggcaggagaatcgcttgaacctgggaggcggaggttgcagtgagccgagatcatgccactgcactccagcctggcagacagagtgagactstgtctcaaaaaaaaaaaaaaaaaaaaaatagaaaaaaaaagaagaaatgaagtgaaggaacaagctggagtgggtatctgtgggactagcaaggcaggca

SEQ ID NO: 48538 - DNA, 201 bp, Homo sapiens
gtcacttggatattttggaaaggatggctcagaaaggtatctctgaggaggtgatgttcagtcatgtaactgatatttactagtacctactgcattccagrcactgctttaggagttaagggtccctgagtgaaggacatttgagctaaggtttaaatgaagtgaaggggccaggtgtggtggctcatgccagtaatccca

SEQ ID NO: 48539 - DNA, 201 bp, Homo sapiens
attgggaactgttatttttcctattctgatttaaattcctttattatggaaaatttcaaatgtatacaaaagcaatgaagataatgaatgcccgtaaactmtcatccagcgtcatcggtaattaagattttgccccatttcaaatgcagacatttttatattttcttgcataactgcaataccgtattgcactaaatggaa

SEQ ID NO: 48540 - DNA, 201 bp, Homo sapiens; identical to SEQ ID NO: 8995

SEQ ID NO: 48541 - DNA, 201 bp, Homo sapiens
aatagatattgggaactgttatttttcctattctgatttaaattcctttattatggaaaatttcaaatgtatacaaaagcaatgaagataatgaatgcccrtaaactctcatccagcgtcatcggtaattaagattttgccccatttcaaatgcagacatttttatattttcttgcataactgcaataccgtattgcacta

SEQ ID NO: 48542 - DNA, 201 bp, Homo sapiens
taatagatattgggaactgttatttttcctattctgatttaaattcctttattatggaaaatttcaaatgtatacaaaagcaatgaagataatgaatgccygtaaactctcatccagcgtcatcggtaattaagattttgccccatttcaaatgcagacatttttatattttcttgcataactgcaataccgtattgcact

SEQ ID NO: 48543 - DNA, 201 bp, Homo sapiens
gtcgcagggtgttgagtgacaggaggctgcttagccacatgggaggtgctcagtaaaggagagcaattcttacaggtgtctgcctcctgacccttccatcyctcaggtgtcctgttgccccctcctcccactgacaccctccggaggcccccatgttgacagaccctcttctcctaccttgtttcccagcctgactctcct

SEQ ID NO: 48544 - DNA, 201 bp, Homo sapiens
acttgaagttgggttcaagcgattctcctgcctcagactccccagtagctgggattacaggtgcccgccaccaggtccagctaatttttgaatttttagtraagacagggtcctcaagtctgcctgccctagcctcccaaagtgccgggatgacaggcgtgagccaccgtgcctggctggccccaccaatctatgagcaga

SEQ ID NO: 48545 - DNA, 201 bp, Homo sapiens
ttggtcaatgctgagtcccaagcacacagcacaggcttcggcacattgtaggagcctagaaaacatcattcactcattcattcaagagattgatgctggcygggtgcagtggctcatgcctgtaatcccagcacttcgggaggccagggcaggaggattgcttgagcccagcctgggcaacatagtgagacctctgtctct

SEQ ID NO: 48546 - DNA, 201 bp, Homo sapiens
cttcatctttgtaaagtgctttagatagcatctggtaaatagcgctgttttgtggttttttgttgttgttgtttttgagacagagtcttactctgtcaccmaggctggagtgcagtggcgcaatctcggcacactataacctctgcctctcaggttcaagcgattctcatgcctcaacctcccaagtagctgggattagag

SEQ ID NO: 48547 - DNA, 201 bp, Homo sapiens
cctgtctctgggctttgttaccggctgtttccctgccagaaaatcagccctgctcccaggctccttcaccaccagatcttagcgccatcagcccagcaacsctgtcaatgaacaaattgaggtcttttttgagacagagtctcgctctgttgcccaggctggagtgcagtggcgtgatctcggctcactgcaacctccgcc

SEQ ID NO: 48548 - DNA, 201 bp, Homo sapiens
ggaggggaaactgtgggctcagcaccttcctctggccgcgtgcgcactgcccctgccctgccaccctggcacccaggcccgatgggtggctcagccccgtygggacaagtctgcccccgcctgtggccgaccgcaggggcagggcagggggtttggggctccccgcttcctccccctgccccgcccctgcctctgcaggcg

SEQ ID NO: 48549 - DNA, 201 bp, Homo sapiens
ccagatggagatagggctgggggggcaacctagggtgacacacgcacctggggaggaggggcatgtggcttctatggtggtagcccctccctgcccctgaygcgtctctcctgcctgcagctccacggagaagaactgctgcgtgcggcagctgtacattgacttccgcaaggacctcggctggaagtggatccacgagcc

SEQ ID NO: 48550 - DNA, 201 bp, Homo sapiens
gcttctgtggctcttggaaaggctttatcttgcctctaggttatccggtgccacttgaagttgggttcaagcgattctcctgcctcagactccccagtagstgggattacaggtgcccgccaccaggtccagctaatttttgaatttttagtaaagacagggtcctcaagtctgcctgccctagcctcccaaagtgccggg

SEQ ID NO: 48551 - DNA, 201 bp, Homo sapiens
tcattatcacccctcagtaggatcgaaattgttatgtgtgtttcaggatgcgctcctggagggtacccttggccccatcttaatccttggactaggcttgwaaatatggggtgagaatcgtaataaaatgatattgaagacttatcccgtgctcactatgctcattacccattcatggattaatgggttaatggattagtg

SEQ ID NO: 48552 - DNA, 201 bp, Homo sapiens
atggtggcacatgcctgtaatcccaggtacttgagaggctgaggcaggagaattgcttgaacccgggagacggaggttgcagtgagctgagatcacaccaycgcactccagcctgggcaacaggagggaaactccatctcaaaaaaaaaaaaagattccggacactagttcttccccttttgtgagttcagaacttcctgt

SEQ ID NO: 48553 - DNA, 201 bp, Homo sapiens
gactcaatttctgtgtctctcatcgctttttaaaaacctacacaacaaatttacgtatagcaaagtatattgtaaacaaatttaatgaccaaatgatagaytggtaaaaaatgtgcctatcaccaagggctgatacctttcctgtggcccaggccctctgctctttaaaaatggggcacaaatacaggcaggtaagagaca

SEQ ID NO: 48554 - DNA, 201 bp, Homo sapiens
tcacctgaggtcaggagtttgagaccagcctgaccaacatggtgaaacccagcctctactaaaaatacaaaaaattagccaggcatggtggcacatgcctrtaatcccaggtacttgagaggctgaggcaggagaattgcttgaacccgggagacggaggttgcagtgagctgagatcacaccatcgcactccagcctggg

SEQ ID NO: 48555 - DNA, 201 bp, Homo sapiens
ggctgcagtggctcacagctataatcccaccactttgggaggccaaggcaggaggattgcttgagcctaagagttggagaccagcctgggcaatatggtgmaaccccatctcccaaaaaaaaaaatatgaaaagtagctgggcctggtggtgtgtaccttttgtcccagctactcaggaggctgaggtgggaggttggctt

SEQ ID NO: 48556 - DNA, 201 bp, Homo sapiens
cattctgggtttccagtggccgccagtgaggctccaacctggatatcccagccgggcttcccagagtgtgggagacagaggagatggggggcacggggggsgggccaagacacacagcagcgagagggaaagggcaaagtgaggagaggacagagccccccagagggagactccagcagagaaagggatggggaaacgagg

SEQ ID NO: 48557 - DNA, 201 bp, Homo sapiens
tctatatatagttgaccctgaatatatatacagagagagagagagatgattttgtagattttgaaaaaagtcctaagagaggccaggtatggtagctcacrcccgtaatcccagcactttgggaggctgaggcaggtggatcacttgaggtcaggagttggagaccagcctggccaacatggtgaaaccctgtctgtacta

SEQ ID NO: 48558 - DNA, 201 bp, Homo sapiens
gaacttattgtgtgcgtgattccaagctttgtggcgtgagctgcgtctggcatgggtgttctgggggcctgtgtgctgtttggtatggatggtcttgtctrtgtgtgtccccagcacgtgttagctccgtgtgtttgtggctgcgctgcatttctggggtgtgcgtctgcattttgtatttctgctgggcaagctgttgta

SEQ ID NO: 48559 - DNA, 201 bp, Homo sapiens
tgattctcttgcttcagcctcccgagtagctgggaccacaggtgcccaccgccacgcccagctaattttttgtattttagtagagatggggtttcaccgtrttgcccaggctggtcttgaactcctgaggtcaggcaatccgcccacctcagcctcccaaagtgctaggattacaggcatgagccactgctcccggccgaa

SEQ ID NO: 48560 - DNA, 201 bp, Homo sapiens
cattacaaagggagatagccagccatgtcagcctccgtagggagggacccaatgttgcctaggaagtcttggcaaaaaatcaaacctgaaggccaggtgcrgtggctcatgcctgtaatcccagcactttgggaggccaaggcaggcagatcgcttgagcttaggagttcaagaccagcttgtgcaacatgttaaaaccct

SEQ ID NO: 48561 - DNA, 201 bp, Homo sapiens
gggtttcaccatgttggtcaggctggtctcgaactcctgacctcgtgatccacccgcctcggcctcccaaagtgctgggattacaggcatgaaccactgcrcccggccacaaattgaggtcttgagtgccaacagctcctgacattacaaagggagatagccagccatgtcagcctccgtagggagggacccaatgttgcc

SEQ ID NO: 48562 - DNA, 201 bp, Homo sapiens
tgatcatctgaccttattcctcccttgcttaaaatattttggtcctgtctctgggctttgttaccggctgtttccctgccagaaaatcagccctgctcccrggctccttcaccaccagatcttagcgccatcagcccagcaacgctgtcaatgaacaaattgaggtcttttttgagacagagtctcgctctgttgcccagg

SEQ ID NO: 48563 - DNA, 201 bp, Homo sapiens
ccttcttaatgaagcttccttgatccccttcttgctaaagcggtatccccaccctcaccctacccagctctgttttccctcacagcaattaccaccatctratctaccctataatttgcttatttactacattcgttgtctaggatatcagcttcacgggggcaggaatttttgtctgccatccatgttcatgtctgccgt

SEQ ID NO: 48564 - DNA, 201 bp, Homo sapiens
aatctaagaaagctgaaatgttggattcctagaaagttgaaatggagagttagaatgttgtaaatttagagtgatcatctgaccttattcctcccttgctyaaaatattttggtcctgtctctgggctttgttaccggctgtttccctgccagaaaatcagccctgctcccaggctccttcaccaccagatcttagcgcca

SEQ ID NO: 48565 - DNA, 201 bp, Homo sapiens
aacccagagaggaaaagactgggcctggggtctccagtgagtatcagggagtggggaatcagcaggagtctggtccccacccatccctcctttcccctctstctcctttcctgcaggctggccccggctccatttccaggtgtggtcccaggacagctttggccgctgccagcttgcaggctatggattttgccatgtgcc

SEQ ID NO: 48566 - DNA, 201 bp, Homo sapiens
gtcttgaactcctgacctcaggagatccacccgccttggcctcccaaagtgctgggataacaggcgtgagccaccgtgcccagccggaatcattagaaatkacttctaagttactgagaattcagggtgtcaaatttgcagaaccgtatgctcagtaaaccccagaatgtttgcagcagaattttattttatttattatta

SEQ ID NO: 48567 - DNA, 201 bp, Homo sapiens
ggggtttgctccttccttcctcttcctccaggggctgggtgagctgcactctcagactggcttccctctcgccactcctacaggggaaattgagggctttygccttagcgcccactgctcctgtgacagcagggataacacactgcaagtggacatcaacggtgaggcctgcttccccggccatgcccagttgtgacgtgt

SEQ ID NO: 48568 - DNA, 201 bp, Homo sapiens; identical to SEQ ID NO: 8998

SEQ ID NO: 48569 - DNA, 201 bp, Homo sapiens
gggtttgctccttccttcctcttcctccaggggctgggtgagctgcactctcagactggcttccctctcgccactcctacaggggaaattgagggctttcrccttagcgcccactgctcctgtgacagcagggataacacactgcaagtggacatcaacggtgaggcctgcttccccggccatgcccagttgtgacgtgtg

SEQ ID NO: 48570 - DNA, 201 bp, Homo sapiens
gggattacggctatccaggtacccaggctggggcaggagaatcactggaacctcgggggtggaggttgcagtgaaccgagatcgcgccactgcactccggsctgggcaatgatgcgagactccatctaaaaaaaaaaaaaaaaaaaaagaaagaaagtgtcagtttgaacctcttgagtgatggctcagaactttggaatg

SEQ ID NO: 48571 - DNA, 201 bp, Homo sapiens
caggtgtggtggctggcacctgtaatcccagctactcggctgggattacggctatccaggtacccaggctggggcaggagaatcactggaacctcgggggkggaggttgcagtgaaccgagatcgcgccactgcactccggcctgggcaatgatgcgagactccatctaaaaaaaaaaaaaaaaaaaaagaaagaaagtgt

SEQ ID NO: 48572 - DNA, 201 bp, Homo sapiens
atgctgggattttattaatagaaagtggcagcaggctgggcgcggtggctcacgcctataattccagcactttgggaggctgaggtgggcggatccctgasgtctggagttcaagaccagcctggccaacatggtgaaaccccatctctattaaaaatacaaaaattagccaggtgtggtggctggcacctgtaatcccag

SEQ ID NO: 48573 - DNA, 201 bp, Homo sapiens
taccagtgttggcagattggagtccttgaatattgggctcacagtggtagaattctgttttgaaatattcacatccacaaatgttggagttggagaaagcmgaatattggtatctcagcatgttggaactcagtgttggaatgttagaatattagaatgctgggattttattaatagaaagtggcagcaggctgggcgcgg

SEQ ID NO: 48574 - DNA, 201 bp, Homo sapiens
agactccatctcaaaaaaaaaaaaaattagccatgcgtggtagcacgcgcctgtggtcccagctactcgggaggctgagatgggaggattgcttgggcctkggagattgaggctgcgagaccttgtctcaaaaaaaaaaaaaaaaaaaaagagagagctgcagtgagagggcagagtggggtgggtgggggaggcaggaag

SEQ ID NO: 48575 - DNA, 201 bp, Homo sapiens
tcggcacattgtaggagcctagaaaacatcattcactcattcattcaagagattgatgctggccgggtgcagtggctcatgcctgtaatcccagcacttcrggaggccagggcaggaggattgcttgagcccagcctgggcaacatagtgagacctctgtctctacagagaatttaaaaagtagccgtgtaggccggatgc

SEQ ID NO: 48576 - DNA, 201 bp, Homo sapiens
aaaaagaaaaaatagggattagggagcaggtgggcactgggaggagtgtcctgggctgttcgacaaaggcctagaaggagctcatctgtcttggtcaatgmtgagtcccaagcacacagcacaggcttcggcacattgtaggagcctagaaaacatcattcactcattcattcaagagattgatgctggccgggtgcagtg

SEQ ID NO: 48577 - DNA, 201 bp, Homo sapiens
cagtgcatgtgtcgctggtattctgagcatgtttgtctacgtggtgtgcatccagcatgcttcctgtggttctcagtgtttgtctgtgtgagggagggctrtacttcggggctgtgtgtccatctcagggactggtgttcccagcctgtgggtgctgtgagcaggtgctaaggtggtgtctgcatgctgtgttcccacatg

SEQ ID NO: 48578 - DNA, 201 bp, Homo sapiens
ttgagaggccgaggtgggtggatcacctgagatcgggagttcgagaccagcctgaccaacatggagaaaccccgtctctactaaaaatacataattagctsggcgtggtgatgcatgcctgtaatcccagctactcgggaggctgaggcaggagaattgcttgaacccaggaggtggaggtttcagtgagccaagatcgtg

SEQ ID NO: 48579 - DNA, 201 bp, Homo sapiens
agagatcttgtcaaggccccaccaggcaggaatgacctagaatgatcaagaatgggatggggaggcaccagcagggaggacaaggctgggacagggaggcmtgcaggatgggggaacgccctaagtgctgttgggagcccagagaaggcacctggacccatctggggagtctaggagggcttgctgggtgagggtgattgt

SEQ ID NO: 48580 - DNA, 201 bp, Homo sapiens
ctgtctggtttctggcagggcccatggtgcccctatctctctccctcacctccctctcatttatgcttttattcaataattgcccacaggttcctgctgtrtgcctggccatgtgctgggtggtgtgggggacatagtgataaccaagacagccctcagttctgccctcatggggcccacagtcacttctggacacctaag

SEQ ID NO: 48581 - DNA, 201 bp, Homo sapiens
tgtccacgctgagtggggcttagcatttcaccaatgaggaaacaggcctcgagaaggcaagaaaacaccttcggctgagctgtgtgaaggtgacttgaccrcagcctgagctttttctccacccctcctctcatgggtactgttggggaggatgggtgccacaggaccacacaggtggctgtctgagagggtagtgcctgg

SEQ ID NO: 48582 - DNA, 201 bp, Homo sapiens
gcaggggccagagggagatgagctatgaagacccacagagtgaagtaacagagggatgggggtgaaggggagaagagagacagggagatggaaggaaaaaygcagaaatggagagacaaaatgagagagacagatacagacacagagttaggccaaggagagacaaagacagatacacaacaaggcaagaggcgaagatga

SEQ ID NO: 48583 - DNA, 201 bp, Homo sapiens
tcccctgactcccacaccaaagcagggttcactaccggccgccgaggtgacctggccaccattcatggcatgaaccggcctttcctgcttctcatggccaycccgctggagagggcccagcatctgcaaagctcccggcaccgccgagccctggacaccaactattgcttcaggtgagccttgtagcctggatggaggcct

SEQ ID NO: 48584 - DNA, 201 bp, Homo sapiens
tttgaacccagatacttggttccagagtccatgcttcgtaacccctaccagtagatgccacagagaaacagtcctatagccacagcggcatccccttcccratggctgcctcccacccctctatgtcccggctctcactgcaggggcggcatggaagctcctgtcaggcgtgcgggagggccaaacgcaagtggacacccc

SEQ ID NO: 48585 - DNA, 201 bp, Homo sapiens
ttttttttttgagacagagtctcactctgtcaccctggctagagtgcagtggtgcaatctcggctcactgcaacctctgtgtcttgggttcaagtgattcycctgcctcagcctcctgagtagctgggattacaggcgtgtgccaccacgcctggctaatttttgtatttttagtagagacgaggtttcactttgttggcc

SEQ ID NO: 48586 - DNA, 201 bp, Homo sapiens
tgcatgctgttacgtgcctgtagttccagctgcttgggagactgaggtgggagaatcacctgagcctgggaggtcgaggctgcagtgagccataatcacastactgcaatccagcctacatgaaagagtgagatcccatctcaaaaaaaaaaaaaaaaaaaaaagattccaggcaaagggaacagcctgtgcaaaggcctg

SEQ ID NO: 48587 - DNA, 201 bp, Homo sapiens
ggcgtgagccactgcgcccggcccagaatgttagcagcagaattttagcattgtgggctgtccacgctgagtggggcttagcatttcaccaatgaggaaayaggcctcgagaaggcaagaaaacaccttcggctgagctgtgtgaaggtgacttgaccgcagcctgagctttttctccacccctcctctcatgggtactgt

SEQ ID NO: 48588 - DNA, 201 bp, Homo sapiens
agtaatgtgaataggtaataatattaatatgcagtctaaatactgacttttcatcattccataacctggactgatgaaaagtcagtatttagactgcatawtaataaaataaaattcattcctgtattcattccaagagtactaattgacacttatgaagggacaggcaattctaggccctagagggccaaagacagagga

SEQ ID NO: 48589 - DNA, 201 bp, Homo sapiens
gagtaatgtgaataggtaataatattaatatgcagtctaaatactgacttttcatcattccataacctggactgatgaaaagtcagtatttagactgcatwttaataaaataaaattcattcctgtattcattccaagagtactaattgacacttatgaagggacaggcaattctaggccctagagggccaaagacagagg

SEQ ID NO: 48590 - DNA, 201 bp, Homo sapiens
aaacatagcaagcagccacagtataggcagccagaattcaggaaggctccagggacccctgggcttggcccagaaaaatgcctcagagtagtaccaggtgytgggaagctgctacagaagactagccattccctgcctccaccttgcctgccaaaaggaaagtcagaggactcaagggatccagggatcaagggatccagg

SEQ ID NO: 48591 - DNA, 201 bp, Homo sapiens
ccaaacatagcaagcagccacagtataggcagccagaattcaggaaggctccagggacccctgggcttggcccagaaaaatgcctcagagtagtaccaggygctgggaagctgctacagaagactagccattccctgcctccaccttgcctgccaaaaggaaagtcagaggactcaagggatccagggatcaagggatcca

SEQ ID NO: 48592 - DNA, 201 bp, Homo sapiens
ggagaacctctgctagggcaatgcagaaggaaaatgtgggttggagcccccatacagaatctctatgggggcactgcctagtggagctgtgagaagacggycaccgtcctccagacccctgaatggtagatccaccgacagcttgcgccatttatccggaaaagccacagacactcaacgccagcccgtgaaagcagccag

SEQ ID NO: 48593 - DNA, 201 bp, Homo sapiens
ctacccgggagctgcagctataggaaggaaggaaggaaggaagacctccaaggaactgtgtagcagaggtgcagtgcaaagagaattttgataaaaaatcyaggaaagctccaatactttcccccttccttgcctaacgggcatgcaggcactccaatccccagccaaacagggcactgggcaaggccggccacccatctg

SEQ ID NO: 48594 - DNA, 201 bp, Homo sapiens
ggaaccgggagcagaggacctcagattcacaccagggcaggaggcaatggcctggctgaagccttcacaatcttcccaatatactctgctgccttcctttrtaaggatccatttctgaaaccctgtgccctggccaggcacggtggctcacacctgtaattccagtactttgggaggccaaggcaggaggaccacgaggtc

SEQ ID NO: 48595 - DNA, 201 bp, Homo sapiens
aaagaggtttaatggactcaccgttccacatggttggagaggcctcacaatcaaggcaggtcttacatggcagcaggcaagagggagaatgagagccaagygaaaggaatttccccttaaaaatccccttataaaaccatcagatctcgtgagacttactcactaccacaagaacagtatgggggaaaccacctctatgat

SEQ ID NO: 48596 - DNA, 201 bp, Homo sapiens
catcccagcagctaggaaccgggagcagaggacctcagattcacaccagggcaggaggcaatggcctggctgaagccttcacaatcttcccaatatactcygctgccttcctttataaggatccatttctgaaaccctgtgccctggccaggcacggtggctcacacctgtaattccagtactttgggaggccaaggcagg

SEQ ID NO: 48597 - DNA, 201 bp, Homo sapiens
gtagatgtggagaccatgatttttgcaaatttttttaagtttaaagttatttctaaattagaagtttaaaaagaagaaatcacataagccataacacaatrgaaagatgtctttaaagttcaaggcaggagggatgtctggaaatcagcgagaaatttgcacctgtgtgtgcatgtgcatatgtgtgtgtgtatgttgcaa

SEQ ID NO: 48598 - DNA, 201 bp, Homo sapiens
atgaaaagaacatattttcacttggatatggcctgttttgaattgtggatactatttcacagaagaaagaccaatgtggatatcatcacccatccagccaygtggcagtgtgcactcaagagagatccatataagtgccacatcagatggaaatatagttacaaacttgtatacccagtcacaagttaaaaaagcaactgt

SEQ ID NO: 48599 - DNA, 201 bp, Homo sapiens
aaaattcattcctgtattcattccaagagtactaattgacacttatgaagggacaggcaattctaggccctagagggccaaagacagaggactaactctawctgacattcttaagtcaccttgtttgtgttcaattagtcagatttgtttgtggaaaaatagtagaaagaggaataaagtagcatccagtccaatttccca

SEQ ID NO: 48600 - DNA, 201 bp, Homo sapiens
ccatactgttcttgtgatagtgaataagtctcacaagatctgatgcctttattgggggtttctgcttttgcgtcttcctcattttctcttgccgccaccasgtaagcagtgccttttgcctcccaccatgattctgaggcctccccagccacgtggagctgtaagtgcatttaaacctctttctcttcccagtctcgggta

SEQ ID NO: 48601 - DNA, 201 bp, Homo sapiens
caagccctttttactcttccttccatctaaaacatctgatggggaccaggtaaacagcatgcactacagctacccatgggggttaaacagaatataagcaygaactttgtcccagggtgaaaaggaaaatcgtaaatatccctgatcttccttaggcagttattttctgtcacagaaacagaaaagactatattcagagaa

SEQ ID NO: 48602 - DNA, 201 bp, Homo sapiens
gcatttaaacctctttctcttcccagtctcgggtatgtctttatcagcggcgtgaaaatggactaatacactgtggttatgtattatagtcatatgatatkttcatatttttggaagctgggtgaagggtagatgtggagaccatgatttttgcaaatttttttaagtttaaagttatttctaaattagaagtttaaaaag

SEQ ID NO: 48603 - DNA, 201 bp, Homo sapiens
gtattttacgttctgcgactgtgataaatatatgatgccagggatccatcagcaaacaaaacaggcaaaattagtctgccctcatgcagcttacattctaktgaaggaagacaaagagtaaattaaaaataggtaataatgcagggaaggggacaagaagcatcatcaggatgcagatggaggttagacaaggcctctcca

SEQ ID NO: 48604 - DNA, 201 bp, Homo sapiens
gtctttaggaagaaagggggaaagatagagaaaactatttctccatttgctgtttcttaattaccttcagttcaaaaataatttttatatcagaaaggcayatttagaggtatgttagtttattttcacactgctaataaagacatacccaagactgggtaatttataaagaaaaagaggtttaatggactcaccgttcca

SEQ ID NO: 48605 - DNA, 201 bp, Homo sapiens
gtgggttggatgccactttcgcagagctggcaccagacttacaaagccccggcaggggaagccactttacaaccagccaggccacacccccagggcagacrtttatgtagagagtaatgtacctgcctgctagtagcctctgcattgtggggccttctctcagaaccacactaaacagtgggtgggtgagaagtgtcactc

SEQ ID NO: 48606 - DNA, 201 bp, Homo sapiens; identical to SEQ ID NO: 9023

SEQ ID NO: 48607 - DNA, 201 bp, Homo sapiens
gaaggagggggacttctgagccacaccctggggtccagggctcacagccttaggagcaaaatcgtccacccccttcctggttcctcggtgctgcagagatwttcataggacagagtctgagttctggccacttaacagaggaagaaaggctggctcggtgaggttaacttacatcccagcagctaggaaccgggagcagag

SEQ ID NO: 48608 - DNA, 201 bp, Homo sapiens; identical to SEQ ID NO: 9024

SEQ ID NO: 48609 - DNA, 201 bp, Homo sapiens
caaattaattcttgtggattacatcttgttcaaaggtactttgataatgttctgctctcccaaggccacagggccctacgattgtctctccctttcctttygttaggccagcatatgattaacgctacgtgattttctatgaatgtgttttcacgtttcaaaaacagattgatacacatattgaacagtgccagacgctgt

SEQ ID NO: 48610 - DNA, 201 bp, Homo sapiens
tttataaaataaattctctaggaaataaagaaaatcatcaatctattatttttaaggtatttatagctcaaagttaccagaaatctttgtggaattttcaytgccaaatttaaatttgggaatgtccgggtacaacatattgtcaccacaatccggagggccgccaaaatcgcagacggctatttgcatcctttcagtgtg

SEQ ID NO: 48611 - DNA, 201 bp, Homo sapiens; identical to SEQ ID NO: 9025

SEQ ID NO: 48612 - DNA, 201 bp, Homo sapiens
cataacaaaatatttacttatatatattaaaaaagagagtctgagaagtctgaaaagttttgccataaacggtctccaccagcctcaactctgagtgcccraggattcagtctcaagtccagcaacattgtgaagcaggaaatttaccttgaaaggagctatgtactctaagtagtgatttacctgtctgcctcccccact

SEQ ID NO: 48613 - DNA, 201 bp, Homo sapiens
acaccagggcaggaggcaatggcctggctgaagccttcacaatcttcccaatatactctgctgccttcctttataaggatccatttctgaaaccctgtgcsctggccaggcacggtggctcacacctgtaattccagtactttgggaggccaaggcaggaggaccacgaggtcaggagtttgagaccagcctggccaatat

SEQ ID NO: 48614 - DNA, 201 bp, Homo sapiens
attagggaacgcctttcctagttggaacgagaagacgagaagtgagagaagtgagatagaaggctccctctctattatttgagcaagaacaatgcttttcraagagggaatttctgcaatgagttcttctcttacttgttcagggaaatggttgaccccatttgaccctgtcttcaccgaagtcgacactttccacctgga

SEQ ID NO: 48615 - DNA, 201 bp, Homo sapiens
agtaattatataggtacatcactcatatcacatcttgtttctgtaaaaaagggcctcccaaacatagcaagcagccacagtataggcagccagaattcagkaaggctccagggacccctgggcttggcccagaaaaatgcctcagagtagtaccaggtgctgggaagctgctacagaagactagccattccctgcctccac

SEQ ID NO: 48616 - DNA, 201 bp, Homo sapiens
cagcttgaaaaccttttaggagcaccagctcagctcaagaattagtagcataaattacatgctcaataaagatttgatgcatgagtgcatcctgagtccaygcccggaatgtgtttcacatattccacaatacttcacattgggttcctgaggtctcctggtattgtttaagactcctgtggcagtccctggtgcaacccc

SEQ ID NO: 48617 - DNA, 201 bp, Homo sapiens
ttaaaaccatctctatcctctcctctccacaggaagtcttgcagctgaagggaggcactccttggcctccgcagccgatcacatgaaggtggtgccaagtmtcctgctctccgtcctcctggcacaggtgtggctggtacccggcttggcccccagtcctcagtcgccagagaccccagcccctcagaaccagaccagcag

SEQ ID NO: 48618 - DNA, 201 bp, Homo sapiens; identical to SEQ ID NO: 9042

SEQ ID NO: 48619 - DNA, 201 bp, Homo sapiens
tgatagcgatatggacaataaggtccaggctgaggtggtctcatatcgagatgaggaacttgttgggaactggagcaaaggtgactcttgttatgttttascaaagagattggtggcacttttcccctgccctagagatttctggaactttgaacttgagagagatgatttagggtacctggcagaagaaatttctaagca

SEQ ID NO: 48620 - DNA, 201 bp, Homo sapiens
atattatacctcctagggaatctaatttgaaatatgaaaagtttaacatcagctgtcattatgtctctctttctgctcattaacaacaacaaaaaaaaaaacccaaaatttaaaaacaaagccccagccactgctttagcttttgtgtaccaatcacattatctcctgctgcctttgttttgcctccttcatcaagcagtt

SEQ ID NO: 48621 - DNA, 201 bp, Homo sapiens
ttaaatatactttttaatgttccctcacatttgctttaagaagttcctaagacactcagtttcagatttcccaagtacacaggcatgacagaaaaacgcasaccaataaaaaatgtaacttaccttacacaaatacatacacacaaattcagggtttccaaccgagcgggggaaatcttaacattgtagaagtcttcacta

SEQ ID NO: 48622 - DNA, 201 bp, Homo sapiens
tatgtgtgtatatatatgtatatatgtatgtgtgtataaatgtatatgtgtgtatatgtgtgtgtgtatatatatatacacacacatatatatatatatgsagagagacatacatatatatatggagagagagagagagagagtcctgtaacttctgattcatactttttggtcctagttctatctctaaaacttctaaga

SEQ ID NO: 48623 - DNA, 201 bp, Homo sapiens
tatatgtatatatatatatgtgtgtatatatatgtatatatgtatgtgtgtataaatgtatatgtgtgtatatgtgtgtgtgtatatatatatacacacayatatatatatatatggagagagacatacatatatatatggagagagagagagagagagtcctgtaacttctgattcatactttttggtcctagttctatc

SEQ ID NO: 48624 - DNA, 201 bp, Homo sapiens
ctgcaggacaagctccaagaacaggaaggtaagactcagcatttggaggtggtgacatctagttggcgtgctgggctaatttcctgaccattgtacagggrgaagtaaccttgaattcaggagtattctgtgtggtcttaatgtagaaagtagcactaaatgatgccacgtaatcgttttagctcaggctcctctaacaaa

SEQ ID NO: 48625 - DNA, 201 bp, Homo sapiens
ctcttcatgcttccagtgacatcaaactcaccatttctttgaagagctgcccaatccacaaatagctaaaattgttatatgtatatatatatatgtgtgtrtatatatgtatatatgtatgtgtgtataaatgtatatgtgtgtatatgtgtgtgtgtatatatatatacacacacatatatatatatatggagagagaca

SEQ ID NO: 48626 - DNA, 201 bp, Homo sapiens
tttactatccacaaagacattttaggaggcattaaaaccatctctatcctctcctctccacaggaagtcttgcagctgaagggaggcactccttggcctcsgcagccgatcacatgaaggtggtgccaagtctcctgctctccgtcctcctggcacaggtgtggctggtacccggcttggcccccagtcctcagtcgccag

SEQ ID NO: 48627 - DNA, 201 bp, Homo sapiens
tctcttcctcttcatgcttccagtgacatcaaactcaccatttctttgaagagctgcccaatccacaaatagctaaaattgttatatgtatatatatatawgtgtgtatatatatgtatatatgtatgtgtgtataaatgtatatgtgtgtatatgtgtgtgtgtatatatatatacacacacatatatatatatatggag

SEQ ID NO: 48628 - DNA, 201 bp, Homo sapiens; identical to SEQ ID NO: 9041

SEQ ID NO: 48629 - DNA, 201 bp, Homo sapiens
gtcagaggtgccaggcaaaggcttttctctaagctggagccaactatgagggaacgactgtgaattccgttcaggtccaggacaatgagaggagccagggrttgttaggaaacatttccctgctttcgtgtgcgattcccaatagggcctgcgagtggagctgcattttgctagctgggctagaggacggggaaaattttg

SEQ ID NO: 48630 - DNA, 201 bp, Homo sapiens
gaaggatggtatcatccctgggcgggctccaacgtgagggctgtgtggctgagcagtgcaaagacctccatcctacactccacagggactgtacatacagmttgggagctggagtggggtaagaggcgaattatagacacaaggggctcctctgcaggaaggaggccaagggaaagaggcttgaaaggcttgatatttcac

SEQ ID NO: 48631 - DNA, 201 bp, Homo sapiens
aagcagacctctccccctctgcttaaagtgctcagggagaaatttgaccctgaaatagaactggtttacagaggcatcatcatttatgttgaatacaactkgaatagttcatgaaattacaccacctttacaatgaaacaaacccctagacatcatctagcccaacttctccctccttgtggaaatcccctccatagccct

SEQ ID NO: 48632 - DNA, 201 bp, Homo sapiens; identical to SEQ ID NO: 9026

SEQ ID NO: 48633 - DNA, 201 bp, Homo sapiens
tgttcaaaggtactttgataatgttctgctctcccaaggccacagggccctacgattgtctctccctttcctttcgttaggccagcatatgattaacgctrcgtgattttctatgaatgtgttttcacgtttcaaaaacagattgatacacatattgaacagtgccagacgctgtcatttgaggcccttccctggtatcct

SEQ ID NO: 48634 - DNA, 201 bp, Homo sapiens
atttctggaactttgaacttgagagagatgatttagggtacctggcagaagaaatttctaagcagcaaagcactcaagatatgacttgggtgctgtcaaagcattcagttttataagggaagcagagcaaaaaagtttggaaaatttgcagcctgacaatgtggtagaaaagaaaaacccattttccgaggagaaatttaa

SEQ ID NO: 48635 - DNA, 201 bp, Homo sapiens; identical to SEQ ID NO: 9027

SEQ ID NO: 48636 - DNA, 201 bp, Homo sapiens
cctttcgttaggccagcatatgattaacgctacgtgattttctatgaatgtgttttcacgtttcaaaaacagattgatacacatattgaacagtgccagaygctgtcatttgaggcccttccctggtatcctatgtgcttgtagtccttattattttcagagcactctacatagctcccctctgacacttagaagcatagg

SEQ ID NO: 48637 - DNA, 201 bp, Homo sapiens
tccaacgtgagggctgtgtggctgagcagtgcaaagacctccatcctacactccacagggactgtacatacagattgggagctggagtggggtaagaggcraattatagacacaaggggctcctctgcaggaaggaggccaagggaaagaggcttgaaaggcttgatatttcacccaccaccactcactgccggagtaagc

SEQ ID NO: 48638 - DNA, 201 bp, Homo sapiens
ccctctctattatttgagcaagaacaatgcttttcaaagagggaatttctgcaatgagttcttctcttacttgttcagggaaatggttgaccccatttgaycctgtcttcaccgaagtcgacactttccacctggacaagtacaagaccattaaggtgcccatgatgtacggtgcaggcaagtttgcctccacctttgaca

SEQ ID NO: 48639 - DNA, 201 bp, Homo sapiens
cactcgctggctccgctcagacatttagcaaagcagacaccttcccaggcctggaggaaacagcccctgctttttgggaatccacaagcccgcagctgcaragctcgacctggatgggcaggcaaaggctgactcctgtgcgtggtgtgagtccagcctggcccctctacaccctcactttcacctcttaaagaactgcct

SEQ ID NO: 48640 - DNA, 201 bp, Homo sapiens
acctcaagttcacgtgggattatctgagcctagactgtcagtcctggggctgctttatttcatataaaaatataatatttatccaaggttttactacacaytgcattttctgtgaagacaatgaccgtgtaaatcagggaaagatctatattttattttgtttgaaactttaccaagcattatttaccatttcaaaagctc

SEQ ID NO: 48641 - DNA, 201 bp, Homo sapiens; identical to SEQ ID NO: 9028

SEQ ID NO: 48642 - DNA, 201 bp, Homo sapiens
gctcacacctgtaattccagtactttgggaggccaaggcaggaggaccacgaggtcaggagtttgagaccagcctggccaatatggtgaaaccccgtctcyactaaaaatagaaaaattagcgtggtggcaggcgcctgtaatcccagctactcgggaggctgaggcaggagaactgtttgaacctgggaggtggaggtct

SEQ ID NO: 48643 - DNA, 201 bp, Homo sapiens
gcgtgaaactgggctgcgtttacactgaaagagctatttacccaacgtttacaatacttgggtgacctgttgaatgcaggcttgccatttagagtcaaaaagagcttcctcaacagtgtcctttgggaaacacagtggaagtatttcactgcttctacaggggagagggtagtgccgttcagactgcagagtgaggccctg

SEQ ID NO: 48644 - DNA, 201 bp, Homo sapiens
aggagaactgtttgaacctgggaggtggaggtctcagtgagctgagacagacagtgcctgggtgacagacagagactccgtctcaaaaaaaaaaaaaaaaagaaagaaaccctgtgccctaagacctgcacactcgctggctccgctcagacatttagcaaagcagacaccttcccaggcctggaggaaacagcccctgct

SEQ ID NO: 48645 - DNA, 201 bp, Homo sapiens
agtctgcttttggtctcataggactgccctaacgcttgtttttcagacgtttaaccctgtaggtctctggacaaatttgctttagaagcccctcgatgtckccctgaagagtggctttcagaagttgtgcctcctgcctgaggggagttccaggaagggttctgcatcgcctatgagtttatctggatcaccagaggcctt

SEQ ID NO: 48646 - DNA, 201 bp, Homo sapiens
ctgcaaagcaacaacagcataataattgtatttaatatactactctttaaggtagaaaatggacctattctatattttaaatatactttttaatgttcccycacatttgctttaagaagttcctaagacactcagtttcagatttcccaagtacacaggcatgacagaaaaacgcagaccaataaaaaatgtaacttacct

SEQ ID NO: 48647 - DNA, 201 bp, Homo sapiens
gcaagaacaatgcttttcaaagagggaatttctgcaatgagttcttctcttacttgttcagggaaatggttgaccccatttgaccctgtcttcaccgaagycgacactttccacctggacaagtacaagaccattaaggtgcccatgatgtacggtgcaggcaagtttgcctccacctttgacaagaattttcgttgtcat

SEQ ID NO: 48648 - DNA, 201 bp, Homo sapiens
taattgtatttaatatactactctttaaggtagaaaatggacctattctatattttaaatatactttttaatgttccctcacatttgctttaagaagttcytaagacactcagtttcagatttcccaagtacacaggcatgacagaaaaacgcagaccaataaaaaatgtaacttaccttacacaaatacatacacacaaa

SEQ ID NO: 48649 - DNA, 201 bp, Homo sapiens
tttgcactgccacacaaatggtttttcacattatttcctttttccaggttttacaaagaacagtgattgaagttgatgaaaggggcactgaggcagtggcrggaatcttgtcagaaattactgcttattccatgcctcctgtcatcaaagtggaccggccatttcatttcatgatctatgaagaaacctctggaatgcttc

SEQ ID NO: 48650 - DNA, 201 bp, Homo sapiens
tactctaagtagtgatttacctgtctgcctcccccactggattgaccagttccttgggggctgagagaacaggtcctgaacatttctgctgtgccccccarcccacatcctcatagtgtccagtaccaggctggggactcaggaagcatccatgggatcccccagtgccttctttctcgaggtgttcagcacctagaacag

SEQ ID NO: 48651 - DNA, 201 bp, Homo sapiens; identical to SEQ ID NO: 9032

SEQ ID NO: 48652 - DNA, 201 bp, Homo sapiens
gggatcccccagtgccttctttctcgaggtgttcagcacctagaacagctcaagacaaattccccacaccccacccagacagagctgaatcttactggggmgaagccttgagttgcaaggcagaagctctcgtgatgggatttgggtcatattccgggttataggaggagctggggagtatgggaagcctcccacttggtc

SEQ ID NO: 48653 - DNA, 201 bp, Homo sapiens
cttgttcagggaaatggttgaccccatttgaccctgtcttcaccgaagtcgacactttccacctggacaagtacaagaccattaaggtgcccatgatgtayggtgcaggcaagtttgcctccacctttgacaagaattttcgttgtcatgtcctcaaactgccctaccaaggaaatgccaccatgctggtggtcctcatgg

SEQ ID NO: 48654 - DNA, 201 bp, Homo sapiens; identical to SEQ ID NO: 9034

SEQ ID NO: 48655 - DNA, 201 bp, Homo sapiens
cgggttataggaggagctggggagtatgggaagcctcccacttggtctttggttttccagaaactccaccatcacaagcaggatgttaatcagtaaccgtyccacaggggatcatactttggaatagcaaatatttgctgaaggttctgggctgcaaagctgaagctttggtttctgctctaaatgaaggacttttccagg

SEQ ID NO: 48656 - DNA, 201 bp, Homo sapiens
ttgttcagggaaatggttgaccccatttgaccctgtcttcaccgaagtcgacactttccacctggacaagtacaagaccattaaggtgcccatgatgtacrgtgcaggcaagtttgcctccacctttgacaagaattttcgttgtcatgtcctcaaactgccctaccaaggaaatgccaccatgctggtggtcctcatgga

SEQ ID NO: 48657 - DNA, 201 bp, Homo sapiens
agctagaaatattttccctgagtagaccactgtaaaagaatggcatgaactacatagtcaactgaaagactcattaatggaaataatcttaaagaacaaamattgtgacctttttggtgtccacagactagggctttgtctacatttcaccatcatctgttcttgtaccacagaaacatggaagttttctttccgaagttc

SEQ ID NO: 48658 - DNA, 201 bp, Homo sapiens
gacagcctggtctattctgctttaactctagcaggaaaggccttcatggtggggcctgaatatcttcctttataaaatcaaagcctggggacagggttacytacttctgaggttcaatctggctctaaaattatgcaacaaatgccattcctttagcacttccttcctaccgggcgagatactcaactccacaggcaccac

SEQ ID NO: 48659 - DNA, 201 bp, Homo sapiens; identical to SEQ ID NO: 9031

SEQ ID NO: 48660 - DNA, 201 bp, Homo sapiens
aaggcaggaggaccacgaggtcaggagtttgagaccagcctggccaatatggtgaaaccccgtctctactaaaaatagaaaaattagcgtggtggcaggcrcctgtaatcccagctactcgggaggctgaggcaggagaactgtttgaacctgggaggtggaggtctcagtgagctgagacagacagtgcctgggtgacag

SEQ ID NO: 48661 - DNA, 201 bp, Homo sapiens; identical to SEQ ID NO: 9037

SEQ ID NO: 48662 - DNA, 201 bp, Homo sapiens
aagccctttttactcttccttccatctaaaacatctgatggggaccaggtaaacagcatgcactacagctacccatgggggttaaacagaatataagcacraactttgtcccagggtgaaaaggaaaatcgtaaatatccctgatcttccttaggcagttattttctgtcacagaaacagaaaagactatattcagagaat

SEQ ID NO: 48663 - DNA, 201 bp, Homo sapiens; identical to SEQ ID NO: 9036

SEQ ID NO: 48664 - DNA, 201 bp, Homo sapiens
caggacccaaggccacacactggtaagaggcagtgggttacaggagaccttcaatgagtctaatcagggagggaccgggaaggatggtatcatccctgggygggctccaacgtgagggctgtgtggctgagcagtgcaaagacctccatcctacactccacagggactgtacatacagattgggagctggagtggggtaag

SEQ ID NO: 48665 - DNA, 201 bp, Homo sapiens
ctccctggggcagggctaacctacttgagccacaggaaggaggcagggtccctgaagaagcttttactatccacaaagacattttaggaggcattaaaacyatctctatcctctcctctccacaggaagtcttgcagctgaagggaggcactccttggcctccgcagccgatcacatgaaggtggtgccaagtctcctgct

SEQ ID NO: 48666 - DNA, 201 bp, Homo sapiens
ttcaaaggtactttgataatgttctgctctcccaaggccacagggccctacgattgtctctccctttcctttcgttaggccagcatatgattaacgctacrtgattttctatgaatgtgttttcacgtttcaaaaacagattgatacacatattgaacagtgccagacgctgtcatttgaggcccttccctggtatcctat

SEQ ID NO: 48667 - DNA, 201 bp, Homo sapiens
ggtaggaccactgtgaagaatttcaaggggctcatttaattcctcctttgcactgccacacaaatggtttttcacattatttcctttttccaggttttacraagaacagtgattgaagttgatgaaaggggcactgaggcagtggcaggaatcttgtcagaaattactgcttattccatgcctcctgtcatcaaagtggac

SEQ ID NO: 48668 - DNA, 201 bp, Homo sapiens
tgatcctataatgcatttatgcatttaaaagcacagagacacaagtcctcatatatgaagttgttatggttacagaaagaaaataaatatttgtgcacacrgagatagcatgaaatcattctacagtgaaaataatagcctctggaaaaagctttgaaaatcagagatggtgccatcaccagacaacacaagtgctggggt

SEQ ID NO: 48669 - DNA, 201 bp, Homo sapiens
actgctgatcccccaggcagcaggaagtgaggaggacagggaagctcagggccccgcacaactaatgtcctggggcccaagtgctgcatgaagggtttttscctctaggttttgaaagtgtgttttggtcttccagtgttccttaagaaaatgcccctcttctggaataagaagaaatcctaacgcaatgaggccctacaa

SEQ ID NO: 48670 - DNA, 201 bp, Homo sapiens
tatctaatcttcctggaaaccttgtgaggcggcactgcttgaacccgtcttacagcctttgaagggtcatgtggtgcccgtggccatgtgaccagcaggtktcaggctggggtcacacccaggtgtgtatgctgttcacaccacatatcagccctgcggggtgcttacagcggaaattgtgcaggttcctgcccaagaggg

SEQ ID NO: 48671 - DNA, 201 bp, Homo sapiens
agaaatactacttatggtataggagatatatatatataattgttacagtaggtagctagtcaggcctgagcatggcaggagagggctcctccaccaccagsaatgtcagacaaccatcagatgatggtcaggcagttgttaactgtctttctaaaataatttgttgcagccagtgccagggaaagcagtctccctatcaat

SEQ ID NO: 48672 - DNA, 201 bp, Homo sapiens
gggaaaataagctgaagccttcgaagctggattttagagtgaccgagtgttggagctcacttctcacctggcacaaaaatcttcctgtttaagctatgatrtagatgcctgcaaatccaacattacagttcctctagcattgacaacattgctccaagcaactgcatcttcccttgatggaacagtatccactttgtgcaa

SEQ ID NO: 48673 - DNA, 201 bp, Homo sapiens; identical to SEQ ID NO: 9083

SEQ ID NO: 48674 - DNA, 201 bp, Homo sapiens
acgtcccaattattttcttccacctcacaaatttcattatttcatgatacttgaacacagtaggagccccacagagacaggtcacaggcttggcttcagaycttacaatatgaactatgtggacaggcgtaaggccagtggcagaggcaagcaggctttgcaggaaggtgacaggagggtgctgggcctcaccaaggccag

SEQ ID NO: 48675 - DNA, 201 bp, Homo sapiens
tgggcagtatgctctaagggggcccgagtgcctggcgtggggggaggttgaggggtcagctgcaaggaccagggtgtgtctgcccacaggaaacctgggcytgctcttgctgccacctctttgtactgtagtcagtgcccccatgcctgcccatcccctcccccggtcactcagggccccctttacctgtactggttctcc

SEQ ID NO: 48676 - DNA, 201 bp, Homo sapiens
tcgttgttttgtgtggccacggaggagtccccacctgcaggctcctgggggccagaggcagctgtggcgtgatggatgctgggctccctccagacgcctgrggacccactgggggccagcatcttgagtggggcagatgtgatgggggcgtcagatgacagcgaaggtctacttgtggtgggtgtagccttgggggtgccc

SEQ ID NO: 48677 - DNA, 201 bp, Homo sapiens
cagatgtgatgggggcgtcagatgacagcgaaggtctacttgtggtgggtgtagccttgggggtgccctcggggccccttgtgggactggctgttgcagcrcggggcacggtgctcccttctttctctcctttgtcctcctcatcggggggcccagatggtggtcccagagacacaggccccatggtgcaagagaccccat

SEQ ID NO: 48678 - DNA, 201 bp, Homo sapiens
gacctgggccccccagggccagaggccggcacatgcctttgaagctgaacttgcacacgaagccctcaatgttacttccgggggagcctgggctcccacasgggccctcagaccacttggggaggcggctgggaaggagcggctgggacaggtccagcagcagagacacacagcgcttggagatgcacgagttccggagct

SEQ ID NO: 48679 - DNA, 201 bp, Homo sapiens
attgcagggtttctttctggggtgattaaaatgttctagaattaatttgcaaaactctatgcgtatgccaaaagccattgaattatacattttagataggyaaactgtatgatgtgtggattatatctcagtatagctgtttttaagaagaagaacatatgttcccccagtgaatgaagcatgagagcttaagtgatgaac

SEQ ID NO: 48680 - DNA, 201 bp, Homo sapiens
tctgcagccctagcatccactcatagcagggagccgttctcgtggtctaggcccctgtttgtgcagctcggaggtagattcctcagaggtagattgtgatmtgcagcattcgctcagcattctacttagttggtgcttaaggatatgggctaaatgagtgactttcagcatgttagccactctgacccccagatctttgtc

SEQ ID NO: 48681 - DNA, 201 bp, Homo sapiens
cacgatgctggaatggaatgttctgatctcaaatatggggcgagtttaatctcagttatttgggagcagactaattggtttgtggatcattcaggcatccrgcctgtctttttcctttttttttttttttgtaactaaaaattaaattaaaaagggaaacaaagcacactgcgtatttcctggcataacatggtatatggt

SEQ ID NO: 48682 - DNA, 201 bp, Homo sapiens
ttgtaaaattgaaatttgtcctttattaatcgtttgctttaaaacttaaaaaactaggaaaatcactaatattgattatgacatgatgatttctgaaagtyattgtgttgtacagaggtgaggggtgctacaaggttcaccctgggcacaaagatgccaggattgctgcaggcaaccccactcgaggacacccgtctgccc

SEQ ID NO: 48683 - DNA, 201 bp, Homo sapiens
ttcagtgattgcttccccaaaaacacatttcacaagaggatagactttatcacatgggttcagccgggctgtgtcatagagacccatcccaactcaccccrtgttattaccagtgaactactgagatgctaaatctttggcttcttggtttgagttgtggaaggacagataaacaaaagtgcctgctaagacccagatatc

SEQ ID NO: 48684 - DNA, 201 bp, Homo sapiens
caccaccaggaatgtcagacaaccatcagatgatggtcaggcagttgttaactgtctttctaaaataatttgttgcagccagtgccagggaaagcagtctycctatcaatagaagaaacctcaaactggggatcagcagcttccagataagatctcaggagctgggtaagtgggctcaagcttgtgcattaagatgcaaaa

SEQ ID NO: 48685 - DNA, 201 bp, Homo sapiens
aagataattggaactatatattttaatgctattttacagaagtatattataatatattctttaaatgcatgaaatgtgagaaattgaacaatgaaaatatmtatcactaatataactgcaaatatttagtgcttgcctttaattttttgtgaaaattagagatctgaacattttgttagcacagtaagtatatttaatata

SEQ ID NO: 48686 - DNA, 201 bp, Homo sapiens
ggccggccagggccagcgcgccaaggaccaggaccccaagcatgttacccaggcgcgccgcgtgcaggcgccggggaaagcgcgggcactgcgacagggcsgtgccggagcagaggggcacaggacgccgatggcgacagcctctcctgtccgtcccagcccagacacttcttgccgctgcgcgcagcccctgcgaggcag

SEQ ID NO: 48687 - DNA, 201 bp, Homo sapiens
tctccctcagacctggatgtccaatgatgtgaacagaaagcagagatcacacaggttgacccatggctctggtttcacaaggtctatcctgattttaaatkctcagggatagtttttaaagctaactgatttgtttatgtggtcctggtatctttccctgagaggcactatggctatttagcgttttgagaatctcaagtt

SEQ ID NO: 48688 - DNA, 201 bp, Homo sapiens; identical to SEQ ID NO: 9095

SEQ ID NO: 48689 - DNA, 201 bp, Homo sapiens
catttaacctgaaggactgcttctgggtcctttttgtttttgtgtggtttttttttttttctttttttctttttttgacagagtcttgctctgtctcccargcttgggtgcagtggtgagatctctgctcactgcaacctccgtctcctaggttcacgcaattctcctgcctcagcctcctgagtagctgggattacaagt

SEQ ID NO: 48690 - DNA, 201 bp, Homo sapiens; identical to SEQ ID NO: 9100

SEQ ID NO: 48691 - DNA, 201 bp, Homo sapiens; identical to SEQ ID NO: 9103

SEQ ID NO: 48692 - DNA, 201 bp, Homo sapiens; identical to SEQ ID NO: 9104

SEQ ID NO: 48693 - DNA, 201 bp, Homo sapiens
cccaaatctgaggttgctcttgttcccttccaccaaaggatggcaccaagtagaatgacaaaggtgccatctccttcctctttctcagggaagggtctctstcttaaggacaaagatgtgaaaggtctctctcttagggacaaagaggaaaggacagaccaacctacagagtggaggagtgctagaccaaatcctcccaat

SEQ ID NO: 48694 - DNA, 201 bp, Homo sapiens
tgttttgatggaggccagtataattagggatattcatgatccctgtggtgctttggtgggaggtggaggaggacagtcagagacagatgtcttcccagtcyccagtgctgagcagaggatttggtaaagcaaccggcagtggataaagtgtagaaagtacaaaactaactccagcccacaatagtcattcactttttgata

SEQ ID NO: 48695 - DNA, 201 bp, Homo sapiens
ctaggtctcctctcctgggggagaaaggtagcggctggtttcctgttccattgcttctttagtatcctgagagagaacagccatgggcacccagctgcccmagcctcttcctgtcccggggccccgaggctgcccttcagcggtctccagcttcctgctcctgtaagcaggggcctctctttttggctttcctgacatttc

SEQ ID NO: 48696 - DNA, 201 bp, Homo sapiens
atatctacatgtggtagggtgggacctctacctcacatcaaataaaaaattaaagaaaaatggtcaaaacacttaaatgtaagattaaaactagaaaatcyttagaagaaaatataggtgtaaatctttgtggccttcaataaggcactggtttcttaaatatggtacaaaaaacacaagcaatccaagaaaatgtagata

SEQ ID NO: 48697 - DNA, 201 bp, Homo sapiens
ggaagctccacagggatcagttaggcctgtgggccatgctttcagcacttggaggagaagatcccttagactcagcctttggctccatgccactcttgacmatgtacagggaagccacttggacctgatgctggagtttaatcaacagacaaggaagaggccccagtgtgtactgggcaaaagaacgggacgggtgtgctg

SEQ ID NO: 48698 - DNA, 201 bp, Homo sapiens
gtccctgaagttcaggtgggaatctgaagacactttcctgatccacgcaggcgacttcagacaatgtcctacacttagccacgggtaaatcatgcttttartatgctcaatggcagaactggtcaaagccactctgagctgctgagagcacttcagattattttccacaccagcaggcgatagaagtggcattcagggact

SEQ ID NO: 48699 - DNA, 201 bp, Homo sapiens
gacctaattttgatactttgtaaacattggaccaatgtgacctatcctagtcccgtgcctttctctggctgacttttcttttatctcatctgattgtgggwtcaatttatttaaaggaaaccatttaatgaaatcttaaggaagccctcacctttatatttggtttaacagttgagtttttggggtacagctgaggtctct

SEQ ID NO: 48700 - DNA, 201 bp, Homo sapiens
atccagcaggtctgggtgggtaccaggatgcggattcgtaacaggagaggctgatgctgccagtctgggtccacattttgagaagcattcctccaagggtyccacccacgctcataccccagtaagtagatggctcagaattgaaatccttgctttccatcttacatctcattctctttatatgcacaaccatgaagccag

SEQ ID NO: 48701 - DNA, 201 bp, Homo sapiens
agtggccagataaggaagcaaggcccagaagggcccagccagtggctctcagactccagagtcatcgagtccctcactcgagggcaggttaactcacagayggctggcccccaccctctgcatttgccatccagcaggtctgggtgggtaccaggatgcggattcgtaacaggagaggctgatgctgccagtctgggtcca

SEQ ID NO: 48702 - DNA, 201 bp, Homo sapiens
tcagcccagtctcccaaggccaggactgctgcctttgccttgccgcatctcagtgggcatccccaagctccactgacttagcacaagatgggaataatagyccctatcttctgtagtttcaaccactagtcaaaatgtgccacttactagccacgtgcccctgggcaaacaccgttcctctctgggcttcagtttccttac

SEQ ID NO: 48703 - DNA, 201 bp, Homo sapiens
ccatctgaattctgctctcactgctggcccatgttctgtggcttcagccgagtaattcaactctccagggctctttgtcatccatctgtgagagccagtcygggcagagaaggagaggagcagggcaagctgagaatgcagcccatgatgccgccccgattatggtgtttcctcactggacacgtggatgaagcgtgctcg

SEQ ID NO: 48704 - DNA, 201 bp, Homo sapiens
ttctttgcctgcttttattttaccagtggctacatttcatcatccagcttcatttcccatagaagttctgaatgttgtctggttttcctcgaaactatgartcacactgtgcacgccctacctctctctagcattgtaagaaaagcactcctctgtgcaggacacaatcctgtctactgcccctgagagccctggttcatc

SEQ ID NO: 48705 - DNA, 201 bp, Homo sapiens
gagtgcaaagagccccagaccagctggatatggcggccacaattcagagcagcaatagtgaagacttgagtgcaggccgtgccatgagctggagacagggsacaggtggcagatggtggaggaagaggccctggacagcatcgaggctcacacaggcccaccaggagggtgtgctagcccaccctacctggtacactgctc

SEQ ID NO: 48706 - DNA, 201 bp, Homo sapiens
aattattaactacagcttttcaggaaaaaaaataacccatttgtatcatttgcctctttccgtggtataaatacctccaccagggtcagcttcagtctccycatgatgttgtggagcatggagcagggaggaggtgtgagcagcctgccgcggaacaggaggctccacagatgcagataaccttaagagcacaggttgcag

SEQ ID NO: 48707 - DNA, 201 bp, Homo sapiens
cgtaacccactggaagccgcgcaggggcccgaggcgcttggggtcgccgcagccgggtggcagctgcaggccgatccagaggcgccggcggccaacgccgscgtcgccgttcagtagcaaggaaatgacatcggcagccaccgaggagcgcactgtcattaggtggccccgcagtccgtcgcagatctgactggcattgag

SEQ ID NO: 48708 - DNA, 201 bp, Homo sapiens
ttcagtagcaaggaaatgacatcggcagccaccgaggagcgcactgtcattaggtggccccgcagtccgtcgcagatctgactggcattgaggaaggtcgyggggcccgggtagagcgcgaagcagtcgtgctcgacgcactggctgccacccggctgcggctctgcgggtgcggggaaccccaggccggccagggccagc

SEQ ID NO: 48709 - DNA, 201 bp, Homo sapiens
tccctgtgcttcccagtgaaccacaggatggtgagtccttctctcaggctctgtttctgggagctggagtgcaaagagccccagaccagctggatatggcrgccacaattcagagcagcaatagtgaagacttgagtgcaggccgtgccatgagctggagacaggggacaggtggcagatggtggaggaagaggccctgga

SEQ ID NO: 48710 - DNA, 201 bp, Homo sapiens
agggatattcatgatccctgtggtgctttggtgggaggtggaggaggacagtcagagacagatgtcttcccagtctccagtgctgagcagaggatttggtraagcaaccggcagtggataaagtgtagaaagtacaaaactaactccagcccacaatagtcattcactttttgataccactgaaatgacgaagtcaaaagc

SEQ ID NO: 48711 - DNA, 201 bp, Homo sapiens
attagtggtatgaatacaatctcacatttactgaataacagttctaatgattatggttattatttttgccctaggtgattctctggcagggaagtcaccargaaccctccagaaggaagaaatgtctagcatgtcctaggtccccgcacccttgcaaagacccagagatgaagcaatgctggatagaccccacctgcacac

SEQ ID NO: 48712 - DNA, 201 bp, Homo sapiens
cactcacccagtgtgaacgtgtcgtagatggggagaaagaacaaattgagaggcacacaaaccaggactgagttccggctctcccacttccagcccacagyggcccagggaaggctgcatgactgtgtggagagggcagagcaacagtatccacctgcaggtgcacagtgacacacaaaggccatgttcctggcccagggg

SEQ ID NO: 48713 - DNA, 201 bp, Homo sapiens
aagcactttcacgagttgggttgccacactgcaaaaccaatttattgcacagaagattataaaacacatttccattcaactcagtctcaagtgatgggcargttggaggggctacagaaccacagtagtattaggaaactgcacaactcgtataccaaataaaagcatcaaggatatgggggcagctggaaagcagccctg

SEQ ID NO: 48714 - DNA, 201 bp, Homo sapiens
accgtcgtccaggatgtagccttcagggcactcacagctagcctgggtgttggggtcgcagtcggctggacaggcagtctggttgcaaaacatctggcacytgtgcggctcgtggggaatgggcgcgaagccctcggcgcagacgcagaggtagctagtttggttcaggggctggcactggtactcgcagttggctctgaa

SEQ ID NO: 48715 - DNA, 201 bp, Homo sapiens
ggctcaggtgggttaattcacctgggacacttacagctaggttctctagctccagccccgcccttctgtgtccgctcccacctataggggacgctccttaraggctgttcaggggattcgtagaggctgagggcatggtgcttcgacctcaggggaggatgaagagcttgcttttcctgggagggatttggtggagtttta

SEQ ID NO: 48716 - DNA, 201 bp, Homo sapiens
tctagtgactctgaccatcggtgacccccaggaatgtgttccagtgccccaggcagaatggtgccgtgtctgtgtgtgtgtgtgtgtgtgtgtgtgtgtgwgagagagagagagagagaaagagtgcacactatcgactacattatcatagggagaaatatttgcaaatgtaacttttaaaatgaggatataatttaaatg

SEQ ID NO: 48717 - DNA, 201 bp, Homo sapiens
tgtagaatctagatggtgttcgaatctaagcggtagaattctacctaggtagaatccacacagctgttcaccgtttgtaaatttttctagcaaaatattargaaaaagactttgcttatggagtccaggctcttttctctgtgaagctgcatttccccaaatgtcggggagacccacctgccctgttaaggaccagcggtg

SEQ ID NO: 48718 - DNA, 201 bp, Homo sapiens
atttgcatggtttgtgagccccatttaatgacataaaatgagggcactgagggaggaaaagtgaacagacacacaacccgagagcacattgttatttgttkattttgtacaagtgatgtcataagcaaggattttgcctgtgttctagattatctccaataaataaataactatgtacaaatattttgagtttacaaaata

SEQ ID NO: 48719 - DNA, 201 bp, Homo sapiens
atttcttctttaaaaaatctttccgagccctgcatattgcattcagccagccctaccaccttagaaaagtgagcccaagaaacgtgtgcattgaaaagatsatgttgttaatctccaaaagagatgagaatgatttcatactggatgagacgtttagaaatgaatatttgaatgagagccacaaactgagacccttcatga

SEQ ID NO: 48720 - DNA, 201 bp, Homo sapiens
agagccacaggggtctagtggctcctgtattgacagcacagggccaccttgttagtggcatcatttataaccctgggcagcattgctataggaatagccayatcctgtaggtctataatgctgtagaaatggaatgtgtggtgcgaatgaaatttaaaatttaagtagccacggtgaaaaaaaaagagaaacaagtaaaat

SEQ ID NO: 48721 - DNA, 201 bp, Homo sapiens
tcctgggtgtccagtccaggagccagtgaactcactatctctggagtttagcagaagaagggtaattccaggccggaacccctttctttcccgacctctcraccacagtcctccccaggcacattttagtggccagggatggagacccgcggataatgactgaaccaggtcacagggtgaaggttctgagatgtccggctc

SEQ ID NO: 48722 - DNA, 201 bp, Homo sapiens
ggctgttggcacacatctcctgtgggataagttcaggccttaaatgtatgcaggacaagaggcttaaaagtgagcatgtgcagagaacaaaacctatttargcaggaaaataagataattggaactatatattttaatgctattttacagaagtatattataatatattctttaaatgcatgaaatgtgagaaattgaaca

SEQ ID NO: 48723 - DNA, 201 bp, Homo sapiens
actgcagcttctctgccacatacagccaatgcttcaccacccgccttgtgcagggagagcaagcctcagctttgcctgtacactgtgctgtgcacaccagrtccccagcataggacagtaacagcacaggcactgcaggggacttcagggaggcctgaatggccctggacccccagcccagacttctgtgcagaagagtta

SEQ ID NO: 48724 - DNA, 201 bp, Homo sapiens
cacctcatagtcacagggtggctgcaagagcccaacctttcctagaagttgcctctgcagatttccccgcatgtctcatcagtcatggttgggccacgtgyccacccctgaagtgatcccaggttccagagaggaaaccaatgttgagcacacaaatacatttcaagtgctgtcctacacaaaatcagggatctgcccacg

SEQ ID NO: 48725 - DNA, 201 bp, Homo sapiens
caaattagatgcaatctctatcaaaatctccgcttttttctttgcagaaatttacatattgatcctagcattcacatggaagttcaagggattccaaagarccaaagaaatcttggaaaagaaaaaaatatgaacacttacttcctgatttcaaaacttaccgcaaagcaccagaaccaaaacaatatagtgctgggataa

SEQ ID NO: 48726 - DNA, 201 bp, Homo sapiens
acacataaaaattaagtctctatggctatgagcaatatataaattcaaggatggaaaaataactgtctgttaagcaaatgttatctaataactgcagcacrttagagcaaaacaagtattttccaaaattttgcctcttactcaggctttcttaaagaaacagggtaaaagtggacaattgtttgttggtctattctttag

SEQ ID NO: 48727 - DNA, 201 bp, Homo sapiens
tctctctttccacctcttcagctgccttgcagcccacctcaccttgttcactatgcccagtccgctccaccagggctcttcccagtacagggcctttgcargtgtgatccttcccacctggactgcttcccctccagtttgcatttgacaaacccctccttccccttcaggtctggtgttaagtgtcagcttgtccaggaa

SEQ ID NO: 48728 - DNA, 201 bp, Homo sapiens
cattttagataggtaaactgtatgatgtgtggattatatctcagtatagctgtttttaagaagaagaacatatgttcccccagtgaatgaagcatgagagyttaagtgatgaactgccagtggacctctgagccttttcctgcagccgggggcttattgtatgaggaaggatagaatacctatagctgtctaccttgacac

SEQ ID NO: 48729 - DNA, 201 bp, Homo sapiens
attagaatcctgcgggaactggctgggttctcgaaggcgttgttatcgccctgtgctcacacataaggaccctgagacccagggccactagggtgaggcgrcagggcagggcctgatgcacctgtcgaaatccacttctagctcccaccctgcccccagagacatgcgccccatgggccggcacacagcaaggggcttcgg

SEQ ID NO: 48730 - DNA, 201 bp, Homo sapiens
ggaataacttccaagtgtatgttgttaatgaatagacttctaacaggatcagctgcatttaaccctaaataatggatatttattgcaagtgtcctgtaccrttagcataacagagcagaaccctttgttcttcttaagtcctgtgcctttgccacagccttttgcacaatcttaaaagcaggctgactcagaattgaccac

SEQ ID NO: 48731 - DNA, 201 bp, Homo sapiens
gatattcatcagatgcagcagaatgaatcgggtatatcagttgtaaagtcatatataatataatttgaagtgaaaaggttcaaaaaggtatattttttatyggtgaaggacgaaatctgccaaacacatattagtcccttcaccacgcggctgtaaatagaagacaaaactggtggaaatccgaggagaagctgacgaagc

SEQ ID NO: 48732 - DNA, 201 bp, Homo sapiens
caggatgctgcatcaactgtggactatgaactgtgctaaaatgctttaaaatgacaactttcaaaacacagtgcatcatctcccgttcacacatcctttargaaacagcctgatggaactttctgcagggcttcctctgtctgagctcggagcactggcattccgggcaggatgaagtggaggcggggccacaggcagggt

SEQ ID NO: 48733 - DNA, 201 bp, Homo sapiens
cttctatctcggctcccagctgggccccaaggggagctgaggggtgagctgcagccactccggcgcagagaaggacacaaaggctgagggctttccacgtycccctgacccaaggcgcatcctgtactgttgtacttcttatttctcaccggatgttggggcttcctgcaatgaatagttctctgactcctgctgccttca

SEQ ID NO: 48734 - DNA, 201 bp, Homo sapiens
atcatggctcactgcagccttgacctcccagatcaagtgatccgcctatctcagcctccagagtagctgggactacaggtatgtgccatcacacccagctsatttttttcttttgtgtgtgtgtgcagaaatggggtctcactatgttgtccaggctagtctggaactcctgggctcagacaatcctccacctcagcctcc

SEQ ID NO: 48735 - DNA, 201 bp, Homo sapiens
tttaacaaatatggttgttattactgctatatataaaaaaaaaagctttatcaaagacccctgtggtcactggtagccatccaggaagtcttgctttttayttatttattgactgattgattgacttttgagacagagtctcaaaatcggtagcccagactagagtgcagcagtgttatcatggctcactgcagccttgac

SEQ ID NO: 48736 - DNA, 201 bp, Homo sapiens
caaggcaggtctcaggatgcacaatctttctgatcagagggcttttgagtagttctaccccagtgtgtgtgtgcgtgtgtgtgtgtgtgtgtgtgtgtgtktttggggggtacatacacaagcccaagtaagtttgtttgaacatattattaaaaatacccatattgcttaacactctgcttttcctatctgaaactggct

SEQ ID NO: 48737 - DNA, 201 bp, Homo sapiens
gctaccagctttagttccatcaaccccaggcttttgtaacaactggttgcatgaaaccctcccttgtagtttgtgtacagaagactgcaatgaattgaagycatgagacatacagccaggatcctgaaagccaccaacatatgtcacctgcctgggaggcttgcttcgatggtcatcttgttctgcctgctaagaccagga

SEQ ID NO: 48738 - DNA, 201 bp, Homo sapiens
gctgctctcttctttagcttcagggccttttcatttcccggcagcaacgaggtgcactgagcacttgtcggggctgtgtttggagcccatcaacagtgctrccagctttagttccatcaaccccaggcttttgtaacaactggttgcatgaaaccctcccttgtagtttgtgtacagaagactgcaatgaattgaagtcat

SEQ ID NO: 48739 - DNA, 201 bp, Homo sapiens
agccgcacaaaacctccatctttcctttcacttcccctgcccctttagttttctattaaaaacaatctgaaccatagcatctatatttcaaaactggcaasagtattaaccctgcaccttgtggcccttcaaccgctccagagtgtcacctcagagaccgatgcattgctaaggcaaaaccagaaacaccctttctctgag

SEQ ID NO: 48740 - DNA, 201 bp, Homo sapiens
aggaaagtggtcttggaacacacaggggtgaccactccttcatgatgtgtgtgtgttttgatagaggtcggtataattagagatattcatgatccccaaargcctccttatggggtaggggcttaaagacattttccctactcttggcccttccccactcaccctccctctgaccccagggcccataaagctactggagcc

SEQ ID NO: 48741 - DNA, 201 bp, Homo sapiens
tccctttgtgagtgtctgcgtcctcatctcctcttctcgtaaggacatagtcctattgcattagggtttcagctagcccccagggtctcacttaccttacwcactgctttaaaggacttttctcctactaaggtcaagttctgaggtgctgaggtgacaaggtcaacaaatgaattttggggacacaattcagccagtatc

SEQ ID NO: 48742 - DNA, 201 bp, Homo sapiens
tgggatgagggtttgcaaccagggagactgtccaggagcaggaggaagcgctgggtctcagcccagtctcccaaggccaggactgctgcctttgccttgcygcatctcagtgggcatccccaagctccactgacttagcacaagatgggaataatagcccctatcttctgtagtttcaaccactagtcaaaatgtgccact

SEQ ID NO: 48743 - DNA, 201 bp, Homo sapiens
tgtacagttgggattcgtacctttctctgcatataaatcttacttcaactttttaaaaaggattaaaaatgcttccttggtgagcgggacttctgtgtgargcctgtaggcacagcagccatgctgtaggcacgaggatgcaagccacatgctcgctggtgcggaggaccaaaagaagaaatgcagccgaaagcagctgca

SEQ ID NO: 48744 - DNA, 201 bp, Homo sapiens
tttacagcgatgacagtctctggtcctgctaacactgctctcggtatttaccttgccttttcttttctttccttttggaaggaaaggatatgctgtttcargtgcagattagtgaaaatatagaagtaatgttttctccattcaagctgatgagacccctgaatgaagaactattcacttaaaagaacacagaactatttc

SEQ ID NO: 48745 - DNA, 201 bp, Homo sapiens
caaatcgcagtctgtgtcttcgttacaaaattgccatcattgcccagtggtccagtgacgtcacggaagaggccgaggctcattctcctccctctaatcaycccctcgccagttagccatggaatagaagaaaacagcttggggggtgcggggagggtcttctccagctgtaatgccagctaaggtgctttggtagcaaag

SEQ ID NO: 48746 - DNA, 201 bp, Homo sapiens
aggttcccccaattccgaattactgggaaactccatttgcccagcagggcactgggcccatgcggccttcatatgacaaggaagtatcatttaacctgaargactgcttctgggtcctttttgtttttgtgtggtttttttttttttctttttttctttttttgacagagtcttgctctgtctcccaggcttgggtgcagt

SEQ ID NO: 48747 - DNA, 201 bp, Homo sapiens
agaagtcaaactgggcaactggtctctcctgtgcaatgggaaaacctcctaatgaagggccatgactttattgttgacaccgattccacttcaaacttggygtctgcaatctctgccagaagattttccgaggttgtttttaagtcataaagttaaataacatgaaatgttgtctccatagtaaaagatgctttcctaaaa

SEQ ID NO: 48748 - DNA, 201 bp, Homo sapiens
cgtggattccgctgcgttcacctcttgcctccagggcccagtagatcctgggctttaaacaagaacagagagtatggcgtctgccacgtgcgacagacacrcaccggtggggtgggccgggctggactggactgacctgcagtgaccaaacgggtggggcgtggacactctgaaagtgaaaaaggcaagcacgactgtccc

SEQ ID NO: 48749 - DNA, 201 bp, Homo sapiens
aaacacaagcaatccaagaaaatgtagataagttagacattatcaaaatttaaaacttttatgcttcaaaaaaaaaaggtggagacaagccacagaatggragaatggtaggagacatttacaaattatgtacctgataaggtctctctagaatatataaggaactacaagtcaataattaaagacaacaaacccaattaa

SEQ ID NO: 48750 - DNA, 201 bp, Homo sapiens
gtacagcatgttactctactgatcagtagaggcaattgtaacacaatggtaagtattcatatatcttaacatctgaacatagaaaaagtatagtaaaaatmcagtattataatcttatgggatcatcttcatatacatggtttgtcattgattgaaatgtcattatgcagtgcatgactttatctgatgaagggctaatat

SEQ ID NO: 48751 - DNA, 201 bp, Homo sapiens
attcttcttcagatccttctttttagctagatctacaatggcattccttttcccaggaatgcgattcccaggctggccaaactcatgttgccatgtattamcccccaaggcaaatagcaaagtttcctttgaagacaataaatacatagtccatgggctggacaactggaggtgttttggaaagttctttttattttcagc

SEQ ID NO: 48752 - DNA, 201 bp, Homo sapiens
gaaaatgagcgtgaacactgcccttgaccctgcagtcataagtcatgcaggtggtggcggggtgggggtgtagggtgagcctacccgctgctctcttcttyagcttcagggccttttcatttcccggcagcaacgaggtgcactgagcacttgtcggggctgtgtttggagcccatcaacagtgctaccagctttagttcc

SEQ ID NO: 48753 - DNA, 201 bp, Homo sapiens
gagtgaacaaggagccaggagtgatggggagccagtagtgatgggggagccagaagtgatgggggaggagccaggagtgatgggggaggagccaggagtgwtgggggaaccaggagtgatgagggaggagccaggagtgatggggagccagtagtgatgggggagctaggagtgatgagggaggagccaggagtgatggag

SEQ ID NO: 48754 - DNA, 201 bp, Homo sapiens
ttaattcaccctgaatctgcccaggtcaatgttcaagactgtgcaccaggaaaggaaaacacttcatggagcaagaaacccagggctggcctagctatggycctaacagagcactcactcctgcccagtgttgctggaaaatcaggggccgattgaaagcgccttccctgggttgtgtgacagtgagctctcaccactaga

SEQ ID NO: 48755 - DNA, 201 bp, Homo sapiens
tcacaaataagctgtattgatggctgggtggatggaaagttgtgacagaagtcaagtgacatattaaaagtgtagaatctagatggtgttcgaatctaagyggtagaattctacctaggtagaatccacacagctgttcaccgtttgtaaatttttctagcaaaatattaggaaaaagactttgcttatggagtccaggct

SEQ ID NO: 48756 - DNA, 201 bp, Homo sapiens
ttagccatggttttatctgccacaaagaaaacggttctattgggccctctaaatggaagcatgggctccgagaagtcccagccattctgagttgcgtagcrggcctcccagtcccataggcctgacccctacctctttttctttattgccacccaaaaatgtcccatacataacataactgcagaaagctgattatcccaa

SEQ ID NO: 48757 - DNA, 201 bp, Homo sapiens
atagagacgggtttcaccattttggccaggctggttgtgaactgctgacctcaaatgaccctctcacctcagcctcccaaagtgtgggggttacaggcgtragccactgcacttagccatggttttatctgccacaaagaaaacggttctattgggccctctaaatggaagcatgggctccgagaagtcccagccattctg

SEQ ID NO: 48758 - DNA, 201 bp, Homo sapiens
agtcttgctctgtctcccaggcttgggtgcagtggtgagatctctgctcactgcaacctccgtctcctaggttcacgcaattctcctgcctcagcctcctragtagctgggattacaagtgcctgccaccatgcccagctaatttttgtatttttaatagagacgggtttcaccattttggccaggctggttgtgaactgc

SEQ ID NO: 48759 - DNA, 201 bp, Homo sapiens
gattcccatagacaggtcgttctctcagctctttagtactcaccactccctccctgccctgtacctaatcatgcatataccacactttttgctgcacttakactccagattcccacacatttttgtatccccttacacctaacagcacgctttgtaactagacagtgcccagagcttattggagcacctgtggtagatgtt

SEQ ID NO: 48760 - DNA, 201 bp, Homo sapiens
tcagctgccttgcagcccacctcaccttgttcactatgcccagtccgctccaccagggctcttcccagtacagggcctttgcaggtgtgatccttcccacmtggactgcttcccctccagtttgcatttgacaaacccctccttccccttcaggtctggtgttaagtgtcagcttgtccaggaagctccctctagtcctcc

SEQ ID NO: 48761 - DNA, 201 bp, Homo sapiens
tactagctccctggcttttctagaatatgctaagcacaggccacttcagaaactgtgagttcacctctccccctgcctggatactctttcttgtggtgttstcctcatagctcacacactcagcttctgcaggtacttgccccctcccccacattcccaggtcttacctccctcacctccccatcttccttcattgcactg

SEQ ID NO: 48762 - DNA, 201 bp, Homo sapiens
agagtgtggactttggagccgacttggctgcactggagacccagctccggcattcacaagtttttgtttattgttaagatttgactaataacccctccccrtgtagctcagtttccttgactgtgtaatgggaatagtccctccttcaaagtgttaggatgaagattaaatgggttatacatgtaaagcatttagaacaga

SEQ ID NO: 48763 - DNA, 201 bp, Homo sapiens
aggacatcagctataacagctgtgtggttcctgcaggtggagtttggccttgcccaggtccttggaggcacgacttctgtgtctggtggaactgtgcagcrtggctcagacccacaagctgtgtgatggcttatcatccctgtgtaggcagggcatgctgagccaggctgactggacacctctgttcaggaagcattacca

SEQ ID NO: 48764 - DNA, 201 bp, Homo sapiens
cagctccggcattcacaagtttttgtttattgttaagatttgactaataacccctccccgtgtagctcagtttccttgactgtgtaatgggaatagtcccwccttcaaagtgttaggatgaagattaaatgggttatacatgtaaagcatttagaacagaggagccgtagtcagctctcaataaattttagcaaaaaagaa

SEQ ID NO: 48765 - DNA, 201 bp, Homo sapiens
cctctcctccctgctccgcgcacacagtcctccctttgtgagtgtctgcgtcctcatctcctcttctcgtaaggacatagtcctattgcattagggtttcmgctagcccccagggtctcacttaccttactcactgctttaaaggacttttctcctactaaggtcaagttctgaggtgctgaggtgacaaggtcaacaaat

SEQ ID NO: 48766 - DNA, 201 bp, Homo sapiens
tcttggtttgagttgtggaaggacagataaacaaaagtgcctgctaagacccagatatctggaggaattctgtggatgccctagagcaaggttgacgtgcygtgtctgtcaagggcaagagagtaaacatttcagctgcaggcctttcagcctctgtcataaccactgaactctgcctttgttgtgtgaaagcagcaagcc

SEQ ID NO: 48767 - DNA, 201 bp, Homo sapiens
ccttcttgttttcttttttctttttttaattttttttgagacagagtcccgctctgtcaccaggttggagtgcagtgacgcgatgtcagctcactgcaacyttcgcctcctgggttcaagttattctcctgcctcagcctcccgagtagcagggactacaggcacacgccaccacgcccagctaatttttgtatttttagt

SEQ ID NO: 48768 - DNA, 201 bp, Homo sapiens
gcaagtttaaaaagtcaatgctcaggaatgatgagaggaaagtggtcttggaacacacaggggtgaccactccttcatgatgtgtgtgtgttttgatagargtcggtataattagagatattcatgatccccaaaggcctccttatggggtaggggcttaaagacattttccctactcttggcccttccccactcaccctc

SEQ ID NO: 48769 - DNA, 201 bp, Homo sapiens
aataagctgtattgatggctgggtggatggaaagttgtgacagaagtcaagtgacatattaaaagtgtagaatctagatggtgttcgaatctaagcggtaraattctacctaggtagaatccacacagctgttcaccgtttgtaaatttttctagcaaaatattaggaaaaagactttgcttatggagtccaggctctttt

SEQ ID NO: 48770 - DNA, 201 bp, Homo sapiens
gcccatgcggccttcatatgacaaggaagtatcatttaacctgaaggactgcttctgggtcctttttgtttttgtgtggtttttttttttttctttttttytttttttgacagagtcttgctctgtctcccaggcttgggtgcagtggtgagatctctgctcactgcaacctccgtctcctaggttcacgcaattctcctg

SEQ ID NO: 48771 - DNA, 201 bp, Homo sapiens
taaggaaaagagacagagaacaaaagttccttaagcaaactgcctgactagctccctacttggtgtgtgcgccacccacacttcaggatttaaaatctcargatgctgcatcaactgtggactatgaactgtgctaaaatgctttaaaatgacaactttcaaaacacagtgcatcatctcccgttcacacatcctttagga

SEQ ID NO: 48772 - DNA, 201 bp, Homo sapiens
gcacatgcctttgaagctgaacttgcacacgaagccctcaatgttacttccgggggagcctgggctcccacaggggccctcagaccacttggggaggcggmtgggaaggagcggctgggacaggtccagcagcagagacacacagcgcttggagatgcacgagttccggagctccttgtgccagttagagtaaggcgtgtc

SEQ ID NO: 48773 - DNA, 201 bp, Homo sapiens
gttaattcaccctgaatctgcccaggtcaatgttcaagactgtgcaccaggaaaggaaaacacttcatggagcaagaaacccagggctggcctagctatgkccctaacagagcactcactcctgcccagtgttgctggaaaatcaggggccgattgaaagcgccttccctgggttgtgtgacagtgagctctcaccactag

SEQ ID NO: 48774 - DNA, 201 bp, Homo sapiens
ggcccatgcggccttcatatgacaaggaagtatcatttaacctgaaggactgcttctgggtcctttttgtttttgtgtggtttttttttttttcttttttyctttttttgacagagtcttgctctgtctcccaggcttgggtgcagtggtgagatctctgctcactgcaacctccgtctcctaggttcacgcaattctcct

SEQ ID NO: 48775 - DNA, 201 bp, Homo sapiens
catcgcaataagtgattaaaggctttaccagtactttcattttggctcattgttgctttaattggctactccaacacctgacagctcagctctctctctckcctgctcagctgaactcctgatactcaacagaggaattaagatgcaatagtaaaatatacataaaatttaagacagctattctgcagaagactctccaga

SEQ ID NO: 48776 - DNA, 201 bp, Homo sapiens
ggcactgggcccatgcggccttcatatgacaaggaagtatcatttaacctgaaggactgcttctgggtcctttttgtttttgtgtggtttttttttttttytttttttctttttttgacagagtcttgctctgtctcccaggcttgggtgcagtggtgagatctctgctcactgcaacctccgtctcctaggttcacgcaa

SEQ ID NO: 48777 - DNA, 201 bp, Homo sapiens
atcaatgtcactttttttaaaaacgtaagaggggctgtgaggacatccagcccgtggtcactccaaacctgccaccacagacagttggggcctccccggartccgtgggccgaatttcacaggcgagcattcccaggggtcctcaccagctgacttagtcagtttgggctgctctggcagccccacaggcaggggcaaagg

SEQ ID NO: 48778 - DNA, 201 bp, Homo sapiens
ggctgggtaacagggggcgaactataaggtgtcactgtctcctctggtctcccagccccatttatctgcacctgtcctgcccccatttgtgtagctcttcyttcacaaagacttagtctgctacttagggggagcatggctcagcttgttatctccatagggcactgtgcatggagcttccccagcacacacacacacaca

SEQ ID NO: 48779 - DNA, 201 bp, Homo sapiens
agctagtaagtggtgaaacaaagattcaccggcctgtggtaaggatgaaagaattacaatgtggagtatgtctgagcccccattttgccacatactggcckacttggctaagttatttcaatctctggtgttctttcccaaaaactggagatataatatctaatatgtaggattagtgtaaaataaaactctttcccaaaa

SEQ ID NO: 48780 - DNA, 201 bp, Homo sapiens
agtcaaaatgtgccacttactagccacgtgcccctgggcaaacaccgttcctctctgggcttcagtttccttacatgtaaatggtgtcacatccacagagscatgaggattaaatgagatgactcagtaaagcgcttggcatagtaggtggtaagtctgtggttccacgattagtggtatgaatacaatctcacatttact

SEQ ID NO: 48781 - DNA, 201 bp, Homo sapiens
ttttcttttgtgtgtgtgtgcagaaatggggtctcactatgttgtccaggctagtctggaactcctgggctcagacaatcctccacctcagcctccaaaastgctgagatcacatgcatgagccactatgcccagccaagcccagctttttagatgggagtttctgcttgatgtctgtggaggaggctggaccaactacct

SEQ ID NO: 48782 - DNA, 201 bp, Homo sapiens
ccaaacacatattagtcccttcaccacgcggctgtaaatagaagacaaaactggtggaaatccgaggagaagctgacgaagccacagccatgggggatgarggcctggatggaggccagggcatgaggacttgcaggacggatgagaaggaaagcagacaagggcgtgacaccccgacaaacacacgcgggacaggaggca

SEQ ID NO: 48783 - DNA, 201 bp, Homo sapiens
tgaaaacaattccatttataatagcatcaaaaagaataacatacttgaggataaatttaacaaaagaaatgcaaaacatttgctcttaaaactacaaaacrttgctgaaagaaactttaaaaggcttaaataaatggaaagacaccctacgttcatggattggaagacttaatatgattaaggtggaaatatccccacaat

SEQ ID NO: 48784 - DNA, 201 bp, Homo sapiens
actacaaaacgttgctgaaagaaactttaaaaggcttaaataaatggaaagacaccctacgttcatggattggaagacttaatatgattaaggtggaaatwtccccacaatttatctacaaattagatgcaatctctatcaaaatctccgcttttttctttgcagaaatttacatattgatcctagcattcacatggaagt

SEQ ID NO: 48785 - DNA, 201 bp, Homo sapiens
aagccaaaataatgaaatggccctggccctatcagcctcgaagctacatcaatgtcactttttttaaaaacgtaagaggggctgtgaggacatccagcccrtggtcactccaaacctgccaccacagacagttggggcctccccggagtccgtgggccgaatttcacaggcgagcattcccaggggtcctcaccagctgac

SEQ ID NO: 48786 - DNA, 201 bp, Homo sapiens
ccaaggcaattgaaagaatagtctcttccacaaatgattctggaacaactgcatatctacatgtggtagggtgggacctctacctcacatcaaataaaaarttaaagaaaaatggtcaaaacacttaaatgtaagattaaaactagaaaatccttagaagaaaatataggtgtaaatctttgtggccttcaataaggcact

SEQ ID NO: 48787 - DNA, 201 bp, Homo sapiens
aaatggcaaatacacacatttaagccaaaataatgaaatggccctggccctatcagcctcgaagctacatcaatgtcactttttttaaaaacgtaagaggrgctgtgaggacatccagcccgtggtcactccaaacctgccaccacagacagttggggcctccccggagtccgtgggccgaatttcacaggcgagcattcc

SEQ ID NO: 48788 - DNA, 201 bp, Homo sapiens
gcttattgtatgaggaaggatagaatacctatagctgtctaccttgacacagaactttggatctatcatctattggatttccatggagccaaaggaagctygggaatgcccagtgatctattcagggtcagtcatccagggtggcctactttgagagcaaagagaattttgtgtctagcagattcatgggacactaccttg

SEQ ID NO: 48789 - DNA, 201 bp, Homo sapiens
gaggcgacagggcagggcctgatgcacctgtcgaaatccacttctagctcccaccctgcccccagagacatgcgccccatgggccggcacacagcaagggrcttcggggcagggtgaaaaaatggcaaatacacacatttaagccaaaataatgaaatggccctggccctatcagcctcgaagctacatcaatgtcacttt

SEQ ID NO: 48790 - DNA, 201 bp, Homo sapiens
tatcccctcctctcaagaggtgttttctgagaaaagtggaggaccacagaaaatagcaagagagccccagaggctgcctgctgggcaatgtctctttctgraacatgtatctggctggacctggtaatctctgctcaggccaataggtggtgagcaagagatgaacaggcatttgggccatgggtcctctggcagttggtt

SEQ ID NO: 48791 - DNA, 201 bp, Homo sapiens
agggcagtgggacgcattgtctgttctccatagacaatagggcagactgcttcctccttgggactggtagttacgtttatgtttctgacaaccagctggcyactgaagaagcgtggagccaacagctgcaagggataattttggcagcatcacccacggtgcaaatttaaaactccagctggttctactgcaagcagaata

SEQ ID NO: 48792 - DNA, 201 bp, Homo sapiens
ccagccctgtgggttttagcaagctctccagggcattctgatgcacaggtttgagaaacaactggctcattgtatgtgaggcatgaatgaagtggcctccsaggctctgctcacatcctcactaccctcatctcttcctcctgggctttccaccttgggtcctggctctaccaactcttccttggatcctgaatctacagt

SEQ ID NO: 48793 - DNA, 201 bp, Homo sapiens
tgctgatgcttgagggactcatggtcagtgaggacaggctgtgagctgagctctgagctcggggcgaaccaaagatgggagaggagcatcagtgcccccckccccatcaccacattagaatcctgcgggaactggctgggttctcgaaggcgttgttatcgccctgtgctcacacataaggaccctgagacccagggccac

SEQ ID NO: 48794 - DNA, 201 bp, Homo sapiens
atcccagccatacatgggaatcacctggggtgggggacaaaccatagtaccaagccccattctggaccaactatatcagacttgctgtgggtgaggcgcaygcgcacacacacacacacacacacacaggtgattcttacaccagctctgagaagcactgaggttgggaagtgagaggtggagagcttgctagcatgaata

SEQ ID NO: 48795 - DNA, 201 bp, Homo sapiens
ggaaagaaagaaaggaagaaaggaagaaagaaagaaggaaggaaggaaggaaggaaggaaagaaggaaggaaggaaggaaggaagaaagaaaagttcctamccctggattaatgtcctggggctgacaaaacaaagtaccacaaactgggtggcttaaaatgacagctctggagactagaagtctgagaccaaggtgtcag

SEQ ID NO: 48796 - DNA, 201 bp, Homo sapiens
aatgaaattataataatttaaaaaggatacttgaataaccccaaagaaaacaggaaaagagaactgaaaggaagggaaggaggaggaggtggaagaggaargtaggaaaggtagaaaaagaaccgaataacaggcctaaccccaataaatgctgattctatctacgaatacttctaaaacaggccaaacaaatctgtggtg

SEQ ID NO: 48797 - DNA, 201 bp, Homo sapiens
ccagggctcttcccagtacagggcctttgcaggtgtgatccttcccacctggactgcttcccctccagtttgcatttgacaaacccctccttccccttcargtctggtgttaagtgtcagcttgtccaggaagctccctctagtcctccactctaaatcctgccttcctcgtgcgccttttcagagtgtgctgtgcttttc

SEQ ID NO: 48798 - DNA, 201 bp, Homo sapiens
catcaatgtcactttttttaaaaacgtaagaggggctgtgaggacatccagcccgtggtcactccaaacctgccaccacagacagttggggcctccccggwgtccgtgggccgaatttcacaggcgagcattcccaggggtcctcaccagctgacttagtcagtttgggctgctctggcagccccacaggcaggggcaaag

SEQ ID NO: 48799 - DNA, 201 bp, Homo sapiens
ctacactgcagcctgggcaacagagcaaggctccgtctcaaaagaaggaaagaaagaaaggaagaaaggaagaaagaaagaaggaaggaaggaaggaaggraggaaagaaggaaggaaggaaggaaggaagaaagaaaagttcctaaccctggattaatgtcctggggctgacaaaacaaagtaccacaaactgggtggct

SEQ ID NO: 48800 - DNA, 201 bp, Homo sapiens
actatatctaaaactttgcagaaacctgatgacctgcctgcagtgagcctctctgggtagtagactatggatgactttttggttccaaaaacatctctgtrttaaagtacaattcctaaactggaaggaaaatgggaaggtgtaactagaagcttgcatgcgggctcctgacctggagcaatttggtgactttgcctgttt

SEQ ID NO: 48801 - DNA, 201 bp, Homo sapiens
ttgaggaaggtcgcggggcccgggtagagcgcgaagcagtcgtgctcgacgcactggctgccacccggctgcggctctgcgggtgcggggaaccccaggcyggccagggccagcgcgccaaggaccaggaccccaagcatgttacccaggcgcgccgcgtgcaggcgccggggaaagcgcgggcactgcgacagggccgtg

SEQ ID NO: 48802 - DNA, 201 bp, Homo sapiens
gagctcagccacaggccaggtccagcctcagctttgccagatccttgcacgggtcatggaggaggctcctggacccgtgcaaggatctggcaaagctgagrtccaggccagcacagcccagttctctcctcctgctgcagccaggctctcagcacgtgcattcacccccactgctttccatctgcccacttcttcattcat

SEQ ID NO: 48803 - DNA, 201 bp, Homo sapiens
tgatatttttgtttgtcagtacagattttagttcatacatgaggcgcttaacagaatttgaataacatttttgtaaaattgaaatttgtcctttattaatygtttgctttaaaacttaaaaaactaggaaaatcactaatattgattatgacatgatgatttctgaaagtcattgtgttgtacagaggtgaggggtgctac

SEQ ID NO: 48804 - DNA, 201 bp, Homo sapiens
acatgaaatgttgtctccatagtaaaagatgctttcctaaaactgaagggcctctagccaaaagacctacagccaaaaagcagggtttggctgtggccatytctaagaaagaaatgtagtcagatgattcaaaggaaaatgggtaaacaaaaaaaaacaaagctgcaagtttaaaaagtcaatactcaggattgatgaaag

SEQ ID NO: 48805 - DNA, 201 bp, Homo sapiens
tatttttagtagagacggggtttcaccatgttggccaggatgatctcaatctcttggcctcataatctgcccaccttggccccccaaagtgctgggattayaggtgtgagccactgcgcccagccccagtagcattattcttcacagccaaagagtagaaagaacccaaatatccatcagctgttgaatgaatgaatggaa

SEQ ID NO: 48806 - DNA, 201 bp, Homo sapiens
tggaagacagcagctgtttaacaaatatggttgttattactgctatatataaaaaaaaaagctttatcaaagacccctgtggtcactggtagccatccagsaagtcttgctttttatttatttattgactgattgattgacttttgagacagagtctcaaaatcggtagcccagactagagtgcagcagtgttatcatggc

SEQ ID NO: 48807 - DNA, 201 bp, Homo sapiens
taatatgtaggattagtgtaaaataaaacagaaaatgtacatacagtgactattacttttcttggaagacagcagctgtttaacaaatatggttgttattrctgctatatataaaaaaaaaagctttatcaaagacccctgtggtcactggtagccatccaggaagtcttgctttttatttatttattgactgattgattg

SEQ ID NO: 48808 - DNA, 201 bp, Homo sapiens
tcctgtccgtcccagcccagacacttcttgccgctgcgcgcagcccctgcgaggcagcctctgacatgcggatcggccagggctcgagtttataagtgccyggccctccctccctggacgttcgggaaaaggaaggaagtgcctggtgggaagggctgatgccgcatactcggattgctgggttctctggccgcccttgcg

SEQ ID NO: 48809 - DNA, 201 bp, Homo sapiens
aaggagccaggagtgatggggagccagtagtgatgggggagccagaagtgatgggggaggagccaggagtgatgggggaggagccaggagtgttgggggarccaggagtgatgagggaggagccaggagtgatggggagccagtagtgatgggggagctaggagtgatgagggaggagccaggagtgatggaggagctagg

SEQ ID NO: 48810 - DNA, 201 bp, Homo sapiens
tagaggccccagcaggcacaagacctggtgcacaggcccgagccaggctggagaatgactcagagggcagggaggatagaggaccaccagccatttgtccygtgagttgcattagaccaggaaagccaagaaccacttcaactagttgaggaaagctgtgcctgttatgctatgtccttcagagagctttacatttttacg

SEQ ID NO: 48811 - DNA, 201 bp, Homo sapiens
ccagggcattctgatgcacaggtttgagaaacaactggctcattgtatgtgaggcatgaatgaagtggcctcccaggctctgctcacatcctcactacccycatctcttcctcctgggctttccaccttgggtcctggctctaccaactcttccttggatcctgaatctacagtttctacctgcatgggcacaagtatcac

SEQ ID NO: 48812 - DNA, 201 bp, Homo sapiens
ttggataactgaatacctgccatccctagatggtactcccaagtctatgagaaagggaggttttaagagaccagaccaggcctaagttgatctcttacacyggagagtgtgatagagttaggggttttgtttgcatgcttttcagttgtgattttaaaaccacctacctttctctcacccatagtcttgatacttgatgtg

SEQ ID NO: 48813 - DNA, 201 bp, Homo sapiens
acaggagaccagccgcagaccatatataaacgaatggatgtggctgtggtccaataaaactttgtttacagactttgaaattttcataattttacatgccrtgaaatatttttcttcttttgatttttttctgaccattaaaaaaatgcaaaaaagccatttttagctcacgcaccatacagaaacaggcagtgggccaga

SEQ ID NO: 48814 - DNA, 201 bp, Homo sapiens
aactgttctgaagttctgtaggaaattgcatctgctatgaattgtggagttggagctgtctagaccaggatggagggatataggcagagtgatgggtataygcaaatccatggaggagaggggtgccaggaccctttacaccccaggagggcacatgggaaggagggtctggtggagaggaagctgaagagatggctggct

SEQ ID NO: 48815 - DNA, 201 bp, Homo sapiens
ctttgaaattttcataattttacatgccatgaaatatttttcttcttttgatttttttctgaccattaaaaaaatgcaaaaaagccatttttagctcacgmaccatacagaaacaggcagtgggccagagtgggcctgcaggccatagttttccaaaccctgccctacaaacattaataaagaaaaaaacttagaagatgc

SEQ ID NO: 48816 - DNA, 201 bp, Homo sapiens
ttgttacttgcagccaaaagcattttctccagacttctgagtcctaaaaatttcattctttgacacaagagctgacccagaggccctgaagcccctctcargcctgcagagctttggtctgtttgctgaatcagattcatatctacacaacagttctagggccaaattctgctctcccacactcccacccactcatattgg

SEQ ID NO: 48817 - DNA, 201 bp, Homo sapiens
gcctgatggaactttctgcagggcttcctctgtctgagctcggagcactggcattccgggcaggatgaagtggaggcggggccacaggcagggtgtctgargcctgccctggctcaaagacaggttgtccttgaatttgtttccttgttagtgttgatcacatccgtagtcaagtgtgtggtaacctcagtacatttggat

SEQ ID NO: 48818 - DNA, 201 bp, Homo sapiens; identical to SEQ ID NO: 9096

SEQ ID NO: 48819 - DNA, 201 bp, Homo sapiens
taaacaatggcaatctctgcttttcattttcctgacttggagggacttgctggggcaggcaacacgcccaaggtatttgttagcaatcacgatatgttgtrtggtgggctcggccagatatgggaggaagctgaagtcctccatgctgctcaaaccaaggacactgcccaccgccccaggactgtacaataataaacaagt

SEQ ID NO: 48820 - DNA, 201 bp, Homo sapiens
ccacctcttcagctgccttgcagcccacctcaccttgttcactatgcccagtccgctccaccagggctcttcccagtacagggcctttgcaggtgtgatcyttcccacctggactgcttcccctccagtttgcatttgacaaacccctccttccccttcaggtctggtgttaagtgtcagcttgtccaggaagctccctct

SEQ ID NO: 48821 - DNA, 201 bp, Homo sapiens
gcttgtggtagaatgcagtcagttcaggctctgtggccacctgctgagtaaagactggaccctctcctgaggtccaggcaggccatgggaaatttgagttwtgttcattaaacaatggcaatctctgcttttcattttcctgacttggagggacttgctggggcaggcaacacgcccaaggtatttgttagcaatcacgat

SEQ ID NO: 48822 - DNA, 201 bp, Homo sapiens
agggcaggagatagcacgcttctctgcttagtcctccttccatcaccactggaaaatgagcgtgaacactgcccttgaccctgcagtcataagtcatgcargtggtggcggggtgggggtgtagggtgagcctacccgctgctctcttctttagcttcagggccttttcatttcccggcagcaacgaggtgcactgagcac

SEQ ID NO: 48823 - DNA, 201 bp, Homo sapiens
ctccagtgggtttagaatgcaccacgcaccagagaggagaagccaaagggtggatgcgatggtttccagccctggctttggcgtccagtgggaaccgggcygtctccccctgctttcccctttactgaactttagtgtggcttgtggtagaatgcagtcagttcaggctctgtggccacctgctgagtaaagactggaccc

SEQ ID NO: 48824 - DNA, 201 bp, Homo sapiens
aaaatgattttagttagtcatctctttccctcttccttccctccttacccccaattttaaggaaaagagacagagaacaaaagttccttaagcaaactgcytgactagctccctacttggtgtgtgcgccacccacacttcaggatttaaaatctcaggatgctgcatcaactgtggactatgaactgtgctaaaatgctt

SEQ ID NO: 48825 - DNA, 201 bp, Homo sapiens
tgcaaaccaccaaaagagaaaaaaaaaattctgagacttaagacacaaggccatggatggttataattttcagccttttttagaagcaaactggactttcyttttgcctagctcatgttctctgttgactttgggagccttttttcttttatcctcccatcgtgaaccttaaatagacaggcattttttaaataggatacg

SEQ ID NO: 48826 - DNA, 201 bp, Homo sapiens
cctccttgctcctctcagctcctggaaacccaggtgtccctgggcttgtggccacatcactccaagctctgtctctatcttcccatggccatctgcccccrttatgtgtttacatttgtgtctctcttttctcttcttatgaggacctcagtcacactggattagggcccatcctgaatgtgcctgcctttgaacttagtt

SEQ ID NO: 48827 - DNA, 201 bp, Homo sapiens
gtgtaggtcacctgacctgggccccccagggccagaggccggcacatgcctttgaagctgaacttgcacacgaagccctcaatgttacttccgggggagcmtgggctcccacaggggccctcagaccacttggggaggcggctgggaaggagcggctgggacaggtccagcagcagagacacacagcgcttggagatgcac

SEQ ID NO: 48828 - DNA, 201 bp, Homo sapiens
gcatataaatcttacttcaactttttaaaaaggattaaaaatgcttccttggtgagcgggacttctgtgtgaggcctgtaggcacagcagccatgctgtargcacgaggatgcaagccacatgctcgctggtgcggaggaccaaaagaagaaatgcagccgaaagcagctgcagcagccctggctttcccacctctgaatt

SEQ ID NO: 48829 - DNA, 201 bp, Homo sapiens
tttgaaaggggagatggataaatgtaatgaccttgaaagcaagttctgccaggtatttcgagttgtcgtgaaatatattaaaacaagttcacaatcaatgkgtttaagagtttattaggataggcacataacagaaagctcaaaggacaacaaagctgcaccttcctaaaggctgaccctcaaagcaccattttgttagaa

SEQ ID NO: 48830 - DNA, 201 bp, Homo sapiens
tcctttaggaaacagcctgatggaactttctgcagggcttcctctgtctgagctcggagcactggcattccgggcaggatgaagtggaggcggggccacargcagggtgtctgaggcctgccctggctcaaagacaggttgtccttgaatttgtttccttgttagtgttgatcacatccgtagtcaagtgtgtggtaacct

SEQ ID NO: 48831 - DNA, 201 bp, Homo sapiens
ctctctgcagacgctctgccttgtggtgggagcacagcttgtacaggagagaggaggaaggaagatgcccccaggcacctgccctttatgtctcttcctgrgctcttgttaagtgagacttatgttaacagcctggggcacttacttccctccccactcacccccggcctgggaataacatctgcttgctgtcacaggtgt

SEQ ID NO: 48832 - DNA, 201 bp, Homo sapiens
ggctgcggctctgcgggtgcggggaaccccaggccggccagggccagcgcgccaaggaccaggaccccaagcatgttacccaggcgcgccgcgtgcaggcrccggggaaagcgcgggcactgcgacagggccgtgccggagcagaggggcacaggacgccgatggcgacagcctctcctgtccgtcccagcccagacactt

SEQ ID NO: 48833 - DNA, 201 bp, Homo sapiens
cggggagggtcttctccagctgtaatgccagctaaggtgctttggtagcaaagctgggggtgaggaggcacaggctcctggacggagccaggctcctggayggaggccgctcagagtctctgcggcgtccgctcggtccgcacgtgctgcagcactacctccttggaaggggccgcgcacttgtactccatcttggccctg

SEQ ID NO: 48834 - DNA, 201 bp, Homo sapiens
ttcttctgctggtgtggtgcagggcacggatttcaggaagtttgtcaaattgtttattctatgagaatcaagagccaggatattgtgtcagccttgcctgwcagctgttgtttatatcacactcggctcctgtctctgggcttctttgcagggccagcttcgccttgctgggtgccctgccattctgctgtcagtggagca

SEQ ID NO: 48835 - DNA, 201 bp, Homo sapiens
aacagcttggggggtgcggggagggtcttctccagctgtaatgccagctaaggtgctttggtagcaaagctgggggtgaggaggcacaggctcctggacgragccaggctcctggacggaggccgctcagagtctctgcggcgtccgctcggtccgcacgtgctgcagcactacctccttggaaggggccgcgcacttgta

SEQ ID NO: 48836 - DNA, 201 bp, Homo sapiens
tgatgtaattttttttccctgatcctttgatgtgggaacatgagaactcattaaggcagcaatttatactgtggtggtgagtgagagaggagccatgggcrggaaaagctgaccagagagcagcgagggatgggaaccagcccaggttttggatagaggaagcagcttcatcaccaccccctattttagaatgtcatcttt

SEQ ID NO: 48837 - DNA, 201 bp, Homo sapiens
agagagagaccggagagctgtgcaaagtggatactggagacatacaggtaagaacaaaggaaacaaacaaaaacctaaatacttaaaaaaaataaatattytagtcatccctagcccacgaggtcaaggtctgcccagaaggctgccgaccaataacgctcaccctcctgcgcccggtagtgaggacctgggacaaatcgc

SEQ ID NO: 48838 - DNA, 201 bp, Homo sapiens
aaaccaatttattgcacagaagattataaaacacatttccattcaactcagtctcaagtgatgggcaggttggaggggctacagaaccacagtagtattargaaactgcacaactcgtataccaaataaaagcatcaaggatatgggggcagctggaaagcagccctgctctggttgagggttactgtcgacatctccctg

SEQ ID NO: 48839 - DNA, 201 bp, Homo sapiens
accagtgacaaggaacagtgacagtcaattgctaattggcatgaatcatgcagtttgaagctttcttgaactgtctcctgggaggtgtttgtctcttctckcaatctagagcaaccttctgaacattttcaacactgtcaaaaataagtaataataacaaaaaaggaaattgcataagaagattagcaacaattaccattt

SEQ ID NO: 48840 - DNA, 201 bp, Homo sapiens
gagatagttctgcatggtttcctaagaaaggcaaagccagaatgcccggggactaccagcattttacctgagtaattaccatgtgagcatgttatcttcargaacaattttgctgtgctttaataatttatctctgagctaaaaaattataattgaaaatgataagcactttcacgagttgggttgccacactgcaaaacc

SEQ ID NO: 48841 - DNA, 201 bp, Homo sapiens
agtgttccttaagaaaatgcccctcttctggaataagaagaaatcctaacgcaatgaggccctacaagtcagtttgacagtgactgggagcagactctttkgacaaacagaaggctgggtaacagggggcgaactataaggtgtcactgtctcctctggtctcccagccccatttatctgcacctgtcctgcccccatttg

SEQ ID NO: 48842 - DNA, 201 bp, Homo sapiens
ccctatgcccttcagagtggtcagcctcacagaccactctgagagaatgggtagccatgtctgtactacatactggagacatgactgtggaatggaagttwcaaaactaagtcagagaaccctctgatcctgcaaacacacatgcacacacacagagacatcaaccatctctaatttgttggcacccaccagggatacctt

SEQ ID NO: 48843 - DNA, 201 bp, Homo sapiens
aagcaccattttgttagaactcagaggagaagctcgatctctgagccttccctcctcacagtttgggaaacatgcacaggatgaaggtaaatcctgcataraaatcttgtaattccagaattagtcaaacaaatttgaaatacacacatttaaaaatacttacattctcatttagcgttcatgaagtgattactgacattt

SEQ ID NO: 48844 - DNA, 201 bp, Homo sapiens
ccaggacgcacgtggcccccccacgacatgggctggagctgcaagggtttcgagaggcacaggtcaccaggtcatccagcagccggaatcctggtcggcarccgcagaggaaggagccatcccccccttcaaagcagtcctggtggcagcccccattgttgaagttgcagccatacttggggctgacacagagggggcccg

SEQ ID NO: 48845 - DNA, 201 bp, Homo sapiens
gtgcatgtgccccccactcccctgccagcaggaagccctgcaaccagaacccggccgcaagcgcatccccctcaccaggaccaccaccttctgaggagccyttcccctacccaccctgcgtggccacctcccaaggggtgggcaccattcctacagccccgaagactgcatctcctgaatgctcacctaagctccaccacc

SEQ ID NO: 48846 - DNA, 201 bp, Homo sapiens
aaacccatataaaaatgggccaaggatttaaatgaacacctctccaaaaaagaggcacaggtggcaaagaagtattgaagagatgctcaatagcacatgtmattagggaattgcaaattaaaacagcaatgagatatcactacatacctaatagaatggctaaaatccagaacactgacaattccaaatgttggcaaggtt

SEQ ID NO: 48847 - DNA, 201 bp, Homo sapiens
tgttccctttgaccaaaaaaccagatcttcttacctaattgaataattaattgatttagttttcatcctaggaagagaaacaaatcatttcaatcctaatsagcatgagcaactcaccttttcctcttagatggtggaagtgagcagagaagatattcaggggagccccttagccccagcctcctcacaccctgatccgga

SEQ ID NO: 48848 - DNA, 201 bp, Homo sapiens; identical to SEQ ID NO: 9091

SEQ ID NO: 48849 - DNA, 201 bp, Homo sapiens
gtgtttgtggatgcatatctctgtgtcatgcatgtgtgtgtttatgtgtgtgggtgtgtgtgttgggggaacagccatggttgttcatatcgaggaataayttccaagtgtatgttgttaatgaatagacttctaacaggatcagctgcatttaaccctaaataatggatatttattgcaagtgtcctgtaccattagcat

SEQ ID NO: 48850 - DNA, 201 bp, Homo sapiens
ccagtataattagggatattcatgatccctgtggtgctttggtgggaggtggaggaggacagtcagagacagatgtcttcccagtctccagtgctgagcaraggatttggtaaagcaaccggcagtggataaagtgtagaaagtacaaaactaactccagcccacaatagtcattcactttttgataccactgaaatgacg

SEQ ID NO: 48851 - DNA, 201 bp, Homo sapiens
gggccatgactttattgttgacaccgattccacttcaaacttggcgtctgcaatctctgccagaagattttccgaggttgtttttaagtcataaagttaartaacatgaaatgttgtctccatagtaaaagatgctttcctaaaactgaagggcctctagccaaaagacctacagccaaaaagcagggtttggctgtggcc

SEQ ID NO: 48852 - DNA, 201 bp, Homo sapiens; identical to SEQ ID NO: 9092

SEQ ID NO: 48853 - DNA, 201 bp, Homo sapiens
atgtcggggagacccacctgccctgttaaggaccagcggtgatctcaatctgacactgccacagtgaatgccacaggtgttctgtgccagtcagtgattcrcccttgtcacagttggggaatagtgaaaggaagccttgaggggagcagtggaggtggccacggcccacctgcccagcagactgatgcccaccactatcct

SEQ ID NO: 48854 - DNA, 201 bp, Homo sapiens
aggaacatcgcccatcggagtgcctagtaataaaagtgtcagcaccaataatgttattaaaagaaaacactttctaggttctgccacctacgtgttgtatscctttaaaaggaagcacagtggatagcacagtgcctgtagaggctgagctggacgtggatttgtttgccttgaagctttgtatcaacagtatgggcacct

SEQ ID NO: 48855 - DNA, 201 bp, Homo sapiens
acacaccattttgcatacatttgttctgactgctcttcagtgagaacttcattacttttatattacagaattgttatacttttaaaaaactttaaatatcrgtcatttgtagtgagcagcttagtattttccgtgatggagtgtaatagttttccattgctgctgtggttaaaaacaacacaaacgtatcatcttagagct

SEQ ID NO: 48856 - DNA, 201 bp, Homo sapiens
aagagttggatccagagatgcatgatgttttagcagcaatgatattcatgaagctttttgcttcactccttgttatggtttgagatcccacagcagacccygagacaaagacctggaggcaggtggttaacttgggaggtggggtcaggggaagggagatggggaagggagaggagacagggcaggtgcttcccgagactg

SEQ ID NO: 48857 - DNA, 201 bp, Homo sapiens
gatgtcacagagagcagggtgctggagagggctttactctgaagtaggggcggccaatatttgatcccatcattcagaaatccctcttctacccacaggcytggcagtgactgaggctccatctagctctgggagaagaggaagggagtggcttcccactgggggtgcctcagacctcgcttacctccacccatagctggt

SEQ ID NO: 48858 - DNA, 201 bp, Homo sapiens
tccccatagtagcatctgcagcatggaggatcttgttacaaatgaaagttccggccaggtacagtggctcacacctgtaatcccaacactttgagagcccraggcgggtggatcacctgaggtcaggagtttgagaccagcctggccaatgtggcgaaaccctgtctctactaaaaatacaaaaattagctgggcgtggtg

SEQ ID NO: 48859 - DNA, 201 bp, Homo sapiens
aaaaatcatttataaatcattaatatatggattccaccagggatacatacaaaaaaaaatggtttagatagaggagcctactcaaacatgctcaagcctgkgtgcagacatagactcactcattattaaagcttaccctggaaagagccacgtgaatctttttgggaacaatcatcccatgctccagctggagggaaccgg

SEQ ID NO: 48860 - DNA, 201 bp, Homo sapiens
ttgctttaaaacttaaaaaactaggaaaatcactaatattgattatgacatgatgatttctgaaagtcattgtgttgtacagaggtgaggggtgctacaargttcaccctgggcacaaagatgccaggattgctgcaggcaaccccactcgaggacacccgtctgcccttgggggaggctcatcgattgaccatctgtcct

SEQ ID NO: 48861 - DNA, 201 bp, Homo sapiens
caaccctgctaacgtcacatggcagggcacacaagctggtggctgtgttattttccaactgaaaaatcatttataaatcattaatatatggattccaccarggatacatacaaaaaaaaatggtttagatagaggagcctactcaaacatgctcaagcctgtgtgcagacatagactcactcattattaaagcttaccctg

SEQ ID NO: 48862 - DNA, 201 bp, Homo sapiens; identical to SEQ ID NO: 9098

SEQ ID NO: 48863 - DNA, 201 bp, Homo sapiens
cagggcctgcatctgtacctgaaggtttccccatcctaagtgtggaaggccactttgcccacatgtgtggtcatctggaagtgctgggaattacccgccamctccacccagggcagccctctactcattaccaatgggtatctacacaccactcccttggctttcagatgtgatgaccctggcatgttttgcaccatttcc

SEQ ID NO: 48864 - DNA, 201 bp, Homo sapiens
tagttacaatgcctaagcatagaatgataaaaccttcaaacgttagtgtcaggggatgctgggcaatcactggttctacccctgcaggtagaatggaggayttcagttcaaccggccagctacgctccaagcctaatatggaagtccaatgttttcttctgctggtgtggtgcagggcacggatttcaggaagtttgtcaa

SEQ ID NO: 48865 - DNA, 201 bp, Homo sapiens
ttaaggagccctgcaggaggttccagaggattcagacacatgctcaggttcaaatacagctagaaggaaatgccctcctgtgctgggaagagctcacctaktgcaggcgggaccagaaaggaaccacacctgcaacctgaagcgaaacctcagaactcaacagagaataagaaaattgccaaagcactcggggaaaaatgg

SEQ ID NO: 48866 - DNA, 201 bp, Homo sapiens
gctgggaaggccgccccagcacccaggaaacgaaggagctgctggacacgggggtctgaagctcccggaatgcacacagctgcgcctcccctgacgcggascccctgggaagaggaagggaagagcggcagatagcacagtagggcttgtccggcgggagcagtcaagctgtggctgcctaggctgaatcagggggtcgtg

SEQ ID NO: 48867 - DNA, 201 bp, Homo sapiens
agtctcctcatgatgttgtggagcatggagcagggaggaggtgtgagcagcctgccgcggaacaggaggctccacagatgcagataaccttaagagcacasgttgcagtaaaaatcatcaggcatgcaggttttactatttattattttaaaaaatataatttacttacctgtaggtttacaaagtttatttttaataatg

SEQ ID NO: 48868 - DNA, 201 bp, Homo sapiens
agctagcattgccctcaaagatgctcagcaagttctttcacagtaagaaatttcagagaaactccaaggagcttctctggaagagaacatctggggaatgyctggcttccatgcacccagcccagtgctggttgctagaatgcatagcaatgacctatgagcagtgggcccagcaaattattaactacagcttttcaggaa

SEQ ID NO: 48869 - DNA, 201 bp, Homo sapiens
ctttgccctctcttggtcaggctttgctgtattaattccatgttcatgcaaacatctgtgcatgagtgtctatgacaactgtattcacaatagccaaaacytagaagcaacccaattatccttccacaggtaaatggttgaaagtggctcatccatactctgaaatactactcagtaatacaaagtaatagattgatccac

SEQ ID NO: 48870 - DNA, 201 bp, Homo sapiens
gcttcagataagggcaggaacctcgttggggcactgctgaaaggtctcagaatgtggggacaattcccagagtgaatgagacaagagagggggacaggatyggttacagaatcagaaaccagtgcaaagtgaaaatgtggggtccattgttcaattacaaggattcaagactgtgatagcaaagtgttaaacaaggaatga

SEQ ID NO: 48871 - DNA, 201 bp, Homo sapiens
gcacacacaccacagtgaaatgctgctggggcttgccattgatcataggataaaaatcagatttttttttttttttgaggcagtctcactctgttgctcargctggagtggcacgatctcggctcactgcaacctccgcctcttgggttcaagcgattctcctgcctcagcctcccaagtagctgagattacaagcatgta

SEQ ID NO: 48872 - DNA, 201 bp, Homo sapiens
tctggggttggaagctccgttcccgggcagctcagcgtggattccgctgcgttcacctcttgcctccagggcccagtagatcctgggctttaaacaagaayagagagtatggcgtctgccacgtgcgacagacacgcaccggtggggtgggccgggctggactggactgacctgcagtgaccaaacgggtggggcgtggac

SEQ ID NO: 48873 - DNA, 201 bp, Homo sapiens
ttgaaaataagggcctgacttggcctgctacttataactgatctatatttcatgtattccagaaaattggaagcagtctggaatggttgtcctcaaattastgagcagacacaccccctgcagatcttgttaaatatagattctcatgaactggatggggtggagcctaggattctgcatttctaaccagctcccatgggc

SEQ ID NO: 48874 - DNA, 201 bp, Homo sapiens
tgcatgactgtgtggagagggcagagcaacagtatccacctgcaggtgcacagtgacacacaaaggccatgttcctggcccaggggaggaaggtttaccaytcaaatggtgactacttcatgatatagaaggaggaagagggagttggtacacagttgggtgtcttttttttccatttttttttttaatcaggctttcatt

SEQ ID NO: 48875 - DNA, 201 bp, Homo sapiens
ttctgatcagaccgtgacttttagctgtgatattgtccaggcctgccaaagtccactatggatgccaggttcagggacccattctgccctgcagttgaccyttgtctcctgctcaaccctgaagcccctgcagtgtgtatagaccctggacccactgggctccagcactgcctgtcacacccctgcaagccaggtgaggct

SEQ ID NO: 48876 - DNA, 201 bp, Homo sapiens
agcacgcttctctgcttagtcctccttccatcaccactggaaaatgagcgtgaacactgcccttgaccctgcagtcataagtcatgcaggtggtggcgggktgggggtgtagggtgagcctacccgctgctctcttctttagcttcagggccttttcatttcccggcagcaacgaggtgcactgagcacttgtcggggctg

SEQ ID NO: 48877 - DNA, 201 bp, Homo sapiens
caccagctgaacccatcacataaccagctcctagatcaagaagcagaacattctctgctccctagacccccgggtcattcccccaggctccatactccccrctctgacagcagcgatggtcacgttgggctgttgagcatccatgcatgcagggtgtgtgctctttgtatctggcgtctttgggcaattcatccgcattgt

SEQ ID NO: 48878 - DNA, 201 bp, Homo sapiens
aaggagggttgaaagagccatgagtgaacaaggagccaggagtgatggggagccagtagtgatgggggagccagaagtgatgggggaggagccaggagtgwtgggggaggagccaggagtgttgggggaaccaggagtgatgagggaggagccaggagtgatggggagccagtagtgatgggggagctaggagtgatgagg

SEQ ID NO: 48879 - DNA, 201 bp, Homo sapiens; identical to SEQ ID NO: 9099

SEQ ID NO: 48880 - DNA, 201 bp, Homo sapiens
atggttacaatggtatatacatttatcaaaatgcattaaattgtacagttgggattcgtacctttctctgcatataaatcttacttcaactttttaaaaargattaaaaatgcttccttggtgagcgggacttctgtgtgaggcctgtaggcacagcagccatgctgtaggcacgaggatgcaagccacatgctcgctggt

SEQ ID NO: 48881 - DNA, 201 bp, Homo sapiens; identical to SEQ ID NO: 9101

SEQ ID NO: 48882 - DNA, 201 bp, Homo sapiens
gtcataaccactgaactctgcctttgttgtgtgaaagcagcaagcctggtggagccccacaaaatcggttatctactgccagtagcaaacctccccaaaasttagtgatgagagcaatgaatattgaaaccctggttatctgaccaagtcagtattggacaaatttgcacagagatcttttggtgatttgcagaagctggt

SEQ ID NO: 48883 - DNA, 201 bp, Homo sapiens; identical to SEQ ID NO: 9102

SEQ ID NO: 48884 - DNA, 201 bp, Homo sapiens
agaccgtgacttttagctgtgatattgtccaggcctgccaaagtccactatggatgccaggttcagggacccattctgccctgcagttgacccttgtctcytgctcaaccctgaagcccctgcagtgtgtatagaccctggacccactgggctccagcactgcctgtcacacccctgcaagccaggtgaggctggctcagg

SEQ ID NO: 48885 - DNA, 201 bp, Homo sapiens
ttctggtgaaagagtagccttccttcgcgggcactgacactgagggaagcagctcagtggctacttccacctgcagatattccaggtggtggctcagaacwgctgacaaccatacctggggaagactggcctttatttttctggttgttcatactccaacagctagcaccgtacgttggggtccaatgaagcgagcagcag

SEQ ID NO: 48886 - DNA, 201 bp, Homo sapiens; identical to SEQ ID NO: 9105

SEQ ID NO: 48887 - DNA, 201 bp, Homo sapiens
accattgtatgtctgagtcatgatgtctttacaactcctcagaggtcctccgcatgcaattccctccaaaccactgacaggcagcctgaagacctggttargtaccgggtttgggataaaatagacagccttgccctcaaggagctcacagacaagttaaaaactccaaaaccaagtttgattgatgtaatgccagaaaat

SEQ ID NO: 48888 - DNA, 201 bp, Homo sapiens
actaccctcatctcttcctcctgggctttccaccttgggtcctggctctaccaactcttccttggatcctgaatctacagtttctacctgcatgggcacargtatcacaaaccttatcctgatgggatagtggaactccaccttcaagccaagataaatgtaatttgtaaaatttttgcacagacaggaggtgcagaggac

SEQ ID NO: 48889 - DNA, 201 bp, Homo sapiens
cagtgggcagcttcccccaccccccagtcttagaaaggcctcctccagttgcaacaggactccctcctccccatcgctgtcccagccacccagcggaaagytgagaccccaccccccaggtggccaattttagacccactaaaggcctttctgggctgtactgggggctaaagggggccaccatcccacagagaaggggcc

SEQ ID NO: 48890 - DNA, 201 bp, Homo sapiens
gtggtctgtgtctgtgatttacagcgatgacagtctctggtcctgctaacactgctctcggtatttaccttgccttttcttttctttccttttggaaggaraggatatgctgtttcaggtgcagattagtgaaaatatagaagtaatgttttctccattcaagctgatgagacccctgaatgaagaactattcacttaaaa

SEQ ID NO: 48891 - DNA, 201 bp, Homo sapiens
cctcacaaggcttcaaggaccagtgttctgctggtctccatgaatgaggaaacatcctggcaagggaggctcctgctcactgtcagagaagcaccttgtcygctcatctccaccctgtagttcatgtctctccctctgctagcaacattctcgtctgccaggctcttcacccactgaaatctttccattctttcaagtccc

SEQ ID NO: 48892 - DNA, 201 bp, Homo sapiens
cccatcccacacctggataaacagcagtgggcagcttcccccaccccccagtcttagaaaggcctcctccagttgcaacaggactccctcctccccatcgstgtcccagccacccagcggaaagctgagaccccaccccccaggtggccaattttagacccactaaaggcctttctgggctgtactgggggctaaaggggg

SEQ ID NO: 48893 - DNA, 201 bp, Homo sapiens
gactgtggaatggaagtttcaaaactaagtcagagaaccctctgatcctgcaaacacacatgcacacacacagagacatcaaccatctctaatttgttggyacccaccagggataccttgggcatctgaagtcagtctccatgtctgtgggtctcgtgtaaccataactacttggagttttttaaaactgcattatttctt

SEQ ID NO: 48894 - DNA, 201 bp, Homo sapiens
aaagagcttgcagtgggaggcactgaagggctcaatgtgaccaaaacacagaccacaggggcgtgtgaggcactggcaggcacatgagcaggagcctaatsccttctatgccacctcaaggatgagggctgtgtcctaagagccaggggtcagtggtggcaggctctaatgaggggcttgggtctgcctagtaagagaagc

SEQ ID NO: 48895 - DNA, 201 bp, Homo sapiens
gtcagagatcttgctttttcttttacaattgtctttaatgtactgttccatggcaagccaggtgttccattttcccagatggtcagggaagatggtatttrgacatgacaggctgtcactcagcaggatacttgcccagtttgtcagctctgatctgtgagcaaagatgcatatgagtttcacactcatctgtgaagtatt

SEQ ID NO: 48896 - DNA, 201 bp, Homo sapiens
ctcctcttccctcccaaatctgaggttgctcttgttcccttccaccaaaggatggcaccaagtagaatgacaaaggtgccatctccttcctctttctcagsgaagggtctctctcttaaggacaaagatgtgaaaggtctctctcttagggacaaagaggaaaggacagaccaacctacagagtggaggagtgctagacca

SEQ ID NO: 48897 - DNA, 201 bp, Homo sapiens
gtgaagtattggcttcactttcattaaagtcatcatagctggcattccttagatgctagaggtggatgcaaaggatcaactaaatatagcacgttttggcrgcactgcctcagaaaccagacatgaatcctagcaaatgtgggcattgacactcttctctgagaggttggaggtagtgaattacccccatctcccacattc

SEQ ID NO: 48898 - DNA, 201 bp, Homo sapiens
attttccacaccagcaggcgatagaagtggcattcagggactgctgtcattgctgctgagatccaagactcctcttggtgcactgtgatttgcagggaaakctgtgtctctctgacttgcaggccagaggttctgaagattgcttgaggttgcaagtacctccaagcttgagcagcagttttgaagtgtggagatgggagg

SEQ ID NO: 48899 - DNA, 201 bp, Homo sapiens
cgccaaacagagcagagtgctcctcaagatccagccgcatcccaaaagcaccatttccgtttgtcacgggcctccaggcagcttgctgttgagtttgctcrtgtttatcatggccgtatcctgtgctgtggagagtcatagacaaattaaacagtgaaactgggacttgccccatgcccttttcagactttccattctcct

SEQ ID NO: 48900 - DNA, 201 bp, Homo sapiens
ttattaaaagagggggacaatgaacaaggcgtaggatctccaaagagtctgtggaaggtgggatccatgttcccaaaggatttaaatcgaaacaaggcagkaggcagtgggaaaaggggaggaattagggagaatgtggaaaagcccctctcctctttgccaagtagaacaaagctttgctggacaacagcggggtaactt

SEQ ID NO: 48901 - DNA, 201 bp, Homo sapiens
gcttgagcagcagttttgaagtgtggagatgggaggtgagttattcacatctctaacaaaggagctgctgcttctggcttcaggaggggctgagaggcccytgattcactatctcatcactgggctggaagctccacagggatcagttaggcctgtgggccatgctttcagcacttggaggagaagatcccttagactcag

SEQ ID NO: 48902 - DNA, 201 bp, Homo sapiens
aatgctggatagaccccacctgcacacagagaagaaaggctgctggagagacatcatcagaggagagagacagtggctctaatccaagaatccaggcaacrtgtgtagggctcagggtggcatgtgtgtgttttcatgcccagcaccaggacctgagcactgagagctttccctacctgccatgggatcctggtatcaagg

SEQ ID NO: 48903 - DNA, 201 bp, Homo sapiens
aaagatatttgagacattttgggaactctccatagaagccaccagaccctccctgtgccccttcattcatccatctgtttgtccatccacccatctaacawttgttgattaagaccctgctatgcactgagtgaggcactggattccaggaggggatccctgcctctgtgatcctggagtcctgttagagtggacaacttt

SEQ ID NO: 48904 - DNA, 201 bp, Homo sapiens
ggacccactgggctccagcactgcctgtcacacccctgcaagccaggtgaggctggctcaggctggtgaggaagtgcttgtgaggagagccagggctccaygccagggtaagagtaggaccaggaacgatgtatttggttattgacttttcctgcttcctgagctttataacaacacggggaagagggtcctgtgatcatc

SEQ ID NO: 48905 - DNA, 201 bp, Homo sapiens
gtgtcagctcccgtccccgccccgggctgggtcaggagcagcagcagcagcagcagcaggcccatggaggtggccatcccggtctctgtgtggccctctgygggaggcgagaagcccagcggcgacaggagcttctatctcggctcccagctgggccccaaggggagctgaggggtgagctgcagccactccggcgcagag

SEQ ID NO: 48906 - DNA, 201 bp, Homo sapiens
ggaggtggccctgtcagcctggaaccggcatcgggagtgcccgtgggaccatttgattgacactttgctcctccagttttctgatcagaccgtgacttttrgctgtgatattgtccaggcctgccaaagtccactatggatgccaggttcagggacccattctgccctgcagttgacccttgtctcctgctcaaccctgaa

SEQ ID NO: 48907 - DNA, 201 bp, Homo sapiens
tccctggacacgcactggccaacgccagaccccatctcatcgggtggggaagtcgcggggacactgtcagggcgccgaagtccggacccggctcagaggcsgtggcaggtgaattgctgcggcgccgggtaggggcgggcgcgtgggagcgagtcagcctggccagtttcggcccagcttccgaaggatggtgcttcttgc

SEQ ID NO: 48908 - DNA, 201 bp, Homo sapiens
agaaatcttaagtgaccgactgcactagacatttattacatggaaagaggagtcactgagtaatggtattggtgtagaatcaagtaatgattgtgcacagrattctcttctctttgtggttcattgaattgttgtgacttttatataatggcctgcagaataacagtgcacctccacaaaacctcagttcagcctaaaggg

SEQ ID NO: 48909 - DNA, 201 bp, Homo sapiens
ccgcgagtccctggacacgcactggccaacgccagaccccatctcatcgggtggggaagtcgcggggacactgtcagggcgccgaagtccggacccggctmagaggcggtggcaggtgaattgctgcggcgccgggtaggggcgggcgcgtgggagcgagtcagcctggccagtttcggcccagcttccgaaggatggtgc

SEQ ID NO: 48910 - DNA, 201 bp, Homo sapiens
gacagcagcgatggtcacgttgggctgttgagcatccatgcatgcagggtgtgtgctctttgtatctggcgtctttgggcaattcatccgcattgtgtgtkgttgcaggctgttcatctcactgctgagtattccactttgtgaatatgccacggttttgcaaatctattctgctattgatgagatttagatggtttccgg

SEQ ID NO: 48911 - DNA, 201 bp, Homo sapiens
tcaggtgagttggcccagttcctgggaggagaaaactaggaagaatggggaataagtggggcttgcttcataaatgtgagagggctaggaaaaaaaaattyaccaagatagtttacctgtcacatgacaagtgggagtttgtagagagagagagaccggagagctgtgcaaagtggatactggagacatacaggtaagaac

SEQ ID NO: 48912 - DNA, 201 bp, Homo sapiens
ccaaagaccttgcagaccctgtgtggcagtgtctagagctgtgtacctagccttttctaccaaagagcaaagctacacaaagaaaattcctcagtttcttraaaataagggcctgacttggcctgctacttataactgatctatatttcatgtattccagaaaattggaagcagtctggaatggttgtcctcaaattactg

SEQ ID NO: 48913 - DNA, 201 bp, Homo sapiens
tatttgaatgagagccacaaactgagacccttcatgactacagtgaatttggatatctcgcagaggagataatgccaaaccatacaccggacacacagctrggattcgccagatgccccaggaagggtttatttaattcattccaacaaatgatcctataatgcatttatgcatttaaaagcacagagacacaagtcctca

SEQ ID NO: 48914 - DNA, 201 bp, Homo sapiens
ctccaacccggtcttcacaataatcagtcaaactaaaactcatgagttcagcattatccagacatataaagcatctgaatatttgcctggactctacttgyttttaatttcttctttaaaaaatctttccgagccctgcatattgcattcagccagccctaccaccttagaaaagtgagcccaagaaacgtgtgcattgaa

SEQ ID NO: 48915 - DNA, 201 bp, Homo sapiens
gcaccatctcagctgagggagaggctccactgctctccaagtcccctgtcattggtagcaggctgtatctctcactttgagagactgactataaattctakccctgcccagtgaccaggggtctctctcacataaaacttgtttctatggacagacacccttgtggctctcgtctgacccatgtccagtttattcctatca

SEQ ID NO: 48916 - DNA, 201 bp, Homo sapiens
ctgtcctgcccccatttgtgtagctcttccttcacaaagacttagtctgctacttagggggagcatggctcagcttgttatctccatagggcactgtgcayggagcttccccagcacacacacacacacactaaagccattacttcttctgcgatggatgtcaaaatctccaacccggtcttcacaataatcagtcaaact

SEQ ID NO: 48917 - DNA, 201 bp, Homo sapiens
tgaggcctcccagagatactcaggtaacttctagtgactctgaccatcggtgacccccaggaatgtgttccagtgccccaggcagaatggtgccgtgtctstgtgtgtgtgtgtgtgtgtgtgtgtgtgagagagagagagagagagaaagagtgcacactatcgactacattatcatagggagaaatatttgcaaatgta

SEQ ID NO: 48918 - DNA, 201 bp, Homo sapiens
acagtgactgggagcagactcttttgacaaacagaaggctgggtaacagggggcgaactataaggtgtcactgtctcctctggtctcccagccccatttakctgcacctgtcctgcccccatttgtgtagctcttccttcacaaagacttagtctgctacttagggggagcatggctcagcttgttatctccatagggcac

SEQ ID NO: 48919 - DNA, 201 bp, Homo sapiens
ggctgacggcagcacacaagcccttccttactgaagacagcactcgcttcccagcccagagagggcatcagcaggcacaagagacgtctggaagggggctytactatcttcccagatcttcctgccttttaaaagacaagaactgctctcctctttgttttgtcactacataggatttatggctctttgctgaaatactat

SEQ ID NO: 48920 - DNA, 201 bp, Homo sapiens
atgcccctcttctggaataagaagaaatcctaacgcaatgaggccctacaagtcagtttgacagtgactgggagcagactcttttgacaaacagaaggctrggtaacagggggcgaactataaggtgtcactgtctcctctggtctcccagccccatttatctgcacctgtcctgcccccatttgtgtagctcttccttca

SEQ ID NO: 48921 - DNA, 201 bp, Homo sapiens
gggcagggagcgggaatcgaagcccgggcaggccctcctgcgacaccgcgactcggcaaaagccagggactcacagtgtgcttttcctgcagccacagacytttgctcattggttgggatcccccaggaggggaccctgagacaggatttggggagactagtttatgtgggaggggaagtgaaacagacaaggaggaagcc

SEQ ID NO: 48922 - DNA, 201 bp, Homo sapiens
caacgagcgccagggggcggcgctgtcgagctctaaacaaagccaaggaagttggagaagtttcgggctaaaaagggttaaggtgtaggagcacagagtcytccttctggggttggaagctccgttcccgggcagctcagcgtggattccgctgcgttcacctcttgcctccagggcccagtagatcctgggctttaaaca

SEQ ID NO: 48923 - DNA, 201 bp, Homo sapiens
ttcaatgtcactctttcagtctttttttcagtgtctttgacctacagcccctacagtcatctcccactgcttgtatctctctttccacctcttcagctgcsttgcagcccacctcaccttgttcactatgcccagtccgctccaccagggctcttcccagtacagggcctttgcaggtgtgatccttcccacctggactgc

SEQ ID NO: 48924 - DNA, 201 bp, Homo sapiens
cccaacagtaaactgtgagacagtcagagctggaaactcatccctcttgtctattgctggctccctagtgcctgctatagggagcaagtgatcagtaactmcttgatcccagccatacatgggaatcacctggggtgggggacaaaccatagtaccaagccccattctggaccaactatatcagacttgctgtgggtgagg

SEQ ID NO: 48925 - DNA, 201 bp, Homo sapiens
caaatcaaaacagcaacaaaattcaggctcactgtttaaaagtaaagataaatacctctttgggtgtaatttctatgacagtccagcaacatcaatttaayaccttttacatctcaacctttgtttaaaattattttgctctgggaatctgaaatttcaggataaattagcaaatctggtgaaaaagcaaatggccatttt

SEQ ID NO: 48926 - DNA, 201 bp, Homo sapiens
agtcaaggtggagccgggcgtcgggctgggcgggggctcgccagagccgctgtcgccaccgtccaccttgccggagtcacagtcggtgccaatgtggcggrcaagggccgagtcgggcccgcagatgcactcgaaggtaccggggaggttgtggcacaccccggagcagaagccgccgttttcgcactcgtcgatgtccgt

SEQ ID NO: 48927 - DNA, 201 bp, Homo sapiens
tccctccctcctccctctccctcccttcctccctctccctcccttcctcccttcctcttttcctcccttccatcctttcttccactcagttgaattctatraaccaattttaaccacaagagaacatcatcatccaagttaatcacgacaaacctcaaatagaacccaactaccagaactcagagagggacaaccgctcat

SEQ ID NO: 48928 - DNA, 201 bp, Homo sapiens
ccatgggggatgagggcctggatggaggccagggcatgaggacttgcaggacggatgagaaggaaagcagacaagggcgtgacaccccgacaaacacacgygggacaggaggcagcgatttcaacaatgaagtaaaacatttgtgatataacgtttttgggaaagccagaccctggagaaagaaggtagacgtcccaatta

SEQ ID NO: 48929 - DNA, 201 bp, Homo sapiens
accaagtagaatgacaaaggtgccatctccttcctctttctcagggaagggtctctctcttaaggacaaagatgtgaaaggtctctctcttagggacaaaraggaaaggacagaccaacctacagagtggaggagtgctagaccaaatcctcccaatacatctatttgagtagcagagactggagacagtggttgaggtca

SEQ ID NO: 48930 - DNA, 201 bp, Homo sapiens
ggtcctttctttagtctctcagtgatcagactgggcaaactctctgataagcaagacagggcacctaccaggagtcttggcaacactagtgtgtggctgcycagattagcatggaataagacacattctatttagaaatgtcagcctttttaacttagttgatgaaggttgaaggagaggcagcttcaggtgatggaaaga

SEQ ID NO: 48931 - DNA, 201 bp, Homo sapiens
ccccagggcttcttcccagcttgtacgtggggttgggggtcctttctttagtctctcagtgatcagactgggcaaactctctgataagcaagacagggcayctaccaggagtcttggcaacactagtgtgtggctgcccagattagcatggaataagacacattctatttagaaatgtcagcctttttaacttagttgatg

SEQ ID NO: 48932 - DNA, 201 bp, Homo sapiens
cagcactggcagtggtccccagggcttcttcccagcttgtacgtggggttgggggtcctttctttagtctctcagtgatcagactgggcaaactctctgakaagcaagacagggcacctaccaggagtcttggcaacactagtgtgtggctgcccagattagcatggaataagacacattctatttagaaatgtcagcctt

SEQ ID NO: 48933 - DNA, 201 bp, Homo sapiens
cgacactcaagcaccaggggcctttcatcccagcagaagggagaggagaggtaactggggcacgttttgcgccttcaccattgtatgtctgagtcatgatktctttacaactcctcagaggtcctccgcatgcaattccctccaaaccactgacaggcagcctgaagacctggttaggtaccgggtttgggataaaataga

SEQ ID NO: 48934 - DNA, 201 bp, Homo sapiens
gctgggattcgccagatgccccaggaagggtttatttaattcattccaacaaatgatcctataatgcatttatgcatttaaaagcacagagacacaagtcytcatatatgaagttgttatggttacagaaagaaaataaatatttgtgcacacagagatagcatgaaatcattctacagtgaaaataatagcctctggaaa

SEQ ID NO: 48935 - DNA, 201 bp, Homo sapiens
catcataacatcagggatctgcagcacttcctgtaacagcctatacactaaatattctcagcttggcaggccactggtctctgttgcaactatttaagtcyatctttgaggcttaaaagcagccatagacaatatgtacagcaatgggcatggctgtgttccaataagaccttctttacagaaacaggccgcaggctggtt

SEQ ID NO: 48936 - DNA, 201 bp, Homo sapiens
gtttctgcatgctacctttttggaggagggggaaaatacatgaagaaagactggagtcaaaccctggcaaaggctcgctgaaaatggggatttgggattayatgagcatttcagaacagatttattaaaagagggggacaatgaacaaggcgtaggatctccaaagagtctgtggaaggtgggatccatgttcccaaagga

SEQ ID NO: 48937 - DNA, 201 bp, Homo sapiens
ggcgctgtctccagaaagttctgttaaaatgtaacacactacagaagcaaaggaacaccattaccatcataacatcagggatctgcagcacttcctgtaasagcctatacactaaatattctcagcttggcaggccactggtctctgttgcaactatttaagtccatctttgaggcttaaaagcagccatagacaatatgt

SEQ ID NO: 48938 - DNA, 201 bp, Homo sapiens
ccaggtgtgtatgctgttcacaccacatatcagccctgcggggtgcttacagcggaaattgtgcaggttcctgcccaagagggacatgtaaatacatctaraagtagttgttatcttcccaaacaatgcagtacataaattgaatcccagtgcactctcatcaaaactccttgagtgcccccacttgcacccagaacattt

SEQ ID NO: 48939 - DNA, 201 bp, Homo sapiens
tcttacagcctttgaagggtcatgtggtgcccgtggccatgtgaccagcaggtgtcaggctggggtcacacccaggtgtgtatgctgttcacaccacataycagccctgcggggtgcttacagcggaaattgtgcaggttcctgcccaagagggacatgtaaatacatctagaagtagttgttatcttcccaaacaatgca

SEQ ID NO: 48940 - DNA, 201 bp, Homo sapiens
aggtttgggaaagtttgctatcagccccttgtaagattaagtcttcttaaatgcaaggttcctcaattctgtgcagtgtccacgtggacccacccacataycatgagctgtgggaatgggaagaggggtaaggggaactggtgcccacactgactgctgggccctaagtaatgaagccctaggtgtctaaccgaggagtgc

SEQ ID NO: 48941 - DNA, 201 bp, Homo sapiens
gaaccaagaattccatttgctgagtctgagaggccaggttctctttggagtctcagttgtagcctgtaacatttgggctctcataggccatatttcccacygctgtccttaaatagtactttagtcagatcagataacattaccatacgctctaactctcctgtaactactaaaccgaaacatttacaaatatgataaaac

SEQ ID NO: 48942 - DNA, 201 bp, Homo sapiens
cttctggccaaggattctcaggaaccaagagaagggatggtaactttgacacttctgttttcagaattgctccttgttcttcccaccgcattagagcatcractgctgcttcctccagtgggacccatcctggtgctggcaggttgctccaagtgtgggcaccgacacatgctgggcaaaccagcccttgaaccaagaatt

SEQ ID NO: 48943 - DNA, 201 bp, Homo sapiens
tggcgggtaggggagggaatgtgtgcagatgctttctgtgaaggtgggataggtgacttcctctgtgcccggttacctcgcatatgtcatgcccagcagcsgggggaatcttcaccagctgaacccatcacataaccagctcctagatcaagaagcagaacattctctgctccctagacccccgggtcattcccccaggct

SEQ ID NO: 48944 - DNA, 201 bp, Homo sapiens
ctatgtggtatggcctattgctcctaagttacgaacctgtacagcatgttactctactgatcagtagaggcaattgtaacacaatggtaagtattcatatrtcttaacatctgaacatagaaaaagtatagtaaaaatacagtattataatcttatgggatcatcttcatatacatggtttgtcattgattgaaatgtcat

SEQ ID NO: 48945 - DNA, 201 bp, Homo sapiens
ctcggccagatatgggaggaagctgaagtcctccatgctgctcaaaccaaggacactgcccaccgccccaggactgtacaataataaacaagtccttccaytgaacactggggtgggggaagcagaaggtgaagctaattttaagtgtccaggaacttatttgaaacaatcttgacccaaactgttctgaagttctgtagg

SEQ ID NO: 48946 - DNA, 201 bp, Homo sapiens
tttttaatcaggctttcattagtgttctgaagaggctgtaatttctttttaatctatttttaattggagtataatttacatatggtagagtgttctctttytagttgtacagttctatgaattttgacatgcaaatttttacattttacattttacaattttacattttacattggggcaactaactgttgccccaatcaa

SEQ ID NO: 48947 - DNA, 201 bp, Homo sapiens
aaaaaaataacccatttgtatcatttgcctctttccgtggtataaatacctccaccagggtcagcttcagtctcctcatgatgttgtggagcatggagcarggaggaggtgtgagcagcctgccgcggaacaggaggctccacagatgcagataaccttaagagcacaggttgcagtaaaaatcatcaggcatgcaggttt

SEQ ID NO: 48948 - DNA, 201 bp, Homo sapiens
gctttgctgtattaattccatgttcatgcaaacatctgtgcatgagtgtctatgacaactgtattcacaatagccaaaacctagaagcaacccaattatcyttccacaggtaaatggttgaaagtggctcatccatactctgaaatactactcagtaatacaaagtaatagattgatccacacatctacctggatgcgtct

SEQ ID NO: 48949 - DNA, 201 bp, Homo sapiens
agatgcagcagaatgaatcgggtatatcagttgtaaagtcatatataatataatttgaagtgaaaaggttcaaaaaggtatattttttattggtgaaggaygaaatctgccaaacacatattagtcccttcaccacgcggctgtaaatagaagacaaaactggtggaaatccgaggagaagctgacgaagccacagccatg

SEQ ID NO: 48950 - DNA, 201 bp, Homo sapiens
tctcccattaaaagacaaagacttttgattgaataaaagaaaaaaaaagtgaaatccagctttgttgtttacaagagacaaacatgaagtgtcaccagaargctgaatttagggaaaaaataccagatattcatcagatgcagcagaatgaatcgggtatatcagttgtaaagtcatatataatataatttgaagtgaaaa

SEQ ID NO: 48951 - DNA, 201 bp, Homo sapiens
ccagagctgcaggccctgggaggggtggggacaagctttgtgccaagaaggtgcaggaagccatccagcagggctttgatggtgcagtgggcactatagcytctaccatcctaagaagatgctggaactgtcaacacaatagccagtcctctgcaggcgctgtctccagaaagttctgttaaaatgtaacacactacagaa

SEQ ID NO: 48952 - DNA, 201 bp, Homo sapiens
aagctgaggtgttcagtggggccagagctgcaggccctgggaggggtggggacaagctttgtgccaagaaggtgcaggaagccatccagcagggctttgayggtgcagtgggcactatagcctctaccatcctaagaagatgctggaactgtcaacacaatagccagtcctctgcaggcgctgtctccagaaagttctgtt

SEQ ID NO: 48953 - DNA, 201 bp, Homo sapiens
tctgtattatttctcataagttgtatgtgaatctgcaaatatctcaaaataaaatgttttattaaaaaaaaacaggagagattctcagggcagaagtttayttatacattgcataagaactagatgcaagtggctttgtcacctgttcgctgcagggaagtcacacccgtccaaagggccaccagcatccacctggatctc

SEQ ID NO: 48954 - DNA, 201 bp, Homo sapiens
atagaggtctgaaggaaagaagccaggcgggggaccccgggagggccggacggggctgggggtgctgttgacactggagccggactggagacctgggaacytggggcagagtcggcagcggggagggggcgaccgaggtgggaaaacggggcggggccggagacgactccagggctgggtgaggcgctgacccccaggagc

SEQ ID NO: 48955 - DNA, 201 bp, Homo sapiens
gccaatctatcatccccgctgctgggtcccagagccattcaagttggtctgaggcattcagggcttgccatctcccagtgggcacaaggcagctcccctgyaagaacacttcccagctttgatgacctaaccctccttgctggggtgcagataaaggacacggcaggtgcactacctctgtaaccctcactcaaatatgcc

SEQ ID NO: 48956 - DNA, 201 bp, Homo sapiens
gtggggcagccataaccagaggttcatgttgtatgcttccatttatgcaataatcttaaaatgatattctatcaattctttcaatggagaacagactaatrgttgtcaggggttaaggtggggtggagtcagggggcaagtgagtgtggttaaaaaaggacagcaggagtcatcttcatggtgacagacatgtgccgtgct

SEQ ID NO: 48957 - DNA, 201 bp, Homo sapiens
tacgacacagaaggatgttagaactgtgtgtgcttgtgggtgtgtgtcttgtgggtgtgtgttgtgtgtgtttgtggatgcatatctctgtgtcatgcatrtgtgtgtttatgtgtgtgggtgtgtgtgttgggggaacagccatggttgttcatatcgaggaataacttccaagtgtatgttgttaatgaatagacttct

SEQ ID NO: 48958 - DNA, 201 bp, Homo sapiens
cctatctgtgccccctgcacaccagggtgggccactccttcctatccctttgcagataacacatccacttcccaatgcttggcccagttcctggcccagcrccctcactctggcccaccagcagacttgctttactcctgaaacagctcccttgaagaacacccatctggtcctaaatactgttgccaaaatcttgttttc

SEQ ID NO: 48959 - DNA, 201 bp, Homo sapiens
tctacaccacctctctggttcctggagcaaggaaggcaggtgtttgtgtcttctggccaaggattctcaggaaccaagagaagggatggtaactttgacayttctgttttcagaattgctccttgttcttcccaccgcattagagcatcgactgctgcttcctccagtgggacccatcctggtgctggcaggttgctccaa

SEQ ID NO: 48960 - DNA, 201 bp, Homo sapiens
gggcactgggcccatgcggccttcatatgacaaggaagtatcatttaacctgaaggactgcttctgggtcctttttgtttttgtgtggttttttttttttyctttttttctttttttgacagagtcttgctctgtctcccaggcttgggtgcagtggtgagatctctgctcactgcaacctccgtctcctaggttcacgca

SEQ ID NO: 48961 - DNA, 201 bp, Homo sapiens
gctgggagctgagatcttgccactacactgcagcctgggcaacagagcaaggctccgtctcaaaagaaggaaagaaagaaaggaagaaaggaagaaagaargaaggaaggaaggaaggaaggaaggaaagaaggaaggaaggaaggaaggaagaaagaaaagttcctaaccctggattaatgtcctggggctgacaaaaca

SEQ ID NO: 48962 - DNA, 201 bp, Homo sapiens
acatgtggaaggggactggtcagtggacccaagcagtgggtgggggggccctcagcaggtggccgcaggtttccaggctgtggagtccaggtcagatgttytcggggctgggtggaggtggggggaagggcaccgggcacgcagaaggactgcatggctcctgccgggagctggggtcctggaaggctgtgtccgctggag

SEQ ID NO: 48963 - DNA, 201 bp, Homo sapiens
cattgtcccatggggggtaccacagtgtctgggttgccctacacaaggatgggtggacatgacccacttggctttcccacctgtaagggctttacccctgrccctcaggatacctttgccttgtggggcctgccctcagccgctttgtttttcctctccagccaataccttggaggctttgcatattttagactaccttct

SEQ ID NO: 48964 - DNA, 201 bp, Homo sapiens
aaggacttttctcctactaaggtcaagttctgaggtgctgaggtgacaaggtcaacaaatgaattttggggacacaattcagccagtatcacttacatgtyctgattttcctccccaaaattctacatgctactagttattactatgcccattttagaaattaatgagatactcaaagaagtgcagtaactacagcaaaat

SEQ ID NO: 48965 - DNA, 201 bp, Homo sapiens
ttccctgggatctgccctcagagcaggcaaggcaggtctcaggatgcacaatctttctgatcagagggcttttgagtagttctaccccagtgtgtgtgtgygtgtgtgtgtgtgtgtgtgtgtgtgtgtttggggggtacatacacaagcccaagtaagtttgtttgaacatattattaaaaatacccatattgcttaaca

SEQ ID NO: 48966 - DNA, 201 bp, Homo sapiens
gagcattgtcccatggggggtaccacagtgtctgggttgccctacacaaggatgggtggacatgacccacttggctttcccacctgtaagggctttacccmtgaccctcaggatacctttgccttgtggggcctgccctcagccgctttgtttttcctctccagccaataccttggaggctttgcatattttagactacct

SEQ ID NO: 48967 - DNA, 201 bp, Homo sapiens
tttacaactcctcagaggtcctccgcatgcaattccctccaaaccactgacaggcagcctgaagacctggttaggtaccgggtttgggataaaatagacarccttgccctcaaggagctcacagacaagttaaaaactccaaaaccaagtttgattgatgtaatgccagaaaatgtagccagagtctggcatgcgagagta

SEQ ID NO: 48968 - DNA, 201 bp, Homo sapiens
taactggggcacgttttgcgccttcaccattgtatgtctgagtcatgatgtctttacaactcctcagaggtcctccgcatgcaattccctccaaaccactsacaggcagcctgaagacctggttaggtaccgggtttgggataaaatagacagccttgccctcaaggagctcacagacaagttaaaaactccaaaaccaag

SEQ ID NO: 48969 - DNA, 201 bp, Homo sapiens
gagaggtaactggggcacgttttgcgccttcaccattgtatgtctgagtcatgatgtctttacaactcctcagaggtcctccgcatgcaattccctccaawccactgacaggcagcctgaagacctggttaggtaccgggtttgggataaaatagacagccttgccctcaaggagctcacagacaagttaaaaactccaaa

SEQ ID NO: 48970 - DNA, 201 bp, Homo sapiens
aggggcctttcatcccagcagaagggagaggagaggtaactggggcacgttttgcgccttcaccattgtatgtctgagtcatgatgtctttacaactcctyagaggtcctccgcatgcaattccctccaaaccactgacaggcagcctgaagacctggttaggtaccgggtttgggataaaatagacagccttgccctcaa

SEQ ID NO: 48971 - DNA, 201 bp, Homo sapiens
gatctctgtgtactgtggagtacagggccttgggctgagcccaaagcattctgagcaaagcatgcatgtatgggcatgtatgggaactaggagttctaaaygctttcccttaccctgtccccttaatcctcttaccaacctgcaagacaggtccttccacagtttcatgtgagatgagtaacggcagttttctcagctgtt

SEQ ID NO: 48972 - DNA, 201 bp, Homo sapiens
cctggcattcatccacgtccacacagtccagctgactcgagtccagctggtacccttgggggcagcggcacgtgtagtttttcccatggggtcccaggacrcacgtggcccccccacgacatgggctggagctgcaagggtttcgagaggcacaggtcaccaggtcatccagcagccggaatcctggtcggcagccgcaga

SEQ ID NO: 48973 - DNA, 201 bp, Homo sapiens
tacttgatcccagccatacatgggaatcacctggggtgggggacaaaccatagtaccaagccccattctggaccaactatatcagacttgctgtgggtgargcgcacgcgcacacacacacacacacacacacaggtgattcttacaccagctctgagaagcactgaggttgggaagtgagaggtggagagcttgctagca

SEQ ID NO: 48974 - DNA, 201 bp, Homo sapiens
ctacccgctgctctcttctttagcttcagggccttttcatttcccggcagcaacgaggtgcactgagcacttgtcggggctgtgtttggagcccatcaacwgtgctaccagctttagttccatcaaccccaggcttttgtaacaactggttgcatgaaaccctcccttgtagtttgtgtacagaagactgcaatgaattga

SEQ ID NO: 48975 - DNA, 201 bp, Homo sapiens
agccccagagccagggccagcaggagtaggatggccaccacggtgcctaggatgtagaataaaagcagcttttgcccgtcagtgccatcgttgttttgtgyggccacggaggagtccccacctgcaggctcctgggggccagaggcagctgtggcgtgatggatgctgggctccctccagacgcctgaggacccactgggg

SEQ ID NO: 48976 - DNA, 201 bp, Homo sapiens
gccgaggctcattctcctccctctaatcaccccctcgccagttagccatggaatagaagaaaacagcttggggggtgcggggagggtcttctccagctgtmatgccagctaaggtgctttggtagcaaagctgggggtgaggaggcacaggctcctggacggagccaggctcctggacggaggccgctcagagtctctgcg

SEQ ID NO: 48977 - DNA, 201 bp, Homo sapiens
ggggctgcgtctcgtggaccttattgtctgctcagcaataacacagggcctggtgctttctgacgaatccacacacatgcactgagtggagctgcgctcasggatgagcacagctgcatctttcacggaggctgctttcctgtcagcttgcatttccctggatctctgtgtactgtggagtacagggccttgggctgagcc

SEQ ID NO: 48978 - DNA, 201 bp, Homo sapiens
tctcaaaaatgaaattataataatttaaaaaggatacttgaataaccccaaagaaaacaggaaaagagaactgaaaggaagggaaggaggaggaggtggargaggaaggtaggaaaggtagaaaaagaaccgaataacaggcctaaccccaataaatgctgattctatctacgaatacttctaaaacaggccaaacaaatc

SEQ ID NO: 48979 - DNA, 201 bp, Homo sapiens
tcctggttacatgctctcactgcaaacctctcaaccttgctcctcttcctcccagaactgagcatagtggtaactttgtatatgtgaaattgatctcccarcagtaaactgtgagacagtcagagctggaaactcatccctcttgtctattgctggctccctagtgcctgctatagggagcaagtgatcagtaactacttg

SEQ ID NO: 48980 - DNA, 201 bp, Homo sapiens
tctggtgacttgtcactcctcgatgaacagaaactaccagagacaggagtgggccaagggagttggcgactgtgaggtgaggtcggggtcctggggaggarggtggagggtggagaaagaataaagaaagaggatgtgctggttaacattgagagttctgactaacacagagggtctctgtgctgatttgctccagatacc

SEQ ID NO: 48981 - DNA, 201 bp, Homo sapiens
gagggtgctgggcctcaccaaggccagcagaacgaagtggcctgaaattcgcaccggcacgccctgagaaactcagcccttccttctcaggctccaagccyagctttgtgagacctgattgtgaccaccacacctgggacattcctctacccccttttgtgttctctctctctcttctctccctcatctctccttccttct

SEQ ID NO: 48982 - DNA, 201 bp, Homo sapiens
ccaggggtctctctcacataaaacttgtttctatggacagacacccttgtggctctcgtctgacccatgtccagtttattcctatcaagacagccacttcstaagagatccctgatgggaggagagttgggttggggtgtgggtcaggggagatgcaggaggcagcacaagaagacacaggaagcaacacaagcaccgtgt

SEQ ID NO: 48983 - DNA, 201 bp, Homo sapiens
cagtttttgctgtaaaaatgattttagttagtcatctctttccctcttccttccctccttacccccaattttaaggaaaagagacagagaacaaaagttcyttaagcaaactgcctgactagctccctacttggtgtgtgcgccacccacacttcaggatttaaaatctcaggatgctgcatcaactgtggactatgaact

SEQ ID NO: 48984 - DNA, 201 bp, Homo sapiens
caatacacacacacgcacacacgtgtgtgaacatgcatgcagactgagtgactgatgaactcttttaactgcattaggccttggggagctttgcccatctycccactgtagattcagcctcctggttacatgctctcactgcaaacctctcaaccttgctcctcttcctcccagaactgagcatagtggtaactttgtata

SEQ ID NO: 48985 - DNA, 201 bp, Homo sapiens
gacacagaactttggatctatcatctattggatttccatggagccaaaggaagctcgggaatgcccagtgatctattcagggtcagtcatccagggtggcytactttgagagcaaagagaattttgtgtctagcagattcatgggacactaccttggtcttctcactcaggtgtcctgatatatcccctcctctcaagagg

SEQ ID NO: 48986 - DNA, 201 bp, Homo sapiens
atgtccacattccccagccacagttctgtgggccacccagtccttccacaaggccaatacacacacacgcacacacgtgtgtgaacatgcatgcagactgrgtgactgatgaactcttttaactgcattaggccttggggagctttgcccatctccccactgtagattcagcctcctggttacatgctctcactgcaaacc

SEQ ID NO: 48987 - DNA, 201 bp, Homo sapiens
cctgggcaacagagcaaggctccgtctcaaaagaaggaaagaaagaaaggaagaaaggaagaaagaaagaaggaaggaaggaaggaaggaaggaaagaaggaaggaaggaaggaaggaagaaagaaaagttcctaaccctggattaatgtcctggggctgacaaaacaaagtaccacaaactgggtggcttaaaatgacag

SEQ ID NO: 48988 - DNA, 201 bp, Homo sapiens
aaagaaaataaatatttgtgcacacagagatagcatgaaatcattctacagtgaaaataatagcctctggaaaaagctttgaaaatcagagatggtgccaycaccagacaacacaagtgctggggtacagggcagccctccatgcatctcatagcatttgcatggtttgtgagccccatttaatgacataaaatgagggca

SEQ ID NO: 48989 - DNA, 201 bp, Homo sapiens
aaatcagatttttttttttttttgaggcagtctcactctgttgctcaggctggagtggcacgatctcggctcactgcaacctccgcctcttgggttcaagmgattctcctgcctcagcctcccaagtagctgagattacaagcatgtactaccatgcccagctaattttttctatttttagtagagatggcatttcaccat

SEQ ID NO: 48990 - DNA, 201 bp, Homo sapiens
agcctgggcaacagagcaaggctccgtctcaaaagaaggaaagaaagaaaggaagaaaggaagaaagaaagaaggaaggaaggaaggaaggaaggaaagaaggaaggaaggaaggaaggaagaaagaaaagttcctaaccctggattaatgtcctggggctgacaaaacaaagtaccacaaactgggtggcttaaaatgac

SEQ ID NO: 48991 - DNA, 201 bp, Homo sapiens
cagcctgggcaacagagcaaggctccgtctcaaaagaaggaaagaaagaaaggaagaaaggaagaaagaaagaaggaaggaaggaaggaaggaaggaaagaaggaaggaaggaaggaaggaagaaagaaaagttcctaaccctggattaatgtcctggggctgacaaaacaaagtaccacaaactgggtggcttaaaatga

SEQ ID NO: 48992 - DNA, 201 bp, Homo sapiens
tgcagcctgggcaacagagcaaggctccgtctcaaaagaaggaaagaaagaaaggaagaaaggaagaaagaaagaaggaaggaaggaaggaaggaaggaargaaggaaggaaggaaggaaggaagaaagaaaagttcctaaccctggattaatgtcctggggctgacaaaacaaagtaccacaaactgggtggcttaaaat

SEQ ID NO: 48993 - DNA, 201 bp, Homo sapiens
acactgcagcctgggcaacagagcaaggctccgtctcaaaagaaggaaagaaagaaaggaagaaaggaagaaagaaagaaggaaggaaggaaggaaggaargaaagaaggaaggaaggaaggaaggaagaaagaaaagttcctaaccctggattaatgtcctggggctgacaaaacaaagtaccacaaactgggtggctta

SEQ ID NO: 48994 - DNA, 201 bp, Homo sapiens
ccatctctaatttgttggcacccaccagggataccttgggcatctgaagtcagtctccatgtctgtgggtctcgtgtaaccataactacttggagtttttwaaaactgcattatttctttgttcctcagtgtctgacaatgcctgccaggatgggcactgatgaatatggttgaacggaactccaaggaccacccaggttg

SEQ ID NO: 48995 - DNA, 201 bp, Homo sapiens
cccagctacctgggaggctgaggcaggagaatcacttaatcccaggaggcagaggttgtggtgagccgagatcgcaccattgcactcagcctgggcaacargagtgaaactctgtctcaaaataaataaaaaaataaaaataaaaacaaaaaataaaaataaaaataaaaaaaccttctgcccagctcttgcctgcatctg

SEQ ID NO: 48996 - DNA, 201 bp, Homo sapiens
ttcaaaaccttctgcccaggccgggagcagtggctcacgcctgtaatcccagcactttgggaggccaagacgggtggatcacctgaggtcgggagtttgasaccagcctgaccaacatggagaaaccctatctctactaaaaatacaaaaaattagctgggcgtgatggcacatgtctgtaatcccagctacctgggaggc

SEQ ID NO: 48997 - DNA, 201 bp, Homo sapiens
tcttcaccagctgaacccatcacataaccagctcctagatcaagaagcagaacattctctgctccctagacccccgggtcattcccccaggctccatactscccgctctgacagcagcgatggtcacgttgggctgttgagcatccatgcatgcagggtgtgtgctctttgtatctggcgtctttgggcaattcatccgca

SEQ ID NO: 48998 - DNA, 201 bp, Homo sapiens
gtaactacttgatcccagccatacatgggaatcacctggggtgggggacaaaccatagtaccaagccccattctggaccaactatatcagacttgctgtgrgtgaggcgcacgcgcacacacacacacacacacacacaggtgattcttacaccagctctgagaagcactgaggttgggaagtgagaggtggagagcttgc

SEQ ID NO: 48999 - DNA, 201 bp, Homo sapiens
cctttcatcttccaggtcatttcattctgctatgaaggtgtttccatctcaaaaattggtagttcatataaagcgggcaaatgggcgccatagtcaccacyttacagacactgcactcatttacacaccattttgcatacatttgttctgactgctcttcagtgagaacttcattacttttatattacagaattgttatac

SEQ ID NO: 49000 - DNA, 201 bp, Homo sapiens
cagatattccaggtggtggctcagaacagctgacaaccatacctggggaagactggcctttatttttctggttgttcatactccaacagctagcaccgtaygttggggtccaatgaagcgagcagcagtagatggcatggccagggcaaggcagacacgctggagcagtcgggaaacctggcatctacacccatgcactgg

SEQ ID NO: 49001 - DNA, 201 bp, Homo sapiens
catgttgaaatagaagcctgatcatttgttttcccataagcacacacaccacagtgaaatgctgctggggcttgccattgatcataggataaaaatcagatttttttttttttttgaggcagtctcactctgttgctcaggctggagtggcacgatctcggctcactgcaacctccgcctcttgggttcaagcgattctcc

SEQ ID NO: 49002 - DNA, 201 bp, Homo sapiens
acaaagtcctcacaaggaagccaagaaatccacaagtgttgtttgagaaacgtcaactgtgcttcggctgttggcacacatctcctgtgggataagttcargccttaaatgtatgcaggacaagaggcttaaaagtgagcatgtgcagagaacaaaacctatttaggcaggaaaataagataattggaactatatatttta

SEQ ID NO: 49003 - DNA, 201 bp, Homo sapiens
tctcattcttaattgtttgagcagttatactttggttgttacttgcagccaaaagcattttctccagacttctgagtcctaaaaatttcattctttgacayaagagctgacccagaggccctgaagcccctctcaggcctgcagagctttggtctgtttgctgaatcagattcatatctacacaacagttctagggccaaa

SEQ ID NO: 49004 - DNA, 201 bp, Homo sapiens
gtttcccaagcaggtttcccaaggggacttctcactggtgggtttagagcaaacagacacgggctccgtggggtccctgtggctgagaggtgggcatggcrgcatgtctgggaagtccctgtggggtgtggagtcactgagaccatcaaatgggctgtatctgcctgtcccacagggaaatggtcaccaggaggtgggtgt

SEQ ID NO: 49005 - DNA, 201 bp, Homo sapiens
tccatgcatctcatagcatttgcatggtttgtgagccccatttaatgacataaaatgagggcactgagggaggaaaagtgaacagacacacaacccgagawcacattgttatttgtttattttgtacaagtgatgtcataagcaaggattttgcctgtgttctagattatctccaataaataaataactatgtacaaatat

SEQ ID NO: 49006 - DNA, 201 bp, Homo sapiens
tagctatggccctaacagagcactcactcctgcccagtgttgctggaaaatcaggggccgattgaaagcgccttccctgggttgtgtgacagtgagctctyaccactagacaatgggatctttatctgccttagggattttagtaaaggtgatctttcacagtcttgccttaaggcaaaatcgagccattgttctcatgcc

SEQ ID NO: 49007 - DNA, 201 bp, Homo sapiens
atcaagacagccacttcctaagagatccctgatgggaggagagttgggttggggtgtgggtcaggggagatgcaggaggcagcacaagaagacacaggaarcaacacaagcaccgtgtcacttacagatcccagggagagggcagtgcaccccacggggccagcaaaaagtggggagctgtctgggtcacaaacactcacc

SEQ ID NO: 49008 - DNA, 201 bp, Homo sapiens
ccatgatggggggaaatcagaacagtggttgcctctagctggggagaaggtaaaattgagaagggggatggggaaacttcctagggtgatggtccgggtcyttatcttgacagggtgttgattacacagatgtctgcatttgtcaaaactcatggaatgacacacttaaaatttgtacatttaattgtgtgtaaatcttat

SEQ ID NO: 49009 - DNA, 201 bp, Homo sapiens
aaacaaatcatttcaatcctaatcagcatgagcaactcaccttttcctcttagatggtggaagtgagcagagaagatattcaggggagccccttagccccrgcctcctcacaccctgatccggaattggtcacattggaatttgaaaagggagggggagtaacaatcattatagagtcacgaaatccccaccgtggcacgc

SEQ ID NO: 49010 - DNA, 201 bp, Homo sapiens
acactgaaaaggcagagttttctaagtattgattcctgtgtcattcaattgtgagagcatttgagtttcaaaaatgttttcaaatgctcctgtaattttcyttgtggggtggtgggaggagtgaaagtttactttcactgttggtaaaatgtctaggaacagaaggtctgaattaatagcctagttcctgcaatagcaatg

SEQ ID NO: 49011 - DNA, 201 bp, Homo sapiens
ccacagtgtctgggttgccctacacaaggatgggtggacatgacccacttggctttcccacctgtaagggctttacccctgaccctcaggatacctttgcyttgtggggcctgccctcagccgctttgtttttcctctccagccaataccttggaggctttgcatattttagactaccttctggtgactgaaggtcccctg

SEQ ID NO: 49012 - DNA, 201 bp, Homo sapiens
aactggcaagagtattaaccctgcaccttgtggcccttcaaccgctccagagtgtcacctcagagaccgatgcattgctaaggcaaaaccagaaacacccyttctctgaggctttggggccttggagggagacacatttcctctgtctgttctcctgcacagtggtggtaaaaagcccacaggagacatgaggcctcccag

SEQ ID NO: 49013 - DNA, 201 bp, Homo sapiens
ccctgcccctttagttttctattaaaaacaatctgaaccatagcatctatatttcaaaactggcaagagtattaaccctgcaccttgtggcccttcaaccrctccagagtgtcacctcagagaccgatgcattgctaaggcaaaaccagaaacaccctttctctgaggctttggggccttggagggagacacatttcctct

SEQ ID NO: 49014 - DNA, 201 bp, Homo sapiens
tcaccattctcaaggctcctcctccaattacttttgagacacatgttttcctcccttcctctcctgtgagccttggggaggcccctgggatcctcttgtascacccactagagtggccattctcaaggttttgctggtggtcttcatcatctctttacaacccaccttttggtgaacttacccattcccctggcagtgata

SEQ ID NO: 49015 - DNA, 201 bp, Homo sapiens
tgctcccaaccctcacccccactctcacataaccattgaactaccatccatcactgcggattagttttacctcttctagaatgtcatagaaatggaatcakgcagtgtccagctaattttgttcctttgtgtctggctttcttgctcattgtgtatttcagacgcctgctccttttccttgataagggatatcccattgtg

SEQ ID NO: 49016 - DNA, 201 bp, Homo sapiens
cgatagaccagtagccccagagccagggccagcaggagtaggatggccaccacggtgcctaggatgtagaataaaagcagcttttgcccgtcagtgccatygttgttttgtgtggccacggaggagtccccacctgcaggctcctgggggccagaggcagctgtggcgtgatggatgctgggctccctccagacgcctgag

SEQ ID NO: 49017 - DNA, 201 bp, Homo sapiens
gacttacaattgtttgctaagattccagtccagtctttcaaaaaaatgtgggtgcccctttggaatggggagttcaaagctctgaggatggtggctggtgwctctagtgtctctagggccacctcactttcagcagtctgtcccaggtgtcggactatgggaaacaaaacagacagcgttggaagccatggcgcctctgtg

SEQ ID NO: 49018 - DNA, 201 bp, Homo sapiens
ctcacttcctcccccagtccaccatccgtccagtgatccacgacgtgcaggcggcatccttcctcccaccttcccagcctctagggatgatctggctccawgccctgggccagtcctctttttccccgcccatgccccacctccaccgcctctcacatgggtgggcacagcactggtgtcctgaccagcccctggctccag

SEQ ID NO: 49019 - DNA, 201 bp, Homo sapiens; identical to SEQ ID NO: 9097

SEQ ID NO: 49020 - DNA, 201 bp, Homo sapiens
gcctgtccacatcaggcctgtcctttcatctcccaatcagagcacccagctgtccactatttcccagaacatctcagagtcaccaagacccaaactactcycacttcctcccccagtccaccatccgtccagtgatccacgacgtgcaggcggcatccttcctcccaccttcccagcctctagggatgatctggctccatg

SEQ ID NO: 49021 - DNA, 201 bp, Homo sapiens
tagagcacagggaagtaagttcctggaagcactagctgtttatcacatagggctaataaccaatggggacagtcgtgcatgcttctcttcttacatgctarcttactatgcttggaggcatacacatgtgtatggggagaggagggcagaatcggggagcattaggagaaaaacctaaagtaggcacaggaaagattccag

SEQ ID NO: 49022 - DNA, 201 bp, Homo sapiens
ggctcctggacccgtgcaaggatctggcaaagctgagatccaggccagcacagcccagttctctcctcctgctgcagccaggctctcagcacgtgcattcwcccccactgctttccatctgcccacttcttcattcatggctgtcctttctgcctctctggtgtcctggggctgctttcacgtcggcctcctctgacctct

SEQ ID NO: 49023 - DNA, 201 bp, Homo sapiens
acacagtgttttaaatatttcagtgaattgtgcatatttaagaaatgtgagattttacagaaagatttgcatttctggcttttctaaaaaaaaaaaaaaaatcaaagtgtcttgcaatgctggcaaccagcccaacgtggcaatcagtgcctgcattagcttcctccttagtgccgccaggctggctcctgcagccctggg

SEQ ID NO: 49024 - DNA, 201 bp, Homo sapiens
tggcgcagggcttgcaggctcacttcccccggctcaggattcctagcaagggccggaaatctgggcagggagcgggaatcgaagcccgggcaggccctccygcgacaccgcgactcggcaaaagccagggactcacagtgtgcttttcctgcagccacagacctttgctcattggttgggatcccccaggaggggaccctg

SEQ ID NO: 49025 - DNA, 201 bp, Homo sapiens
ccaaaagacctacagccaaaaagcagggtttggctgtggccatctctaagaaagaaatgtagtcagatgattcaaaggaaaatgggtaaacaaaaaaaaamaaagctgcaagtttaaaaagtcaatactcaggattgatgaaaggaaagtggccttggaacacacagaggtgaccgctccttcatgatgtgtgtgtgtttt

SEQ ID NO: 49026 - DNA, 201 bp, Homo sapiens
ctactcgggaggctgacgcaggagaatggcgtgaacccaggaggcagaggttgcagtgagccaagactgtgccactgcactccagcctgggcgacagagcragactccgtctcaaaaaaaaaaaaagaaagaaagaaatacttttggactaaggcttcccctgtgtgatgggtactacataaattaataaacttctgcttg

SEQ ID NO: 49027 - DNA, 201 bp, Homo sapiens
cgggcgtggtggcgggtgcctgtagtcccagctactcgggaggctgacgcaggagaatggcgtgaacccaggaggcagaggttgcagtgagccaagactgygccactgcactccagcctgggcgacagagcaagactccgtctcaaaaaaaaaaaaagaaagaaagaaatacttttggactaaggcttcccctgtgtgatg

SEQ ID NO: 49028 - DNA, 201 bp, Homo sapiens
ctctttgctgaaatactatttaaccaaggacccctaagccattgccttcagaaatacttttggactggccgggcacggtggctcgcgcctgtaatcccagyactttgggaggcagaggcgggctgatcacgaggtcaggagatcgagaccatcctggctaacacaatgaaaccccgtctctattaaaaacacagaaaatta

SEQ ID NO: 49029 - DNA, 201 bp, Homo sapiens
ttacacaagcatggatggcatagcctactacacacctaggctatgtggtatggcctattgctcctaagttacgaacctgtacagcatgttactctactgawcagtagaggcaattgtaacacaatggtaagtattcatatatcttaacatctgaacatagaaaaagtatagtaaaaatacagtattataatcttatgggat

SEQ ID NO: 49030 - DNA, 201 bp, Homo sapiens
gctgtccactatttcccagaacatctcagagtcaccaagacccaaactactctcacttcctcccccagtccaccatccgtccagtgatccacgacgtgcargcggcatccttcctcccaccttcccagcctctagggatgatctggctccatgccctgggccagtcctctttttccccgcccatgccccacctccaccgcc

SEQ ID NO: 49031 - DNA, 201 bp, Homo sapiens
aggactgaaaactgcagactagctactctagacttctggtggctgagaacaagcctgcaggatggcttgacagctctgggtaaactgtctgagaacatcttcagcttgggcagaacagccttccaggaatgaagatgtcacagagagcagggtgctggagagggctttactctgaagtaggggcggccaatatttgatccc

SEQ ID NO: 49032 - DNA, 201 bp, Homo sapiens
cttgcaggctcacttcccccggctcaggattcctagcaagggccggaaatctgggcagggagcgggaatcgaagcccgggcaggccctcctgcgacaccgmgactcggcaaaagccagggactcacagtgtgcttttcctgcagccacagacctttgctcattggttgggatcccccaggaggggaccctgagacaggatt

SEQ ID NO: 49033 - DNA, 201 bp, Homo sapiens
cccctgccagcaggaagccctgcaaccagaacccggccgcaagcgcatccccctcaccaggaccaccaccttctgaggagcccttcccctacccaccctgygtggccacctcccaaggggtgggcaccattcctacagccccgaagactgcatctcctgaatgctcacctaagctccaccacctgttccttccagcagccc

SEQ ID NO: 49034 - DNA, 201 bp, Homo sapiens
tttagtagagacggggtttcaccatgttggccaggatgatctcaatctcttggcctcataatctgcccaccttggccccccaaagtgctgggattacaggygtgagccactgcgcccagccccagtagcattattcttcacagccaaagagtagaaagaacccaaatatccatcagctgttgaatgaatgaatggaatgtg

SEQ ID NO: 49035 - DNA, 201 bp, Homo sapiens
agctgaacttgcacacgaagccctcaatgttacttccgggggagcctgggctcccacaggggccctcagaccacttggggaggcggctgggaaggagcggmtgggacaggtccagcagcagagacacacagcgcttggagatgcacgagttccggagctccttgtgccagttagagtaaggcgtgtcctcccccccgccca

SEQ ID NO: 49036 - DNA, 201 bp, Homo sapiens
aacatatttagatataagcaggaccagaataacatacctagaacagatactgattttcttgcattcatgtaataatcatttaaaattcatatctgctttaygcgaatagatataaacatagagctaagtgctcctacaagatgaatttttagtaggctaaacagcacagctaaagtctcttatgaacctcatttccccaac

SEQ ID NO: 49037 - DNA, 201 bp, Homo sapiens
caactatatctaaaactttgcagaaacctgatgacctgcctgcagtgagcctctctgggtagtagactatggatgactttttggttccaaaaacatctctktattaaagtacaattcctaaactggaaggaaaatgggaaggtgtaactagaagcttgcatgcgggctcctgacctggagcaatttggtgactttgcctgt

SEQ ID NO: 49038 - DNA, 201 bp, Homo sapiens
cattaaacaggctaaataatccatgatggggggaaatcagaacagtggttgcctctagctggggagaaggtaaaattgagaagggggatggggaaacttcytagggtgatggtccgggtccttatcttgacagggtgttgattacacagatgtctgcatttgtcaaaactcatggaatgacacacttaaaatttgtacatt

SEQ ID NO: 49039 - DNA, 201 bp, Homo sapiens
gtgccgtaggtgatcgagacggcggcagccgcggcgccgggctccacagccagtggcctgcaggtggctgggaagtggaactcgcagaggaagccatcggscttcacttcgcactgctgctcctcccagatcggctcgctgggcacagtggcctcagcagcggagacagcgacgcacaacgggccgcagaggggagcccca

SEQ ID NO: 49040 - DNA, 201 bp, Homo sapiens
cctcggccgctgtttggctgacggcagcacacaagcccttccttactgaagacagcactcgcttcccagcccagagagggcatcagcaggcacaagagacrtctggaagggggctttactatcttcccagatcttcctgccttttaaaagacaagaactgctctcctctttgttttgtcactacataggatttatggctct

SEQ ID NO: 49041 - DNA, 201 bp, Homo sapiens
tttttcatgttgagcagtagaatataagagatgataatgaggaaatggaaattaaagacgtgtgcgtgtgccactccctgcagattcggtttataccatgsctccaggagtcacagagcgttggacacagcaggatgggtggtctgatcccagctatttgcagcccacacagtgatcaggggattctttattggtcacttt

SEQ ID NO: 49042 - DNA, 201 bp, Homo sapiens
tatgaaaacttcctctacttcaaaaaagatatatatagagaagaaaaaaacccaaccactaagaagcattgtattcaaatgcaagagacaatggtgggaaragccctctttgtcttgtttctgtccattgtggatgtttcttgtcactgttgtggaattatggtgagtgaaagagagggcgttaagaaggaagagaagaga

SEQ ID NO: 49043 - DNA, 201 bp, Homo sapiens
gattccagtccagtctttcaaaaaaatgtgggtgcccctttggaatggggagttcaaagctctgaggatggtggctggtgactctagtgtctctagggccmcctcactttcagcagtctgtcccaggtgtcggactatgggaaacaaaacagacagcgttggaagccatggcgcctctgtgcctgcacgtccccaccttgg

SEQ ID NO: 49044 - DNA, 201 bp, Homo sapiens
agagtttaattggtatatgaccttctagggacatttgactggcaagggaagaatgcttgaagtgagcatgtgtacaactccagtaaacaaactgtgctggyaggccactgagcatgtggacagcccatcccaagggaagaatcaggggagaaaggatgcaagaccccagaagtatgccaacacataaaaccccaagtgaaa

SEQ ID NO: 49045 - DNA, 201 bp, Homo sapiens
aatgacagagtttaattggtatatgaccttctagggacatttgactggcaagggaagaatgcttgaagtgagcatgtgtacaactccagtaaacaaactgwgctggtaggccactgagcatgtggacagcccatcccaagggaagaatcaggggagaaaggatgcaagaccccagaagtatgccaacacataaaaccccaa

SEQ ID NO: 49046 - DNA, 201 bp, Homo sapiens
ccatatagatttaaaccatgggttttgcagccgaagtagagacagatgttttctgggatcatatctcagattcccaagctaaagctattgttcaaggtgayggaaatatgtagggggcattaaaccattttgcagctgctagaaagctgtgttttcctgttttcctgatttagacaatggagaagctaagaagagaaataa

SEQ ID NO: 49047 - DNA, 201 bp, Homo sapiens
agggtttgactgtggccatctctaagaaagaaatgtagtcagatgattcaaaggaaaatgggtaaaagaaaaaaaccaaagctgcaagtttaaaaagtcartgctcaggaatgatgagaggaaagtggtcttggaacacacaggggtgaccactccttcatgatgtgtgtgtgttttgatagaggtcggtataattagaga

SEQ ID NO: 49048 - DNA, 201 bp, Homo sapiens
gacggtccttagcacaatgctaggcccacagaatatgctcaagcacatttcctagaaactgaagggcctgtacaggccaaaaggcctgtagcccaaaagcrgggtttgactgtggccatctctaagaaagaaatgtagtcagatgattcaaaggaaaatgggtaaaagaaaaaaaccaaagctgcaagtttaaaaagtcaa

SEQ ID NO: 49049 - DNA, 201 bp, Homo sapiens
ctaaatacttaaaaaaaataaatattttagtcatccctagcccacgaggtcaaggtctgcccagaaggctgccgaccaataacgctcaccctcctgcgccyggtagtgaggacctgggacaaatcgcagtctgtgtcttcgttacaaaattgccatcattgcccagtggtccagtgacgtcacggaagaggccgaggctca

SEQ ID NO: 49050 - DNA, 201 bp, Homo sapiens
tggacatgacccacttggctttcccacctgtaagggctttacccctgaccctcaggatacctttgccttgtggggcctgccctcagccgctttgtttttcytctccagccaataccttggaggctttgcatattttagactaccttctggtgactgaaggtcccctgtctgtgttcttgccccatccctatcttcctatct

SEQ ID NO: 49051 - DNA, 201 bp, Homo sapiens
cagcccatgtacctgccggagagtgtcagaactcttctgctgctctcctctcccctgcactctggctttcaaaaggatgcttccatatgggtaggactccyctggaaactgggctaggatattaatcattcctgaacctctggctgttcttcaagggctgggaagcaggaggtggtgagaaatgaatggtccctgtgtgtg

SEQ ID NO: 49052 - DNA, 201 bp, Homo sapiens
atctgcccacgaggaagaagaggcggtggagcttggaaggtatgcaaccatggctgagactgtaagagccacggtggaactccaggttctgaacctcaaargttccactttccattgtgatgaaagcatctcaggactgcactgcccagcttggcagccacagcctcacatgaccactgagcacttgaaatgtagttaata

SEQ ID NO: 49053 - DNA, 201 bp, Homo sapiens
gccccaagatcccccaaacaagaatttccatgcttcaaagtaacagcaaaaataaacaggagaataaagcacgtgtttgagcccagtggtttccatcagakgcacaacctgagctgtctggttgggttgctggctctccccccgtggtgggagtggtgtgcaagagaaagcaccacccagcaggagagggacccagcctgc

SEQ ID NO: 49054 - DNA, 201 bp, Homo sapiens
caaggaggaagccaacccatgatgacttgctgagaaggtgaccctgggctgctggagccagtgccaggaaactctgggggcctgaggggaccacacctcarcaccatctcagctgagggagaggctccactgctctccaagtcccctgtcattggtagcaggctgtatctctcactttgagagactgactataaattctag

SEQ ID NO: 49055 - DNA, 201 bp, Homo sapiens
atcatttcaatcctaatcagcatgagcaactcaccttttcctcttagatggtggaagtgagcagagaagatattcaggggagccccttagccccagcctcstcacaccctgatccggaattggtcacattggaatttgaaaagggagggggagtaacaatcattatagagtcacgaaatccccaccgtggcacgccaacac

SEQ ID NO: 49056 - DNA, 201 bp, Homo sapiens
aagggcagggtgaggggatgtcaagtgcaaggcaagtggtccaagcttccaggtggtccctgaccagttccgggcacatctttacccaaagggaggactcsgggacccccagccccgccgccgcagaccccctgtagcaaagcagggaactggacctcaaagggctgctggggaagacgggatctgaatagaggtctgaag

SEQ ID NO: 49057 - DNA, 201 bp, Homo sapiens
ggtccacccaccatgggtgctcaaaagtagaaggaaggatggggaaacattcagtccacgtccaaatcatcgagaagacttttcagattgggaataattcygaagccagatcccagcaaggcactgccaaaaaatggctctctggggtttattttcctttggaaaggacttttgggacatacggcaagagggagctttctg

SEQ ID NO: 49058 - DNA, 201 bp, Homo sapiens
accaccaggaatgtcagacaaccatcagatgatggtcaggcagttgttaactgtctttctaaaataatttgttgcagccagtgccagggaaagcagtctcsctatcaatagaagaaacctcaaactggggatcagcagcttccagataagatctcaggagctgggtaagtgggctcaagcttgtgcattaagatgcaaaat

SEQ ID NO: 49059 - DNA, 201 bp, Homo sapiens
cgccaaaagcgccaccaccaggcacaggctcgcgatggagatgcctatgagcaagcccgaatgcacgagccccacggccggaggagtcaaggtggagccgrgcgtcgggctgggcgggggctcgccagagccgctgtcgccaccgtccaccttgccggagtcacagtcggtgccaatgtggcgggcaagggccgagtcggg

SEQ ID NO: 49060 - DNA, 201 bp, Homo sapiens
acttatggtataggagatatatatatataattgttacagtaggtagctagtcaggcctgagcatggcaggagagggctcctccaccaccaggaatgtcagrcaaccatcagatgatggtcaggcagttgttaactgtctttctaaaataatttgttgcagccagtgccagggaaagcagtctccctatcaatagaagaaac

SEQ ID NO: 49061 - DNA, 201 bp, Homo sapiens
aggcacaggctcgcgatggagatgcctatgagcaagcccgaatgcacgagccccacggccggaggagtcaaggtggagccgggcgtcgggctgggcggggrctcgccagagccgctgtcgccaccgtccaccttgccggagtcacagtcggtgccaatgtggcgggcaagggccgagtcgggcccgcagatgcactcgaag

SEQ ID NO: 49062 - DNA, 201 bp, Homo sapiens
atgagcaagcccgaatgcacgagccccacggccggaggagtcaaggtggagccgggcgtcgggctgggcgggggctcgccagagccgctgtcgccaccgtmcaccttgccggagtcacagtcggtgccaatgtggcgggcaagggccgagtcgggcccgcagatgcactcgaaggtaccggggaggttgtggcacaccccg

SEQ ID NO: 49063 - DNA, 201 bp, Homo sapiens
gctgccccagtcgaacacatcgggggccttctccttgcacaggaaataatgactctgagtctcgtccttgtcaccttccccacaggctacattggccgcakaggcaaagggcacagcctccaaggaggaactggtggtctggaagggggtggtgtaggtcacctgacctgggccccccagggccagaggccggcacatgcc

SEQ ID NO: 49064 - DNA, 201 bp, Homo sapiens
agggccggaaatctgggcagggagcgggaatcgaagcccgggcaggccctcctgcgacaccgcgactcggcaaaagccagggactcacagtgtgcttttcytgcagccacagacctttgctcattggttgggatcccccaggaggggaccctgagacaggatttggggagactagtttatgtgggaggggaagtgaaacag

SEQ ID NO: 49065 - DNA, 201 bp, Homo sapiens
caatctgaagacaatcaagtccagactggatgtcagggtcccaggggtcatgtggtggatgattagagaccagagtttggaggagttatgccaaatccccrgaagcatggaaatcccccacctctgccgaatgttactggattgtgagctccctgccctgcagctggtcagtgaggctcccacaaatcagtactgacaaat

SEQ ID NO: 49066 - DNA, 201 bp, Homo sapiens
agattcggtttataccatgcctccaggagtcacagagcgttggacacagcaggatgggtggtctgatcccagctatttgcagcccacacagtgatcagggrattctttattggtcacttttttttctttctctctaccaattaatgttccttgttcttgatccacccctttgagccaaacaaccattgaaaagatggaaac

SEQ ID NO: 49067 - DNA, 201 bp, Homo sapiens
cttttgtgggttacatcagtttccagcaggcacatggctattagggggactcagcctcttggggataaaaagcaaagcaacttggagagttcatggcgccrtggggctgcaggaaggaaggtagccctagccttcagccccagaactggctgcaggtgaacaatctgaagacaatcaagtccagactggatgtcagggtcc

SEQ ID NO: 49068 - DNA, 201 bp, Homo sapiens
tgaggaaatggaaattaaagacgtgtgcgtgtgccactccctgcagattcggtttataccatgcctccaggagtcacagagcgttggacacagcaggatgrgtggtctgatcccagctatttgcagcccacacagtgatcaggggattctttattggtcacttttttttctttctctctaccaattaatgttccttgttct

SEQ ID NO: 49069 - DNA, 201 bp, Homo sapiens
cgttccctgggatctgccctcagagcaggcaaggcaggtctcaggatgcacaatctttctgatcagagggcttttgagtagttctaccccagtgtgtgtgygcgtgtgtgtgtgtgtgtgtgtgtgtgtgtttggggggtacatacacaagcccaagtaagtttgtttgaacatattattaaaaatacccatattgcttaa

SEQ ID NO: 49070 - DNA, 201 bp, Homo sapiens
gatgctagtaagcgttgggacgtgctgggagactcccctattcaggggacaaccctgacagatctgagcaatgatgacatttctgtccccagctgacaccyggctcaggagggacctggctcaggagggacacagactggcccatgtggcataagggaaagttccatatgcttctgggaaagtcccccttgctcttaaaca

SEQ ID NO: 49071 - DNA, 201 bp, Homo sapiens
ggtcctgctaacactgctctcggtatttaccttgccttttcttttctttccttttggaaggaaaggatatgctgtttcaggtgcagattagtgaaaatatrgaagtaatgttttctccattcaagctgatgagacccctgaatgaagaactattcacttaaaagaacacagaactatttcggtcagttcaagtagaagcct

SEQ ID NO: 49072 - DNA, 201 bp, Homo sapiens
ccaagggcactttgggaggacctgcctaggacgtggacttccccgaagacaggatcgcaaggagagacagctggatcctgtccgcggccaaggtgcctggytcaggaaaccagcggagcgcgcttggcctcacaggacagtgggtgtggctggggtgacggggcagggtggggaagactggcctaacaccagcgccctctg

SEQ ID NO: 49073 - DNA, 201 bp, Homo sapiens
accttcctgtttcccgtgggaacaaagtgggcggcaaatgcagggtgagatactgggtcacttcaggctccaacttgcagaagctgtttcagacccacaaygggagcaggctgcatcttttgcctactcaggataaaacgtgacactgctgcgtcatacagagatagttctgcatggtttcctaagaaaggcaaagccaga

SEQ ID NO: 49074 - DNA, 201 bp, Homo sapiens
gacagttcttcaaatgaaagttagctgggaactatccaggattctccctataccaagcttgtccaacctacagctcaagggcccatgaggcccaggatggytttgaatgcagtccaacacaaattcataaactttctcaaaacactatgagatttttttggtgattttttttttagctcatcactatcgttagtgttagtg

SEQ ID NO: 49075 - DNA, 201 bp, Homo sapiens
atagcctatgcatcttctatcgaaagtcatgacagttcttcaaatgaaagttagctgggaactatccaggattctccctataccaagcttgtccaacctayagctcaagggcccatgaggcccaggatggctttgaatgcagtccaacacaaattcataaactttctcaaaacactatgagatttttttggtgattttttt

SEQ ID NO: 49076 - DNA, 201 bp, Homo sapiens
cctgaactgtgagaagccaagtcctgtgttttagatacaataccatctgaattctgctctcactgctggcccatgttctgtggcttcagccgagtaattcmactctccagggctctttgtcatccatctgtgagagccagtccgggcagagaaggagaggagcagggcaagctgagaatgcagcccatgatgccgccccga

SEQ ID NO: 49077 - DNA, 201 bp, Homo sapiens
caggatgaaggtaaatcctgcatagaaatcttgtaattccagaattagtcaaacaaatttgaaatacacacatttaaaaatacttacattctcatttagcrttcatgaagtgattactgacatttacaattacatctgacatcacagagcaagcctttgcagggatctaattcaagcttaagccaaatctatgcaaagaac

SEQ ID NO: 49078 - DNA, 201 bp, Homo sapiens
aagagtttattaggataggcacataacagaaagctcaaaggacaacaaagctgcaccttcctaaaggctgaccctcaaagcaccattttgttagaactcaraggagaagctcgatctctgagccttccctcctcacagtttgggaaacatgcacaggatgaaggtaaatcctgcatagaaatcttgtaattccagaattag

SEQ ID NO: 49079 - DNA, 201 bp, Homo sapiens
ggggagaaaggtagcggctggtttcctgttccattgcttctttagtatcctgagagagaacagccatgggcacccagctgccccagcctcttcctgtcccrgggccccgaggctgcccttcagcggtctccagcttcctgctcctgtaagcaggggcctctctttttggctttcctgacatttctcctgacctcttctgct

SEQ ID NO: 49080 - DNA, 201 bp, Homo sapiens
tggatgtttcttgtcactgttgtggaattatggtgagtgaaagagagggcgttaagaaggaagagaagagaaaggaaaagcaaaatacagtgagtatttakgaagttgtagaaggcaaagtaaggactgaaatgaccacaagcttcatattacaaggagagagaaaaatgtggttctgttctttcagttaaagagaaaaac

SEQ ID NO: 49081 - DNA, 201 bp, Homo sapiens
atcattcagaaatccctcttctacccacaggcctggcagtgactgaggctccatctagctctgggagaagaggaagggagtggcttcccactgggggtgcytcagacctcgcttacctccacccatagctggtccacccaccatgggtgctcaaaagtagaaggaaggatggggaaacattcagtccacgtccaaatcatc

SEQ ID NO: 49082 - DNA, 201 bp, Homo sapiens
ttacagccacttccaaggaaagcctggattgcaagagctctgggaaccggagacttcagagaagagggctttgaatggggagtgggggaggtggtgcacargacctgcaagacgctgggaggggtgatcggcaccaagggcactttgggaggacctgcctaggacgtggacttccccgaagacaggatcgcaaggagagac

SEQ ID NO: 49083 - DNA, 201 bp, Homo sapiens
cttgttgtcccctccccaaaataaccattctgacttgcatgccacttgctgttgctgctcctgcttccttgtagtcaacaacttgtccccctattaaaacytttaggagaagtgcttctacagaagggatgggctgatgcattccctgggcaacactgcgtgaggggctggtggccgtggctcaccctctgggactcatcc

SEQ ID NO: 49084 - DNA, 201 bp, Homo sapiens
actcttgccaagaaggaacaaatccatgtaccagcaggagctgctagagggagcccagccttgtacacagtggaggccccaggtgctaagaaggcctcacraggccgctgttggtgcgcagaggctctcttaaaagtttgtgtgcaggtgctctcagagacatggccctgctgagagattgtgtttccaagtgtcagttgg

SEQ ID NO: 49085 - DNA, 201 bp, Homo sapiens; identical to SEQ ID NO: 9163

SEQ ID NO: 49086 - DNA, 201 bp, Homo sapiens
gttgaccaggtggtacatagacttcctttctcatttttgtctttgatgtgggtatgcccacctggcagttttcctatctctgttccgggcctctcctgacytgccgcctccagctccttagcttctgggccacatccttctctctcttcccccgctcagacccttatattttaaacccatgcacccagaggcctttggtgc

SEQ ID NO: 49087 - DNA, 201 bp, Homo sapiens
cttgtagcccaggctggagtgcaatggtgcaatcccagctcactgcaacctccactccccgggttcaagtgattctcctgcctcagctgggattacaggtkcccgccaccacacccagctaaattttgtatttttagtagagacgggctttcaccatgttggccaggctggtctcgaactccagacctcaggtgatccacc

SEQ ID NO: 49088 - DNA, 201 bp, Homo sapiens
ctggaaaccctggactctgctgctcagtactgctgagtcagatgtggctctgggcgcttcgggtttggccgctggctcagcctcccttggccctggggccyggatctgagcccaccctcctcagtgtgggtctgcaggaagctggggctgccctcgggtgatttgtgcctctccttgggaacttcctgccagcctgatccc

SEQ ID NO: 49089 - DNA, 201 bp, Homo sapiens
gcagagataaataaaatgtcgtcctgcttcctggtcagaggtgggtgcatgggtgagtggtggattcaggttgaagttcattgcagctggagtggcgggartggagggcaatgtgaggtgagtttgggtttggagcctggaaggccttgaatgcagtgagtttggacattattcattgacagtggggagtcatggaagaga

SEQ ID NO: 49090 - DNA, 201 bp, Homo sapiens
agcagccagggcaagacaaccgattggagttctgtagggcctgacacctgagctttctgactctgcctgggagaggctgggcacagcagggatgaaggagkcggcctaggcccaggaggtcagaggctcctcagcgccaccccatgtcacgcagcgcacgcagcctggatgcctcaggtgagtcaccatctcctgaactgc

SEQ ID NO: 49091 - DNA, 201 bp, Homo sapiens
ggcagccaagtttcaagcagaactgtgagccagaactcagcttaattaccccagcagcatccatccgggaagtaaggccgtggctccaccaggaacatccmgctctaactccatgtgacctttctgttcctcgagcccagtgcaacccccactggattcagggtttccacacctaatagaagtcccttcctaaactgttac

SEQ ID NO: 49092 - DNA, 201 bp, Homo sapiens
ctccctcctgtgagcagctggtaggagtggccactgggtggcgtgtgggcaccagggtttccttgctcccagttgtccagagctccttaattcatccatcyttctggcactgtcgccttagaaggcggaagtttctaagtcaggatgatggcaaaggtcagtgagaaatgctgacttcaagctgtaaatttgtgtgtgagt

SEQ ID NO: 49093 - DNA, 201 bp, Homo sapiens
atgcctcagacaccccaccaccctagtccagtactctccaaaggagtcaccccaggaagatcggcttgtgtgtcactcgcatctctcagctgtgctcaaayctgctattttctttgtccccagtggggctgtttgcagccggtatgggggaaaagaatgagatacagaaaagtccctgagctgggcagaggcatcaccccc

SEQ ID NO: 49094 - DNA, 201 bp, Homo sapiens
gcccaggaggtgcgatgccaccaaggacagggaggcactcgctttccgggcaggcccagaaagtgccagtgatggtggggagagaaggcattgtctcctcyctccgagttggtggaggggaaaattgtttgtgacgatgctgcctcccgagccatctgctcaccgagaaacccaggatggtggagtggaatgaagccgtgc

SEQ ID NO: 49095 - DNA, 201 bp, Homo sapiens
agatgctggagaaggtcattgactccagctctttttggctttctggagcctgggcaggtagagaggtgggtggaggaggaaggatactccaggtggaaaamcagcatgtgccgagctatggaggtgaggttcgtaaggcgtgtgtttgagtgacagtgagcagtgttggttttgccccccttctcttccacggcacaggcc

SEQ ID NO: 49096 - DNA, 201 bp, Homo sapiens
attcttctagcacagggaaggactgacgcctcgtctgtctctgtcagagctggctgtgccctcggccctttgtttctgggagtgaaggtggccagtgtgcygtggaagcagctctgctctcctgacactccgctcacgcctgttttcatttacagtggctggtgctgacgtgcagacgctgcgggagaggctcattgacgc

SEQ ID NO: 49097 - DNA, 201 bp, Homo sapiens
catccattttgcctccctgccacctttctccactccctcgactggttgaccaggtggtacatagacttcctttctcatttttgtctttgatgtgggtatgyccacctggcagttttcctatctctgttccgggcctctcctgacctgccgcctccagctccttagcttctgggccacatccttctctctcttcccccgctc

SEQ ID NO: 49098 - DNA, 201 bp, Homo sapiens
gtgtgggcaaaaggccatttgaagtatgggacagagctggggtgccaagagaagaaggaaggctgagggccaaggacatgttccccctccaaagcactacrttcgagggcgtatctcagaagggtccaagaatcctaaacttaaatgtggccttccagattatgatgaaggtatacatgtcaagataaaaggataggaatt

SEQ ID NO: 49099 - DNA, 201 bp, Homo sapiens; identical to SEQ ID NO: 9143

SEQ ID NO: 49100 - DNA, 201 bp, Homo sapiens
agggctgtccaattactgaatcatacataaaagccaagtaagattttaaaatttgttataattttggtttttaacaacttctgttgtaaataataaaagcmctaaatccctactgaaaataaagggcctaaagactgaatgagagatgcaattttttttggctaacctattggcaaagaaatgatgatgatgatgatgatg

SEQ ID NO: 49101 - DNA, 201 bp, Homo sapiens
gccccatcactccaggttgcactgctgcccagggggtttgtgccaggcctgggtcacagtggaagagagtctggaaatcacaaggcagaggaggagacctytgccaatgtgagagaacaaagttaaggggcagtccatgggggcattgaccttacttaggtgaggaggactcagggaacatctacagactctagggctagg

SEQ ID NO: 49102 - DNA, 201 bp, Homo sapiens
ctcaaaattaccaggcacaagctgagagccccctccacaaggcctgatcactatgactcatgactggacccttgactctgcttgttgtcccctccccaaartaaccattctgacttgcatgccacttgctgttgctgctcctgcttccttgtagtcaacaacttgtccccctattaaaacctttaggagaagtgcttctac

SEQ ID NO: 49103 - DNA, 201 bp, Homo sapiens
tgggccacccgtggggctgctggtagctggtgtgtggctgctgctggactgtgtggcagtccatccatctgtcagcagccactgcgggcctacttgctggrtgcccagcaccgcactcaccactgcaggcgtggccaggagcgtgagatccccagagcccatggccagtgagaggcggccagggataggtacccagggaat

SEQ ID NO: 49104 - DNA, 201 bp, Homo sapiens
cctgaggtctgagagagggagacttccaggaccccaccccatttagagcgagcaccttccctaccctgtcttctagccttaccaggtgtcccagagcaaargtagtacagaagtcatatttgtgtcttagttagaatgttttcctggtggttttggaactttgcacaacctcctccccactgccccccgccccccgccccc

SEQ ID NO: 49105 - DNA, 201 bp, Homo sapiens
aagacaaccgattggagttctgtagggcctgacacctgagctttctgactctgcctgggagaggctgggcacagcagggatgaaggaggcggcctaggccyaggaggtcagaggctcctcagcgccaccccatgtcacgcagcgcacgcagcctggatgcctcaggtgagtcaccatctcctgaactgcctggctggctgt

SEQ ID NO: 49106 - DNA, 201 bp, Homo sapiens
tctccaggcagcctggtttctgccagtcctctcctcctccaccttgctcaggcagttccctgcccactggaccgacggtctaggttcaactctgtttccayctttcctgctgagcccatgccttggtctgcagggccgacctctccaaacttgagagttctgtgccacatgatttggcccctgccactgccctctcacggc

SEQ ID NO: 49107 - DNA, 201 bp, Homo sapiens
aaagtcaacagggccccttccgcttcagtccccatctgtaaaaatggtttatcaacctcatgttgaggttcagagttggtataatatcaaccctcatattragggttggtgtgaggactaaatgagtaccatctgtaaatccttagagcagcaggtgcaaagtgctagcccacaccatgagtatttgctcatctgattcat

SEQ ID NO: 49108 - DNA, 201 bp, Homo sapiens
gctgcagatggacttattctagaatttcttccttcttgagagtgctggggggaaagattagcttccagctgactcacatgtttggcctcttgcaatgcagrgtttttagttttcctatgagttgcatgtctagatactgacccattctgctcctggatgagggttaccacttccaaacaggattccccagtgcatggagcc

SEQ ID NO: 49109 - DNA, 201 bp, Homo sapiens
aattgcttgaaccctagaggcagaggttgtagtgagccaagattgtgccactgcactccagcctaggcaactgagtgacactctgtctcaaaaaaaaaagaaaaaaaaaaaaaagaaaaaaaggaaactgcttttcacccttggactggtaaactctgtcaggcgtctagactaggctggggcttggataggtaatgggaa

SEQ ID NO: 49110 - DNA, 201 bp, Homo sapiens
aaatataattgaatacttcactgtttttgaaagcatgaaaacaatggaaaatgcaactgatgtgagtaatccatctacttgacgtcacttttaagaaatarggccaggcacggtggctcacgcttgtaatcctagcactttgggaggccgaggtgggtggatcacgaggtcaggagtttgagaccagcttggccaacatgg

SEQ ID NO: 49111 - DNA, 201 bp, Homo sapiens
aactgttacaaagctgtgtttgaaaaaggccaaaggagtggttcagccatttcttatgggaacccaggggaggggaaagtcacagagggctaatctgatcmccagaggccttcatgccagtagttatttattacacgcttgccttatgccagcactttgctaagggccttcacaggccattattatgacaatccttacccg

SEQ ID NO: 49112 - DNA, 201 bp, Homo sapiens
ctctgtgctgggcaccttccctgtgttacctcattcagtcatggggccacttctggaggcagggcacaggaatggagaggtaaactgaggcccaaggacascaaagtggaacacagaggagaccttgccctgaggaggagcataggcagccacaatgcgtaccccattagttgaccttattggctctttccaacctcagga

SEQ ID NO: 49113 - DNA, 201 bp, Homo sapiens
tccttttaagaacagatcaatacttcaagaaaaccttgttttaacagagaggaccaaattctgatttttcatcagtgtacttttgatattaaggctcatcaaaaaaaaaaaaacacaaaaactataagttagcccattcgaccacacttgaagttcttttctcttcacaacttccttgtatccattggtttgtcctgtact

SEQ ID NO: 49114 - DNA, 201 bp, Homo sapiens; identical to SEQ ID NO: 9130

SEQ ID NO: 49115 - DNA, 201 bp, Homo sapiens
attgatatttcaaacaaacaataattagtaatttctaaagggatcttttccctttagaaaaatgttatgagaaggccctggggaatcctggacatcagagrgcagtcttggggtgtgaaggtcttaaagacaagaacgtgctggctcagtgcaaaaaacaaacgagaattaaaatgaaaccacattttattgtgctcttta

SEQ ID NO: 49116 - DNA, 201 bp, Homo sapiens
ccttgtatcagccccaagaagggccagcttagttgccttctttccagggatgcgtcagggtgtgccaggctcttcctgcatctgtctcgtggaggtgaggstaacactccttccccaggcgtaacgtgttcttaggagctctgataccttctgaaattgtgttcttctgagacgtcgtaaggagtaagttctagggtggag

SEQ ID NO: 49117 - DNA, 201 bp, Homo sapiens
cagggatccccggcacgggagttatcacacccaaggcatgagggctttgtcacccccgctctggtggaaagtggcacgagatctctgatgatgccttacctgccagcctgcccagtgcagggcatcaacagcttaattaacgtctgaacagcttccaaggctctcaaataggaggccctggatagcccagggcagcaaggc

SEQ ID NO: 49118 - DNA, 201 bp, Homo sapiens
ggacccctccacctgcccggtgggcagcctcctactccgggagcgcgtccctcttccagtcacctccgcccacctcttcctctccgcgcatcccacgcccmccaccttcatgtttctcagctccatttttgcctcccgctcccttgccttttcctcttggccctcatcccgagcttctttccctctccgcggcctgggccc

SEQ ID NO: 49119 - DNA, 201 bp, Homo sapiens
gaagaggtaacacggaggtcaaattcataggacttgtcagctaactggatgacgggtttttgaagagggggatggtgtgggtggcagggagggggactggttgctgggtgaggtaaacacaagtggcaaagcaggttgagagaggggtgattcagtcttggggatggtgggggaggggctgtatccagacacctgagtgga

SEQ ID NO: 49120 - DNA, 201 bp, Homo sapiens
taacctgtctgtaaataaacaagagcaccatcaccatgaataactgcagcgcaacatcaccctcgggtttcttttttgtttttaaattttatttatttttmatttttaactttttgtagagatggggcctcactgtgttgcctagggtggtcttgaactccagggttcaagtgatcctccctcctaggtctcccaaagtgc

SEQ ID NO: 49121 - DNA, 201 bp, Homo sapiens
actacaggcgcctgccaccaagcctggctaattttttgtatttttagtagagatggggtttcaccatgttgcccagggtggtctcaaactcctcagctcargcaatcggcctgccttggcctcccaaagtactgggattacaggcataagccactgcacccagcccaaagcaatccttttaaagaactttaggaaggaggt

SEQ ID NO: 49122 - DNA, 201 bp, Homo sapiens; identical to SEQ ID NO: 9146

SEQ ID NO: 49123 - DNA, 201 bp, Homo sapiens
aacaggtaagtaactttccaggtttacacagatgctggagaaggtcattgactccagctctttttggctttctggagcctgggcaggtagagaggtgggtrgaggaggaaggatactccaggtggaaaaacagcatgtgccgagctatggaggtgaggttcgtaaggcgtgtgtttgagtgacagtgagcagtgttggttt

SEQ ID NO: 49124 - DNA, 201 bp, Homo sapiens
gcaataattgcaccaggaaagggttttctccccagtagtagagctagactgatactactgatcattttggtgttaggcatttaagacacctgacacttcaraaagcctctgtcacccagctctgcattgcgttgacagtaaagcttaaatgcagctttgctttaacaatggagcactcacataaggaccttctctattcca

SEQ ID NO: 49125 - DNA, 201 bp, Homo sapiens
ttatttgtgcagtcaatatttttgagtactcactatgtgctaggcactgtggcagcagatatgtacaggcagatgcattctctgcttgtgcagaccctacagcatacagcatcccttctaggaaggcacccaacctcacttgaatgcctgtggtgtcagtgagttcactgccttttcaggtcacctgtgtgtgtgtccaca

SEQ ID NO: 49126 - DNA, 201 bp, Homo sapiens
cctattgtatcctgttgtaaagagagcagatacttattgaacttatgcaaataacagtattgccataaaaataggaatattcacaaatagtttctgaattycagagaggtcttgtagggagaaaatgtttccatttttgttcacaagagtatacttaccaaattgctgtaaactatagatagcttaaaagaaaataagttt

SEQ ID NO: 49127 - DNA, 201 bp, Homo sapiens
tttgtgcagtcaatatttttgagtactcactatgtgctaggcactgtggcagcagatatgtacaggcagatgcattctctgcttgtgcagaccctacagcatacagcatcccttctaggaaggcacccaacctcacttgaatgcctgtggtgtcagtgagttcactgccttttcaggtcacctgtgtgtgtgtccacagtc

SEQ ID NO: 49128 - DNA, 201 bp, Homo sapiens
tctggaaattctttcccagtccaatcgtattatctcgaagttatcagaaatggtacttatcagagacgtttccgtggatctccttgaagatgaagcacttyaggattatagttgcttagaaaaaagcttttagaaaaacatcagaataaagcaattaactgtagacaataagacttaaaatggttgtggttaaagatctga

SEQ ID NO: 49129 - DNA, 201 bp, Homo sapiens
tgcagtcaatatttttgagtactcactatgtgctaggcactgtggcagcagatatgtacaggcagatgcattctctgcttgtgcagaccctacagcatacrgcatcccttctaggaaggcacccaacctcacttgaatgcctgtggtgtcagtgagttcactgccttttcaggtcacctgtgtgtgtgtccacagtcgtaa

SEQ ID NO: 49130 - DNA, 201 bp, Homo sapiens
taggtgtgggcaaaaggccatttgaagtatgggacagagctggggtgccaagagaagaaggaaggctgagggccaaggacatgttccccctccaaagcacyacattcgagggcgtatctcagaagggtccaagaatcctaaacttaaatgtggccttccagattatgatgaaggtatacatgtcaagataaaaggatagga

SEQ ID NO: 49131 - DNA, 201 bp, Homo sapiens
gtaatcttaatttctagtgaaaactagcaagcattgtgaactgtcttctattaacattcaccatttcataatttctagaaacatgtttcctcagcttttcrtgcttattacagacccaattatattctctatgccatacaaaaacaagatgccaaagcatatatactttagacttatgttcagcaattaatgtttcagtat

SEQ ID NO: 49132 - DNA, 201 bp, Homo sapiens
tggccctgaaaaagtttgtggcagtgctggccaaggtgagcagggccatggcttcccttgtctgtgcaattctacggatggtcagtgtgcgttcctgtaagctgggcaccccgtcagcccctccctccagaagcccatggtctggctggacacctggacccacagctctccctgtccaccataggtgataccctccagcct

SEQ ID NO: 49133 - DNA, 201 bp, Homo sapiens
aactgtcttctattaacattcaccatttcataatttctagaaacatgtttcctcagcttttcatgcttattacagacccaattatattctctatgccatamaaaaacaagatgccaaagcatatatactttagacttatgttcagcaattaatgtttcagtattttaatttacttagaaatgatattttatgaatatctat

SEQ ID NO: 49134 - DNA, 201 bp, Homo sapiens
accactcacaggaagcaggtacgtccaggacccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggcc

SEQ ID NO: 49135 - DNA, 201 bp, Homo sapiens
ctgtttcatgtcctgttccatcggtagagttacacactttcctgagactttatatggtggtgctgctgggtgccagcccttcttccctccaacagtggcartaaccactgttgtgtgttggtgtcaaggagtggggacaccctgaaggaatccgccttttctagagctctcgctccattccctacatcgaggctgaagtgc

SEQ ID NO: 49136 - DNA, 201 bp, Homo sapiens
taatggaaaatattgttacaaaaacagttctgtatagtatgatcttattttatttatttattttttatttatttattttgagacggagtctcgcactgtcrcacaggctgtagtgcagtggcgtgatctcggctcactgcaagctccgcctcccaggttctcgccattctcctacctcagcctcctgagtagctgggacta

SEQ ID NO: 49137 - DNA, 201 bp, Homo sapiens
tgttacaaaaacagttctgtatagtatgatcttattttatttatttattttttatttatttattttgagacggagtctcgcactgtcacacaggctgtagygcagtggcgtgatctcggctcactgcaagctccgcctcccaggttctcgccattctcctacctcagcctcctgagtagctgggactacaggcgcccgcca

SEQ ID NO: 49138 - DNA, 201 bp, Homo sapiens
tcccaatacgaaggccaaggggcaattaccatttatcatcacatttgtgctgttgatttggaagagggaaatatttccctgcactgtgtctctaactgcattttttttttttggcttgtttcctttaggcaggttcttgctctgttgcccaggctggagtgcagtgacacaaacacagttcactgcagcctcaacctccca

SEQ ID NO: 49139 - DNA, 201 bp, Homo sapiens
agcttgcagagataaataaaatgtcgtcctgcttcctggtcagaggtgggtgcatgggtgagtggtggattcaggttgaagttcattgcagctggagtggygggagtggagggcaatgtgaggtgagtttgggtttggagcctggaaggccttgaatgcagtgagtttggacattattcattgacagtggggagtcatgga

SEQ ID NO: 49140 - DNA, 201 bp, Homo sapiens
ccaagtttcaagcagaactgtgagccagaactcagcttaattaccccagcagcatccatccgggaagtaaggccgtggctccaccaggaacatccagctcyaactccatgtgacctttctgttcctcgagcccagtgcaacccccactggattcagggtttccacacctaatagaagtcccttcctaaactgttaccacat

SEQ ID NO: 49141 - DNA, 201 bp, Homo sapiens; identical to SEQ ID NO: 9153

SEQ ID NO: 49142 - DNA, 201 bp, Homo sapiens
ccctcaaatgatgttcccctttagatggtcatggtcatcagcaggggtgggtgcatcgatcctgtggggtcttggtggtcgcagaccaagcgtccctcttytcacatctaattcacaacgtctcatcgctccgcgggagcccaggaactgccctacaacagccgaaatccgggtcgtctattccaacggactcctcttccg

SEQ ID NO: 49143 - DNA, 201 bp, Homo sapiens; identical to SEQ ID NO: 9154

SEQ ID NO: 49144 - DNA, 201 bp, Homo sapiens
ctctaggttatatctttgttattgctcttatctgtttaagtttcaagattctgtttgaacaatggtttccaagtctttaaaaagtcgaaaatcccccttcygatgagatacagaaaccccagactttaaaactctcagtcttaaacctctttggcaccattgccaagaaacttttctctattccattcaaatagtttgtat

SEQ ID NO: 49145 - DNA, 201 bp, Homo sapiens
gagtgtctcagtagcctcgccctagtcctggctttcacttaaatatgttttcgaatgtttgtaataaaatatttcttttggaaggcaaaaatagcaaggaraataaataggattaaaggatactaaagcccattcaataaaatttgtaggaggccactgatttggcctaggctcctatgatgtaaccaacagaccaaacca

SEQ ID NO: 49146 - DNA, 201 bp, Homo sapiens
cgcttacctgcagagactctctgggctcaccagggaggctgcccagaccacagttgcaccaaccactgctaacaagatagctcccactgtttggaaattgkcagatcggtaaggctacgcctggttctcctcacttcttctccttcctctgatcacagaccaccacaccttcacacccacgccctcttgctcattcttctt

SEQ ID NO: 49147 - DNA, 201 bp, Homo sapiens
taatgaccttattttaccttcattacctctttaaagaccctgtctccaaatacggccacattctgagaggctggggattagggcttcaacataggaatttkgggggacataattcagcccatagcacaggctggagaccagcaggtgcaaaggacaagcctggtgtgtgggcagcactgaaagaaggctgctgtggccgga

SEQ ID NO: 49148 - DNA, 201 bp, Homo sapiens; identical to SEQ ID NO: 9121

SEQ ID NO: 49149 - DNA, 201 bp, Homo sapiens
agtgtagaaccttctgctggtgccgtggatcctcttgactcagaccgggggtgtcagccaggtgtgaggggtagagaaggcattttgtccatccagtgacrtcactgcccagaaactgtcagcaaggaggaaggaaggcatgagttggtgaccgcatagtgctgactagctggacagggcataaactaactctctgtgtca

SEQ ID NO: 49150 - DNA, 201 bp, Homo sapiens
accctcctcttttcctgagcagcttgcagattggtttctgaagaggcgagatggaaccatgtgtacatcttttagccatatggtcctggaaaattattttyaaatgaaacttataagctgttttgacctccagtttacacttgcctacatgcctcactggtcccattagctgaacgtgcctttctgagcagtgcttcacac

SEQ ID NO: 49151 - DNA, 201 bp, Homo sapiens; identical to SEQ ID NO: 9124

SEQ ID NO: 49152 - DNA, 201 bp, Homo sapiens
ttaatgtttcagtattttaatttacttagaaatgatattttatgaatatctatgacttaatttaacgtaaaataaccgtaagaggaggctggatatgtggrcaggggccaaatgaagaactgccttctggttgtagattttcttctaaagtcagttagagcccccagagaatgttgaatagagattgacataatcagatcc

SEQ ID NO: 49153 - DNA, 201 bp, Homo sapiens
atttaacgtaaaataaccgtaagaggaggctggatatgtggacaggggccaaatgaagaactgccttctggttgtagattttcttctaaagtcagttagarcccccagagaatgttgaatagagattgacataatcagatccacagaaagaaaagatcatttggtggctagagaggccagtgaggggtggagcacattaga

SEQ ID NO: 49154 - DNA, 201 bp, Homo sapiens
actcagagtgagaactcactcgttatcaagggggcagtgccgagctgttcatgagggatctgcccccaagatctaatacctttcactacctaatctaatamctttcacctcgtctaacattggagatcacatttcaacatgagatttggaggggacaagatccagaccatatcaggtggggtcagaggtcctgctaaaact

SEQ ID NO: 49155 - DNA, 201 bp, Homo sapiens
agaactcactcgttatcaagggggcagtgccgagctgttcatgagggatctgcccccaagatctaatacctttcactacctaatctaatacctttcacctygtctaacattggagatcacatttcaacatgagatttggaggggacaagatccagaccatatcaggtggggtcagaggtcctgctaaaactgtgactatca

SEQ ID NO: 49156 - DNA, 201 bp, Homo sapiens
atgtgggggatctgggctgctgggaaccccgaatgttggaatcgccctgacaaccttatgagggtggtcagatatgggtcctgaggaaactgattccacgrcaactgcccgccaacccagcacaccccacagtgaagaggggcttctgatccatgagtagggcccctcaaatgatgttcccctttagatggtcatggtcat

SEQ ID NO: 49157 - DNA, 201 bp, Homo sapiens
cggggcacctgacctggaacctgagctcaggagagctgcctggtatatgagcttgtttcttctcagttcctgggctgtggcccagaatggtgccattattytctctgccaatgtttcagcggccagcagccttgtggcccggggcctgatgcaggggccagactctggcctcaaggcttctttccccgcagttcctggatt

SEQ ID NO: 49158 - DNA, 201 bp, Homo sapiens
cgcccggttcgtcccccgccaggttactgcctccttccctgcgagaggtctcctttgttccttcctccgcatggtccgctgacaccttaccgtttcctggkccagccttgtggcagtcctcttcctctcgtccagggacccatgtcatcttcctgccaggttccctagctgctgtgggtcagtgctggggagaaaagggaa

SEQ ID NO: 49159 - DNA, 201 bp, Homo sapiens
cagagattcggggccatgaagaacctgtgtgcccttggcagaggctgacctggagactgctggtgggccagagacatagccctgttgccctgcctgctgcmctctgggggctggagcctgtccttgcactctgtccatgaagagctgaaaagcgagggcccatgcgaagcagggggaggagagagtgcttttggtatgatg

SEQ ID NO: 49160 - DNA, 201 bp, Homo sapiens
accagcccagcctgtttagcaaacacctgggccctgaagggcgggccagctgtgtcaggtccccatcaggttggagccagagcccagctggaaggaaacaraggcgtgggagagggaggggctggttggctgcaggttctggctggagcttggcaacctagaggctggaacttccgggtcaaggggcttctccgtgggcct

SEQ ID NO: 49161 - DNA, 201 bp, Homo sapiens
gaggctggaacttccgggtcaaggggcttctccgtgggcctcaggagtgcccttcagtgggaatagaatgggactttttatggccgaaggcctggccggarcaaggggtacacagcacagcagcataggggtggggaagggcaggtcttctctcttcgaggctctgaggagatcagtgatgtggtttcaaatccaggcctc

SEQ ID NO: 49162 - DNA, 201 bp, Homo sapiens
tgtcagccaggtgtgaggggtagagaaggcattttgtccatccagtgacgtcactgcccagaaactgtcagcaaggaggaaggaaggcatgagttggtgaycgcatagtgctgactagctggacagggcataaactaactctctgtgtcaggagagctcctgaattcttcggtgtagagtccagagctgagggtcagtaga

SEQ ID NO: 49163 - DNA, 201 bp, Homo sapiens
agaccagcctggtgttgcctggttttctgccattagggagcagctagaggtcttccagtagctcctgtgtaaagtgatgaaagaaaagggctgggtgctgmctgctcctggagaaaagcaacacactcccagagtcttaattgcctgcttccagggagctgtggtggtttcccttgggcagggcacacgccccagtggttg

SEQ ID NO: 49164 - DNA, 201 bp, Homo sapiens
gaaggtcagatcgacagcttagttttggcttggtggcgtggaacttcagcttgagggactccatcttggtttggtctcttgggccttgtgcaggagctcartcccaaccaatggcctcctagaaatattatttaacagttctccccttttggtcaggttctcacctaggtgagagttactaaaacagggcatcagcactac

SEQ ID NO: 49165 - DNA, 201 bp, Homo sapiens
tttataggttaaggtgtcctcattatcatgcgtttcttggagttttatcattccagctggagagagaccatttagcattcagcagagggctgcatatagayatttaagactctttgagaggatacagtgtaacagggaaactactgtaatgactctccccaggataatactaagagtttacaatatgacgcttagccaggg

SEQ ID NO: 49166 - DNA, 201 bp, Homo sapiens
gtatatcaagttgttcagcttctgtttatagggctttaggcacagaacagttcctgttcttagttggagaattgtagctagttattggaagaaactggaaraattcagaattcaatccatcttataggtagatgataaaaacttgaaaatgatcaacaaggctacaatctaataacagatgtactatagtttttctttagg

SEQ ID NO: 49167 - DNA, 201 bp, Homo sapiens
gggaagtttgtacaaaatgtcaaaggtttaaaattaaaacacttaatcagcctgggcatggtggctcatgacggtaatcccaacactttgggaggccgagkcaggaggataccttgagcctaggggttcgagaccagtctgggcaacataggaagaccccatttctatattaaaattttaaaaaattagccaggtgtggtg

SEQ ID NO: 49168 - DNA, 201 bp, Homo sapiens
tactattgttatatatatgctaacgtttgtctagaaaaagtctagaaaaatacacactgaactgtgaatagcagttatatttagaaagcaacattaggatkgacttaagtcagggctcggactagagcaaggcaagtgaggtgccaggatgcaaaagttaaggagacacctgacctcaggggcccacaactgcagagcccc

SEQ ID NO: 49169 - DNA, 201 bp, Homo sapiens
tttgaagaggtaacacggaggtcaaattcataggacttgtcagctaactggatgacgggtttttgaagagggggatggtgtgggtggcagggagggggacyggttgctgggtgaggtaaacacaagtggcaaagcaggttgagagaggggtgattcagtcttggggatggtgggggaggggctgtatccagacacctgagt

SEQ ID NO: 49170 - DNA, 201 bp, Homo sapiens
ggtggcagggagggggactggttgctgggtgaggtaaacacaagtggcaaagcaggttgagagaggggtgattcagtcttggggatggtgggggaggggcwgtatccagacacctgagtggaggccaccaggaagaaccaggagtctaggacaggtgaggtctgagatgcagagggttcagatggcaaatcatttggacaa

SEQ ID NO: 49171 - DNA, 201 bp, Homo sapiens
ctagcaagcattgtgaactgtcttctattaacattcaccatttcataatttctagaaacatgtttcctcagcttttcatgcttattacagacccaattatrttctctatgccatacaaaaacaagatgccaaagcatatatactttagacttatgttcagcaattaatgtttcagtattttaatttacttagaaatgatat

SEQ ID NO: 49172 - DNA, 201 bp, Homo sapiens
ggtgaggtaaacacaagtggcaaagcaggttgagagaggggtgattcagtcttggggatggtgggggaggggctgtatccagacacctgagtggaggccaycaggaagaaccaggagtctaggacaggtgaggtctgagatgcagagggttcagatggcaaatcatttggacaaagtcattggctttggcaagggagaaat

SEQ ID NO: 49173 - DNA, 201 bp, Homo sapiens
agaaccaggagtctaggacaggtgaggtctgagatgcagagggttcagatggcaaatcatttggacaaagtcattggctttggcaagggagaaatgatagstttgttcattgatccctttatccactcatcatttagaagcaagattgagcaacttctttgtgacagtgccttcaacagctttttaaacagaagagtgtca

SEQ ID NO: 49174 - DNA, 201 bp, Homo sapiens
agcctgcatcctggggagaggctcttggggtccctgcatccccctgggccactctggctgaccgaggttcctggtcagactccaagctgcttgtggctgcwgggatcttgaggggttgcctttttaaaatttttttattttttgagacagagtctctctctgtcgcccaggctggagtgcagtggcatgatctcggctcac

SEQ ID NO: 49175 - DNA, 201 bp, Homo sapiens
ggtggctcatgacggtaatcccaacactttgggaggccgaggcaggaggataccttgagcctaggggttcgagaccagtctgggcaacataggaagacccyatttctatattaaaattttaaaaaattagccaggtgtggtggtgtgcacctgtggtaccagctacttaagcagctgaggtgggagaattacttgagccca

SEQ ID NO: 49176 - DNA, 201 bp, Homo sapiens
cctcccaggttcaagcaattctcctgcctcagtctcctgagtagttgggatacaggtgcatgtcaccaaatttggctaatttttatatttttagtagagamggggttttaccctgttggccaggctggtctcaaactcctgacctcaagtgatccgcccacctcggcctcccaaagtgctgggattaccggcatgagccac

SEQ ID NO: 49177 - DNA, 201 bp, Homo sapiens
aaattagtcgagtgtggtggtgggcgcctgtagtcccagctacctgggaagctgaggcaggagagtcccttgaacctgggaggcagagcttgcagtgagcygagatcgcgccactgcactccagcctgagcgacagagcgagactctgtctcaaaaaaaaaaaaagaaagaaagaaaaaagaaacaggctcaacaacatta

SEQ ID NO: 49178 - DNA, 201 bp, Homo sapiens
caaaggatgcaccccagcttgcagatacttggataggctcaagttgctatccttgtgtgctaagggagtcaagaaggctccccaaaaagtgtgtggtgggrgggtgttgaggaggttggggaaatggcatcataggatgtagctcacctcactctgctaaatacttttgacgtctgactctggtaaatacctccatctact

SEQ ID NO: 49179 - DNA, 201 bp, Homo sapiens
agagcaggcctgcgtggctgcactcttggccactatctattactgatgcccacctgtgtgtttgcttccagttcttcaaggcctttaccaagaacggctcrggagcagtatttccaggtgggtgcccagctctggttgtcctgttagcatcttcctcccccaacctccctcttcacctgggtttctattggggtggagaaa

SEQ ID NO: 49180 - DNA, 201 bp, Homo sapiens
ggaattccagatcccctaaggcatgttctccaccctctggaactgatcccatttagagccccagggacaaaggcaataccagggcttttcctggggggtgrggggctggggggatggcgaggagcagggcaaactccttcaacatctctcagcccccatccctggccccgattagtaatggagaaacagataccattatga

SEQ ID NO: 49181 - DNA, 201 bp, Homo sapiens
agatggatggggcttctccaggttgtacctgctgctgtttcttgctaccttccctcaaaatgtttgcgggacgcagcaggatttcacatgctctatccccrggaaggccactgagagtcagaatggcatgaggaggaaaaaggagatcaaatattttgagggaaattggggggaggtggagagaaggtggtcatgcctggg

SEQ ID NO: 49182 - DNA, 201 bp, Homo sapiens
tagttttcttccagattagagaagccaaattcaaatctctgtctctgtagcaccagctataaataatatgtaccctcccaccagaatggcatctagaaaascagtttcttctgtagccattaaggattattaggaaatgcctttgaaagctgaaatgccaagcattgtccctggaacaagatacctctgagctgggggtag

SEQ ID NO: 49183 - DNA, 201 bp, Homo sapiens
gcgggacgcagcaggatttcacatgctctatccccgggaaggccactgagagtcagaatggcatgaggaggaaaaaggagatcaaatattttgagggaaaytggggggaggtggagagaaggtggtcatgcctggggcatgggggtggcccctggctctctgtatggcagagcatcaggtgcagtggccggtgctctgtat

SEQ ID NO: 49184 - DNA, 201 bp, Homo sapiens
cgtgtcattgaaaagtggcagcagagagtctgcatgtcaatcatccctttgaaatgaaaggccttcctggcagggacatggtgctatctttggccctaagrtgtgtaattgagaatattcaaacagggcactctgttcctttggctgaaccagggtgagtggccctgagtgggaagctgtgggcaagttagtgtggcacaa

SEQ ID NO: 49185 - DNA, 201 bp, Homo sapiens
tttgagggaaattggggggaggtggagagaaggtggtcatgcctggggcatgggggtggcccctggctctctgtatggcagagcatcaggtgcagtggccrgtgctctgtatctgtcagccaggcaagcttcccagcttgcctcttttccaggaaaatgaagacagtaaggtgcatggtcttgcccatactttcccaaaga

SEQ ID NO: 49186 - DNA, 201 bp, Homo sapiens
ccagggtgagtggccctgagtgggaagctgtgggcaagttagtgtggcacaaggaaccatcattcacaggctgatatttttctcccagtgagcatgagccrcaggggtgcagccactgcccagcccccaggggaggggttgacactggtacagcagccagggcaagacaaccgattggagttctgtagggcctgacacctg

SEQ ID NO: 49187 - DNA, 201 bp, Homo sapiens
gcccagcctgtttagcaaacacctgggccctgaagggcgggccagctgtgtcaggtccccatcaggttggagccagagcccagctggaaggaaacaaaggygtgggagagggaggggctggttggctgcaggttctggctggagcttggcaacctagaggctggaacttccgggtcaaggggcttctccgtgggcctcagg

SEQ ID NO: 49188 - DNA, 201 bp, Homo sapiens
ggtctcccatatgcaagtgccaccatgctagtgtgatttggacttcagtaaaagttagtttgcttccttcccgttgtcccatctcactcctgggccacccrtggggctgctggtagctggtgtgtggctgctgctggactgtgtggcagtccatccatctgtcagcagccactgcgggcctacttgctgggtgcccagcac

SEQ ID NO: 49189 - DNA, 201 bp, Homo sapiens
tgaaaggccttcctggcagggacatggtgctatctttggccctaaggtgtgtaattgagaatattcaaacagggcactctgttcctttggctgaaccaggktgagtggccctgagtgggaagctgtgggcaagttagtgtggcacaaggaaccatcattcacaggctgatatttttctcccagtgagcatgagccgcaggg

SEQ ID NO: 49190 - DNA, 201 bp, Homo sapiens
aggcaactgagtgacactctgtctcaaaaaaaaaagaaaaaaaaaaaaaagaaaaaaaggaaactgcttttcacccttggactggtaaactctgtcaggcrtctagactaggctggggcttggataggtaatgggaaccactagtagagccagaggtgaacatataacaatcaccatagcactcatagatgggaactacac

SEQ ID NO: 49191 - DNA, 201 bp, Homo sapiens
gaaggcaaagcaggagaggaagcaggagggggttgggaagtgccaccctattttaagcaatcagatcttatgagaactcagagtgagaactcactcgttaycaagggggcagtgccgagctgttcatgagggatctgcccccaagatctaatacctttcactacctaatctaatacctttcacctcgtctaacattggaga

SEQ ID NO: 49192 - DNA, 201 bp, Homo sapiens
ataaagatctctccatcctccgtatttatgagagtgcaaggggttaaccctgtcatttctgaccttcttcgccagtttgcaccagggagtcagtgatcttsgttgggtcctaacaataatcaataaatgactattgattgagctctctatgcgcacatctcatttaatcctcataatgttagtggaaggtagatattctcc

SEQ ID NO: 49193 - DNA, 201 bp, Homo sapiens
accctgtcatttctgaccttcttcgccagtttgcaccagggagtcagtgatcttcgttgggtcctaacaataatcaataaatgactattgattgagctctytatgcgcacatctcatttaatcctcataatgttagtggaaggtagatattctccccatttagcagatgaagaaacagtactttgaaaaggttaagcaact

SEQ ID NO: 49194 - DNA, 201 bp, Homo sapiens
ctgtatggcagagcatcaggtgcagtggccggtgctctgtatctgtcagccaggcaagcttcccagcttgcctcttttccaggaaaatgaagacagtaagktgcatggtcttgcccatactttcccaaagaagagacagctagattaaaaacactaggccccccacttctggatcagaactcaagataggataatgcccac

SEQ ID NO: 49195 - DNA, 201 bp, Homo sapiens
aaaggtttggttgactcccttggagggccctgtgtggaagcggaggagggcgggatggccatacctgcagcactgcatcaccagcgtctggcgttgccagmggttttgtcttatttctgctggctgtgcagagtgactgccagaattgtctcttgcaggctggaggagattgatggattctttgcgagaaataacgaagag

SEQ ID NO: 49196 - DNA, 201 bp, Homo sapiens
gcgcctgccaccaagcctggctaattttttgtatttttagtagagatggggtttcaccatgttgcccagggtggtctcaaactcctcagctcaggcaatcsgcctgccttggcctcccaaagtactgggattacaggcataagccactgcacccagcccaaagcaatccttttaaagaactttaggaaggaggtagagatg

SEQ ID NO: 49197 - DNA, 201 bp, Homo sapiens
tcaaatgcagcagtttatgtaaagggcctggattgcagctgacacatagtaggtgctttataaggatccattcccctcgcctaatgcagagagctcaccaytctgccattggttcatggacttctccatagaccagttgtgagcttttcccagctgcaaaggtgggacgtgccagtgcacgggagatactccaagtcagtg

SEQ ID NO: 49198 - DNA, 201 bp, Homo sapiens
aattcataggacttgtcagctaactggatgacgggtttttgaagagggggatggtgtgggtggcagggagggggactggttgctgggtgaggtaaacacargtggcaaagcaggttgagagaggggtgattcagtcttggggatggtgggggaggggctgtatccagacacctgagtggaggccaccaggaagaaccagga

SEQ ID NO: 49199 - DNA, 201 bp, Homo sapiens
cagcagtttatgtaaagggcctggattgcagctgacacatagtaggtgctttataaggatccattcccctcgcctaatgcagagagctcaccattctgccrttggttcatggacttctccatagaccagttgtgagcttttcccagctgcaaaggtgggacgtgccagtgcacgggagatactccaagtcagtgcagggag

SEQ ID NO: 49200 - DNA, 201 bp, Homo sapiens
agacggagtttcactcttgttgcccaggctggagtgcaatggcactgtcttggctcgctgcaacctccacctcccaggttcaagcatttctccttcctcascctcccaattagctgggattacaggcatgcaccaccatgcctggctaattttgtattttcagtagagacgtggtttcaccattttggtcaggctggtctc

SEQ ID NO: 49201 - DNA, 201 bp, Homo sapiens
ggcagggagggggactggttgctgggtgaggtaaacacaagtggcaaagcaggttgagagaggggtgattcagtcttggggatggtgggggaggggctgtrtccagacacctgagtggaggccaccaggaagaaccaggagtctaggacaggtgaggtctgagatgcagagggttcagatggcaaatcatttggacaaagt

SEQ ID NO: 49202 - DNA, 201 bp, Homo sapiens
gggcaggcccagaaagtgccagtgatggtggggagagaaggcattgtctcctctctccgagttggtggaggggaaaattgtttgtgacgatgctgcctccmgagccatctgctcaccgagaaacccaggatggtggagtggaatgaagccgtgcgtcccatgccagctcccccggggcagccctcacgctgctgctggacc

SEQ ID NO: 49203 - DNA, 201 bp, Homo sapiens
gaaggtcaccaaggagcttccctagaacggcttcaactgagggttgtggggatggccagagagcagtctgaggagcaagggcagacgctgttccaggaacrttggcagcatggggacacgggaaggaaatgcggttactcgagaaggaaggagggcctctcttcatccccatcctccttcccttcccatcctttccttttt

SEQ ID NO: 49204 - DNA, 201 bp, Homo sapiens
agggcgagcttatggatgggcagctgccatattgaatctcggggtccttggggaagggagtcacactccgccgttcctgtctgtgggcaccgggctgtccygtgcctttccatgccctgcctggagccagagggccactgggggaattcttgggcccaattgccttaccaggtgaggtttgacatcaggctggtgtcagag

SEQ ID NO: 49205 - DNA, 201 bp, Homo sapiens
gagggcctctcttcatccccatcctccttcccttcccatcctttccttttttaagggttagactagaaggattcgaatctatctgtaggcctagttgggcrgctgtagtagaaaagaggaatgatgagagatggctaggaagaagttcctgaagagcgtgaggcgtgggagccagaactcggaggagacattggcctggga

SEQ ID NO: 49206 - DNA, 201 bp, Homo sapiens
acctgctattttctttgtccccagtggggctgtttgcagccggtatgggggaaaagaatgagatacagaaaagtccctgagctgggcagaggcatcacccsctctgtgcctgctgagtctctgccttcagcaagggctgggaatgagcttgagatgaaggtgcctgccctgccagagccagggccctcggggtagggctgg

SEQ ID NO: 49207 - DNA, 201 bp, Homo sapiens; identical to SEQ ID NO: 9138

SEQ ID NO: 49208 - DNA, 201 bp, Homo sapiens
ccatcctccttcccttcccatcctttccttttttaagggttagactagaaggattcgaatctatctgtaggcctagttgggcagctgtagtagaaaagagkaatgatgagagatggctaggaagaagttcctgaagagcgtgaggcgtgggagccagaactcggaggagacattggcctgggaggtgggtgcgaagcttct

SEQ ID NO: 49209 - DNA, 201 bp, Homo sapiens
ctcaaatgtttgtctttgctttctttgctgtgattttctcagggtcctcatcccctcggccagcctctttgtggttttatctgatcagcctgctgctgtgyccctctttctcctgccctccgccccttgtgctgtgcacgtgcacacacgcacacacacacacatacacacatatgtcctcctccctggagtccttgtggt

SEQ ID NO: 49210 - DNA, 201 bp, Homo sapiens
tgctaacgtttgtctagaaaaagtctagaaaaatacacactgaactgtgaatagcagttatatttagaaagcaacattaggatggacttaagtcagggctyggactagagcaaggcaagtgaggtgccaggatgcaaaagttaaggagacacctgacctcaggggcccacaactgcagagcccctgacagtgagtgtctca

SEQ ID NO: 49211 - DNA, 201 bp, Homo sapiens
tgtgttgcctagggtggtcttgaactccagggttcaagtgatcctccctcctaggtctcccaaagtgctgggattacaggtgcgagccactgcacctgacytggtttattatttgtcggcaaaccaaaccccaaatagatgtatcttcaattttgttcatgaaaaagtgtcagtccataaatgccgtaacttacattatca

SEQ ID NO: 49212 - DNA, 201 bp, Homo sapiens
agcactttagatgtatggtcatggaatcctcacaagtcttcaaggtagatggtgtcatcctcatttcaaagatgagaacacaaaggttcggagcagttgaygcgttgcccaaggtcacacagcaagagcaaagcagaaccagtccttgaacgaggtctgccagagcccggggcctgttctcagctgccagcttgggataag

SEQ ID NO: 49213 - DNA, 201 bp, Homo sapiens
tgcgggacgcagcaggatttcacatgctctatccccgggaaggccactgagagtcagaatggcatgaggaggaaaaaggagatcaaatattttgagggaamttggggggaggtggagagaaggtggtcatgcctggggcatgggggtggcccctggctctctgtatggcagagcatcaggtgcagtggccggtgctctgta

SEQ ID NO: 49214 - DNA, 201 bp, Homo sapiens; identical to SEQ ID NO: 9144

SEQ ID NO: 49215 - DNA, 201 bp, Homo sapiens
ggctgttggccccttactcaaactgctagggcagagggagctggggttctctctccctgggaagggtctgatgagagaaggggctggaggagaccaggtcrttcctggaaataccaggcaccggctcccaggagggagccttgccctctgcgttccctcattatggtgcttccttttcctcatcaggagtctgatggctct

SEQ ID NO: 49216 - DNA, 201 bp, Homo sapiens
atccttttccttctccatatgtgcactcacactcatgtgtccctcagggtgccgttcttgccaagaaggtgaactggattggctgccaggggagtgagccrcatttccggggctttccctgctccctgtgggtcctcttccacttcttgactgtgcaggcagctcggcaaaatgtagaccactcacaggaagcaggtacgt

SEQ ID NO: 49217 - DNA, 201 bp, Homo sapiens
gaccccaccccatttagagcgagcaccttccctaccctgtcttctagccttaccaggtgtcccagagcaaaggtagtacagaagtcatatttgtgtcttakttagaatgttttcctggtggttttggaactttgcacaacctcctccccactgccccccgccccccgccccccgccttcttctgcatagcttcctaccatc

SEQ ID NO: 49218 - DNA, 201 bp, Homo sapiens
cggggctttccctgctccctgtgggtcctcttccacttcttgactgtgcaggcagctcggcaaaatgtagaccactcacaggaagcaggtacgtccaggasccgttcaccccactgtgcctccaaccctgctctgttcggccctccaaggggagagggggcagggaagctcccttgaattgccccactggctcccagctgc

SEQ ID NO: 49219 - DNA, 201 bp, Homo sapiens
tgactagggcagtagattctctaggcacctgctgccccggggcagagcatgtgtttctgagaacctggtttatcccctttctattccagagcagctccggktgtctcactgtatgttttggaaactggttgtatccaatttagaccttcattgctattcactggctaatcaatcagcaaatatttgttgagtgataagcat

SEQ ID NO: 49220 - DNA, 201 bp, Homo sapiens
tattgcacttcccactgaaaaacaatttcctgggggaagttggggaaacacgtttcccctgctgcctcggattgtccacaaactgcaccaccatgttctcyggccacgctgccccacacctgcttttgaagactgaaaggatgcgcatccaattcagtccacactgattgaggaaccaggtttataccaggctgcggcttg

SEQ ID NO: 49221 - DNA, 201 bp, Homo sapiens
tcacctgctagagggcccaggaggtgcgatgccaccaaggacagggaggcactcgctttccgggcaggcccagaaagtgccagtgatggtggggagagaargcattgtctcctctctccgagttggtggaggggaaaattgtttgtgacgatgctgcctcccgagccatctgctcaccgagaaacccaggatggtggagtg

SEQ ID NO: 49222 - DNA, 201 bp, Homo sapiens
cagggggacagagaggcctgcagtgcatcagggctagggccgtggtggagagaaagatgtggggtgaagagagggcaggctcgacgccattgggaaggggyccgaggccttacggggtgagttgaggggtgatgggtgagtagggattccgccaggagaggagcatcccagcagagggagcagcctgtgtggagccccgtg

SEQ ID NO: 49223 - DNA, 201 bp, Homo sapiens
aatgataggtttgttcattgatccctttatccactcatcatttagaagcaagattgagcaacttctttgtgacagtgccttcaacagctttttaaacagamgagtgtcaggacctgacatgtgtctgtaggagagaccggggtaggagatgggggtggacagtgggcacaggagagcagtcgaaagtgaagctaggaccag

SEQ ID NO: 49224 - DNA, 201 bp, Homo sapiens
acctcggaggactcttgccaagaaggaacaaatccatgtaccagcaggagctgctagagggagcccagccttgtacacagtggaggccccaggtgctaagraggcctcacaaggccgctgttggtgcgcagaggctctcttaaaagtttgtgtgcaggtgctctcagagacatggccctgctgagagattgtgtttccaag

SEQ ID NO: 49225 - DNA, 201 bp, Homo sapiens
gggggacagagaggcctgcagtgcatcagggctagggccgtggtggagagaaagatgtggggtgaagagagggcaggctcgacgccattgggaaggggccygaggccttacggggtgagttgaggggtgatgggtgagtagggattccgccaggagaggagcatcccagcagagggagcagcctgtgtggagccccgtgaa

SEQ ID NO: 49226 - DNA, 201 bp, Homo sapiens
gccagagcccagctggaaggaaacaaaggcgtgggagagggaggggctggttggctgcaggttctggctggagcttggcaacctagaggctggaacttccrggtcaaggggcttctccgtgggcctcaggagtgcccttcagtgggaatagaatgggactttttatggccgaaggcctggccggagcaaggggtacacagc

SEQ ID NO: 49227 - DNA, 201 bp, Homo sapiens
agaggaatggatctgttagcaggttttcctgttcagttaccattcgtgtctccagtatccttctcctctcaaatgtttgtctttgctttctttgctgtgaktttctcagggtcctcatcccctcggccagcctctttgtggttttatctgatcagcctgctgctgtgtccctctttctcctgccctccgccccttgtgctg

SEQ ID NO: 49228 - DNA, 201 bp, Homo sapiens
tccttacacacacacgtacatcctcatggcacattttcagccctggggtatctcaaaagcaacagctcaagcaatcctgccaaggtctctcaaagtgatcyttttttttttttttttttggaagacagaatctcgctctgttgcccaggctgggagtgcagcggcacgatcttggctcactgcaacctccacctcctgggt

SEQ ID NO: 49229 - DNA, 201 bp, Homo sapiens
ggagaaggcagtgtgggacgtctgggaagagagtctcccaggctgtgttggtgtccttgggctgcactcacaaatgtcaggctggggctcagccagtagaygtctgttgtctgagttctggaggctgaagtgcaaggtggaggtgtctgtgctggtttcttcgagcctctccttggctgggcggtggtcgtcttctccttg

SEQ ID NO: 49230 - DNA, 201 bp, Homo sapiens
gtacctgtgattcccagcacagagcctggtgcagagtaggagcccactgcacgttcatggtggccagtggcctgagcctcacaggattccaaatgacagcrtgagtgtagaaccttctgctggtgccgtggatcctcttgactcagaccgggggtgtcagccaggtgtgaggggtagagaaggcattttgtccatccagtg

SEQ ID NO: 49231 - DNA, 201 bp, Homo sapiens
gtcagtgagaaatgctgacttcaagctgtaaatttgtgtgtgagttccagaggcccgtgtgggctcaccaggagggcacgtgtcaaagcgtggtcttttcyggccatttctcactctgggggaaggtgtccagcccaacgtttgataggaatatttaatggctttctcagaggaatggatctgttagcaggttttcctgtt

SEQ ID NO: 49232 - DNA, 201 bp, Homo sapiens
ttggtgtccttgggctgcactcacaaatgtcaggctggggctcagccagtagacgtctgttgtctgagttctggaggctgaagtgcaaggtggaggtgtckgtgctggtttcttcgagcctctccttggctgggcggtggtcgtcttctccttgtgtctccgtgcagttgtccctctcccaatccatgtccaaatttcctc

SEQ ID NO: 49233 - DNA, 201 bp, Homo sapiens
cggagcacctatcatttcaggcaccttactaagtactcggcatacattgtctcatagtttcctttccacaatttaaagattcctgtggtgtcacacatccrcctaatccaggtagtgggtatttggcgggcaggagtggtatagtgatagtgatttgttcctgacttgctgcctctgaatggagttacttcctgactctgg

SEQ ID NO: 49234 - DNA, 201 bp, Homo sapiens
gtggccactgggtggcgtgtgggcaccagggtttccttgctcccagttgtccagagctccttaattcatccatccttctggcactgtcgccttagaaggcrgaagtttctaagtcaggatgatggcaaaggtcagtgagaaatgctgacttcaagctgtaaatttgtgtgtgagttccagaggcccgtgtgggctcaccag

SEQ ID NO: 49235 - DNA, 201 bp, Homo sapiens
ttggaccagattgctgacacacgtagctgctaatccccaaaattaatgaaggtgatcaaatagcatgcccaagatcacacagctagtaagttggtagaagrgggctttgaaccaggtccgtctggctccaaagccaatgttgtttccacagtgtcccactccatgggactggagtgaaatatttgggagggagggaacatt

SEQ ID NO: 49236 - DNA, 201 bp, Homo sapiens
ggacaagcctggtgtgtgggcagcactgaaagaaggctgctgtggccggagggagggaggtgaggctgcagagacaggccgggggcggaggtgagcgctcrtgggctcagaggccttggcgagggcagggtttggaggttggtgttggcattttgagaagccactggagaggctaacggaagtgacagttggttaacactt

SEQ ID NO: 49237 - DNA, 201 bp, Homo sapiens
atctctgttccgggcctctcctgacctgccgcctccagctccttagcttctgggccacatccttctctctcttcccccgctcagacccttatattttaaayccatgcacccagaggcctttggtgcgtgtttggctcttgctccatgttcccaatccctggttggggcaccaaaactatatttcctgaattccaagacacc

SEQ ID NO: 49238 - DNA, 201 bp, Homo sapiens
ccgctggctcagcctcccttggccctggggcccggatctgagcccaccctcctcagtgtgggtctgcaggaagctggggctgccctcgggtgatttgtgcytctccttgggaacttcctgccagcctgatccctccttcccacctccctgtcctggccccctggcttggtcacatgaatgcgtggtgacactgagagggcc

SEQ ID NO: 49239 - DNA, 201 bp, Homo sapiens
agttggttaacactttagaaaggtggaggatgggctactgcaggcagggggaggcagggcagctgaggagcaagctgcatgctcgcccagcagtggtggtygggcctggactagggttgtcagtgtgcccctggaggaagtggtcagatttggggatatgttaaaggcagagctgagggacttactgatagattggaggaa

SEQ ID NO: 49240 - DNA, 201 bp, Homo sapiens
gtaaggctggtcagtgtcaagccaaccaggggagggtggcaacgtgaaagcaacaaaggagagcaaccacaaaatgtggcacgaaagttgacaaatgctcrccatgggaagacaaagcaggcagtaataacatctgtaccagagagaggccaggagggcggggagagatcactggagtggctgaagagaaggtcaccaagg

SEQ ID NO: 49241 - DNA, 201 bp, Homo sapiens
ccacctgtcaggttcatgccattctcctgcctcagcctcctgagtagctgggactacaggcgcccgccaccacaccaggctaatttttttatatttttagkagagacggggtttcaccatgttggtaaggatggtcttgatctcctgaccttgtgatctgaccaccttggcctcccaaaatgctggaattacaggtgtgag

SEQ ID NO: 49242 - DNA, 201 bp, Homo sapiens
atggccttgttggattcggctgaagagagaccaggaggcaagattctggagataatgagcaggaactggggcatgactgggttagagggaacttctttatsatcatccttttccccagttggaatgatcccttatcaggggataaatggatgacgcagtaaagaaaaaacactaacgggagtgaaatcctggaggtgagga

SEQ ID NO: 49243 - DNA, 201 bp, Homo sapiens
tagctgctgtgggtcagtgctggggagaaaagggaacggacatccattttgcctccctgccacctttctccactccctcgactggttgaccaggtggtacrtagacttcctttctcatttttgtctttgatgtgggtatgcccacctggcagttttcctatctctgttccgggcctctcctgacctgccgcctccagctcc

SEQ ID NO: 49244 - DNA, 201 bp, Homo sapiens
cctgcctcagcctcctgagtagctgggactacaggcgcccgccaccacaccaggctaatttttttatatttttagtagagacggggtttcaccatgttggkaaggatggtcttgatctcctgaccttgtgatctgaccaccttggcctcccaaaatgctggaattacaggtgtgagccaccacgcccggcctgggagcttt

SEQ ID NO: 49245 - DNA, 201 bp, Homo sapiens
tgaccttgtgatctgaccaccttggcctcccaaaatgctggaattacaggtgtgagccaccacgcccggcctgggagctttatttttaagtaaacacttaygtacctactatgtgctagtcactgttatggcattttaataacattaaccccttcagttctcagaacagcccccctgaagttggtggtattattattattg

SEQ ID NO: 49246 - DNA, 201 bp, Homo sapiens
ctgctcacaaatggggaatctgcgtgcaaggacactctgaggcctccagaccaacttcccacccaagcaattatttgtgcagtcaatatttttgagtactyactatgtgctaggcactgtggcagcagatatgtacaggcagatgcattctctgcttgtgcagaccctacagcatacagcatcccttctaggaaggcaccc

SEQ ID NO: 49247 - DNA, 201 bp, Homo sapiens
aaccctgttccgcagctcagagacctcaaaggcctcagccccccgcacccagtgtcgcctgcaccctcattacgtccccaccacagccctggccctcttcyccaccctcttctgttcgcaggcagactcattggcaggctacaggcctggcaagcactcgtatatgcctgaccctccctccctttggttttctaattgcag

SEQ ID NO: 49248 - DNA, 201 bp, Homo sapiens
agcaaaggtagtacagaagtcatatttgtgtcttagttagaatgttttcctggtggttttggaactttgcacaacctcctccccactgccccccgcccccygccccccgccttcttctgcatagcttcctaccatctgcaggacggggaacttggggaattgcttttcactctccagcttccgcttgttcctccccacagt

SEQ ID NO: 49249 - DNA, 201 bp, Homo sapiens
cccggcatgcctcagacaccccaccaccctagtccagtactctccaaaggagtcaccccaggaagatcggcttgtgtgtcactcgcatctctcagctgtgmtcaaacctgctattttctttgtccccagtggggctgtttgcagccggtatgggggaaaagaatgagatacagaaaagtccctgagctgggcagaggcatc

SEQ ID NO: 49250 - DNA, 201 bp, Homo sapiens
tcgggagggagcggtgcacgtggctgtgacagcctcccgggggggggagaccagggcggagccgaggttaaaggagctgaatggagcaggtggtggtgcargcgcctgcacttggtcgtggtctcctggggcctcctatcgaactttgaaaggaagacatgtgcctgtcttctccttcccccaccccgcccctgccaccaa

SEQ ID NO: 49251 - DNA, 201 bp, Homo sapiens
cctgtctctgactttaggcctcatttgatgacttgcaggttcccaaaaggcctcacccctgatattaagccaaagaccacagacaacaaggtcttcttgaktctatagtcttgtatcttcattctactctaaataattagctctgtgtgtgtgtgtgtagtgtgtgtgtagtgtgtgtgtgtgcgggtgtgtgtgcctatg

SEQ ID NO: 49252 - DNA, 201 bp, Homo sapiens
cctgggcaacactgcgtgaggggctggtggccgtggctcaccctctgggactcatccagaggctgcctagagggctgggcccacctggggtaccaacagcstgcagccccagcagcatcctgactcttccaagtacccctcaggtctccccccaactatcccttggagcccacccctaccccagagggctgctgctgggta

SEQ ID NO: 49253 - DNA, 201 bp, Homo sapiens
ttcctttaccggactgtacacctcgcctcctggggcctgaggcgggaacccgggtcgcgctgctccgaggcctcggcggaccgcgaaaggatggctcaccrcccggccagggccagcccctgcaacaagctcagccccgcccgctcccgcgcccaggagcggccggcggggcggggtggctgggccggcctcgggggcggg

SEQ ID NO: 49254 - DNA, 201 bp, Homo sapiens
gggcggtggtcgtcttctccttgtgtctccgtgcagttgtccctctcccaatccatgtccaaatttcctcttcctgcaaggacaccagtcctattggattwgggcccaccctaatgaccttattttaccttcattacctctttaaagaccctgtctccaaatacggccacattctgagaggctggggattagggcttcaac

SEQ ID NO: 49255 - DNA, 201 bp, Homo sapiens; identical to SEQ ID NO: 9136

SEQ ID NO: 49256 - DNA, 201 bp, Homo sapiens; identical to SEQ ID NO: 9139

SEQ ID NO: 49257 - DNA, 201 bp, Homo sapiens; identical to SEQ ID NO: 9140

SEQ ID NO: 49258 - DNA, 201 bp, Homo sapiens
tattctcccaaatggtgagaggtagatccaggacttgaccccagatcccacccactcaaccctggagctgcagtctctaccccttctaacacatgtgattytgtttcatgtcctgttccatcggtagagttacacactttcctgagactttatatggtggtgctgctgggtgccagcccttcttccctccaacagtggcag

SEQ ID NO: 49259 - DNA, 201 bp, Homo sapiens
ttaagggtggaaagtgccaaatggagagacttttagtagatcaagggagaaggaaagagagagtgaggggtggtgtaatcattatgatcattccgtcattrtgaatgatcatcataatcattcgatcattacagttatgcaaaccattgacgttcttgtaatagcttgggctggtgtatgtgccaggctctgtgctgggca

SEQ ID NO: 49260 - DNA, 201 bp, Homo sapiens
ttgcgggtccctgctaaattcctctccctcttcctgggattcccatccatgtattgccagctacatgtagagtggagaggagaggtttttcctgcagggcyttccagagaaaggattcttggccagaggaaatcacagcctataagatcaatatcctgatagaatcccgggccaggtgtgagaggggagagctcactcaca

SEQ ID NO: 49261 - DNA, 201 bp, Homo sapiens
catcataatcattcgatcattacagttatgcaaaccattgacgttcttgtaatagcttgggctggtgtatgtgccaggctctgtgctgggcaccttccctrtgttacctcattcagtcatggggccacttctggaggcagggcacaggaatggagaggtaaactgaggcccaaggacagcaaagtggaacacagaggagac

SEQ ID NO: 49262 - DNA, 201 bp, Homo sapiens
gggcccacctaagatgtgaggtccggcagctgtgagcacatcagccctgaaagaaatacaggccctgcttcccctcctgcccccagtcgccatttcccagmcttggtgggcagctaaaccctggtctttcagagagggcccagtttttccagagccatgtcgtgtgtatgaacctgctggtctgattatgtctagtggtct

SEQ ID NO: 49263 - DNA, 201 bp, Homo sapiens
gccctgcttcccctcctgcccccagtcgccatttcccagacttggtgggcagctaaaccctggtctttcagagagggcccagtttttccagagccatgtcrtgtgtatgaacctgctggtctgattatgtctagtggtcttggctcggagctggcctgattagtgagttgcaggaggggtggctgtgggcctggagagaga

SEQ ID NO: 49264 - DNA, 201 bp, Homo sapiens
cgcctggtggccctgaaaaagtttgtggcagtgctggccaaggtgagcagggccatggcttcccttgtctgtgcaattctacggatggtcagtgtgcgttsctgtaagctgggcaccccgtcagcccctccctccagaagcccatggtctggctggacacctggacccacagctctccctgtccaccataggtgataccct

SEQ ID NO: 49265 - DNA, 201 bp, Homo sapiens
gcctctccttgggaacttcctgccagcctgatccctccttcccacctccctgtcctggccccctggcttggtcacatgaatgcgtggtgacactgagaggrcctgacagggacatttcagcctaaggcaggacagtcgttggcccctcactgaagtcccatgcaaaatgagcccttgttcttcagtccattgccataatag

SEQ ID NO: 49266 - DNA, 201 bp, Homo sapiens
ctatcatttcaggcaccttactaagtactcggcatacattgtctcatagtttcctttccacaatttaaagattcctgtggtgtcacacatccacctaatcyaggtagtgggtatttggcgggcaggagtggtatagtgatagtgatttgttcctgacttgctgcctctgaatggagttacttcctgactctggtgctaggt

SEQ ID NO: 49267 - DNA, 201 bp, Homo sapiens
tttgggtaaatctgtgcctctgtcttcatggaagtccagacccacttaacactcggaggctgcatgtttcttgttaagagttgtttgccatccagcacctsaacggttgtcagagctagaaggggcattagagatcattcatcctggccctcgctgatccaggaggaagcagaggtccagagagacatgtggagctcacgg

SEQ ID NO: 49268 - DNA, 201 bp, Homo sapiens
gattttcttctaaagtcagttagagcccccagagaatgttgaatagagattgacataatcagatccacagaaagaaaagatcatttggtggctagagaggscagtgaggggtggagcacattagaacctcaccaggagagaaataatatgttgatgtttctctggaagccctgccatgagaacctgtactagctcatggga

SEQ ID NO: 49269 - DNA, 201 bp, Homo sapiens
acccctgggttttttgtcctttcagcctggaggccggccctgtatctcgccgccctggactgtgctgaggagaccaacagtgcagtctgcagagacttcarcatccctggcttcccgactgtgagggtgtgtgactgacaggaggggaaggcaggctgggcctgctttgtttccctttataagggaaagggaccatgtggg

SEQ ID NO: 49270 - DNA, 201 bp, Homo sapiens
gggtgcccagcaccgcactcaccactgcaggcgtggccaggagcgtgagatccccagagcccatggccagtgagaggcggccagggataggtacccagggwatgccacaggagtttgctgggctcacggagctctttcactggtcagagaggagtgtgtgtaggagaggacttctacttggtgttgaaggacagatggggt

SEQ ID NO: 49271 - DNA, 201 bp, Homo sapiens
ccagtgagaggcggccagggataggtacccagggaatgccacaggagtttgctgggctcacggagctctttcactggtcagagaggagtgtgtgtaggagrggacttctacttggtgttgaaggacagatggggtttggctgggagagaggaggaatgtgggcgggccttataggcaggcgagaaggtgagagccaaggcc

SEQ ID NO: 49272 - DNA, 201 bp, Homo sapiens
gggagtgaaggtggccagtgtgctgtggaagcagctctgctctcctgacactccgctcacgcctgttttcatttacagtggctggtgctgacgtgcagacrctgcgggagaggctcattgacgccctggagtcccatcatgacacgtggcccccagcctgtcccccactggagcctgccaagtactttgggctggggcagg

SEQ ID NO: 49273 - DNA, 201 bp, Homo sapiens
ctcagctcaggcaatcggcctgccttggcctcccaaagtactgggattacaggcataagccactgcacccagcccaaagcaatccttttaaagaactttargaaggaggtagagatgtgtgatgaaaggtgagctgcctcttctgaagtctgagggtgggagtggggaaaggggtactggcccccatgtaggttgtgctct

SEQ ID NO: 49274 - DNA, 201 bp, Homo sapiens
cataagccactgcacccagcccaaagcaatccttttaaagaactttaggaaggaggtagagatgtgtgatgaaaggtgagctgcctcttctgaagtctgarggtgggagtggggaaaggggtactggcccccatgtaggttgtgctcttctgccagcctagggaagacccagggaagaggtctgagaggctggccacctga

SEQ ID NO: 49275 - DNA, 201 bp, Homo sapiens
tgtagacatgatatgtgggcctccatttgtactactgactcagttcttgcaaatattaagggtagacctgtccctgatcttcgtgtgtaaaatagcacctyctctgccactctattcttaccccagtctacatttcttcataacatcggtcaccatctgatctacatttacttatgtatcatctctttacccccactggaa

SEQ ID NO: 49276 - DNA, 201 bp, Homo sapiens
taatagagacctttcctccaaggctgagagctgtttggtcctcacagtgcagaggcctggggttgacaacctagagacttagaggggaaaaatccagaackgacccacgtacagtccctcctcctgacccatgagggagagcacccagcatgctttcccggcatgcctcagacaccccaccaccctagtccagtactctcc

SEQ ID NO: 49277 - DNA, 201 bp, Homo sapiens
actccagcctgggggacagagcgagactctgtctcaaaaaaataaaaaaataaaaataaaaaaataaagtaaagctacatatttaaaagctggggaaatayatgctgtaaatatgacaaagggctgtgactcttctgcaacacaccattttaagaatgagctaggtctgcatttattgacctgataaaatgtcccaagaag

SEQ ID NO: 49278 - DNA, 201 bp, Homo sapiens
ctgacccatgagggagagcacccagcatgctttcccggcatgcctcagacaccccaccaccctagtccagtactctccaaaggagtcaccccaggaagatyggcttgtgtgtcactcgcatctctcagctgtgctcaaacctgctattttctttgtccccagtggggctgtttgcagccggtatgggggaaaagaatgaga

SEQ ID NO: 49279 - DNA, 201 bp, Homo sapiens
tgtttgggttttgcccgcacatcccctggggtctgtagagtattctggcccttgccttgcttgggtagcttcttcctgaatagtagtatcctagcagctaycatttcttcagccctgccggtgcctgcagtgttctttgtatattagctcctcattctgtttctcagagaagattccacagcatggcttctagtatgatct

SEQ ID NO: 49280 - DNA, 201 bp, Homo sapiens
gccttgtggtggggaggtgggcacctgtgctgggtgcagaagaacaagctgagaaggcagaggagagagagagaggcaggtgtgggctgctgcgggtctcrccttgccaggagtgaggagagtagggtgccaacgtcctgctgcgtggaggggtaaaagcaggagattggcttctaaaggcctgggaggtttgcggtagga

SEQ ID NO: 49281 - DNA, 201 bp, Homo sapiens
catgtgtccctcagggtgccgttcttgccaagaaggtgaactggattggctgccaggggagtgagccgcatttccggggctttccctgctccctgtgggtyctcttccacttcttgactgtgcaggcagctcggcaaaatgtagaccactcacaggaagcaggtacgtccaggacccgttcaccccactgtgcctccaacc

SEQ ID NO: 49282 - DNA, 201 bp, Homo sapiens
gtgtccctcagggtgccgttcttgccaagaaggtgaactggattggctgccaggggagtgagccgcatttccggggctttccctgctccctgtgggtcctyttccacttcttgactgtgcaggcagctcggcaaaatgtagaccactcacaggaagcaggtacgtccaggacccgttcaccccactgtgcctccaaccctg

SEQ ID NO: 49283 - DNA, 201 bp, Homo sapiens
gccccactggctcccagctgccagaagatggggagagtcagccttggggctctggctggattgctctatctgcaggtagccccacacggccagaatagaaycaatcccaggagggagcagactttaggaattcaaccagtcctgttttcggccccgggagctctggggctgaggcttctccctgtctttctccgggcttat

SEQ ID NO: 49284 - DNA, 201 bp, Homo sapiens
aggcatgcaccaccatgcctggctaattttgtattttcagtagagacgtggtttcaccattttggtcaggctggtctcaaactcctgacctcaggagatcygcccacctcagcctcccataatgctgggattacagacgtgagccactgcgcccaaccaggaactttatttttattattttgagatggagtctcgctctgt

SEQ ID NO: 49285 - DNA, 201 bp, Homo sapiens
gtggacctctagtgtgaggcagggggacagagaggcctgcagtgcatcagggctagggccgtggtggagagaaagatgtggggtgaagagagggcaggctsgacgccattgggaaggggcccgaggccttacggggtgagttgaggggtgatgggtgagtagggattccgccaggagaggagcatcccagcagagggagca

SEQ ID NO: 49286 - DNA, 201 bp, Homo sapiens
catgactgggttagagggaacttctttatgatcatccttttccccagttggaatgatcccttatcaggggataaatggatgacgcagtaaagaaaaaacaytaacgggagtgaaatcctggaggtgaggagtggggtaacccgagcagcagcggagacagaggctgagcaacgccagggccgtgtggtgaggccttgtggt

SEQ ID NO: 49287 - DNA, 201 bp, Homo sapiens
ttaaactccagggagctgggtcgggagggagccatctgtggacaggaggcggtttgtgtgtcgggagggagcggtgcacgtggctgtgacagcctcccggkggggggagaccagggcggagccgaggttaaaggagctgaatggagcaggtggtggtgcaggcgcctgcacttggtcgtggtctcctggggcctcctatcg

SEQ ID NO: 49288 - DNA, 201 bp, Homo sapiens
aaactccagggagctgggtcgggagggagccatctgtggacaggaggcggtttgtgtgtcgggagggagcggtgcacgtggctgtgacagcctcccggggkggggagaccagggcggagccgaggttaaaggagctgaatggagcaggtggtggtgcaggcgcctgcacttggtcgtggtctcctggggcctcctatcgaa

SEQ ID NO: 49289 - DNA, 201 bp, Homo sapiens
agcagaccgaccaaagactgcaaaacagatcaaaatgagtattcttgccctttcccatgtctggtactggggtaaaggctggttgtaaagtccacatagcrggacagtgggtctggccaacaccgggaaatgactgagatggcgctcttcacgcttccctggaaaaccacggagggccggggctgaggggtaggtggatct

SEQ ID NO: 49290 - DNA, 201 bp, Homo sapiens
tggccaacaccgggaaatgactgagatggcgctcttcacgcttccctggaaaaccacggagggccggggctgaggggtaggtggatctgcctcctcctccwtgctgccatctgttgagctcccactgtgggctagtgtttgtaatctgtattttctaattacccatcctctggaagggcagtggcgagccctttctgcaga

SEQ ID NO: 49291 - DNA, 201 bp, Homo sapiens
aggaggtgcgatgccaccaaggacagggaggcactcgctttccgggcaggcccagaaagtgccagtgatggtggggagagaaggcattgtctcctctctcsgagttggtggaggggaaaattgtttgtgacgatgctgcctcccgagccatctgctcaccgagaaacccaggatggtggagtggaatgaagccgtgcgtcc

SEQ ID NO: 49292 - DNA, 201 bp, Homo sapiens
cccactgccccccgccccccgccccccgccttcttctgcatagcttcctaccatctgcaggacggggaacttggggaattgcttttcactctccagcttcygcttgttcctccccacagtatttccctggccggcccttagtccagaacttcctgcactccgtgaatgaatggctcaagaggcagaagagaaataaaattc

SEQ ID NO: 49293 - DNA, 201 bp, Homo sapiens
acggctgtggggctggcagcctgaagggctggtgcgtggcatctcctctgccctgtagccaaggccaaggaggtcctcccagccatccgaggctacgtgcrctacttcttcggctgccgagactgcgctagccacttcgagcagatggctgctgcctccatgcaccgggtggggagtcccaacgccgctgtcctctggctc

SEQ ID NO: 49294 - DNA, 201 bp, Homo sapiens; identical to SEQ ID NO: 9126

SEQ ID NO: 49295 - DNA, 201 bp, Homo sapiens; identical to SEQ ID NO: 9128

SEQ ID NO: 49296 - DNA, 201 bp, Homo sapiens; identical to SEQ ID NO: 9129

SEQ ID NO: 49297 - DNA, 201 bp, Homo sapiens
agggtcttccagctagtgaggggctgggcagggagccacacccactcgcatccagcccatgcccattaccaccaagtgcatggtgctcacaggcccgaacscctaagggtgccagtggacactgctggctccccctggctagctgccagccctgcaggtgcccggtcagtcaggaggccctctgcatgtcctgccggtgcc

SEQ ID NO: 49298 - DNA, 201 bp, Homo sapiens; identical to SEQ ID NO: 9131

SEQ ID NO: 49299 - DNA, 201 bp, Homo sapiens
ccagtatccttctcctctcaaatgtttgtctttgctttctttgctgtgattttctcagggtcctcatcccctcggccagcctctttgtggttttatctgaycagcctgctgctgtgtccctctttctcctgccctccgccccttgtgctgtgcacgtgcacacacgcacacacacacacatacacacatatgtcctcctcc

SEQ ID NO: 49300 - DNA, 201 bp, Homo sapiens; identical to SEQ ID NO: 9132

SEQ ID NO: 49301 - DNA, 201 bp, Homo sapiens
agtcacactccgccgttcctgtctgtgggcaccgggctgtcccgtgcctttccatgccctgcctggagccagagggccactgggggaattcttgggcccarttgccttaccaggtgaggtttgacatcaggctggtgtcagagaggctttccagagcatgtgcagtgattagaagggttacagcgaggcctgggtgccgtc

SEQ ID NO: 49302 - DNA, 201 bp, Homo sapiens; identical to SEQ ID NO: 9133

SEQ ID NO: 49303 - DNA, 201 bp, Homo sapiens
agccccctcaggagaagctgcagtctgctgtctgcggggccagcgcctccaccgtcaggagcctgggcctgaaacgctaaccctgttccgcagctcagagwcctcaaaggcctcagccccccgcacccagtgtcgcctgcaccctcattacgtccccaccacagccctggccctcttccccaccctcttctgttcgcaggc

SEQ ID NO: 49304 - DNA, 201 bp, Homo sapiens; identical to SEQ ID NO: 9134

SEQ ID NO: 49305 - DNA, 201 bp, Homo sapiens
gcgagccctttctgcagacaaggaagctggcgttctgagtggaggagtgtggtctgggtttttgggtgggactgatgtcaccaccagcctgtgtatgcttycctctgtaggtgcccccagcgaggacccccagttccccaaggtgcagtggccaccccgtgaactttgttctgcctgccacaatgaacgcctggatgtgcc

SEQ ID NO: 49306 - DNA, 201 bp, Homo sapiens
gcagacaaggaagctggcgttctgagtggaggagtgtggtctgggtttttgggtgggactgatgtcaccaccagcctgtgtatgcttccctctgtaggtgmccccagcgaggacccccagttccccaaggtgcagtggccaccccgtgaactttgttctgcctgccacaatgaacgcctggatgtgcccgtgtgggacgtg

SEQ ID NO: 49307 - DNA, 201 bp, Homo sapiens; identical to SEQ ID NO: 9137

SEQ ID NO: 49308 - DNA, 201 bp, Homo sapiens; identical to SEQ ID NO: 9141

SEQ ID NO: 49309 - DNA, 201 bp, Homo sapiens; identical to SEQ ID NO: 9142

SEQ ID NO: 49310 - DNA, 201 bp, Homo sapiens
tggggtctcggtgacacagttcactgtttgctgcagaggaggccccactcgcagccttggcctctgccctgcagaagaattccctgtaactcactcaccartggccgtgggagccagtggcctcggcgagggtcagttggactgcatagctgccggctgagtctctctggccaccctcactggccccatcactccaggttg

SEQ ID NO: 49311 - DNA, 201 bp, Homo sapiens
acttaaatatgttttcgaatgtttgtaataaaatatttcttttggaaggcaaaaatagcaaggaaaataaataggattaaaggatactaaagcccattcartaaaatttgtaggaggccactgatttggcctaggctcctatgatgtaaccaacagaccaaaccaatatggagtcattcatgctaaatgaaactagttagg

SEQ ID NO: 49312 - DNA, 201 bp, Homo sapiens
gcctggaagcttagctggggctgtgggaggggcctccagtcctctccccatgggcctctccatgggctgctcagacttcctcacggcatggtggctgggcycttcagggtggccttttcatgtgctagcctcagaagccacctagcatgacttttgcgattttctgttggttgaggttgatgtaacggctcgcccaggatg

SEQ ID NO: 49313 - DNA, 201 bp, Homo sapiens
aatagtttgtattctttgccatttctgatgctctgaaacagatattcaaacaagcaagtctttatgtatttatctggagtgtctttctcaagcactcagcrtgttcagtagacatttgtctccttaatttctaggcccatgggaaagataactacaacactgtttaacaacagagacatttgaaggtacaaaactttactg

SEQ ID NO: 49314 - DNA, 201 bp, Homo sapiens
ctcctttttagagcatactgtgagttcctgggaccctagaaaatagtgccgcaatagcaacaggtcaccagctacaggctgcctcagccttttcccaaggyctatcctcctgaggagcaaggggtggtcaaggggaggctatttgcaggtgtggacaaaactctgatgtgcagatgtcgttgttataggtgtgggcaaaag

SEQ ID NO: 49315 - DNA, 201 bp, Homo sapiens
atgtatcatctctttacccccactggaatgtaagttccacgtccctagagtctatattttgtttactgccttatccttatacctaaacaagtgcctggcaygacaccactcagtaaaacttgaataaatgaataacaaatctaggctcaaagctcttacaggtgaaaggggctaacctggcagtcacaaaggaaaaatatc

SEQ ID NO: 49316 - DNA, 201 bp, Homo sapiens
gggtgctgaacacagaggccaatgtggtgagaaagtttggtgtcaccgacttcccctcttgctacctgctgttccggaatggctctgtctcccgagtcccygtgtgagtatcctgtctcctggcgtcccctctcgtccctccctgtgctcatccttccttcttgcccagaggggctgcccgcctttcacagtggccaacat

SEQ ID NO: 49317 - DNA, 201 bp, Homo sapiens
gggaattcttgggcccaattgccttaccaggtgaggtttgacatcaggctggtgtcagagaggctttccagagcatgtgcagtgattagaagggttacagygaggcctgggtgccgtcttctggcctcacagaggacaagatggaatctcgttcacatatttaataaaccttcctgtccgatgagccacccttcttcctct

SEQ ID NO: 49318 - DNA, 201 bp, Homo sapiens
gggaagggagtcacactccgccgttcctgtctgtgggcaccgggctgtcccgtgcctttccatgccctgcctggagccagagggccactgggggaattctygggcccaattgccttaccaggtgaggtttgacatcaggctggtgtcagagaggctttccagagcatgtgcagtgattagaagggttacagcgaggcctgg

SEQ ID NO: 49319 - DNA, 201 bp, Homo sapiens
gaagccagtggtaacttacaagactctgtgaccatcagcagtgccccttctcttctctccctttagccctggatgctccttgcagcccctgcaccatggtyaatacttctttctctctctatctccctctgggtcctcagctccaagatctacatggctgacctggaatctgcactgcactacatcctgcggatagaagtg

SEQ ID NO: 49320 - DNA, 201 bp, Homo sapiens
cccggatctgagcccaccctcctcagtgtgggtctgcaggaagctggggctgccctcgggtgatttgtgcctctccttgggaacttcctgccagcctgatscctccttcccacctccctgtcctggccccctggcttggtcacatgaatgcgtggtgacactgagagggcctgacagggacatttcagcctaaggcaggac

SEQ ID NO: 49321 - DNA, 201 bp, Homo sapiens
cgaagcagggggaggagagagtgcttttggtatgatggggacaggcccacacacaagtctggcctccctgagtggcatgtgtgactgtccttttcttctgyctccagccccttgtcactatgagcaaacagtgagcttctaccagcccagcctgtttagcaaacacctgggccctgaagggcgggccagctgtgtcaggtc

SEQ ID NO: 49322 - DNA, 201 bp, Homo sapiens
ggagaattacctaaaaggtacagaaaaacctttcactgtttccttttaagaacagatcaatacttcaagaaaaccttgttttaacagagaggaccaaattctgatttttcatcagtgtacttttgatattaaggctcatcaaaaaaaaaaaaacacaaaaactataagttagcccattcgaccacacttgaagttcttttc

SEQ ID NO: 49323 - DNA, 201 bp, Homo sapiens
gagtagctgggactacaggcgcctgccaccaagcctggctaattttttgtatttttagtagagatggggtttcaccatgttgcccagggtggtctcaaacwcctcagctcaggcaatcggcctgccttggcctcccaaagtactgggattacaggcataagccactgcacccagcccaaagcaatccttttaaagaacttt

SEQ ID NO: 49324 - DNA, 201 bp, Homo sapiens
gaggctggaccattttccttaaaacgttataaaagctggaattgaatgccatcggtgtcacccctgggaagtgtgctttctcttgagctcttttggccccragatagcagtcactccatagtttcgtgaagaccagcctggtgttgcctggttttctgccattagggagcagctagaggtcttccagtagctcctgtgtaa

SEQ ID NO: 49325 - DNA, 201 bp, Homo sapiens
cttctccatggataatccacggtgttggaagtggttaaggtaatggatcctcatgggcttaccataaaaatatctggaggctggaccattttccttaaaaygttataaaagctggaattgaatgccatcggtgtcacccctgggaagtgtgctttctcttgagctcttttggccccaagatagcagtcactccatagtttc

SEQ ID NO: 49326 - DNA, 201 bp, Homo sapiens
attagggagcagctagaggtcttccagtagctcctgtgtaaagtgatgaaagaaaagggctgggtgctgactgctcctggagaaaagcaacacactcccaragtcttaattgcctgcttccagggagctgtggtggtttcccttgggcagggcacacgccccagtggttgacttaataaggatacattttaatcagaggac

SEQ ID NO: 49327 - DNA, 201 bp, Homo sapiens
acctatcatttcaggcaccttactaagtactcggcatacattgtctcatagtttcctttccacaatttaaagattcctgtggtgtcacacatccacctaayccaggtagtgggtatttggcgggcaggagtggtatagtgatagtgatttgttcctgacttgctgcctctgaatggagttacttcctgactctggtgctag

SEQ ID NO: 49328 - DNA, 201 bp, Homo sapiens
acccttcttcctcttctgacattggttagctctaatcttgttctctgcacttactgcctctcctccctggttctgtgccctcacaggctcatggaatccakgtccttctataccgcttacctgcagagactctctgggctcaccagggaggctgcccagaccacagttgcaccaaccactgctaacaagatagctcccact

SEQ ID NO: 49329 - DNA, 201 bp, Homo sapiens
catgtcatcttcctgccaggttccctagctgctgtgggtcagtgctggggagaaaagggaacggacatccattttgcctccctgccacctttctccactcyctcgactggttgaccaggtggtacatagacttcctttctcatttttgtctttgatgtgggtatgcccacctggcagttttcctatctctgttccgggcct

SEQ ID NO: 49330 - DNA, 201 bp, Homo sapiens
gccagtggacactgctggctccccctggctagctgccagccctgcaggtgcccggtcagtcaggaggccctctgcatgtcctgccggtgccttcccacccrgcctctcccagcctgtgctccctcctgtgagcagctggtaggagtggccactgggtggcgtgtgggcaccagggtttccttgctcccagttgtccagagc

SEQ ID NO: 49331 - DNA, 201 bp, Homo sapiens
actattgttatatatatgctaacgtttgtctagaaaaagtctagaaaaatacacactgaactgtgaatagcagttatatttagaaagcaacattaggatgracttaagtcagggctcggactagagcaaggcaagtgaggtgccaggatgcaaaagttaaggagacacctgacctcaggggcccacaactgcagagcccct

SEQ ID NO: 49332 - DNA, 201 bp, Homo sapiens; identical to SEQ ID NO: 9122

SEQ ID NO: 49333 - DNA, 201 bp, Homo sapiens
ccattcctttaccggactgtacacctcgcctcctggggcctgaggcgggaacccgggtcgcgctgctccgaggcctcggcggaccgcgaaaggatggctcrccacccggccagggccagcccctgcaacaagctcagccccgcccgctcccgcgcccaggagcggccggcggggcggggtggctgggccggcctcgggggc

SEQ ID NO: 49334 - DNA, 201 bp, Homo sapiens
agaattgtctcttgcaggctggaggagattgatggattctttgcgagaaataacgaagagtacctggctctgatctttgaaaagggaggctcctacctggstagagaggtgagctgccctgaagttccctgcaattcttggatagccatggagagagagccccagtttgggagcagggcttttcctgccaattctagggtc

SEQ ID NO: 49335 - DNA, 201 bp, Homo sapiens
gctgggcggtggtcgtcttctccttgtgtctccgtgcagttgtccctctcccaatccatgtccaaatttcctcttcctgcaaggacaccagtcctattggwttagggcccaccctaatgaccttattttaccttcattacctctttaaagaccctgtctccaaatacggccacattctgagaggctggggattagggcttc

SEQ ID NO: 49336 - DNA, 201 bp, Homo sapiens
tgctccgtgcagggtatctaggcacagttcatttggcaagttggtgttggctgctgcctggaagcttagctggggctgtgggaggggcctccagtcctctmcccatgggcctctccatgggctgctcagacttcctcacggcatggtggctgggcccttcagggtggccttttcatgtgctagcctcagaagccacctagc

SEQ ID NO: 49337 - DNA, 201 bp, Homo sapiens; identical to SEQ ID NO: 9180

SEQ ID NO: 49338 - DNA, 201 bp, Homo sapiens
cacggaagagcagctcacatttggaaggggctaaaatttttacctagtttgaatctgctctgcaatgtccccatcaagttcttaaccatcccgggttccartggttacagagttctgccctggggagggaggaattgcttagcaaatgatgttgagaatagtgattatttgggggaaaattcaggtaagatctcaccttca

SEQ ID NO: 49339 - DNA, 201 bp, Homo sapiens
tttgaagaatgaagtccaggtttacttggttttagtaaatttagaaggatccatgcagacagcatttatgttaacattttattctctataatgtttttatratgtgctttctccttccccttgcatttgaatatctgaatgttgatttgatttgcttctagtaatttggagttttgatttgtatttaatcatgggggtcat

SEQ ID NO: 49340 - DNA, 201 bp, Homo sapiens
cgccgtccagttccatcaggtagtgtacactccagttttttggttccttttaaaacaaagggggaaaatgaggtccttcagctgctttgccaaaaatgatrgtgacatagtgatagtgacacagtgatagaatggggaaataggatattttacttccattacagtcatagattagcaactgtaaaattacctgtcctatta

SEQ ID NO: 49341 - DNA, 201 bp, Homo sapiens; identical to SEQ ID NO: 9199

SEQ ID NO: 49342 - DNA, 201 bp, Homo sapiens
ggcagcatctaagcagcccccagtgatctccatctcctcatgtattatagccttaagcaatccccttgagtttgggctgcattagtagtgtcttgcttctkctagtgcatagagtatagcagaagtgataggctatcactgccgatattcggtctcaaaaaactggtttctgccttaggggctctctcttgctccctttga

SEQ ID NO: 49343 - DNA, 201 bp, Homo sapiens
tttaatttattatttatatgtaagtatttattattttcccttccatgattggttcattttttcattttttggttagtatttcattaattatacaactagcmtgcactacaatatgagattatagccatatctttgatcaaattttgttggaaatgagacactcttgaactgattttcttgattcactctataagcacctta

SEQ ID NO: 49344 - DNA, 201 bp, Homo sapiens
tatggtaataatgaaactggtggttttcttttcttccccctcacagtatctcagagatgttaactgtcctttcaagattcaagatcgacaagaagctattsactggcttcttggtttagctgttagacttgaatatggagataatggtacgttttgtggggaatgtgtattttaaagagagaggaaagatgggaaagggag

SEQ ID NO: 49345 - DNA, 201 bp, Homo sapiens
ttattcttatcacaagttaaaagcacttttattgtctttcattggtgtttatatatttctgttagaatttggaaatggtgccctctggagaaggctaattractgtcttctcacagagtaacactactttgataatatggtctgcaccttagcctttcaaattaaattgtttttagtgtcccagaattgatgggactttga

SEQ ID NO: 49346 - DNA, 201 bp, Homo sapiens
tctcttgtaagttttcccatctctaatttacttgtttaaatcagtatagatacatggatttttattttattcaatggattataatcctttctgtcatcacrtattttgctgttgatactgttccagatttggccagtggaagcctttttaactctgacttaaattttatgcttttattttttcctcgtttcattaacagat

SEQ ID NO: 49347 - DNA, 201 bp, Homo sapiens
tatctctgaaagacactgttttcttttaaaggttcttactggctcgttgtatatgaatcgagccactggaagttgggttaaagatcagcttatttcacccwcactatagaacagacagtaaattgttctggtgtaataaagtcattcattcattcattcattccttcagcaaaactatgctttggaaggcagtgtaagtaa

SEQ ID NO: 49348 - DNA, 201 bp, Homo sapiens; identical to SEQ ID NO: 9196

SEQ ID NO: 49349 - DNA, 201 bp, Homo sapiens
aggatgaaaaacatccttgaaggatcttatctgccaatgaggaggtgatgaaacaaaagcctcagagggcttaatgagtcaagtcaggtactgacttttgktaaaacaagtggtgtgtcctctggaacagttggccttttcaggcttgtccagaatttgtggggctcacctcctccagtctgtgtggtagaagtgatctgc

SEQ ID NO: 49350 - DNA, 201 bp, Homo sapiens
gccaggagtattataatatctcccattagtgtcaccttctgttcttaactgcatggccaaccaagctaactttctgaaacgttaatctattttaggatgcmacttactccttgtttccaaagaacagttccagttacatattcatattaataaacatacatatccataaacactaatttcccattttctataaaaagaatt

SEQ ID NO: 49351 - DNA, 201 bp, Homo sapiens
attattaaatgtcagttttaacaagactgttgtattcctaagttattaaaattttctatactgaatctgaatgttaacttggattttctcaatccagattrcatgccaaaagacaaaaatgtttttagtgaaatttagctatttcaaaggcttgttctttattccgacaattatgtaaattgccttggaactgttctatag

SEQ ID NO: 49352 - DNA, 201 bp, Homo sapiens
cagttacatattcatattaataaacatacatatccataaacactaatttcccattttctataaaaagaattttaagctccttagcatggtagttaatgatractgatatccaacctgtattcacatcttgacatcccagctaaattagaataatagtgcttcctgtttatatcccatttccccctctgtttctttgttcac

SEQ ID NO: 49353 - DNA, 201 bp, Homo sapiens
tttatttaattgttgatagtctacagggctttcttttttctcttgtgagtagcagttttaaaaactaagagatttgttgctaccgaaaagttaaaaatgtwtttgtatgttcacaaatatgtttgtaattatacgtttgcagggttgtaagtttttgtttgtttttaatcttttatagtaaataatcctgattttaaggct

SEQ ID NO: 49354 - DNA, 201 bp, Homo sapiens
tacagtaataggaaaaccattttatcttaccaatttatttaattgttgatagtctacagggctttcttttttctcttgtgagtagcagttttaaaaactamgagatttgttgctaccgaaaagttaaaaatgtttttgtatgttcacaaatatgtttgtaattatacgtttgcagggttgtaagtttttgtttgtttttaa

SEQ ID NO: 49355 - DNA, 201 bp, Homo sapiens
tcaatattgtgtctgtcacagtacctgacatagtttcttgcacacaacaggtgcttatcaatttcagtaatgtgtggcgaatgcagtatatgtgagtgttwacatacactgatttggagcatcagccaattttttgctgatgcctcagacttaaatttcagaagccttatggcaaaaatcttaaggaaagctcaatttgag

SEQ ID NO: 49356 - DNA, 201 bp, Homo sapiens
tggccactatgtttatttactgatacaacaccatccctggtaacagaaaggaagagtgaattcagggacagtcatttactagataaagaagtcagtcagccacagaaaatcagttgcaatagaggaaaatttctggcagccttctctgtcccagggctggtgctaaagccatactgaagtttgaagaccattgctctaaat

SEQ ID NO: 49357 - DNA, 201 bp, Homo sapiens
atctgtttaagatatccattctacgttctacaacttagagaaaggatagcttacttcagtgcttcctaaagcaaattgaatgtattcagtggctagggggkcatttttgagtgaaaaacttcatgttcctctcactttgtaccttaaaaaagccacaaatagctcatgcacagtccacaaatcatgcttgtggcccgttga

SEQ ID NO: 49358 - DNA, 201 bp, Homo sapiens
tctctgaaagacactgttttcttttaaaggttcttactggctcgttgtatatgaatcgagccactggaagttgggttaaagatcagcttatttcacccacmctatagaacagacagtaaattgttctggtgtaataaagtcattcattcattcattcattccttcagcaaaactatgctttggaaggcagtgtaagtaaag

SEQ ID NO: 49359 - DNA, 201 bp, Homo sapiens
ttgaacataaaaatgaattttgtgtttagacttcagtcccatccccaaaatatcccattttatatatgcagataatccgaagtctgaaaaaatttaaaatyggaaattattggcatttccagtaagggaaactcaacctgtaatcattttggctcagttaaatttggtaaatagcagtagtcattttaccttgagttgcag

SEQ ID NO: 49360 - DNA, 201 bp, Homo sapiens
actggccactatgtttatttactgatacaacaccatccctggtaacagaaaggaagagtgaattcagggacagtcatttactagataaagaagtcagtcagccacagaaaatcagttgcaatagaggaaaatttctggcagccttctctgtcccagggctggtgctaaagccatactgaagtttgaagaccattgctctaa

SEQ ID NO: 49361 - DNA, 201 bp, Homo sapiens
ctgatgttcttttgtggttttacattgatatgttgcctccttgacttttaagttacttattttaaaatttgctgaaaccattgtgagtttttattatttgygctctactattttttgaagccttttggtagcttgtcaacatgatcaataactgaaattttttaaatgtataatttcagatgtatagaaaaattacaaaat

SEQ ID NO: 49362 - DNA, 201 bp, Homo sapiens
aactggccactatgtttatttactgatacaacaccatccctggtaacagaaaggaagagtgaattcagggacagtcatttactagataaagaagtcagtcagccacagaaaatcagttgcaatagaggaaaatttctggcagccttctctgtcccagggctggtgctaaagccatactgaagtttgaagaccattgctcta

SEQ ID NO: 49363 - DNA, 201 bp, Homo sapiens
tttattattttagaatgagaaggccaacattagcctcactgggttcatgtcaagttgtcagcaaggcaggttccttttggaggctctcgggggaatctgtktctttccttttttaacttctagaggctgcctgaattccttgactctggccccttcttccttcttcaagtctagcagcatagcattttccagtctcttatc

SEQ ID NO: 49364 - DNA, 201 bp, Homo sapiens
agggaaaatgtttatcttgatttctgctacagcaacactgaagccagaggtgtctgagctttggctaatgtcacttgatgtaggtcagccctactgtgagygtcaaccctggtttctaaatgtgctgctggaggaatcccacttcacttccagtttaagtgtcagctgaggcctcgcctgatcatttgattcagagtagcc

SEQ ID NO: 49365 - DNA, 201 bp, Homo sapiens
cgttgtatatgaatcgagccactggaagttgggttaaagatcagcttatttcacccacactatagaacagacagtaaattgttctggtgtaataaagtcawtcattcattcattcattccttcagcaaaactatgctttggaaggcagtgtaagtaaaggcttagccaaatctctttgctcttgtttgtaaagtaaaattt

SEQ ID NO: 49366 - DNA, 201 bp, Homo sapiens
taaactggccactatgtttatttactgatacaacaccatccctggtaacagaaaggaagagtgaattcagggacagtcatttactagataaagaagtcagtcagccacagaaaatcagttgcaatagaggaaaatttctggcagccttctctgtcccagggctggtgctaaagccatactgaagtttgaagaccattgctc

SEQ ID NO: 49367 - DNA, 201 bp, Homo sapiens
atatcttgtattcttcatcaaaagagacttttacttaaaatgttcacaggtctgagagccatggcaggatcagggcaaatctgtaggagttcaccatcccytgccccttcttcagctggcaggctgaactcagtgctgtggttttggaaccctggcaagtctgaacctaaagtaaagcgtgctgtttggcactcagctgtc

SEQ ID NO: 49368 - DNA, 201 bp, Homo sapiens
tattctagcctctgtacttctttttattattattatttttgagatggggtcttacatgttgcacaggttggtgtgatcatggctcactgcagcctcaaccytgcaggctcaagtgatcctcccacctcagcctcctgagtagctgggtccacaggcacacacgagcatgccaggctaatttttctttcttctttttttttt

SEQ ID NO: 49369 - DNA, 201 bp, Homo sapiens
agtgtccaccatggtacatagcacatgctgaatgaatgaatgaatgttctccaccctcgctctttacccaggtcggacatcctccttaactgactcattgkgagctacctaggcctttagatgttgatatagtttggatgttgtccccgcccaagtttcacgttgaattgtaatcctcagtgttggaggtggggtctgata

SEQ ID NO: 49370 - DNA, 201 bp, Homo sapiens; identical to SEQ ID NO: 9197

SEQ ID NO: 49371 - DNA, 201 bp, Homo sapiens
ctccacccaaaccccagaaagttcattttaagactcatttactagtacttaaatttactagtacttaaaagtttacagaccaaagaaaggagatctaagtkatgggatttcattttgtagtaaaatctgttagtgctcacattcactgtgatgagaggttatctatttgcattccatcagtagtattacctgcatctgccc

SEQ ID NO: 49372 - DNA, 201 bp, Homo sapiens
ttggaaccactgtaagttcagattttcctcatcttgcactagggttacatcccactgaactcattgtaaggtcaaaaaattacaagtctaaccatcctaarttggggaccgtctcatacagtaataggaaaaccattttatcttaccaatttatttaattgttgatagtctacagggctttcttttttctcttgtgagtag

SEQ ID NO: 49373 - DNA, 201 bp, Homo sapiens
cttttaagtattgtttttcaaatgaaaataataaaatctacctttggaattctgaatttcaagtttccatgaaataagtttgaggtttgtatatgatggtrtatttgatgtattgatttttttggggaaagcaaggtttttggattttatgtacagcattcaaaagaagatggggggaaagcgtactttttaatgagtttg

SEQ ID NO: 49374 - DNA, 201 bp, Homo sapiens
aaacatacatatccataaacactaatttcccattttctataaaaagaattttaagctccttagcatggtagttaatgatgactgatatccaacctgtattmacatcttgacatcccagctaaattagaataatagtgcttcctgtttatatcccatttccccctctgtttctttgttcacacttttcccttggctaatata

SEQ ID NO: 49375 - DNA, 201 bp, Homo sapiens
gcctgacacaggatgcagttgctaaggcaaatcaaacaaaagaggtacgtttctataaatcctaaataagttgttaatgaacatttcttctggtatggccrtgattttaaactttgcatgtatctgtttaagatatccattctacgttctacaacttagagaaaggatagcttacttcagtgcttcctaaagcaaattgaa

SEQ ID NO: 49376 - DNA, 201 bp, Homo sapiens
aaaaggttactaatgccagggcagtatctctgaaagacactgttttcttttaaaggttcttactggctcgttgtatatgaatcgagccactggaagttggrttaaagatcagcttatttcacccacactatagaacagacagtaaattgttctggtgtaataaagtcattcattcattcattcattccttcagcaaaacta

SEQ ID NO: 49377 - DNA, 201 bp, Homo sapiens
tcttttcctttgctcttagaaaatatttttaaaattttcagtggacttcttaaaactttgaaatatatttttaggattttatgtttgtttatattacattwtatggtctattcatgtgtacaagacagtacagaattctgcatgtagaaaggtatctggagaatataaaaaattgtctaggctgggcacggtggctcatgc

SEQ ID NO: 49378 - DNA, 201 bp, Homo sapiens; identical to SEQ ID NO: 9195

SEQ ID NO: 49379 - DNA, 201 bp, Homo sapiens
gggcattaaacataattatttttataatttgtgtgatttcaagccttagcttataaattataacatctgggtaaatacttgccctttgtaagctatgtctrtaattactgaggcaaccttttaaccaaaatccttagtatttttaaaatattttctaggtaggaggaaaaaagtgactaaaatggtaacataactcatatt

SEQ ID NO: 49380 - DNA, 201 bp, Homo sapiens
tgtctataattactgaggcaaccttttaaccaaaatccttagtatttttaaaatattttctaggtaggaggaaaaaagtgactaaaatggtaacataactyatatttcaatgtaaaggaatcagtcttaaaaatttttacaatagctaaaccattcaagaatttccaagtttcacatttctcatggagccgatttaaattt

SEQ ID NO: 49381 - DNA, 201 bp, Homo sapiens
tccttctaggctttccttacacttcactgtctcaatgaggcccaacctgaccatcttgtctaaaactgcaacacccattatatccccaccgctatttgttrccccccttaccttgttataattttcctatagtacttagaaccttctgaatagtaaataatgtatttatttattattgtactgtttgtcttcccttgccca

SEQ ID NO: 49382 - DNA, 201 bp, Homo sapiens
ctaaattagaataatagtgcttcctgtttatatcccatttccccctctgtttctttgttcacacttttcccttggctaatataccatttcattctatctamacatctaaatcctacccatctttttaagatccatctcatatgctgtcttatgtcttagcagcagtataatttccctctgaacttccatagcttttaaccc

SEQ ID NO: 49383 - DNA, 201 bp, Homo sapiens
tgttattactgaaggaagctaccctgctacaatgctttccaaagaatgtccttagcattataacagatgtttataggtaagttatagtgaccctctccccrcataagaataacttcacttaagtttgtcaattcaacaatggctaattcttttaactgttaaaaatatgccaggcactcatggtcaggcaagcagtacaaa

SEQ ID NO: 49384 - DNA, 201 bp, Homo sapiens
ccactcactcacattcattcctgacatttcagtagtgattatgggctacatctacaggacttcgatttcaacaggtgcagaacttaattcttcagcttcckcagactggtttccttctaccggtgctcctgtttctatgcaagaattcactgcttatcacatctctgataggtgaccttctagaaacctcctttaagccat

SEQ ID NO: 49385 - DNA, 201 bp, Homo sapiens
ttttaagatccatctcatatgctgtcttatgtcttagcagcagtataatttccctctgaacttccatagcttttaaccctatacattttaagtcattaacmactttccattttgcttctatgtcttattcgtcccagtaatttgtaaactgatactcagctttgattcctacatggtacctctcttagcttccaattgatg

SEQ ID NO: 49386 - DNA, 201 bp, Homo sapiens
gactccagagacatggccaaagtttcattgcctacaagatggcagctctccccagttttcaggtcaagcaccaagaaggaataaggggccgggcgcagtgrctcatacctataatcccagcactttgggaggccaaggcaggtggatcacccagggtcaggagttggagaccaaaatggcgaaaccctgtctcgactaaaa

SEQ ID NO: 49387 - DNA, 201 bp, Homo sapiens
ctccatctaaagatgacgtttcaattttaggagcttctctattccagtctgtccagtacaagttgctgtaagttaaaaatcaagattgtaaaagaatagcyatgtagcctgtggtaggcagcatctaagcagcccccagtgatctccatctcctcatgtattatagccttaagcaatccccttgagtttgggctgcattag

SEQ ID NO: 49388 - DNA, 201 bp, Homo sapiens
actcagtgactgaaaacacaatttattattttagaatgagaaggccaacattagcctcactgggttcatgtcaagttgtcagcaaggcaggttccttttgraggctctcgggggaatctgtttctttccttttttaacttctagaggctgcctgaattccttgactctggccccttcttccttcttcaagtctagcagcat

SEQ ID NO: 49389 - DNA, 201 bp, Homo sapiens
tggctctgatcctcctgagcccacctggataatccaggataatcccctatctcaagatccttaattttatcatatttgcaaatcttgccatgtaaggtaamacatacacaggttccagggatcaggacatggacatcttggggggtacaggtcaatattgtgtctgtcacagtacctgacatagtttcttgcacacaacag

SEQ ID NO: 49390 - DNA, 201 bp, Homo sapiens
tctatggcaagtccttcagggcttatcagacctggaaataaagcaaagtcaggactggagtgtttgcaggatatggagggcaaacctgaagccctccaacrgtcgggtgggcaggggggtcagcaggggaaagcaaagcccaagtgtctccaagtccccaagaaccaggttaatagagaaacaagtacttttgttacatat

SEQ ID NO: 49391 - DNA, 201 bp, Homo sapiens
ggggataaagtataaatcaactacaacaaaatgctataaaattctagtcctgctgcacatttgtcccttttgagttattttaagaggcattcaaacaatarcataatatggaaaacatcttagtacgtttgccaagtacaagcatcagtatattaactgtttggcaaccagactatttaataacatctgcaataactgtta

SEQ ID NO: 49392 - DNA, 201 bp, Homo sapiens
ggaccttactgtaacagtttccatctacaactttatgctgatggctcctcaatggacatctcatccactcactcacattcattcctgacatttcagtagtkattatgggctacatctacaggacttcgatttcaacaggtgcagaacttaattcttcagcttccgcagactggtttccttctaccggtgctcctgtttcta

SEQ ID NO: 49393 - DNA, 201 bp, Homo sapiens
tctcttattagaccatttcattttgaaaggcctgccaacatctaaatgcaagatttgattatcttatctgcatcccctgcattttgtgtttttcggttagytacagtcctcttaattatttactttggaagcctttttatatcttggcttatccctttcccttcatcccacctacactgactttttctcatgtttgttgta

SEQ ID NO: 49394 - DNA, 201 bp, Homo sapiens
ttagttacagtcctcttaattatttactttggaagcctttttatatcttggcttatccctttcccttcatcccacctacactgactttttctcatgtttgwtgtatcttcattcccattggcataatcctaattcaggctcttgtcactttctgccaggagtattataatatctcccattagtgtcaccttctgttcttaa

SEQ ID NO: 49395 - DNA, 201 bp, Homo sapiens
taatgccaatatacattaatactctataggccagaatatattacttatgtttactgtcttagcacagatacttctatggttggaagcttctgaatgttagyacctatagtaaaaacaatttttctttaaacgggtgttttctcttattagaccatttcattttgaaaggcctgccaacatctaaatgcaagatttgattat

SEQ ID NO: 49396 - DNA, 201 bp, Homo sapiens
ttttatgcttttattttttcctcgtttcattaacagatcccataagcactgtatagcctaagatgccattttgaacattaagtttagtgaattattaataagtgtttttatttttgaattccttttaagtattgtttttcaaatgaaaataataaaatctacctttggaattctgaatttcaagtttccatgaaataagtt

SEQ ID NO: 49397 - DNA, 201 bp, Homo sapiens
gaccatttcattttgaaaggcctgccaacatctaaatgcaagatttgattatcttatctgcatcccctgcattttgtgtttttcggttagttacagtcctsttaattatttactttggaagcctttttatatcttggcttatccctttcccttcatcccacctacactgactttttctcatgtttgttgtatcttcattcc

SEQ ID NO: 49398 - DNA, 201 bp, Homo sapiens
agacgtggaatcaacctagatgcccatcagaggctgactggataaagaaaatatggtacatatacccccatggaatactatgcagccataaaaagaacaamtattatgtccaaatttgcagcaatatggatgcagctggaggccgttatcctaagcaaattaacacaggaacagacaaccaaataccacaggttctcactt

SEQ ID NO: 49399 - DNA, 201 bp, Homo sapiens
atttgcttcatccttctctctacacagaggcacacaccatttttttccaaaccatttgatagtaaattatagatgattcctttttactcttaaacactttraagtgcatttcctaaaaacaactttgtcttatataaccacagtacagtgatcaaaatcaggaagttatctttgatatactattatttattcacattttac

SEQ ID NO: 49400 - DNA, 201 bp, Homo sapiens; identical to SEQ ID NO: 9194

SEQ ID NO: 49401 - DNA, 201 bp, Homo sapiens
agacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgcacat

SEQ ID NO: 49402 - DNA, 201 bp, Homo sapiens
tagacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgcaca

SEQ ID NO: 49403 - DNA, 201 bp, Homo sapiens
atgatgattacctggtaatgcttaaggtcagcttcatgttcttgattcttgacagaaactgtgcacatagaaaaatgtctttattttctaaatattaactrttgatattaaaattatggttgaatgactaaaatacacagaagaatatgaaacataaagtagatttcatggttttatctgatttggattctgttttctgcc

SEQ ID NO: 49404 - DNA, 201 bp, Homo sapiens
attgttttatgcttatacaggttaagcatccctaatccgagaatctgaaatcctaaatgctccaaaatccaaaactttttgagcactgacatgaggacacmagtagaaatttccacacataagcacttaacacaaactttatttcatgcacaaaattattaaaaatattatatgaaattaccttcaggctatgtgtataag

SEQ ID NO: 49405 - DNA, 201 bp, Homo sapiens
attagaccatttcattttgaaaggcctgccaacatctaaatgcaagatttgattatcttatctgcatcccctgcattttgtgtttttcggttagttacagycctcttaattatttactttggaagcctttttatatcttggcttatccctttcccttcatcccacctacactgactttttctcatgtttgttgtatcttca

SEQ ID NO: 49406 - DNA, 201 bp, Homo sapiens
tacaacttgttccaaaaattctgatttcatggggtgttcaattgataacattcattagaatataaaacctgtttttctgtgcactgtagagacttttgtgrctattcctggttattaccaacttgttctgttcactgttttcggaagactaatttgaacaaaggcttctagtaaaactgccaagactttaaaagttgttac

SEQ ID NO: 49407 - DNA, 201 bp, Homo sapiens
agcttctgcacctggcctgtacttctttgtagtacattttatatttcttgtaattcacttactctttctaactccagattataagtatttatttacacatstatatttgtcattatacttaaacttcctgaaaatagagactgtagtttactcatttgtatgctcctcagatcctaagtgtttaattaaaatcttaattaa

SEQ ID NO: 49408 - DNA, 201 bp, Homo sapiens
gcatctgggaatttcatttcgtagaaactccacttaaacatggcaagagtttctcaagatataaaaattctccctgattgtaacaagtactgagacagtgracaaatcctgtatgtcacatttgatgaccttagcaattatacagacagggaaaatgtttatcttgatttctgctacagcaacactgaagccagaggtgtc

SEQ ID NO: 49409 - DNA, 201 bp, Homo sapiens
tgaatcgagccactggaagttgggttaaagatcagcttatttcacccacactatagaacagacagtaaattgttctggtgtaataaagtcattcattcatwcattcattccttcagcaaaactatgctttggaaggcagtgtaagtaaaggcttagccaaatctctttgctcttgtttgtaaagtaaaatttagttttatt

SEQ ID NO: 49410 - DNA, 201 bp, Homo sapiens
tgagcgtcaaccctggtttctaaatgtgctgctggaggaatcccacttcacttccagtttaagtgtcagctgaggcctcgcctgatcatttgattcagagyagccctagttctcacaacactatctgaattttctacatatcacatcacagactaatattgtttataccagtcttgtttcctcctaataaaatataagtgc

SEQ ID NO: 49411 - DNA, 201 bp, Homo sapiens
tcagcaaaactatgctttggaaggcagtgtaagtaaaggcttagccaaatctctttgctcttgtttgtaaagtaaaatttagttttatttttaatgctccmaattttaattttggtgtcatctcaaaagataccagcctataacaatttagtggagttcttacagtctagtgtacttataagcatttataactactatttg

SEQ ID NO: 49412 - DNA, 201 bp, Homo sapiens
tctctatcttatccaggacactgtccgtccagtacattgttctgcggatgtggtctatggcaagtccttcagggcttatcagacctggaaataaagcaaaktcaggactggagtgtttgcaggatatggagggcaaacctgaagccctccaacagtcgggtgggcaggggggtcagcaggggaaagcaaagcccaagtgtc

SEQ ID NO: 49413 - DNA, 201 bp, Homo sapiens
tggaaataaagcaaagtcaggactggagtgtttgcaggatatggagggcaaacctgaagccctccaacagtcgggtgggcaggggggtcagcaggggaaarcaaagcccaagtgtctccaagtccccaagaaccaggttaatagagaaacaagtacttttgttacatattccactacctctagcttctagaccagcagacc

SEQ ID NO: 49414 - DNA, 201 bp, Homo sapiens
tgtttccaaagaacagttccagttacatattcatattaataaacatacatatccataaacactaatttcccattttctataaaaagaattttaagctcctyagcatggtagttaatgatgactgatatccaacctgtattcacatcttgacatcccagctaaattagaataatagtgcttcctgtttatatcccatttccc

SEQ ID NO: 49415 - DNA, 201 bp, Homo sapiens
aattatttactttggaagcctttttatatcttggcttatccctttcccttcatcccacctacactgactttttctcatgtttgttgtatcttcattcccaytggcataatcctaattcaggctcttgtcactttctgccaggagtattataatatctcccattagtgtcaccttctgttcttaactgcatggccaaccaag

SEQ ID NO: 49416 - DNA, 201 bp, Homo sapiens
ttcttgcacacaacaggtgcttatcaatttcagtaatgtgtggcgaatgcagtatatgtgagtgtttacatacactgatttggagcatcagccaatttttkgctgatgcctcagacttaaatttcagaagccttatggcaaaaatcttaaggaaagctcaatttgagacttcgtttacttttccatttaatttaaaaaaaa

SEQ ID NO: 49417 - DNA, 201 bp, Homo sapiens
ctgggcacggtggctcatgcctataatccaagcagtttgggaagccaagatgggtggatcacctgaggtcaggggttcgagaccagccgggccaacgtggygaaaccccgtctctactaaaaacacaaaattagccaggtgtggtggcgcatgtgtgtaatctcagctgcccagggggctgagccaggagaatcatttgaa

SEQ ID NO: 49418 - DNA, 201 bp, Homo sapiens
ctttgtcttatataaccacagtacagtgatcaaaatcaggaagttatctttgatatactattatttattcacattttaccaaaccccccacttctctcgamagaaaaaaataacccagagcaatcctggattatgcaccgcattagttgttacatctgtcttagtatcttaaaatctggaacagttcctgtctttatttgt

SEQ ID NO: 49419 - DNA, 201 bp, Homo sapiens
gcagatcatttgagctcaggagttctgacagcagcctgggcaacatgatgaaaccctgtctctacaagaaaatagaaagttatctgggtgtgctggcctgygtctgtagtgtcagctaattgggaggctgaggttctccagcctgggcgacagagtgacaccttgtctcaaaaaaagacattattgagatgcttgaaaacc

SEQ ID NO: 49420 - DNA, 201 bp, Homo sapiens
ttcattaacagatcccataagcactgtatagcctaagatgccattttgaacattaagtttagtgaattattaataagtgtttttatttttgaattcctttkaagtattgtttttcaaatgaaaataataaaatctacctttggaattctgaatttcaagtttccatgaaataagtttgaggtttgtatatgatggtgtatt

SEQ ID NO: 49421 - DNA, 201 bp, Homo sapiens
ttagacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgcac

SEQ ID NO: 49422 - DNA, 201 bp, Homo sapiens
agggaaactcaacctgtaatcattttggctcagttaaatttggtaaatagcagtagtcattttaccttgagttgcagttgtacaaattatatttttgcctstttttatagctgaaaaatacaaggatttagtacctgataattcaaaaactgctgacaatgcaactaaaaatgcagaaccattgatcaatttggatggtga

SEQ ID NO: 49423 - DNA, 201 bp, Homo sapiens
tttagacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgca

SEQ ID NO: 49424 - DNA, 201 bp, Homo sapiens
ctctgtacttctttttattattattatttttgagatggggtcttacatgttgcacaggttggtgtgatcatggctcactgcagcctcaaccttgcaggctsaagtgatcctcccacctcagcctcctgagtagctgggtccacaggcacacacgagcatgccaggctaatttttctttcttcttttttttttttttttagt

SEQ ID NO: 49425 - DNA, 201 bp, Homo sapiens
agacaataccttctacaagttggtcaaaggatttctgaggaatgagatttcccagccctctaaggtccctgcagtagcagcccctaattcctagcatcttsgagaaagactagttctcaagaatttgaaacaaagggaaaggtcaggcctttgcaggcatctcagttagcagctctgcctggtgggggtcactgaggtact

SEQ ID NO: 49426 - DNA, 201 bp, Homo sapiens
gtatttatttattattgtactgtttgtcttcccttgcccaatgataagctccctgaggtcagggttgttgtgtttaagctctcagatgactccaaaatgcytacaagattgcctggcatgtaattgacactctaaacactttactgaacaattcaacagatgaattaatagcctgtcaaacctatgatcaaccattagatt

SEQ ID NO: 49427 - DNA, 201 bp, Homo sapiens
ttgttttcactgttcggcaagtgtttcctctgcagtattagatgtggaaggtgaatgctttatgctgtttgcatgactacataaattcctattcattcctrttcgttttctaccaataaaattgagttctactgccctgccattttgcttttaatgctaaatcatgaaattccagagcttgaccttaaaaagcagcaagtt

SEQ ID NO: 49428 - DNA, 201 bp, Homo sapiens
agacctggaaataaagcaaagtcaggactggagtgtttgcaggatatggagggcaaacctgaagccctccaacagtcgggtgggcaggggggtcagcaggsgaaagcaaagcccaagtgtctccaagtccccaagaaccaggttaatagagaaacaagtacttttgttacatattccactacctctagcttctagaccagc

SEQ ID NO: 49429 - DNA, 201 bp, Homo sapiens
ctacgtagatttacattactagataaggcaagaattgagcagtgactaaagcatttgaatagtaacaggttgtaacattgaaagattgaaagtacgggtastgtgtttttcttggcagtgattttatataatcagcaggaagtacagactgtcctcattttagaatttgtttctgtgaagtttggcatcaccatagtcacc

SEQ ID NO: 49430 - DNA, 201 bp, Homo sapiens
ttcttgtaattcacttactctttctaactccagattataagtatttatttacacatctatatttgtcattatacttaaacttcctgaaaatagagactgtrgtttactcatttgtatgctcctcagatcctaagtgtttaattaaaatcttaattaatgaaatgaaatgaaacgtacatagttggcttacccccaagaatt

SEQ ID NO: 49431 - DNA, 201 bp, Homo sapiens
tttattttatttaagaaacttcttaaataaaacaacttcttttaatcttcataactctatgaggtaagttctattagcaccctcattttgtagctgaagartctgaggcacagaaaatgtgggtgattatcccaagttcacacaaccagtaagtatctggacccaggatttgaacagatcattgttaatctgtactttcaa

SEQ ID NO: 49432 - DNA, 201 bp, Homo sapiens
aggtctctttcaactctcccattcttttttctgtgactttatggtaataatgaaactggtggttttcttttcttccccctcacagtatctcagagatgttmactgtcctttcaagattcaagatcgacaagaagctattgactggcttcttggtttagctgttagacttgaatatggagataatggtacgttttgtgggga

SEQ ID NO: 49433 - DNA, 201 bp, Homo sapiens
tagtcattttaccttgagttgcagttgtacaaattatatttttgcctgtttttatagctgaaaaatacaaggatttagtacctgataattcaaaaactgcwgacaatgcaactaaaaatgcagaaccattgatcaatttggatggtgagtatataaatgcataacattgaacatcaacatttttggttttttaaatgtttt

SEQ ID NO: 49434 - DNA, 201 bp, Homo sapiens
tagaccatttcattttgaaaggcctgccaacatctaaatgcaagatttgattatcttatctgcatcccctgcattttgtgtttttcggttagttacagtcytcttaattatttactttggaagcctttttatatcttggcttatccctttcccttcatcccacctacactgactttttctcatgtttgttgtatcttcatt

SEQ ID NO: 49435 - DNA, 201 bp, Homo sapiens
ggactttgaagtgttgttgcagtaggtaatttctcaaaagactgaaacatgtctaatgccaatatacattaatactctataggccagaatatattacttaygtttactgtcttagcacagatacttctatggttggaagcttctgaatgttagtacctatagtaaaaacaatttttctttaaacgggtgttttctcttatt

SEQ ID NO: 49436 - DNA, 201 bp, Homo sapiens
ctctgtttctttgttcacacttttcccttggctaatataccatttcattctatctacacatctaaatcctacccatctttttaagatccatctcatatgcygtcttatgtcttagcagcagtataatttccctctgaacttccatagcttttaaccctatacattttaagtcattaaccactttccattttgcttctatgt

SEQ ID NO: 49437 - DNA, 201 bp, Homo sapiens
cccttgcccatgcagctaaaagagttaagacaccagaatagctaggtgcttttcagtttcagttgaggaaaggatgctattcttaaccataaatactctcrttttgtctttctttttttaaagggcttacctgttgctttagacaaacatattcttggttttgacacaggaggtaagtgattttgtttaaattcaaactat

SEQ ID NO: 49438 - DNA, 201 bp, Homo sapiens; identical to SEQ ID NO: 9193

SEQ ID NO: 49439 - DNA, 201 bp, Homo sapiens
tagcctgtggtaggcagcatctaagcagcccccagtgatctccatctcctcatgtattatagccttaagcaatccccttgagtttgggctgcattagtagtgtcttgcttcttctagtgcatagagtatagcagaagtgataggctatcactgccgatattcggtctcaaaaaactggtttctgccttaggggctctctct

SEQ ID NO: 49440 - DNA, 201 bp, Homo sapiens
gtagcctgtggtaggcagcatctaagcagcccccagtgatctccatctcctcatgtattatagccttaagcaatccccttgagtttgggctgcattagtagtgtcttgcttcttctagtgcatagagtatagcagaagtgataggctatcactgccgatattcggtctcaaaaaactggtttctgccttaggggctctctc

SEQ ID NO: 49441 - DNA, 201 bp, Homo sapiens
tgtagcctgtggtaggcagcatctaagcagcccccagtgatctccatctcctcatgtattatagccttaagcaatccccttgagtttgggctgcattagtagtgtcttgcttcttctagtgcatagagtatagcagaagtgataggctatcactgccgatattcggtctcaaaaaactggtttctgccttaggggctctct

SEQ ID NO: 49442 - DNA, 201 bp, Homo sapiens
tagcagtagtcattttaccttgagttgcagttgtacaaattatatttttgcctgtttttatagctgaaaaatacaaggatttagtacctgataattcaaaractgctgacaatgcaactaaaaatgcagaaccattgatcaatttggatggtgagtatataaatgcataacattgaacatcaacatttttggttttttaaa

SEQ ID NO: 49443 - DNA, 201 bp, Homo sapiens
gcatttataactactatttgaggcatatggtagttttcaggggtagcttggtggcctgttggcaaaggaaaaaaaagtggagcctctggtactagatgaayatataaagccactcagtacaattctgctctttaattttgctcacttgtgctttcgtacccattggtttcttcagacttacatgtgttagctgttttaaag

SEQ ID NO: 49444 - DNA, 201 bp, Homo sapiens
cacactatagaacagacagtaaattgttctggtgtaataaagtcattcattcattcattcattccttcagcaaaactatgctttggaaggcagtgtaagtwaaggcttagccaaatctctttgctcttgtttgtaaagtaaaatttagttttatttttaatgctccaaattttaattttggtgtcatctcaaaagatacca

SEQ ID NO: 49445 - DNA, 201 bp, Homo sapiens
aatcctagagacagctgctaatatctttttaaaaatatatatcatatgaagaaactgagactcaatgaggataatgtctaagatgacacagaaaatgacaragccaggattttaagcactataaccctgtggtccattgtttttcccacattaccctacttctgtttagtgagtctttttaatgattcatagtctgcattt

SEQ ID NO: 49446 - DNA, 201 bp, Homo sapiens
ataatgtctaagatgacacagaaaatgacaaagccaggattttaagcactataaccctgtggtccattgtttttcccacattaccctacttctgtttagtkagtctttttaatgattcatagtctgcatttgttaagatggtcgaaaatgccaaatgagtaatggtgaatttggtcaaaaatatataaccccaaaatctct

SEQ ID NO: 49447 - DNA, 201 bp, Homo sapiens
tgctaaggcaaatcaaacaaaagaggtacgtttctataaatcctaaataagttgttaatgaacatttcttctggtatggccgtgattttaaactttgcatrtatctgtttaagatatccattctacgttctacaacttagagaaaggatagcttacttcagtgcttcctaaagcaaattgaatgtattcagtggctagggg

SEQ ID NO: 49448 - DNA, 201 bp, Homo sapiens
gtttcctcctaataaaatataagtgccatgaaagaacagaccttgtcttttcctagaacaggtcctgacacctcttagatcctcagtaaatctttgttacmtgaatgcatttgagctttcactctcttgttctgaccttccccacattgtatttaaaacccaagggcttcacatcaggatctacaggtaagagaagaatta

SEQ ID NO: 49449 - DNA, 201 bp, Homo sapiens
tttttttgagatggagcttaactcttattgcccaggctgcagtgcaacggcgcgatctcggctcaccgcaatctccgcctcctgggttcaagcgattctcytgcctcagccttccgagtagctgggattacaggcatgcgccaccacgcccagataattttgtatttttagtagagacagggtttctctgtgttggtcagg

SEQ ID NO: 49450 - DNA, 201 bp, Homo sapiens
aaattctgcttccctggacaaaatcacccccaccgccatcctgagtgctctttgttgggttgggagtcagggtgccatgggagagcctgccggatggtctrtaagatgctgtctgaatcttctaaggtttaacaaagtggatttggacctcacccttgaggccagtgtctgggatttgatctttgccctgaggccatctct

SEQ ID NO: 49451 - DNA, 201 bp, Homo sapiens
agcgtaccagcctgaggccagaggtgtacctccaagggcacagattttgagttgatacagattcttattttaatttcattaccttctatataaactggaayttgtctatataattgtgtatttagtgaatcattcagtcactaaggttagatctttttatattgcaagattggaggctttggaccctgaaggggtgcaggg

SEQ ID NO: 49452 - DNA, 201 bp, Homo sapiens
ctcccaggaagcagtgcaggtcactcatgcagctgtttcagtggacacctggcccggaaggttcaagaaggcctctctcacacctgaaacctcgatttttwttttttttttgagacagagttttgctcttgttgcccaggctggagcacaatggcgcgatgtcggctcactgcaacctccgcctcccgggttcaagtgatt

SEQ ID NO: 49453 - DNA, 201 bp, Homo sapiens
ctgatctcggcttactgcaacctccgccttctgggttcaagtgattctcctgcctcagcctcccaagtagctgggattacaggtgcatgccaccatacatrgctaatttttgtatttttagtagagacgggctttcgccatgttggccaggctggtctcgaactcctgagctcacacgatccacccgcctcggccccccaa

SEQ ID NO: 49454 - DNA, 201 bp, Homo sapiens
tgaataactgcaaacttaaaaaatctgcttctgaaatcagttgccattatttgacattttggaaatgctcaatgtgttctgttctctctgatttctccctrtttccttggtgtacccatgatgcctttcagtgtttggtatacctcttctggatcaatccacgttttaattttgaggagggggttagtgtgttaatgttaa

SEQ ID NO: 49455 - DNA, 201 bp, Homo sapiens
cctgcagcctttctcctcggcttgtagacactgttttctccctgtgtcctcacatggtcatctctctgtgtgtgtctgtgtcctcatctcctctttttatmaggacatgagtcctattggattaaagcccaacctaatggccttatgttaccttaatcacccctgtaaaggccctctctgcaaatgcagttccatcctgag

SEQ ID NO: 49456 - DNA, 201 bp, Homo sapiens
ttgctttttcccgtgagatctccccctgcctccctcttagaaggatacctgtgattacatttagggtcaactggaacaatccaggataatctcccatctcragagcctgaatctaatcgtgctgcacagtcccttttgccatgtaaggggcattcacaggtcccagggattatgacccaggtatctttggagcacttgctc

SEQ ID NO: 49457 - DNA, 201 bp, Homo sapiens; identical to SEQ ID NO: 9227

SEQ ID NO: 49458 - DNA, 201 bp, Homo sapiens
ttggtctcaaactcctggcctcaagtgatcctcacacctcagcctcccaaactgctggaattataggtgtgagccactgtgtctggcctaactgttctttragcttgtaaagaacatcttctgactgcccacctttttgataatcctttaagttcttgtctttaagtcataggcacccatgattgcttcttatctcatgtg

SEQ ID NO: 49459 - DNA, 201 bp, Homo sapiens
cagtatacactgaactcaaatttgtagccttttatccctcactcccttcccacccttttcccccaagtccccaaagtccattgtatcattcttatgccttygtatcctcatagtttaggtcctacttatgagtgagaacatacaatgtttggttttccattcctgagttacttcacttagaacaacggtctccaatcccat

SEQ ID NO: 49460 - DNA, 201 bp, Homo sapiens
tctgcggaatcctggatttatttatgtatcatcaaagactcccttatattcagaagaattttagtaatatgtactttctattgtccttttattagaaattagtaatcttaaaatatgtttggaaaggcttggcaagccaggagtgcccagtgccccaagtattctgtgtaatgaataaagaagagtttgaaaacaaaatat

SEQ ID NO: 49461 - DNA, 201 bp, Homo sapiens
gtaaatttgaggggacacatgcagcccatcacagtaggcgtgggaggcacgtggccgtcacggagcagtggcaattcccaagcccagccaggcatgtattrttcacctctcagccctgggtgcagggtgttccttgatgagcctccactgcagcttcccagaattgtcccttgtccgttgctgccctggctgtgctctgcc

SEQ ID NO: 49462 - DNA, 201 bp, Homo sapiens
  misc_feature (1)...(201): n = A,T,C or G, or insertion/deletion polymorphism (see Tables 1-2)
aacagtagagtgaaattagcatgaatagaaccaacattcttttccacatatgtaataataagggcacccaagcagatgttgtacggtcccagggaagaccncacaccttacatttccaggcttactgcacttgggattaagccaaggcatccaaagaaagaaaattttttttttttttttttttgccaggctggagtgcag

SEQ ID NO: 49463 - DNA, 201 bp, Homo sapiens; identical to SEQ ID NO: 9206

SEQ ID NO: 49464 - DNA, 201 bp, Homo sapiens
cacggctcaatgatgtgggctctgctcatttatatacatttatttttaaatttaatatatattttagtttttttatttccatagttttttggagaacacgyggtatttggttacatggcaagttttttttttttttcctgagatggggtcttgctctgttgcccaggctggggtgcagtggcatgatctcagctcactgca

SEQ ID NO: 49465 - DNA, 201 bp, Homo sapiens
cattcttatgcctttgtatcctcatagtttaggtcctacttatgagtgagaacatacaatgtttggttttccattcctgagttacttcacttagaacaacrgtctccaatcccatccaggttgccaatgccattaattcattcctttttatggctgagtagcattccaccgtatacgcataccacagtttctttatccact

SEQ ID NO: 49466 - DNA, 201 bp, Homo sapiens
ccccagccgattcctgatgtgtcggggatccgcagccgcccctatctaatgcggtcttgaattcttccgctcaggtaaaattgcggagttgctctctccgrgctcagtggatccattgacaaggctggttctggtgaatgctgtctatttcagaggaaactgggatgaacagtttgacaaggagaacaccgaggagagact

SEQ ID NO: 49467 - DNA, 201 bp, Homo sapiens
gcaggacatgccttcctccctttggaattcagacacaactgaccaacattaatgttaaaatagagatcttaatactaatgaaacagcttttttttttttttgtagcagtcagacaccaaattccagcctggtcctagaatagcatcacatgacaaagagcaggccctgaaagaaatcgaagtattttaccccaaaatgtat

SEQ ID NO: 49468 - DNA, 201 bp, Homo sapiens; identical to SEQ ID NO: 9232

SEQ ID NO: 49469 - DNA, 201 bp, Homo sapiens
gcctccctcttagaaggatacctgtgattacatttagggtcaactggaacaatccaggataatctcccatctcgagagcctgaatctaatcgtgctgcacmgtcccttttgccatgtaaggggcattcacaggtcccagggattatgacccaggtatctttggagcacttgctcagccaaccccagctccaaatgtaaagg

SEQ ID NO: 49470 - DNA, 201 bp, Homo sapiens
gacggaccagactggagtgcggtggcgccatctcggctcactgcagcctctgcctcccgggttcaagtgattctcctgcctcagcttccccagcaactgarattacaggcacgcgccattacactcggctaatttttgtatttttagtagagacggggttttgccatgttggccaggctggtctggaactcctgacctcca

SEQ ID NO: 49471 - DNA, 201 bp, Homo sapiens
gtccttgcgtttcttggcttgaggcccttcatcttcaaggccagtggagtggcattttgctttattctttgcattgctttttcccgtgagatctccccctscctccctcttagaaggatacctgtgattacatttagggtcaactggaacaatccaggataatctcccatctcgagagcctgaatctaatcgtgctgcaca

SEQ ID NO: 49472 - DNA, 201 bp, Homo sapiens
gatatttttttctgaagttgaaacttttaaatataattattagctattgtctttcttttttgggggtaaatttgttaatgtcctttgcacgtgtttctackggggtctgtttttcctatttttttagtagcccagttacgccattatttttcagttttaagagtattttactgattctggctgctttttgggtagaccatc

SEQ ID NO: 49473 - DNA, 201 bp, Homo sapiens
aactcccttgggtaagatttggggtggaacatggcttatcttgtttccctccctggtttgcatggtctggtgggcaggtgtgatggcgtgggggatgtatrgaaaatacgggagtgggtacgggccaagctctgtccctgctgcctccgtattacttgcatggcgtgagaaggattgcctgtctttgtcagtattagcatg

SEQ ID NO: 49474 - DNA, 201 bp, Homo sapiens
aatgaaacagcttttttttttttttgtagcagtcagacaccaaattccagcctggtcctagaatagcatcacatgacaaagagcaggccctgaaagaaatygaagtattttaccccaaaatgtatttctttggcatgttttgaaatggtcctgcaaagctgtctcttgtgggggaaatctacattctgtagagaatcccct

SEQ ID NO: 49475 - DNA, 201 bp, Homo sapiens
aaaaacatcagcaaattgaaatatattgtttgtaaaaagcccaagctcattaataagttcagatgaggcaaacaagatgagccttaaaaaggcacaaaagmattcagtaatgtttgcactgtgtctaggattgctatggaaaaagtttagttattatagcttcctgggctaacaaacacagtagttgtaaaaaccaactta

SEQ ID NO: 49476 - DNA, 201 bp, Homo sapiens
atggtcctgcaaagctgtctcttgtgggggaaatctacattctgtagagaatccccttcccttttccaggttttttcctgatccaggagagaattaactaygagtttggcacattttaagtctgataagagacatttacaatctatcctctctgaaaccttctacctggaggctttatctgcataataagaaccttggtct

SEQ ID NO: 49477 - DNA, 201 bp, Homo sapiens; identical to SEQ ID NO: 9205

SEQ ID NO: 49478 - DNA, 201 bp, Homo sapiens
tgtgcttaagtgatactgattttaaatcttgttccaggtctgccatcatggatgttctcgcagaagcaaatggcacctttgccttaaaccttttgaaaacrctgggtaaagacaactcgaagaatgtgtttttctcacccatgagcatgtcctgtgccctggccatggtctacatgggggcaaagggaaacaccgctgcac

SEQ ID NO: 49479 - DNA, 201 bp, Homo sapiens; identical to SEQ ID NO: 9204

SEQ ID NO: 49480 - DNA, 201 bp, Homo sapiens
acacttccttcagttgattccaggtcttcagataaactcttttaaaccaattgcaaatcagaacatctttgaatctacctatgacctggagcctccccgcycgattatagttgtttcaccttttcaaaccgaaccaatgtacatcttgtatctattgattgatgtcttatgtctccctaaaatgtataagaccaagctgta

SEQ ID NO: 49481 - DNA, 201 bp, Homo sapiens
gacttcagtgtgtaaatttgaggggacacatgcagcccatcacagtaggcgtgggaggcacgtggccgtcacggagcagtggcaattcccaagcccagccrggcatgtattgttcacctctcagccctgggtgcagggtgttccttgatgagcctccactgcagcttcccagaattgtcccttgtccgttgctgccctggc

SEQ ID NO: 49482 - DNA, 201 bp, Homo sapiens
ctctcctacaagactccaacgctgccactgacctaacaggaggtggagctcaggcggtgatgttcgctcacctgctgctcacctcctgctgcgtggcccarttcctaacagaccacagacggatctgctggggactcctgcatataaagtaagtgtgtttggagggaaagtaactaatttaaagagattcccaccagccaa

SEQ ID NO: 49483 - DNA, 201 bp, Homo sapiens
cacttccttcagttgattccaggtcttcagataaactcttttaaaccaattgcaaatcagaacatctttgaatctacctatgacctggagcctccccgccygattatagttgtttcaccttttcaaaccgaaccaatgtacatcttgtatctattgattgatgtcttatgtctccctaaaatgtataagaccaagctgtac

SEQ ID NO: 49484 - DNA, 201 bp, Homo sapiens
agacagtttttccactgataaagttgggggtatggtttcaagataaaactgttccacctcagatcatcaggcattcgattctcatacgcagcatgcaaccragatcaccacgtgcacagttcaccgtaggttcactctcctacaagactccaacgctgccactgacctaacaggaggtggagctcaggcggtgatgttcgc

SEQ ID NO: 49485 - DNA, 201 bp, Homo sapiens
tacatacactgaataaaattacatttccaaagcaaccttttgaggtggatatcagctctattattgttgtttttaatctgtagacaaaagtttggatgaawtttttttatccttacaaaagtgttcccagtctaactaattaacctattctcttagtcatttagatacttttacagaatcaagagtaattatgttaccatt

SEQ ID NO: 49486 - DNA, 201 bp, Homo sapiens
ctgctgttatcagcatagatggcgtttgttctcatttcaggaccgtatctgagtaattgcatccattgtgatgtgccaccaaagagaaaagtactttggtyatactcgactatgtaaactaagtattttaagttaaggccaattccaatgcattttattacaattcagcatgaaacagttaacacggaccagtaacagtag

SEQ ID NO: 49487 - DNA, 201 bp, Homo sapiens
tgttttcattctgtttttgatttcagatactttctttcaataaaagtggcggtggtggagacatccaccagggcttccagtctcttctcaccgaagtgaayaagactggcacgcagtacttgcttaggatggccaacaggctctttggggaaaagtcttgtgatttcctctcagtaagtcatacttgctcttattcactaa

SEQ ID NO: 49488 - DNA, 201 bp, Homo sapiens
ccgggccacaggtgaccccggtcggccccgcggcctcggtgacccctcgcccgctccgcgacccggaggacgcgtgctcagtcttggggcgccgggtgttrggagccgggcgggaggcggagagaggccgaggggttcggcgccaaacggtgccatccgggccccctgcgtgtgttcactggactggccgtgctgggcttg

SEQ ID NO: 49489 - DNA, 201 bp, Homo sapiens
tctggcatccacagcatagcacagggccctgctgggcagcagcaccctaggtcttaaagtcttcaactgtctccctctaggtggagaaagaactcacttaygagaagttcgtagaatggacgaggctggacatgatggatgaagaggaggtggaagtgtccctcccgcggtttaaactagaggaaagctacgacatggaga

SEQ ID NO: 49490 - DNA, 201 bp, Homo sapiens
ctgtgtcctgcttgccaaggccccactgccaaaggcagaggcgtctccgcgcctgagaggggttgagagagggtgcgcacaccacagatgtagctggtcgrggccacccgtgactgctgtggtctgccctctggacctggtggttccctgggagcctgagatccaggtgtaggcagggttggtttctcctgcagcctttct

SEQ ID NO: 49491 - DNA, 201 bp, Homo sapiens
gttcaagcgattctctttcctcagcttcccgagtagctgggttacaggtacgcaccaccaggcccagctcatttttgtgtgtttagtagagatggggtttygccatgttggccaggctgatctcgaactcctgacctcaggtgatcctcccgccttggcctcccaaagtgctgggattataggcgtgagctgctgcgccca

SEQ ID NO: 49492 - DNA, 201 bp, Homo sapiens; identical to SEQ ID NO: 9210

SEQ ID NO: 49493 - DNA, 201 bp, Homo sapiens
gtaccagaagattttgttgttttgctttaaggacacgtatccctttatatttgggggacagtggaactctctatccgtgcacttgactgctgaaggagaasgccccagccgattcctgatgtgtcggggatccgcagccgcccctatctaatgcggtcttgaattcttccgctcaggtaaaattgcggagttgctctctcc

SEQ ID NO: 49494 - DNA, 201 bp, Homo sapiens
tctgagaggaagtgctcgcagaagacaggcttgaaacaagtacccatcacgtccccgcctgtgtcctgcttgccaaggccccactgccaaaggcagaggcrtctccgcgcctgagaggggttgagagagggtgcgcacaccacagatgtagctggtcggggccacccgtgactgctgtggtctgccctctggacctggtgg

SEQ ID NO: 49495 - DNA, 201 bp, Homo sapiens
tatctcaacctcccaagtagttgggatcacaggcacgtgccaccatgccctgctaatttttgtattttttagtagagacaggttttcaccatgttggccasgatgatctcaatctcttgacctcgtgatccacccgccttggcctcccaaagtgctgggattacagcatcaattcttgtgctcaagcggtcctcctgcttc

SEQ ID NO: 49496 - DNA, 201 bp, Homo sapiens
gttttcagtcatggttagcagcagggaccaattaagcaggtgggaaagaaaaaggctttccctgaagtcaggtctttgttatgacatcttatgtttgaaaygaattttctgaacattaaacaccaatgagtcaccgagttccatggaataacaattgtgactgtgatcctctacaaacggacaatgagatgcctgccttca

SEQ ID NO: 49497 - DNA, 201 bp, Homo sapiens
tgttccctcttcaccaaatccacgccaacatctattattttttgagtttttgattttttgattaaggccactcttgcgggagtaaggtggtatcacattgyggttttgatttgcatttccctaatcattagtgatgttgagcattttttcttgtttgttggccatttgcatatcctcttttgagaactgtctattcatgcc

SEQ ID NO: 49498 - DNA, 201 bp, Homo sapiens
tgtgactcagaagtccattgattcacccctgctcatctttccttcctcactctgggtccggagagagggtgaggctctccctcgggaggttagccccacgsgtatattgcatgattgaccaattccttattaaatgagaaaaacgggaaagagaaaaaatatagaagagcctgaatgttaccttcaggcaggaggctctgg

SEQ ID NO: 49499 - DNA, 201 bp, Homo sapiens
agaggcgtctccgcgcctgagaggggttgagagagggtgcgcacaccacagatgtagctggtcggggccacccgtgactgctgtggtctgccctctggacytggtggttccctgggagcctgagatccaggtgtaggcagggttggtttctcctgcagcctttctcctcggcttgtagacactgttttctccctgtgtcct

SEQ ID NO: 49500 - DNA, 201 bp, Homo sapiens
ttagctattgtctttcttttttgggggtaaatttgttaatgtcctttgcacgtgtttctacgggggtctgtttttcctatttttttagtagcccagttackccattatttttcagttttaagagtattttactgattctggctgctttttgggtagaccatcaaattgtttgctaactgtgctcattttgtctcctttctg

SEQ ID NO: 49501 - DNA, 201 bp, Homo sapiens
caccttttcaaaccgaaccaatgtacatcttgtatctattgattgatgtcttatgtctccctaaaatgtataagaccaagctgtaccccaaccaccttagrcacgtgttctcaggacctcccgagtctgtgtcacgggcacgaccttaaccttggcaaaataaacttctaaattgattgatacttgtctcagatacttttt

SEQ ID NO: 49502 - DNA, 201 bp, Homo sapiens
tccaccctctgataggacccagtgtttgttgctcccctctttgtgtccacgttctcatcatttagcttccactcataagtgagaacatgcggtatttggtwttctgttccctgcgtgtgtttgctaaggataatggcctccagccccatccatgtttctgcaaaacacatgatctcattcttttttatggttgcatagtat

SEQ ID NO: 49503 - DNA, 201 bp, Homo sapiens
ttgtgggctgcgtcagcgggggctcagcggggcgctgggcgtcttctccgtggccttccacatgcttccttcagcagcgttgcctgggcttccgtaggccwggcggctgggttctgagaggaagtgctcgcagaagacaggcttgaaacaagtacccatcacgtccccgcctgtgtcctgcttgccaaggccccactgcca

SEQ ID NO: 49504 - DNA, 201 bp, Homo sapiens
tgtacatcttgtatctattgattgatgtcttatgtctccctaaaatgtataagaccaagctgtaccccaaccaccttaggcacgtgttctcaggacctccygagtctgtgtcacgggcacgaccttaaccttggcaaaataaacttctaaattgattgatacttgtctcagatactttttggtttacacaccaaaaaggct

SEQ ID NO: 49505 - DNA, 201 bp, Homo sapiens
ctttaaagggatcagcaatctaaatataaaaaataaaactgtgcaaatactagaagaaaacattagtgaactctataatctagagattattcttttttttwaaaaaaaagagattgctccttgtgaatagagaaagtttttctaactacgactcagaaacaataaaggaaaaatcattaaagttgactacattaaaagagt

SEQ ID NO: 49506 - DNA, 201 bp, Homo sapiens
ttttttttttttttttgagacggaccagactggagtgcggtggcgccatctcggctcactgcagcctctgcctcccgggttcaagtgattctcctgcctcwgcttccccagcaactgagattacaggcacgcgccattacactcggctaatttttgtatttttagtagagacggggttttgccatgttggccaggctggtc

SEQ ID NO: 49507 - DNA, 201 bp, Homo sapiens
gatgatcccagggaggcggctccaccattctcagcacgtcgccttcttcctcatggtcacaagatggctgagctggcttcagcagttccggtggcagggasggggaggaacaagggaggggaggggagcctaaaccttccccttagtggttctgcgtttcagaaagggaaagctgctttctatatggtgtaggccagaact

SEQ ID NO: 49508 - DNA, 201 bp, Homo sapiens
tggctgctcccttaaaggatccagcagttggtgaagttcgtttgatattcagagactgattcaacttagtgttttttgcttttttttttttttgttttttkgttttttgagacagaatctcgctctgtcgcccaggctggagtgtggtggcctgatctcggcttactgcaacctccgccttctgggttcaagtgattctcc

SEQ ID NO: 49509 - DNA, 201 bp, Homo sapiens
cattccagagccacgggcaggagggagtctgccccttctgatgtcaggggcggcctgtgtttgtatagacaggaggtctggttggcacccttgtttgccamcagactccaagtactgagcatcaggagcctgggtttgtggagggcgttgcagctcatgccagcacagacagggtacagggaggggctttcaagacccttc

SEQ ID NO: 49510 - DNA, 201 bp, Homo sapiens
aatccaggataatctcccatctcgagagcctgaatctaatcgtgctgcacagtcccttttgccatgtaaggggcattcacaggtcccagggattatgaccyaggtatctttggagcacttgctcagccaaccccagctccaaatgtaaaggcatgcacagtggagagccgcttaattcagcatctcctcacagggcctcca

SEQ ID NO: 49511 - DNA, 201 bp, Homo sapiens
gatataaagatcagcgcctgaaacagattctccgggatattaccggagacggagtgttttattattagcctttcttaggtggacatttccatttgaattamaagtcctttaggctgggcgtggtgcatggctgtaatctcagcaccttgggaggctgaggcaggaagatcacttgaggccaggcgttggagagcagcctgg

SEQ ID NO: 49512 - DNA, 201 bp, Homo sapiens
tgcaggtgtgagccaccacgcccggctagaggcctcagttcttcaagcaactctctccacaggtgatggcaccttctccagggctttccatgtggccttcrgcaggatagcctggacttccttctgtcatggtggccagggtacaagagagtgaacatggcagctgtcaggccttttaaaaagggcctaggcctggaacag

SEQ ID NO: 49513 - DNA, 201 bp, Homo sapiens
ggggctgccacacccactgcacggcagggctagagagatgtgcagcctgaccctacccctgagcctgtctgtgaaggtggagatgggcatgcacccacagyccatgaggcaaggtggtgtcctgagtgtgctgtgagttcaggcgcaggaaggcctggcttgttgcagcaggatgtccccaagcgtggtccaaaattgggg

SEQ ID NO: 49514 - DNA, 201 bp, Homo sapiens
aaaaaatctgcttctgaaatcagttgccattatttgacattttggaaatgctcaatgtgttctgttctctctgatttctccctatttccttggtgtacccrtgatgcctttcagtgtttggtatacctcttctggatcaatccacgttttaattttgaggagggggttagtgtgttaatgttaatatagtttttcctttca

SEQ ID NO: 49515 - DNA, 201 bp, Homo sapiens
gggtcagcaaacttcagcctacagcaaagccagcccaccacctaattttttttaaaggtttactgaaacacagccatgcttattttttttttttttttttwttttttccaagacagagtttctctcttgttgcccaggctggagtgcagtggtgccatctcggaacactgcagcctccgcctcccgggttcaggtgattct

SEQ ID NO: 49516 - DNA, 201 bp, Homo sapiens
cctcaggtgatgcactcgcctcggcctcccaaagtgctgggattgcaggtgtgagccaccacgcccggctagaggcctcagttcttcaagcaactctctcyacaggtgatggcaccttctccagggctttccatgtggccttcggcaggatagcctggacttccttctgtcatggtggccagggtacaagagagtgaacat

SEQ ID NO: 49517 - DNA, 201 bp, Homo sapiens
tatctgggattacaggcatgcaccaccacgccaggctaattttgtatttttagtagagatggggtttctccacgttggtcaggctggtctcaaattcccgrcctcaggtgatgcactcgcctcggcctcccaaagtgctgggattgcaggtgtgagccaccacgcccggctagaggcctcagttcttcaagcaactctctc

SEQ ID NO: 49518 - DNA, 201 bp, Homo sapiens
agaatacaaacatagaagcaaaagccagtgccccttctgtaattccaccccaaggaagagactccaggaaagggtgcctccttcccactttctccacgtgygggcaggcgtgcagggaggagtcctcacaaaacagggcggcgtttcacatagaactctttcattttccacacttaacattagaaacacacaaaataatgt

SEQ ID NO: 49519 - DNA, 201 bp, Homo sapiens
agtatctgggattacaggcatgcaccaccacgccaggctaattttgtatttttagtagagatggggtttctccacgttggtcaggctggtctcaaattccyggcctcaggtgatgcactcgcctcggcctcccaaagtgctgggattgcaggtgtgagccaccacgcccggctagaggcctcagttcttcaagcaactctc

SEQ ID NO: 49520 - DNA, 201 bp, Homo sapiens
ttaaccaaccccctccataaattatatgctatagaaaatgtgaaaatccagaaaaacacaaaaaacataaaaattaccgttagaaacatttggtgtatagwatttccctctattctgtctgtaaattgtgcctacacttaccttttttcctaatttacatggataaatttaaattgtatgtatagttttatatctttttta

SEQ ID NO: 49521 - DNA, 201 bp, Homo sapiens
ttcttccttcactttattgtattttacttttatttttgacataattctaaatcatactcaggaaatactggtgtaccaatttacagtattgttactgatcrtgggttcttagattctcatgcagtggaaattgacatgagacagagaaagtgtcccagacaaggctttataatgggcttatgctggagcaggagggcagcg

SEQ ID NO: 49522 - DNA, 201 bp, Homo sapiens
ggcatttaggttgattccatgtctttgctattgtgaatagtgctgcggtgaacattcgcgtgcgtgtatctttatgggagaatgatttctattcctctctyctctggttgtatactcagtaatgggattgctgggttgaatggtagttctgtttttagctctgaggaatcgccacactgctttccccaatggttgaactgt

SEQ ID NO: 49523 - DNA, 201 bp, Homo sapiens
gctaaggataatggcctccagccccatccatgtttctgcaaaacacatgatctcattcttttttatggttgcatagtattccatggtgtatatgtaccacratttctttatcccatctgccatgcatgggcatttaggttgattccatgtctttgctattgtgaatagtgctgcggtgaacattcgcgtgcgtgtatcttt

SEQ ID NO: 49524 - DNA, 201 bp, Homo sapiens
atctggcgaggcacacaagttcaagttcagtttttggcaagcttgaaaacacagtaactttatgtatgtttctagtaaaataccctctttttttttttgaratggactctcactctgtcacccaggctggaatgcagtggtgcaacctcagctcactgcaacctccacctcccaggttcaagtgatgcttgtgcctcagcc

SEQ ID NO: 49525 - DNA, 201 bp, Homo sapiens
tgggggacagtggaactctctatccgtgcacttgactgctgaaggagaaggccccagccgattcctgatgtgtcggggatccgcagccgcccctatctaaygcggtcttgaattcttccgctcaggtaaaattgcggagttgctctctccgggctcagtggatccattgacaaggctggttctggtgaatgctgtctattt

SEQ ID NO: 49526 - DNA, 201 bp, Homo sapiens
gtctatttcagaggaaactgggatgaacagtttgacaaggagaacaccgaggagagactgtttaaagtcagcaaggcgagtaaggggccgtgacaggagcrgcgcctgtgttcacacgagcgtctccggctcggggcctcccgcgtctgcagccgtggggcctttctgtccctgcccctcctgcttgacatccattgggtg

SEQ ID NO: 49527 - DNA, 201 bp, Homo sapiens
cagtggggcattgatggtaggtctctctaagggcttggtggactttaacatgtgattctgtgattccgacttgcctgaagataccccagctcccccctccsgactatccagctgcattcctgctctggaccctgctggggctgccacacccactgcacggcagggctagagagatgtgcagcctgaccctacccctgagcc

SEQ ID NO: 49528 - DNA, 201 bp, Homo sapiens
caggacctacccactcctttctttctggcggcgtcccgggaagccccgctaccgcgcctcctgctggcctccgtgccacactgcaggagcggaacaactcrgcctgctgaattgaggctgagcagggaggactctctgacaagtgccagacacgtagctggtgcttagtaaatgctgaaccgatgagtgatattcagtcct

SEQ ID NO: 49529 - DNA, 201 bp, Homo sapiens
tctgaaatgaactgtgctattttcccctggcaaaataatttctctctttaaaatttaatgattaacaagatgtacaagggctttgactacagataacagamaccccggttcaccatggtttatctcctaggagctcatctcccctgccaggaggtctggaggcaggtgagacctgggctggtctggcactggggcgatgat

SEQ ID NO: 49530 - DNA, 201 bp, Homo sapiens
tctggcactggggcgatgatcccagggaggcggctccaccattctcagcacgtcgccttcttcctcatggtcacaagatggctgagctggcttcagcagtyccggtggcagggagggggaggaacaagggaggggaggggagcctaaaccttccccttagtggttctgcgtttcagaaagggaaagctgctttctatatgg

SEQ ID NO: 49531 - DNA, 201 bp, Homo sapiens
atttaacacagaagaatgtgctacaccagagactggggaccatacggcgtctttgactgtgcctattgcagggtatttactcaactcacaggagcagctcsgagtcaggaactgagggggattgttggatggggtgtggttcctggcctccagtctttctcattggctggctggggttggtgaccagtgcagttttttctg

SEQ ID NO: 49532 - DNA, 201 bp, Homo sapiens
ttaaaatttaatgattaacaagatgtacaagggctttgactacagataacagacaccccggttcaccatggtttatctcctaggagctcatctcccctgcyaggaggtctggaggcaggtgagacctgggctggtctggcactggggcgatgatcccagggaggcggctccaccattctcagcacgtcgccttcttcctca

SEQ ID NO: 49533 - DNA, 201 bp, Homo sapiens
aggcaggggtcagcaaacttcagcctacagcaaagccagcccaccacctaattttttttaaaggtttactgaaacacagccatgcttattttttttttttwttttttttttttccaagacagagtttctctcttgttgcccaggctggagtgcagtggtgccatctcggaacactgcagcctccgcctcccgggttcaggt

SEQ ID NO: 49534 - DNA, 201 bp, Homo sapiens
gggcaccccagtttctggaggttgaggtaatgaagatggcagagcaggcgctgccgggtgttctggaagctggggagaaaccgagctgcgtttctccctgyagagagtggccagctccgacacatttgtcccatgtgtcagtggggtcttgtttcaacttgatgtttatctgttttctttgtagaatgaggagaaacctgt

SEQ ID NO: 49535 - DNA, 201 bp, Homo sapiens
aaacactctttagttcactgcatattgacgagcacaaccttggtaaggttgtgtttggaaattatgtatgggaagggaattatgtatgggaagggaattawgtatgggaagggaattatgtatgggaagggaattatgtatgggaagggaattatgtatgggaagggaattaagtatgggaagggaattatgtatgggaag

SEQ ID NO: 49536 - DNA, 201 bp, Homo sapiens
tctgctgtggctgctgtccctactttgcggtcagccgtttaacactggagcgctgctgaccatagccacgctgccactggtgtctggcatccacagcatakcacagggccctgctgggcagcagcaccctaggtcttaaagtcttcaactgtctccctctaggtggagaaagaactcacttacgagaagttcgtagaatgg

SEQ ID NO: 49537 - DNA, 201 bp, Homo sapiens; identical to SEQ ID NO: 9214

SEQ ID NO: 49538 - DNA, 201 bp, Homo sapiens; identical to SEQ ID NO: 9215

SEQ ID NO: 49539 - DNA, 201 bp, Homo sapiens
tggggtgcagtggcatgatctcagctcactgcaaccaacctccgcctgctagattcaagcaattctcctgcctcagcctcctcagtagctggcactacagrtgtgtgccaccatgcctaatttttttatatttttagtagagacgggggtttcaccatgctggccaggctggtctcgaactcctgacctcatgatctgcct

SEQ ID NO: 49540 - DNA, 201 bp, Homo sapiens
aaatgctcaatgtgttctgttctctctgatttctccctatttccttggtgtacccatgatgcctttcagtgtttggtatacctcttctggatcaatccacrttttaattttgaggagggggttagtgtgttaatgttaatatagtttttcctttcacaagtaacataaaaaattcgcagtgtggatctcaagctgcctccc

SEQ ID NO: 49541 - DNA, 201 bp, Homo sapiens
gttttaggttttggtcatggcagaattccacttctggatggctgcatgtgtcagctgttgccacaaaacaaaccatcccaaacttagtggctggaaataayaatgattgattatttctcagattccgtggcctgagcaggcaggactgctcccaggaagcagtgcaggtcactcatgcagctgtttcagtggacacctggc

SEQ ID NO: 49542 - DNA, 201 bp, Homo sapiens; identical to SEQ ID NO: 9266

SEQ ID NO: 49543 - DNA, 201 bp, Homo sapiens
tgatgtcttcaaggcaaagaggaaactttaactacaaattggcatttaagttattttcttcctttttttttttttttttttttgtcctaaagattggcttsggaaaactgaggtacagaaaattaataattaatgttcacatgctgtcaggaatactcagatgcgagggggcatctgagtccattttttgggcacttttgc

SEQ ID NO: 49544 - DNA, 201 bp, Homo sapiens
gggattacagatgtgagccactgcgcctagcctgaaaataatgtttaactcccatttatatgttaggctgctcagatatattaaacacatacacacacaamacacacacacacacacacatacacactgcacaaggaaacagagggacaaagcaggaagtccaagtttccattaaaccagtctttaaatggttaaatttag

SEQ ID NO: 49545 - DNA, 201 bp, Homo sapiens
caccaccgatagccacaccgaagagttctcccatttgctggttcccggacaaaaaagctgctgatcccttgagcacactgcagtgaagctcccagctgacrtgtcctgtccatgtaaacagaacttcctccatgtaaacagaacttccagcattgtttgtgttttcctcttaactatgtactgacatccaagggttgttag

SEQ ID NO: 49546 - DNA, 201 bp, Homo sapiens
actttctttcaataaaagtggcggtggtggagacatccaccagggcttccagtctcttctcaccgaagtgaacaagactggcacgcagtacttgcttaggrtggccaacaggctctttggggaaaagtcttgtgatttcctctcagtaagtcatacttgctcttattcactaaagaaataaaggtggccaggtagtggggg

SEQ ID NO: 49547 - DNA, 201 bp, Homo sapiens
gctgggattacagatgtgagccactgcgcctagcctgaaaataatgtttaactcccatttatatgttaggctgctcagatatattaaacacatacacacamaacacacacacacacacacacatacacactgcacaaggaaacagagggacaaagcaggaagtccaagtttccattaaaccagtctttaaatggttaaatt

SEQ ID NO: 49548 - DNA, 201 bp, Homo sapiens
cccaaagtgctgggattacagatgtgagccactgcgcctagcctgaaaataatgtttaactcccatttatatgttaggctgctcagatatattaaacacayacacacacaacacacacacacacacacacatacacactgcacaaggaaacagagggacaaagcaggaagtccaagtttccattaaaccagtctttaaatg

SEQ ID NO: 49549 - DNA, 201 bp, Homo sapiens
ccaagcccagccaggcatgtattgttcacctctcagccctgggtgcagggtgttccttgatgagcctccactgcagcttcccagaattgtcccttgtccgytgctgccctggctgtgctctgccctctgtgtcctggtgtcgctcttggcagctcctttcctgttctgtaagaaatggcccgtgcttgctgcgctcccagc

SEQ ID NO: 49550 - DNA, 201 bp, Homo sapiens
tgatgggcatttgggttggtttcatgtttttgcaattacgaattgtgctgctattaacatgcgtgtgcaagtatcttttttgtataatgacttattttccyctgcgtagatacccagtagtgggattgctggatcaaatggtagttctatttttagttatttaaggaatcgccatactattttccacagtggttgtactat

SEQ ID NO: 49551 - DNA, 201 bp, Homo sapiens
tgtgctgggattaacaccagtgactgctgttatcagcatagatggcgtttgttctcatttcaggaccgtatctgagtaattgcatccattgtgatgtgccmccaaagagaaaagtactttggttatactcgactatgtaaactaagtattttaagttaaggccaattccaatgcattttattacaattcagcatgaaacag

SEQ ID NO: 49552 - DNA, 201 bp, Homo sapiens
cactttgagccgtctctctcttttagtccaagctgttacaagtgcctgaaaaccactgtggaatttctatcaacttaaaattctgcttccctggacaaaakcacccccaccgccatcctgagtgctctttgttgggttgggagtcagggtgccatgggagagcctgccggatggtctgtaagatgctgtctgaatcttcta

SEQ ID NO: 49553 - DNA, 201 bp, Homo sapiens
agtctactttttttttttttttttttttttttttttttgagacggaccagactggagtgcggtggcgccatctcggctcactgcagcctctgcctcccggrttcaagtgattctcctgcctcagcttccccagcaactgagattacaggcacgcgccattacactcggctaatttttgtatttttagtagagacggggttt

SEQ ID NO: 49554 - DNA, 201 bp, Homo sapiens
gctccgacacatttgtcccatgtgtcagtggggtcttgtttcaacttgatgtttatctgttttctttgtagaatgaggagaaacctgtgcaaatgatgttkaagcaatctacttttaagaagacctatataggagaaatatttacccaaatcttggtgcttccatatgttggcaaggaactgaatatgatcatcatgcttc

SEQ ID NO: 49555 - DNA, 201 bp, Homo sapiens
ctggcgaggcacacaagttcaagttcagtttttggcaagcttgaaaacacagtaactttatgtatgtttctagtaaaataccctctttttttttttgagawggactctcactctgtcacccaggctggaatgcagtggtgcaacctcagctcactgcaacctccacctcccaggttcaagtgatgcttgtgcctcagcctc

SEQ ID NO: 49556 - DNA, 201 bp, Homo sapiens
ggaggggcgtgtggtttgctcctggcatccacttggtgaatctcctccagagattctgtgaaacatgtgtgatggcaggacagcccccacaaccacaagtyatcgggttcatgcggtcaacagtgtcgcagttgagaaactctgccttagggtaagcacagagggagtaaaacagcttgagttctcaaaattgaactcatg

SEQ ID NO: 49557 - DNA, 201 bp, Homo sapiens
ccagcctgggtgacagagagggactccagctcaaaaaaaaaaaaaaaagtttgtatgggagaaaaagcaacaaggagagccaggaaaatctgaagcagaaragcagtaaggagaatgcgctgtacgagatattgaatcataagagaaaacctctataactgaaagaatctgaccaacagaaccaaatagaaagtttagaaa

SEQ ID NO: 49558 - DNA, 201 bp, Homo sapiens
ttattttacatggagtactgaagtcctttcaaaccaaaactgaactagcccccatccggagaagtctgagaaaagaaaatgtcacgctattgctaagtaaracccatgtgttttcagtcatggttagcagcagggaccaattaagcaggtgggaaagaaaaaggctttccctgaagtcaggtctttgttatgacatcttat

SEQ ID NO: 49559 - DNA, 201 bp, Homo sapiens
gattacaggcgtgagccaccgcgcctggcctatatttacgtaacttttattacagtatgttattgtaaaccaaaaataaaatactttttttttttttttttgagatggagcttaactcttattgcccaggctgcagtgcaacggcgcgatctcggctcaccgcaatctccgcctcctgggttcaagcgattctcctgcctc

SEQ ID NO: 49560 - DNA, 201 bp, Homo sapiens
aaatgttgcctggcctttttagcatcccagctcattaattcgtttatgcatttatcatttattcagcagagattgactgagtgccttttttttttttttttgagatggagtctcggtctgtctcccaggctggagtgcagcggtgcaatcttgggtcactgcaacctctgcctcccgggttcaagtgattctcctacctca

SEQ ID NO: 49561 - DNA, 201 bp, Homo sapiens
ggctgctcccttaaaggatccagcagttggtgaagttcgtttgatattcagagactgattcaacttagtgttttttgcttttttttttttttgtttttttgttttttgagacagaatctcgctctgtcgcccaggctggagtgtggtggcctgatctcggcttactgcaacctccgccttctgggttcaagtgattctcct

SEQ ID NO: 49562 - DNA, 201 bp, Homo sapiens
ttgatgcatggctgctcccttaaaggatccagcagttggtgaagttcgtttgatattcagagactgattcaacttagtgttttttgctttttttttttttkgtttttttgttttttgagacagaatctcgctctgtcgcccaggctggagtgtggtggcctgatctcggcttactgcaacctccgccttctgggttcaagt

SEQ ID NO: 49563 - DNA, 201 bp, Homo sapiens
cttgatgcatggctgctcccttaaaggatccagcagttggtgaagttcgtttgatattcagagactgattcaacttagtgttttttgcttttttttttttttgtttttttgttttttgagacagaatctcgctctgtcgcccaggctggagtgtggtggcctgatctcggcttactgcaacctccgccttctgggttcaag

SEQ ID NO: 49564 - DNA, 201 bp, Homo sapiens
agtatcttttttgtataatgacttattttcctctgcgtagatacccagtagtgggattgctggatcaaatggtagttctatttttagttatttaaggaatygccatactattttccacagtggttgtactatccatcagcagtgtagaggtgttccctcttcaccaaatccacgccaacatctattattttttgagttttt

SEQ ID NO: 49565 - DNA, 201 bp, Homo sapiens
ttaaggctcttgctacccagaaatgggattctctctctcattataaaaacatttggccatcttttcttgtgtaactgtcagtgaatgtatcattttgaatrtttttcaaattaaaacagtacatttaagcccgcaaaacacaccaaagaatacaaacatagaagcaaaagccagtgccccttctgtaattccaccccaagg

SEQ ID NO: 49566 - DNA, 201 bp, Homo sapiens
tagtttaggtcctacttatgagtgagaacatacaatgtttggttttccattcctgagttacttcacttagaacaacggtctccaatcccatccaggttgcsaatgccattaattcattcctttttatggctgagtagcattccaccgtatacgcataccacagtttctttatccactctttgattgatgggcatttgggtt

SEQ ID NO: 49567 - DNA, 201 bp, Homo sapiens
acgtgtgctgacggtagaatagtctaggatggggttgggggagcatgtgggaccttcccctggccagctgacatggtacttaacctctgtcttttttttttggtttatggaggagccatctcacctggcagcctctccacgtgggctgagccctcttggggacaaagacagaagtccatgtccccaggccagggaaaaccc

SEQ ID NO: 49568 - DNA, 201 bp, Homo sapiens
tgtatcattcttatgcctttgtatcctcatagtttaggtcctacttatgagtgagaacatacaatgtttggttttccattcctgagttacttcacttagarcaacggtctccaatcccatccaggttgccaatgccattaattcattcctttttatggctgagtagcattccaccgtatacgcataccacagtttctttat

SEQ ID NO: 49569 - DNA, 201 bp, Homo sapiens
tcagccgtttaacactggagcgctgctgaccatagccacgctgccactggtgtctggcatccacagcatagcacagggccctgctgggcagcagcaccctrggtcttaaagtcttcaactgtctccctctaggtggagaaagaactcacttacgagaagttcgtagaatggacgaggctggacatgatggatgaagaggag

SEQ ID NO: 49570 - DNA, 201 bp, Homo sapiens
ccctttatagtaacggagtttacggcgacttcacgagtcagcaccaggtgcctttctgtttcactgaagtattgcagacagaaaagacagctaaggtttcyggggccatttgtgttacttgctggaaatgtgatccctgcacccagccatccaggagcagaaggacaggtcaggctcagatggagccacacaatgttccag

SEQ ID NO: 49571 - DNA, 201 bp, Homo sapiens
atcacagtaggcgtgggaggcacgtggccgtcacggagcagtggcaattcccaagcccagccaggcatgtattgttcacctctcagccctgggtgcagggygttccttgatgagcctccactgcagcttcccagaattgtcccttgtccgttgctgccctggctgtgctctgccctctgtgtcctggtgtcgctcttggca

SEQ ID NO: 49572 - DNA, 201 bp, Homo sapiens
actacaggcatgcaccaccatgcccagataatttttgcatttttagtagagacaaggtttcccaatgttggccaggctggtctcaaattcctgacctcagstgatccggcctgcctcggcctcccaaagtgctgggattacaggtgtgagccactgcgtccggcctcagctaatcttttgtatttttagtagagacggttt

SEQ ID NO: 49573 - DNA, 201 bp, Homo sapiens
tcctgaagctgcggtggatagtctcggggaaggagaatggaatcactggctcaggcccgcctagattgcgcacgcactgggccttggttctattcactccygcactgaaaccgtttgcatctgggtgaacagggcacacatccagttcccacatggatactgcatgtggctctcagggcacaaatcattccaatcttaaca

SEQ ID NO: 49574 - DNA, 201 bp, Homo sapiens
agagggagagagagagatcatatttacataactttttttgagacggagtttcgctcttgtcccccaggctgcagtgcagcgtgatcttggctcactgcaayttccacctccctggttcaagagattctcctgcctcagcctcctgagtagttaggattacaggggtgcaccaccacgcccggctaatttttgtatttttag

SEQ ID NO: 49575 - DNA, 201 bp, Homo sapiens
atcaacttaaaattctgcttccctggacaaaatcacccccaccgccatcctgagtgctctttgttgggttgggagtcagggtgccatgggagagcctgccrgatggtctgtaagatgctgtctgaatcttctaaggtttaacaaagtggatttggacctcacccttgaggccagtgtctgggatttgatctttgccctgag

SEQ ID NO: 49576 - DNA, 201 bp, Homo sapiens
aaagataaaggatcatcatatatacagaagagcaacagcactctgggaagtgggggaaatatcagaccccttggttttttgtttttgttttgttttgttcrtagagatggggtctcactgttacccaggctggtctcagattactgagctcaagcaatcctccctccttggcctctcaaagtgctgggattacacgtgtga

SEQ ID NO: 49577 - DNA, 201 bp, Homo sapiens
ccctggctaacatggtgagacctcgtctctactaaaaatacaaaaattagccaggtgtggtggcgggcacctcagctactcgggaggctgaggcaggaggmtcacttgaacccaggaggcggaagttgcagtgagctgagatcatgccactgcactccagcctgggcaaaagagtgagactccgtctcaaaaacaacaaca

SEQ ID NO: 49578 - DNA, 201 bp, Homo sapiens
caattgtccagcccccaggcaacaggggaagggccttggccaacatctgggtgccagcagggcaggggtggggctctgaggggataagggcttttaaaagsctccccagggaggttccccagttcctccacctgctggcccctggacacctctgtcaccatgtggttcctggttctgtgcctcgccctgtccctggggggg

SEQ ID NO: 49579 - DNA, 201 bp, Homo sapiens
aaaaaaaaagatttagttctgggcttcctggtagccatggcaaaaaggcaaatactgtcctttccttagccaggtccctgatatacagcagaggctggaaytctgagctgctttgattttaccaaaaagccaagacaacctgttggaagcctatgggtttaccattgaggctgcaggaatctagttcctaattatcttcag

SEQ ID NO: 49580 - DNA, 201 bp, Homo sapiens
cgcgttgcccccacccgggggaggcctgtgtggtgtctggctggggcctggtgtcccacaacgagcctgggaccgctgggagcccccggtcacaaggtgcrtgaaaggatggagctggatgcgaggcctcaaggaatcctatgctccagggctcttgggcggaggggacaagggccggaatttatggatctgctccaagtc

SEQ ID NO: 49581 - DNA, 201 bp, Homo sapiens
gtgacagagcaagactccatctcagaaaaaaaaaaaaaaaaaaaaagatttagttctgggcttcctggtagccatggcaaaaaggcaaatactgtcctttycttagccaggtccctgatatacagcagaggctggaactctgagctgctttgattttaccaaaaagccaagacaacctgttggaagcctatgggtttacca

SEQ ID NO: 49582 - DNA, 201 bp, Homo sapiens
cgcagccaccgcaacgacatcatgttgctgcgcctagtccagcccgcacgcctgaacccccaggtgcgccccgcggtgctacccacgcgttgcccccaccygggggaggcctgtgtggtgtctggctggggcctggtgtcccacaacgagcctgggaccgctgggagcccccggtcacaaggtgcgtgaaaggatggagct

SEQ ID NO: 49583 - DNA, 201 bp, Homo sapiens
ccaactcacataaccctggatgagggattctcctggcatatgctggcctctgggccacagaggtaatcatgtgattctggctgagccaatcacagtacccyagctgcagaccctgcaattggcccaaagatggacacatgaccaaagcccaaccaatcaagctctgccccaagactttttattaggaagctgtcaaggaaa

SEQ ID NO: 49584 - DNA, 201 bp, Homo sapiens
ccagaccctgtatgcaagtgtctgtgacactggatgccaagactcacactagagatgttgaatttaggtctgaacaatatccaattctgtgtgtgtgtttktgtgtgcatgtgtgtgtgtgttgtattcatgtcttaaccatccatattcatatacacatatgaacatctgtgctgtgattcttttttttttttttttttt

SEQ ID NO: 49585 - DNA, 201 bp, Homo sapiens
tgcacacacacacatacacattcctacctcatccttacaacaatcttcattttacagatgaggaaacagaggcacagacaggtcgaataacttactcaaartttcacagctagtacattcgaacccaggcttaaggacccatctttgtccagaccctgtatgcaagtgtctgtgacactggatgccaagactcacactaga

SEQ ID NO: 49586 - DNA, 201 bp, Homo sapiens
gtccagaccctgtatgcaagtgtctgtgacactggatgccaagactcacactagagatgttgaatttaggtctgaacaatatccaattctgtgtgtgtgtktgtgtgtgcatgtgtgtgtgtgttgtattcatgtcttaaccatccatattcatatacacatatgaacatctgtgctgtgattcttttttttttttttttt

SEQ ID NO: 49587 - DNA, 201 bp, Homo sapiens
ctgaggcaggtggatcacctgaggttaagagttcgagacccgcctgaccaacatggtgaaaccccatctgtgctaaaattacaaaaaaattagccaggcayggtggtgccaattacctacaattcccgggtcagtatccaagaccctccaccagccaggaacagtcacggggtcagtatccaacagcctccaccagccagc

SEQ ID NO: 49588 - DNA, 201 bp, Homo sapiens
gcagggagcacagaattcaatgttccctgcataccaactccaaaatcacaatcaaaacctaaaaataagtaatgagaatttaaaaaaacagaactgaatgytcatcaaaaatctggagggagaacctcccgaagccaagaagcaattaataaagtcacagagacaaaggtgaagaaattaaactacctaaaaattctaagg

SEQ ID NO: 49589 - DNA, 201 bp, Homo sapiens
gagttgagttgggttggggttccctgggatggggatggattgggtttggggtgagattgcaaatggtgattaggatgaggatgaatccaggaggtttcacycaacctgagaccccctcttttccccacagggtgactctgggggacccctggtctgtgggggcatcctgcagggcattgtgtcctggggtgacgtcccttg

SEQ ID NO: 49590 - DNA, 201 bp, Homo sapiens
gtatttttagtagagacatggtttcaccatgttggccaggctggtctcaaactcctgacctcaggtgatcggcttcccaaagtgctgggattacaagcgtsagccactgagcccagcctcgatcatttctagaaccacccccacagacacccctggtcaccctacttgaactcctaaaaggtgtctcataacaactcatgt

SEQ ID NO: 49591 - DNA, 201 bp, Homo sapiens
tggcccacagtctatcctagtccggggtgccccggctcttatctatcttgcgcggccccaccctaaacttccacccccgctcctccatgttgtcatagtgytcactcccacaccagattcctgctcctcccaggaagcctcagtactttctcctcttccctagccaacgccctgtcccaccgctttaccaaaggggcagat

SEQ ID NO: 49592 - DNA, 201 bp, Homo sapiens
ccccacctggcttcaaccccaggaatgcgtccagcgtgatccagggcctgcagaacaggtgctggttctccctccccgtctacagctctggggatcggagsggggggggcaattgtccagcccccaggcaacaggggaagggccttggccaacatctgggtgccagcagggcaggggtggggctctgaggggataagggct

SEQ ID NO: 49593 - DNA, 201 bp, Homo sapiens
tctgagcaatccaaccatgaacctatgcgttccagagggctgcagtttctggactgtagtaataccacctcctccctttgtccttctggccaagtagcagyatcctgtagttcctaactcctggtttgcctcactatttcctattggcttctcagctcctctgttactcacgaacaaattccctgtatttacttccttctg

SEQ ID NO: 49594 - DNA, 201 bp, Homo sapiens
ccacgctgaaggggttggccgggcatctggccatggctaccggtcggtgtcctgaagacctcgggtgctattccttggaggtgcttgggtctcatcctcgwgggtgtatgaaatgggaaggcccggggtgcgctcggagtcagcgtctgagttccgctgtttggatgtccgcctcgctgcgccctgctgcacggcccaccc

SEQ ID NO: 49595 - DNA, 201 bp, Homo sapiens
tgtcctccagaccctgacatctggtctccccagtccttccagggtcccccaaatttcaccagaaaaccctgcttcccaaactggcatgtgggatcccccayctggtatgggggggggtctgcaaatgtcccttcccacccagcacccccagctctcccaggaaaaacaccacaccctcccaccacatgctcctttccttgg

SEQ ID NO: 49596 - DNA, 201 bp, Homo sapiens
cttcccaaactggcatgtgggatcccccatctggtatgggggggggtctgcaaatgtcccttcccacccagcacccccagctctcccaggaaaaacaccamaccctcccaccacatgctcctttccttggggaagttccatcccgccccaggccccagcccttctctgcctgaattgttcctacacagctctggttttctg

SEQ ID NO: 49597 - DNA, 201 bp, Homo sapiens
ccacatgctcctttccttggggaagttccatcccgccccaggccccagcccttctctgcctgaattgttcctacacagctctggttttctggaaccccacsccaaggatcctgaatgccttctcagccagcgcttctgccctggcctcccccaagtcagtatgtgattctacaacctcacatcaagtgggtcctgcattgc

SEQ ID NO: 49598 - DNA, 201 bp, Homo sapiens
cgaggcctcaaggaatcctatgctccagggctcttgggcggaggggacaagggccggaatttatggatctgctccaagtccactgtcttccccagtgagtytcccagatacgttgcattgtgccaacatcagcattatctcggacacatcttgtgacaagagctacccagggcgcctgacaaacaccatggtgtgtgcagg

SEQ ID NO: 49599 - DNA, 201 bp, Homo sapiens
ttttctaccggactcggcagttattaccaactctgccaagttgctaacaactctgccagttttttgtctgtctgctctcagatccatttcccgccctgtcytgttctgcactgcaaggaccacatttcccagcctcctttgctcaccatcttatcactgtgtttgactaatgggaggcactggcagaagactggttctggg

SEQ ID NO: 49600 - DNA, 201 bp, Homo sapiens
ctggttttctggaaccccacgccaaggatcctgaatgccttctcagccagcgcttctgccctggcctcccccaagtcagtatgtgattctacaacctcacrtcaagtgggtcctgcattgcattcccacagctgcttggcgcctgttctcaccacttctccaatcctcttcctaggattgcctccaagaggaccccatatc

SEQ ID NO: 49601 - DNA, 201 bp, Homo sapiens
gataacttttttctaccggactcggcagttattaccaactctgccaagttgctaacaactctgccagttttttgtctgtctgctctcagatccatttcccrccctgtcctgttctgcactgcaaggaccacatttcccagcctcctttgctcaccatcttatcactgtgtttgactaatgggaggcactggcagaagactg

SEQ ID NO: 49602 - DNA, 201 bp, Homo sapiens
ccccccgataagaccttcccctccaacaccccaccctcatccctctggcccacagtctatcctagtccggggtgccccggctcttatctatcttgcgcggscccaccctaaacttccacccccgctcctccatgttgtcatagtgctcactcccacaccagattcctgctcctcccaggaagcctcagtactttctcctct

SEQ ID NO: 49603 - DNA, 201 bp, Homo sapiens
ctgagccccgtcccagtcctgaccgcaactgtgttctcagggccccaacctcccctcagattgccattcctggttcacaggaaggaccccaaaacctctcrgaagcccacctctagccttaaccatagccctttcttttaccctttaaccaggaagccctgaaatctaactgtcccagccaagctggccccttccaacccc

SEQ ID NO: 49604 - DNA, 201 bp, Homo sapiens
ccagatgtggtgcacctggacccactcggctgaggctggggccaccccagctgtgtcaatctcatgcctggaagtctgaggtcaccagcaggtggggaaargaaggggctgtgacaggtgcagacaaacaggcagggaaaggctcagatcccaaagggcgagtcagggacgccagaacagttcactcacactaggatggac

SEQ ID NO: 49605 - DNA, 201 bp, Homo sapiens
tttccctagcctaggagccccttagccctccagattcttcctcagtgagcctctgatcctgtcccacccttggcgccttgatccctggtttccagaatccytttccactcccctaacccaccacctcccatcccccagccccagaccccaaatgacctgacgcccagatgcagtgtctgctccagacactgtctcctgtct

SEQ ID NO: 49606 - DNA, 201 bp, Homo sapiens; identical to SEQ ID NO: 9323

SEQ ID NO: 49607 - DNA, 201 bp, Homo sapiens; identical to SEQ ID NO: 9313

SEQ ID NO: 49608 - DNA, 201 bp, Homo sapiens; identical to SEQ ID NO: 9314

SEQ ID NO: 49609 - DNA, 201 bp, Homo sapiens
acatgagcctcctggagaaccacacccgccaagcagacgaggactacagccacgacctcatgctgctccgcctgacagagcctgctgataccatcacagaygctgtgaaggtcgtggagttgcccaccgaggaacccgaagtggggagcacctgtttggcttccggctggggcagcatcgaaccagagaattgtatgtggg

SEQ ID NO: 49610 - DNA, 201 bp, Homo sapiens
ggtgaggtcgggctgcagccctttttctcccgggttcgtagtctcatttccagatgatctccagtgtgtggacctcaaaatcctgcctaatgatgagtgcraaaaagcccacgtccagaaggtgacagacttcatgctgtgtgtcggacacctggaaggtggcaaagacacctgtgtggtgaggcagccctgcccccaggg

SEQ ID NO: 49611 - DNA, 201 bp, Homo sapiens
tgtgcatccaatgtgtgtcacgttctgccatcacctatctttccagatgtggtgcacctggacccactcggctgaggctggggccaccccagctgtgtcartctcatgcctggaagtctgaggtcaccagcaggtggggaaaggaaggggctgtgacaggtgcagacaaacaggcagggaaaggctcagatcccaaagggc

SEQ ID NO: 49612 - DNA, 201 bp, Homo sapiens
ccaccgaggaacccgaagtggggagcacctgtttggcttccggctggggcagcatcgaaccagagaattgtatgtgggggcagactgtgtagcccaaggcrgggatggggactcctgcgtccaagggagaaagggccagggaagcaggtgaggtcgggctgcagccctttttctcccgggttcgtagtctcatttccagat

SEQ ID NO: 49613 - DNA, 201 bp, Homo sapiens
ttttttctaccggactcggcagttattaccaactctgccaagttgctaacaactctgccagttttttgtctgtctgctctcagatccatttcccgccctgycctgttctgcactgcaaggaccacatttcccagcctcctttgctcaccatcttatcactgtgtttgactaatgggaggcactggcagaagactggttctg

SEQ ID NO: 49614 - DNA, 201 bp, Homo sapiens
atgactggtttcaagtgaccacctgtctgaacctgtatccagtgcccctgtctccacccccaaccacagaggacttcttgccctctggtctgttccccttsctctctctcccagagtcttatagcaaatggggtgggggctagagttctggagaaaacaggcagcggttgtaaataaacaacagggcaggcggagcatggt

SEQ ID NO: 49615 - DNA, 201 bp, Homo sapiens; identical to SEQ ID NO: 9317

SEQ ID NO: 49616 - DNA, 201 bp, Homo sapiens
cgatgtgcccgcaggggcagcgtcctgcagatggtcctgcccctcctccccctaacctgtctgcaggcactgtccacctggaccctgccccatgtgcaggmgctggaccctgaggtcccttcccccttggccaggactggagaccctgtcccctctgtgggaatccctgcccaccttcctctgggagtgggcactggaggc

SEQ ID NO: 49617 - DNA, 201 bp, Homo sapiens
cagagacatgctaagacagaggccccgaggggagcagcacggaagtctagatacacctccagaaagccagagagcagggctggggttagggagggcccccrccccccaagccaacacctaccaatgccgaggcagaggaaactgaagacaaagtcggccatgttcaggcggaggaccactggccaggaggagagggccatg

SEQ ID NO: 49618 - DNA, 201 bp, Homo sapiens
tcaccctgtccgagaaggactgccactcacgcctccctcctcctgagccccgtcccagtcctgaccgcaactgtgttctcagggccccaacctcccctcakattgccattcctggttcacaggaaggaccccaaaacctctcggaagcccacctctagccttaaccatagccctttcttttaccctttaaccaggaagccc

SEQ ID NO: 49619 - DNA, 201 bp, Homo sapiens
tcccacactcggtcactcctgcttcctctctgcctctgtttctagttctcactctgacgtcccgcgtcctttttcatttgtctgcttctcgctcccttccrtgttctgttccctcttcctccctcttccctgggcctgtttctcgctgtccctgtcttttatccttctcatctgcctcttttttgctcaccctgtttctca

SEQ ID NO: 49620 - DNA, 201 bp, Homo sapiens
accctttaaccaggaagccctgaaatctaactgtcccagccaagctggccccttccaaccccaatgtagggaccccaagtcacccccaaactcttcagtcsagatgctcttctttacctctcagacctggttccctaaagctgcatcctttcctgaacctcaaaagcccaacccaggtcctgtttccctagcctaggagcc

SEQ ID NO: 49621 - DNA, 201 bp, Homo sapiens
ccaagcagacgaggactacagccacgacctcatgctgctccgcctgacagagcctgctgataccatcacagacgctgtgaaggtcgtggagttgcccaccsaggaacccgaagtggggagcacctgtttggcttccggctggggcagcatcgaaccagagaattgtatgtgggggcagactgtgtagcccaaggcggggat

SEQ ID NO: 49622 - DNA, 201 bp, Homo sapiens
ccgctccctcatccctactaaacacacacccagatggacctaagggaggccccagagtaaaggaagggctttatccccaacttgtgtgcctgggagggggygcctctccctctgtccagctccccgccccacaggatatccctccactctggagagacacagggaagggctggtttcagcgggagctgggtggggcaactg

SEQ ID NO: 49623 - DNA, 201 bp, Homo sapiens
agcccaacccaggtcctgtttccctagcctaggagccccttagccctccagattcttcctcagtgagcctctgatcctgtcccacccttggcgccttgatscctggtttccagaatccctttccactcccctaacccaccacctcccatcccccagccccagaccccaaatgacctgacgcccagatgcagtgtctgctcc

SEQ ID NO: 49624 - DNA, 201 bp, Homo sapiens
tcacaaggtgcgtgaaaggatggagctggatgcgaggcctcaaggaatcctatgctccagggctcttgggcggaggggacaagggccggaatttatggatytgctccaagtccactgtcttccccagtgagtctcccagatacgttgcattgtgccaacatcagcattatctcggacacatcttgtgacaagagctaccca

SEQ ID NO: 49625 - DNA, 201 bp, Homo sapiens
gatgctcttctttacctctcagacctggttccctaaagctgcatcctttcctgaacctcaaaagcccaacccaggtcctgtttccctagcctaggagcccsttagccctccagattcttcctcagtgagcctctgatcctgtcccacccttggcgccttgatccctggtttccagaatccctttccactcccctaacccac

SEQ ID NO: 49626 - DNA, 201 bp, Homo sapiens
tgtcccagccaagctggccccttccaaccccaatgtagggaccccaagtcacccccaaactcttcagtccagatgctcttctttacctctcagacctggtyccctaaagctgcatcctttcctgaacctcaaaagcccaacccaggtcctgtttccctagcctaggagccccttagccctccagattcttcctcagtgagc

SEQ ID NO: 49627 - DNA, 201 bp, Homo sapiens
ccaaaggggcagattctgggccatctctgtctctctctggaggaccccaaccctcccatgggcttcccccaccccacaggactctgatcatcccctcctgycccctagttccctgcggccacctatttggctcctgagtctacaaatcccaccacactccagtgactttttccatccagctgtccgctctcaactgtgtcc

SEQ ID NO: 49628 - DNA, 201 bp, Homo sapiens
ggggatgtgggagggggaacgggccctgattctcttgctggcctcacatccccccccgataagaccttcccctccaacaccccaccctcatccctctggcycacagtctatcctagtccggggtgccccggctcttatctatcttgcgcggccccaccctaaacttccacccccgctcctccatgttgtcatagtgctcac

SEQ ID NO: 49629 - DNA, 201 bp, Homo sapiens
cccaagccaacacctaccaatgccgaggcagaggaaactgaagacaaagtcggccatgttcaggcggaggaccactggccaggaggagagggccatgggcrggaggaggactcagcacagggccacggccagtaacatgaagcccttgctcatatggatgagaactggggagagggggacaggggccccagagtcaacccc

SEQ ID NO: 49630 - DNA, 201 bp, Homo sapiens
tgtgccccaagccacacaggattcttgcaagaactgttgataacttttttctaccggactcggcagttattaccaactctgccaagttgctaacaactctrccagttttttgtctgtctgctctcagatccatttcccgccctgtcctgttctgcactgcaaggaccacatttcccagcctcctttgctcaccatcttatc

SEQ ID NO: 49631 - DNA, 201 bp, Homo sapiens
gtggggagcacctgtttggcttccggctggggcagcatcgaaccagagaattgtatgtgggggcagactgtgtagcccaaggcggggatggggactcctgygtccaagggagaaagggccagggaagcaggtgaggtcgggctgcagccctttttctcccgggttcgtagtctcatttccagatgatctccagtgtgtgga

SEQ ID NO: 49632 - DNA, 201 bp, Homo sapiens
ggcttcaaccccaggaatgcgtccagcgtgatccagggcctgcagaacaggtgctggttctccctccccgtctacagctctggggatcggaggggggggggcaattgtccagcccccaggcaacaggggaagggccttggccaacatctgggtgccagcagggcaggggtggggctctgaggggataagggcttttaaaag

SEQ ID NO: 49633 - DNA, 201 bp, Homo sapiens
cccacctggcttcaaccccaggaatgcgtccagcgtgatccagggcctgcagaacaggtgctggttctccctccccgtctacagctctggggatcggaggsgggggggcaattgtccagcccccaggcaacaggggaagggccttggccaacatctgggtgccagcagggcaggggtggggctctgaggggataagggctt

SEQ ID NO: 49634 - DNA, 201 bp, Homo sapiens
aaaaaaaaaaaaaaaaaaagatttagttctgggcttcctggtagccatggcaaaaaggcaaatactgtcctttccttagccaggtccctgatatacagcaraggctggaactctgagctgctttgattttaccaaaaagccaagacaacctgttggaagcctatgggtttaccattgaggctgcaggaatctagttcctaa

SEQ ID NO: 49635 - DNA, 201 bp, Homo sapiens
gaaaaaaaaaaaaaaaaaaaaagatttagttctgggcttcctggtagccatggcaaaaaggcaaatactgtcctttccttagccaggtccctgatatacarcagaggctggaactctgagctgctttgattttaccaaaaagccaagacaacctgttggaagcctatgggtttaccattgaggctgcaggaatctagttcc

SEQ ID NO: 49636 - DNA, 201 bp, Homo sapiens
caaaaaaagaaagggaaacagagagtgggggagagagacatcccacagatagagtagaactgagtcagagctccccagagacatgctaagacagaggcccygaggggagcagcacggaagtctagatacacctccagaaagccagagagcagggctggggttagggagggcccccgccccccaagccaacacctaccaatg

SEQ ID NO: 49637 - DNA, 201 bp, Homo sapiens
caggagttgcagtgagccgagatcgcgccactgcactccagcctggtgacagagcaagactccatctcagaaaaaaaaaaaaaaaaaaaaagatttagttstgggcttcctggtagccatggcaaaaaggcaaatactgtcctttccttagccaggtccctgatatacagcagaggctggaactctgagctgctttgattt

SEQ ID NO: 49638 - DNA, 201 bp, Homo sapiens
aggcaggagttgcagtgagccgagatcgcgccactgcactccagcctggtgacagagcaagactccatctcagaaaaaaaaaaaaaaaaaaaaagatttasttctgggcttcctggtagccatggcaaaaaggcaaatactgtcctttccttagccaggtccctgatatacagcagaggctggaactctgagctgctttga

SEQ ID NO: 49639 - DNA, 201 bp, Homo sapiens
tctctactaaaaatactaaaaaaatttagccgggcgtggtggcacacgactgtaatcctagctacttgggagggtgatgtgggaggatcgcttgaacttakgaggcaggagttgcagtgagccgagatcgcgccactgcactccagcctggtgacagagcaagactccatctcagaaaaaaaaaaaaaaaaaaaaagattt

SEQ ID NO: 49640 - DNA, 201 bp, Homo sapiens
actgccaaagccggtatgaaggcaggggctcagggtcctgagggagcctggttcggggggaagagctcctagatttgggggaagacggaggcagacgccasaactcctgggttctgaaagacgaggaggccggatgtcaagcccctgggttaggaaggagtgtgtgtttcaaagccttcgatctctgaaggaggaaggaga

SEQ ID NO: 49641 - DNA, 201 bp, Homo sapiens
ctccccacactgggtgctgtctgcggcccactgccaaagccggtatgaaggcaggggctcagggtcctgagggagcctggttcggggggaagagctcctakatttgggggaagacggaggcagacgccagaactcctgggttctgaaagacgaggaggccggatgtcaagcccctgggttaggaaggagtgtgtgtttcaa

SEQ ID NO: 49642 - DNA, 201 bp, Homo sapiens
gattttgagatgggcatgggtttgatttgattttgaatggtgaggatgtgggctgagttggatttaacttagtacagttgcactggagttgcatgggggtragattggatataggttgggtgagttgtattgagctgtgttgaattggggttggggttggggttgggttggctctgtttgggataaactgggctgtattga

SEQ ID NO: 49643 - DNA, 201 bp, Homo sapiens
ctacgagcgtggacgctttaactgtggcgcttccctcatctccccacactgggtgctgtctgcggcccactgccaaagccggtatgaaggcaggggctcarggtcctgagggagcctggttcggggggaagagctcctagatttgggggaagacggaggcagacgccagaactcctgggttctgaaagacgaggaggccgg

SEQ ID NO: 49644 - DNA, 201 bp, Homo sapiens
aagatggagtcttgctctgttgcccaggctggagtgcagtggtgtgatctcggctcactccaacctctgcctttgggctcaagcaattctcctgcctcagmctcccgattagctgatactacacgcagctgctgccacgccagcctaatttttgtatttttagtagagacatggtttcaccatgttggccaggctggtctc

SEQ ID NO: 49645 - DNA, 201 bp, Homo sapiens
ggactgagacatcctctcccaccctccgtgacaagcagacacacacacacacacacacacacacacacacacacgccctcacaacagacagaaagataccyggagagaggggacaaaaaaagaaagggaaacagagagtgggggagagagacatcccacagatagagtagaactgagtcagagctccccagagacatgcta

SEQ ID NO: 49646 - DNA, 201 bp, Homo sapiens
ctttccagatgtggtgcacctggacccactcggctgaggctggggccaccccagctgtgtcaatctcatgcctggaagtctgaggtcaccagcaggtgggraaaggaaggggctgtgacaggtgcagacaaacaggcagggaaaggctcagatcccaaagggcgagtcagggacgccagaacagttcactcacactaggat

SEQ ID NO: 49647 - DNA, 201 bp, Homo sapiens
agtcccaccctaggccccacccgcttcccgaggccccgccctcctcccgaggccccgccctcaccggagtgcagcatcaagtcgctggcgtcccagcacargtaggaggtcaccaggtaggacaccaccggacttgggtgcaccgccttgccgttaactgaaaagagcgtcaggctgaagagaaatcaggagccctgcaat

SEQ ID NO: 49648 - DNA, 201 bp, Homo sapiens
gggcgggaggaggactcagcacagggccacggccagtaacatgaagcccttgctcatatggatgagaactggggagagggggacaggggccccagagtcamccccagatacccctcttggtcaccctccaaagtcatctctgctgatacccacaagcagcccaacagacaaccccaaagtctggcacatcctcaaaatcac

SEQ ID NO: 49649 - DNA, 201 bp, Homo sapiens
tcggtgtcctgaagacctcgggtgctattccttggaggtgcttgggtctcatcctcgagggtgtatgaaatgggaaggcccggggtgcgctcggagtcagygtctgagttccgctgtttggatgtccgcctcgctgcgccctgctgcacggcccacccgcggtagctcagccgccgcgcattcaagggctgccctctgctt

SEQ ID NO: 49650 - DNA, 201 bp, Homo sapiens
aggggcctggggtctgggaggagggcatctatgctgccacaggattgacaggccagtggcattccccttggataacctcaggcaagactggggggctgagscagagaggaaggctctggcgcaggtcgcctggcagggcagagctgggctggacacccctctccaaggctgcctgggtctcttgggatctggttctgcttg

SEQ ID NO: 49651 - DNA, 201 bp, Homo sapiens
cacggccagtaacatgaagcccttgctcatatggatgagaactggggagagggggacaggggccccagagtcaaccccagatacccctcttggtcaccctycaaagtcatctctgctgatacccacaagcagcccaacagacaaccccaaagtctggcacatcctcaaaatcacccctactcacctccccaaagtcacctc

SEQ ID NO: 49652 - DNA, 201 bp, Homo sapiens
gcactgtgaggacccagtgggcagggacaaagccgcaaagggcgggccctagagcgagggctggagtttgccaccggtcccctcggagggcgtggcctgayatcagggggtggggcctcaggggaggtcgaatatccagggcgtggccacgctgaaggggttggccgggcatctggccatggctaccggtcggtgtcctga

SEQ ID NO: 49653 - DNA, 201 bp, Homo sapiens
aaaggtcatcccactcatcctcaaggttaccccacagaatcacctcaatcatttctttctttcttcttctttttttttttttttttttaagatggagtctygctctgttgcccaggctggagtgcagtggtgtgatctcggctcactccaacctctgcctttgggctcaagcaattctcctgcctcagcctcccgattagc

SEQ ID NO: 49654 - DNA, 201 bp, Homo sapiens
aggggcagggccacacaaactagccacactgccgagctcagcgggacgctggacaagtgtctgcagaacgggaggggatgctgggcctctggggtggaggyactgtgaggacccagtgggcagggacaaagccgcaaagggcgggccctagagcgagggctggagtttgccaccggtcccctcggagggcgtggcctgata

SEQ ID NO: 49655 - DNA, 201 bp, Homo sapiens
tgtcggacacctggaaggtggcaaagacacctgtgtggtgaggcagccctgcccccagggtctggaagggctgagggaggggactcagcctctgaactggyttctgagagctaaccaggcatctgcttcactgcttcccagctagctgtagccactcgccccatcagtgccccagctccccctccttcccccgcccatcca

SEQ ID NO: 49656 - DNA, 201 bp, Homo sapiens
aaactttcaagtcaaatactctaaaaccaatgtgcccaaaagcttagttccagtttacagtggatatttatccaacttagacttccagcagaagagaggtwtacctgtttccgagatgctacatctcctccttttagccctttttctactttgtctacttttcaacagtgcaaaattgttttagccaaataggccaagacc

SEQ ID NO: 49657 - DNA, 201 bp, Homo sapiens
cagcccactctgtgatttggtcagaatgagtggatatttgcagcttacctccccaccatgcatttcacctcctgcccattccccattctcagccccagtcwtaagccaatcagccaactgtactccactggccatataattggctcggggtgctcatgtgccccaagccacacaggattcttgcaagaactgttgataact

SEQ ID NO: 49658 - DNA, 201 bp, Homo sapiens
catgctgtgtgtcggacacctggaaggtggcaaagacacctgtgtggtgaggcagccctgcccccagggtctggaagggctgagggaggggactcagcctstgaactggcttctgagagctaaccaggcatctgcttcactgcttcccagctagctgtagccactcgccccatcagtgccccagctccccctccttccccc

SEQ ID NO: 49659 - DNA, 201 bp, Homo sapiens
gtttgactaatgggaggcactggcagaagactggttctgggaggagagggcaagccagggtatttattagcctctctatctctgcatgtggtgggtcttcmgtagtagttgtatctattctctgattctagccacttctgagcaatccaaccatgaacctatgcgttccagagggctgcagtttctggactgtagtaatac

SEQ ID NO: 49660 - DNA, 201 bp, Homo sapiens
tattagcctctctatctctgcatgtggtgggtcttccgtagtagttgtatctattctctgattctagccacttctgagcaatccaaccatgaacctatgcsttccagagggctgcagtttctggactgtagtaataccacctcctccctttgtccttctggccaagtagcagcatcctgtagttcctaactcctggtttgc

SEQ ID NO: 49661 - DNA, 201 bp, Homo sapiens
ctgtactccactggccatataattggctcggggtgctcatgtgccccaagccacacaggattcttgcaagaactgttgataacttttttctaccggactcrgcagttattaccaactctgccaagttgctaacaactctgccagttttttgtctgtctgctctcagatccatttcccgccctgtcctgttctgcactgcaa

SEQ ID NO: 49662 - DNA, 201 bp, Homo sapiens
tgccccacctggcttcaaccccaggaatgcgtccagcgtgatccagggcctgcagaacaggtgctggttctccctccccgtctacagctctggggatcggrggggggggggcaattgtccagcccccaggcaacaggggaagggccttggccaacatctgggtgccagcagggcaggggtggggctctgaggggataaggg

SEQ ID NO: 49663 - DNA, 201 bp, Homo sapiens
ctggccaaccttgactatttattataggtaattctgtgcagatgtctgacttatgttggccatctccaggatggacctgaactttcacacgtatgtccctrtgactaaatccaggtgtcatttgcaaaaaacaactaatattattaagtagctaccagggctaggtatcactcaccatacatacacacatgcacacacaca

SEQ ID NO: 49664 - DNA, 201 bp, Homo sapiens
ccagatctctgggactttggaggacaggacgttgagcacccataactgggagcaagaagtgggaggctcattgagaccccagcattgtttgggagggacaytggattttgtaatgctaaagaacttaccctgggagacccctgaaacttcacattcctggatctggaggcactaggaatgtggtgatgtgtaccccaaaat

SEQ ID NO: 49665 - DNA, 201 bp, Homo sapiens
gggggaagggtcattggaatctgtggttagcctgatcttgacctgggagggaaggttgtccagatctctgggactttggaggacaggacgttgagcacccmtaactgggagcaagaagtgggaggctcattgagaccccagcattgtttgggagggacactggattttgtaatgctaaagaacttaccctgggagacccct

SEQ ID NO: 49666 - DNA, 201 bp, Homo sapiens
tgagatgattcgtctgaactgattaaaatcgtgtctggcactgagtaaataccctctatctctggatcccagttaaaggacctaacagacactagattacsaagaatggctttttctttaaggtttagttctgggccgggcatggtggctcacacctgtaatcccagcactttgggaggccaaggcgggcggctcacttga

SEQ ID NO: 49667 - DNA, 201 bp, Homo sapiens
gtgcaccccactcccagccatggcaagtggctctctacgagcgtggacgctttaactgtggcgcttccctcatctccccacactgggtgctgtctgcggcmcactgccaaagccggtatgaaggcaggggctcagggtcctgagggagcctggttcggggggaagagctcctagatttgggggaagacggaggcagacgcc

SEQ ID NO: 49668 - DNA, 201 bp, Homo sapiens
caacacacatgaccacccgtgtgatcttgaacaagaggcccaatctcacttcgccttggtttccttatctgtaaaatgagaccatcttattgctgacttcmaagggctgttgtgaggattaaatgagatgattcgtctgaactgattaaaatcgtgtctggcactgagtaaataccctctatctctggatcccagttaaag

SEQ ID NO: 49669 - DNA, 201 bp, Homo sapiens
gatccctaggtgaggagaagcggcttgaagcagggctccattcattcaacacacatgaccacccgtgtgatcttgaacaagaggcccaatctcacttcgcyttggtttccttatctgtaaaatgagaccatcttattgctgacttcaaagggctgttgtgaggattaaatgagatgattcgtctgaactgattaaaatcgt

SEQ ID NO: 49670 - DNA, 201 bp, Homo sapiens
aggaatttctgtgacttttttctggggtcaaagagaaaccccgagacactgtacactgttccttttcacccaccaccccgatccctaggtgaggagaagcrgcttgaagcagggctccattcattcaacacacatgaccacccgtgtgatcttgaacaagaggcccaatctcacttcgccttggtttccttatctgtaaaa

SEQ ID NO: 49671 - DNA, 201 bp, Homo sapiens
cgctcaaggtcacctgtttaatgccaagataacaaagcgctgatccaagttgctctgtaggaatttctgtgacttttttctggggtcaaagagaaaccccragacactgtacactgttccttttcacccaccaccccgatccctaggtgaggagaagcggcttgaagcagggctccattcattcaacacacatgaccaccc

SEQ ID NO: 49672 - DNA, 201 bp, Homo sapiens
gttgggttggctctgtttgggataaactgggctgtattgagttgagttgggttggggttccctgggatggggatggattgggtttggggtgagattgcaamtggtgattaggatgaggatgaatccaggaggtttcactcaacctgagaccccctcttttccccacagggtgactctgggggacccctggtctgtgggggc

SEQ ID NO: 49673 - DNA, 201 bp, Homo sapiens
cggatggggttggattttctttgctttgggccagagaagatgctagggttaggcttggagatggagtaggaagagaagttagaataggggtgaggttggarttggggttataggtggggattgcgttgtttgaggtggataatgtgatagttagtttgagatggcatgggttggggttgagaatgggaatggtttggtttg

SEQ ID NO: 49674 - DNA, 201 bp, Homo sapiens
agtagtcctggagaggtggcctctgcgatgtgcccgcaggggcagcgtcctgcagatggtcctgcccctcctccccctaacctgtctgcaggcactgtccwcctggaccctgccccatgtgcaggagctggaccctgaggtcccttcccccttggccaggactggagaccctgtcccctctgtgggaatccctgcccacct

SEQ ID NO: 49675 - DNA, 201 bp, Homo sapiens
ctagaggggccatcaggcggaagaagagggatggggacaggtgtgggagtccggatggggttggattttctttgctttgggccagagaagatgctagggtkaggcttggagatggagtaggaagagaagttagaataggggtgaggttggagttggggttataggtggggattgcgttgtttgaggtggataatgtgatag

SEQ ID NO: 49676 - DNA, 201 bp, Homo sapiens
tctcatgcctggaagtctgaggtcaccagcaggtggggaaaggaaggggctgtgacaggtgcagacaaacaggcagggaaaggctcagatcccaaagggcragtcagggacgccagaacagttcactcacactaggatggaccctgccctggtggggaggtggggggcaatggaaggtctgaggctgagaggttttattgt

SEQ ID NO: 49677 - DNA, 201 bp, Homo sapiens
atctcaccccccacaccagagttcaccgttcctcgtggtaatgtgttgttaccgtcgagtcagagagtagtcctggagaggtggcctctgcgatgtgcccrcaggggcagcgtcctgcagatggtcctgcccctcctccccctaacctgtctgcaggcactgtccacctggaccctgccccatgtgcaggagctggaccct

SEQ ID NO: 49678 - DNA, 201 bp, Homo sapiens
tgttgttaccgtcgagtcagagagtagtcctggagaggtggcctctgcgatgtgcccgcaggggcagcgtcctgcagatggtcctgcccctcctccccctracctgtctgcaggcactgtccacctggaccctgccccatgtgcaggagctggaccctgaggtcccttcccccttggccaggactggagaccctgtcccct

SEQ ID NO: 49679 - DNA, 201 bp, Homo sapiens
cccagcctcctttgctcaccatcttatcactgtgtttgactaatgggaggcactggcagaagactggttctgggaggagagggcaagccagggtatttatyagcctctctatctctgcatgtggtgggtcttccgtagtagttgtatctattctctgattctagccacttctgagcaatccaaccatgaacctatgcgttc

SEQ ID NO: 49680 - DNA, 201 bp, Homo sapiens
  misc_feature (1)...(201): n = A,T,C or G, or insertion/deletion polymorphism (see Tables 1-2)
ctgcgatgtgcccgcaggggcagcgtcctgcagatggtcctgcccctcctccccctaacctgtctgcaggcactgtccacctggaccctgccccatgtgcnggagctggaccctgaggtcccttcccccttggccaggactggagaccctgtcccctctgtgggaatccctgcccaccttcctctgggagtgggcactgga

SEQ ID NO: 49681 - DNA, 201 bp, Homo sapiens
gcgatgtgcccgcaggggcagcgtcctgcagatggtcctgcccctcctccccctaacctgtctgcaggcactgtccacctggaccctgccccatgtgcagkagctggaccctgaggtcccttcccccttggccaggactggagaccctgtcccctctgtgggaatccctgcccaccttcctctgggagtgggcactggagg

SEQ ID NO: 49682 - DNA, 201 bp, Homo sapiens
ttttagccaaataggccaagacctcatctgctttgtttctggcaaactgcacatctctaatacccaacaagaaagataaaggatcatcatatatacagaasagcaacagcactctgggaagtgggggaaatatcagaccccttggttttttgtttttgttttgttttgttcatagagatggggtctcactgttacccaggc

SEQ ID NO: 49683 - DNA, 201 bp, Homo sapiens
ttttctcccgggttcgtagtctcatttccagatgatctccagtgtgtggacctcaaaatcctgcctaatgatgagtgcaaaaaagcccacgtccagaaggwgacagacttcatgctgtgtgtcggacacctggaaggtggcaaagacacctgtgtggtgaggcagccctgcccccagggtctggaagggctgagggagggg

SEQ ID NO: 49684 - DNA, 201 bp, Homo sapiens; identical to SEQ ID NO: 9320

SEQ ID NO: 49685 - DNA, 201 bp, Homo sapiens
agggtcgggagacctcgggttgcccactctttgatctttctgtcctctacttgcgggtaaccactggcccgcactccactggcgggaaaaccactcgcccscacagcttcatgagagtgcgcctgggagagcacaacctgcgcaagcgcgatggcccagagcaactacggaccacgtctcgggtcattccacacccgcgct

SEQ ID NO: 49686 - DNA, 201 bp, Homo sapiens
atgtggtgatgtgtaccccaaaattttattatgaaaggaacagtagctttggggacctaggtcctgggtctgggagtgcaagaaccagggcattctgaagkccaaggcttatatttcagggggaactggcagctgagatgctagtatcttggctccgagtggtgcagggaatcagagccctaactgctggtgtttgagggc

SEQ ID NO: 49687 - DNA, 201 bp, Homo sapiens
gctgcagccctttttctcccgggttcgtagtctcatttccagatgatctccagtgtgtggacctcaaaatcctgcctaatgatgagtgcaaaaaagcccaygtccagaaggtgacagacttcatgctgtgtgtcggacacctggaaggtggcaaagacacctgtgtggtgaggcagccctgcccccagggtctggaagggc

SEQ ID NO: 49688 - DNA, 201 bp, Homo sapiens
gaccctgacatctggtctccccagtccttccagggtcccccaaatttcaccagaaaaccctgcttcccaaactggcatgtgggatcccccatctggtatgkgggggggtctgcaaatgtcccttcccacccagcacccccagctctcccaggaaaaacaccacaccctcccaccacatgctcctttccttggggaagttcc

SEQ ID NO: 49689 - DNA, 201 bp, Homo sapiens
aaaattacaaaaaaattagccaggcacggtggtgccaattacctacaattcccgggtcagtatccaagaccctccaccagccaggaacagtcacggggtcrgtatccaacagcctccaccagccagcagcaatcgcctggtcagtatccaagaccccttgccaattattcacaatcaccaggtcagtatccaagaccctac

SEQ ID NO: 49690 - DNA, 201 bp, Homo sapiens
acacccgcgctacgaagcgcgcagccaccgcaacgacatcatgttgctgcgcctagtccagcccgcacgcctgaacccccaggtgcgccccgcggtgctayccacgcgttgcccccacccgggggaggcctgtgtggtgtctggctggggcctggtgtcccacaacgagcctgggaccgctgggagcccccggtcacaagg

SEQ ID NO: 49691 - DNA, 201 bp, Homo sapiens
tgtgacactggatgccaagactcacactagagatgttgaatttaggtctgaacaatatccaattctgtgtgtgtgtttgtgtgtgcatgtgtgtgtgtgttgtattcatgtcttaaccatccatattcatatacacatatgaacatctgtgctgtgattcttttttttttttttttttttttttgagatggagtttcactc

SEQ ID NO: 49692 - DNA, 201 bp, Homo sapiens
gggcagattgcttgagcttacaagttcgagaccagcctgggaaacatggcaaaactctacctctaccaaaaaatacaaaattatagctaggaatagtagcrctcccctgtagtcccaactacgtgggaggcagaggtgagaggatggcttgaacctgggaggcggaggttgcagtgagccgagatctcatgccactgcact

SEQ ID NO: 49693 - DNA, 201 bp, Homo sapiens
ggtgaaggttgcagtgaaccaagatcacgccactgcactccagcctgggtgaaagagtgaaactccatctcaaatttaaaaaagtaaaaaataaaaaaaawttaaaaaaaaagagtttgtgtcacttgtgacccaaaaactcctgactaattcaagtcccttccttaggacagcagggagcacagaattcaatgttccctg

SEQ ID NO: 49694 - DNA, 201 bp, Homo sapiens
agttagccgggcatggcagcgggcgcctgtaatcccagctactccggaggctgaggcaggagaatcgctcaaacccggggggtgaaggttgcagtgaaccragatcacgccactgcactccagcctgggtgaaagagtgaaactccatctcaaatttaaaaaagtaaaaaataaaaaaaatttaaaaaaaaagagtttgtg

SEQ ID NO: 49695 - DNA, 201 bp, Homo sapiens
gtgaaactccgtctctactaaaaagataaaagttagccgggcatggcagcgggcgcctgtaatcccagctactccggaggctgaggcaggagaatcgctcraacccggggggtgaaggttgcagtgaaccaagatcacgccactgcactccagcctgggtgaaagagtgaaactccatctcaaatttaaaaaagtaaaaaa

SEQ ID NO: 49696 - DNA, 201 bp, Homo sapiens
catggtgaaactccgtctctactaaaaagataaaagttagccgggcatggcagcgggcgcctgtaatcccagctactccggaggctgaggcaggagaatcrctcaaacccggggggtgaaggttgcagtgaaccaagatcacgccactgcactccagcctgggtgaaagagtgaaactccatctcaaatttaaaaaagtaa

SEQ ID NO: 49697 - DNA, 201 bp, Homo sapiens
atcccagcactttgggaggccgaggcaggtggatcacctgaggtcaggagtttgagaccagcctggccaacatggtgaaactccgtctctactaaaaagayaaaagttagccgggcatggcagcgggcgcctgtaatcccagctactccggaggctgaggcaggagaatcgctcaaacccggggggtgaaggttgcagtga

SEQ ID NO: 49698 - DNA, 201 bp, Homo sapiens
tcaagctctgccccaagactttttattaggaagctgtcaaggaaaagcagtctctcctcaaggattacaagcctgaagctgcctaagccttggacctagcytcatggggagagtaaaactaagaaggaaaacagacaagcgaaagagcattgagctgacactgaagtccctggctctcgtcatcccagagagcagcccact

SEQ ID NO: 49699 - DNA, 201 bp, Homo sapiens
cagctgcagaccctgcaattggcccaaagatggacacatgaccaaagcccaaccaatcaagctctgccccaagactttttattaggaagctgtcaaggaaragcagtctctcctcaaggattacaagcctgaagctgcctaagccttggacctagcttcatggggagagtaaaactaagaaggaaaacagacaagcgaaag

SEQ ID NO: 49700 - DNA, 201 bp, Homo sapiens
ctgaagagaaatcaggagccctgcaatggggtggggccagagacagaaggctggacagtgagccctatgacccccagtaagaaaagagggactgagacatyctctcccaccctccgtgacaagcagacacacacacacacacacacacacacacacacacacgccctcacaacagacagaaagatacctggagagagggga

SEQ ID NO: 49701 - DNA, 201 bp, Homo sapiens
cagttgagctcatgtaattaccatatgttaatttgggggtgatatgttttaggttgatattaactaatatgttttcctatgcagtgagaaatgttttgctkctttcctttcagaacagaacaatccatatgcatgtatactccaaggcaaccccttgacttttctgggaaatttactttcttgggaataacctaagttatt

SEQ ID NO: 49702 - DNA, 201 bp, Homo sapiens
cctgcccgagcgtacccccccggggggttccggggaagggggcgggggtccggatccccggatccccggaaggcgacttgcggggaccccggccggcctckcacgccggcgatcgatcccttttccggctgcccaggatcgggggagagaggcgggatccgggtgccgcggtgcccgagcctcccggggaaagcctccgcg

SEQ ID NO: 49703 - DNA, 201 bp, Homo sapiens
tggggaaagttcccaggccggggaaaaggtggccgcacgctggcttttctcaaggcagccggccctcttggcgtcgtgcttgatttcatgggtgtttaatwcgtgctttgtgggcgctggctccccctccccaccccaccctcaccctcttttctggcttcacttttcagataatgctgtccctggcgttttggtgaccga

SEQ ID NO: 49704 - DNA, 201 bp, Homo sapiens
ggggaaagttcccaggccggggaaaaggtggccgcacgctggcttttctcaaggcagccggccctcttggcgtcgtgcttgatttcatgggtgtttaattygtgctttgtgggcgctggctccccctccccaccccaccctcaccctcttttctggcttcacttttcagataatgctgtccctggcgttttggtgaccgac

SEQ ID NO: 49705 - DNA, 201 bp, Homo sapiens
tgcccttttataatggcaccaaccccacccatgagggtggagtcctaatggcctaatcagctctctgagatcccatctgttaatactgttacaatggcaaytaaatttcaacatgagttttggaggggacagacattcaaaccatggcaggtggcaagaagtatcaaactactagatccttgggattgtgctttgtactgg

SEQ ID NO: 49706 - DNA, 201 bp, Homo sapiens
tcactgccacagagaagtcagaggaagggacttgttgctaaaaaatcctttaaaaggttaaatactttaaaagattaaagcaacataactgtaaacatatygtataaaaatgaaaaacacaggaaccctcttcccttccgcctggtgtgggcttgggaaatgggcaagcggccccagcaatcatgggaggaactcttgcgg

SEQ ID NO: 49707 - DNA, 201 bp, Homo sapiens
tgatacatggaaaaatgtacctgaaatgtgagtcctgcttttgtgactcaccctttcctttacataagcattgatttacatctgttgttttttaagatagkgtgtatgttgaaaagttcagaacaagatcaagtggagacataaaatggtaagatgtgaaaagttgttcttgccagattaaatggttccacctgaagaaaa

SEQ ID NO: 49708 - DNA, 201 bp, Homo sapiens; identical to SEQ ID NO: 9341

SEQ ID NO: 49709 - DNA, 201 bp, Homo sapiens
ccctgggctgcatcatccttccacattgtctctctaaagtacctgaagccagtagttctcaaactttggagagggttttgagtcacctcgagagctgataagaacagaggcccagattgaagttgaatagtgctgggcctttgtttttaccaagttccctggatggttctgctacctcctagcctgtgagaactactcctt

SEQ ID NO: 49710 - DNA, 201 bp, Homo sapiens
attgtggcagaagggtatcttaaaaaccatttgtttctttaaaaaaactcaaacattagcactttattcttataaacttgttttctgtctttttttccccrtaagagaaatgtttaaaaacattctttaaacaattctattttgtcattatcttttttttggacaaatatcagtgtcttctgtttattacgttgctgctgg

SEQ ID NO: 49711 - DNA, 201 bp, Homo sapiens
taattatcaataattatgaattgtcaaaattatgtcatgaaacctctttttttcttttttttgagggggagtcttgctctgtcacccaggctggattgcartggtgtgatcctggttcactgcaacctttgcctctgaggttcaagtgattcttctgcctcagcctgggattacaagcatgcgccaccatgcctggctaat

SEQ ID NO: 49712 - DNA, 201 bp, Homo sapiens
tcaggcctttttatggggctgcctctctctctggaggaggaagggagcagatattgatggagcaccaactgtggccactgtctgatggccatctgatgggrttggggctccgaaggaaaatgggggatgtgtccctcttgtggttgatgtctttttgtctcctgtgcttgaaacagatgccagcaatacagagagaagccg

SEQ ID NO: 49713 - DNA, 201 bp, Homo sapiens
aaaaatacaaaaaattagccaggcgtggtggtgggcgtctgtagtcccagctactcgggaggctgaggcaggagaccgcgccactgcactccagcctgggygacagagcgagactctgtctcaaaaaaaaaaaaaaaaaaaaaaaaaagaaaacaggaagtagggaggggcaaggaggcatctggtgcagtgatctgacta

SEQ ID NO: 49714 - DNA, 201 bp, Homo sapiens
cctcttttctggcttcacttttcagataatgctgtccctggcgttttggtgaccgacctttccccttcctggcatttccataggggctgaggcagagcagytgaaggggcattcccatttcacagatggggaactgagggagagaagtgaaatagcggagcacccagcccgtgccatgggagctgagccagcgggcacgtc

SEQ ID NO: 49715 - DNA, 201 bp, Homo sapiens
ccttggctccccaaagtgttgggattacaggcatgaaccactgcacccagccatgtttttattttatctgagagaaaactgaggttcagaacttaactgtrtacttctggaatcttcacagagaaataaaaaaaaagaaaaataatttactatagattcattaactactacgtggcggagccagggctgatgtctccactg

SEQ ID NO: 49716 - DNA, 201 bp, Homo sapiens
ttcatggctcttactggccactgggcaagactcagatagcaccaaccaaccagtcacagttgtgatgtaggatgtgactgtgaatgacatccctgctgccygcttcagagaaagggctgccacttgccagagaaggaatggtgataatgagggacagccagtccctaagtggagatccctgaaagtggtgaatatcttaga

SEQ ID NO: 49717 - DNA, 201 bp, Homo sapiens
gctgaggcatgagcatcacttgagccctggaggtggaggttgcttgagtcctggaggcggagtgagccaagattgcgccactgcacttcagcttgggctgyagggtgagattctgtctcaaaaaaataaataaataaataaataaaataaaaaaacaattgaggtggatgtctccctaggggtaccccaggaagccacagg

SEQ ID NO: 49718 - DNA, 201 bp, Homo sapiens
ggtcagaggcaagaggagggtgcctctgagcttcaacccctcccaggaacaatgagctcaaattggaagagtccagtggaatcggggggatggtgtgagcrcccctgttcagtctttgacaattgcatacagaaaagcagctggtatgggtttgggtgtcaatgaaagggccaaagactggtggccagctggtttggggga

SEQ ID NO: 49719 - DNA, 201 bp, Homo sapiens
tctttatgcaggactgttatttcaaaggatggtgtcccctccccaaccataagaacgatccaaacctgttttctggggcccagagtttgctgaggataggmctgggctgaagctttcattgctggtctgtggggtagaggtaagcctcccctgtgaagctggtaggttacatgctttggcaacatgaattgttatttctgg

SEQ ID NO: 49720 - DNA, 201 bp, Homo sapiens
gcgtgtgtgtgtatgtggggggtgtgtgtgtgtgtgtgtatgtggggggtgtgtgtgtctgtgtgtgtgtgtgtgtgtgtgtgtgtgtgtgtgtgtgtgtdgtcatttgccaaatgggtattcagatattcttggagagcaggtgtttcctggttatttctgttcacatctgcccaccaactttatagaaatcaaagaccc

SEQ ID NO: 49721 - DNA, 201 bp, Homo sapiens
ctacaaaggacctgaactcatccttttatggctgcatagtattccatggtgaatgtgtgccacatttttcttagtccagtctatcattgatgggcatttcrgttggttccaagtctttgctattgtgaatagtgctgcaataaacatacatgtgcatgtgtctttatagcagcatgatttataatcctttgggtatatacc

SEQ ID NO: 49722 - DNA, 201 bp, Homo sapiens
ctggtcctgcccgcctggtcctgtggccagcactctccactgtgagtcattcaggcccagtccttgtcctggtggtgcatctgcctcatgatgtcaagcaytgtgggaaaggcacccagcctgccccactccaaaggatgagtatggggaggtggtggtgcttctcaaacccaaggctgtttgtcataccacattccgaag

SEQ ID NO: 49723 - DNA, 201 bp, Homo sapiens
agcttcttatggctcttatgttctgcaggacggatgaactaggtacccaggacaggtctgtttgtgcacaaggctgtctccttctccccctccttggtttytctactgaggctttgttgtgcttggctcagggtgatgttagcaaatgcactctccaccctgctgtgccacattaaggaaacgcatgttgtattggcttct

SEQ ID NO: 49724 - DNA, 201 bp, Homo sapiens
gaactcctgacctcaagggatctgcccgcctcagcctcctgaagtgttgggatcacaggcgtgagcccctgtgcctggccagattaggttctgattttggrgggggaaatggatcagtcagtggctggataaaacagttttattgtttcttgttaaaaataagagtaatacatgcttatggcaaaaaatatagaaaagaag

SEQ ID NO: 49725 - DNA, 201 bp, Homo sapiens
tgacagcatgccctgatgacctctccctccctctgccttggccgttctggttattttgaactcctcttgtgttctcacagatgctattcaggtttttgacrtcaccgctgtgaacatcagtgccacaagcctgaccctgatctggaaagtcagcgataacgagtcgtcatctaactatacctacaagatacatgtggcggg

SEQ ID NO: 49726 - DNA, 201 bp, Homo sapiens
tttatgtcttcttttgtactaagtctttgatatctagtctgtattgtgtgcttgtagcacatctgaatgcaaactggtcacctctcaggggcttggcagcygcatgtggctagagggctgctgtatcagcacaggtttagacaattatgttgtggttgttttggagttcagatttctgtctccttgaatcttgaatatata

SEQ ID NO: 49727 - DNA, 201 bp, Homo sapiens
ccacccccattattaaatcctcaactgctttatttctgatttgcattttccatggctgaatgaatctgctgacttccgttttctttttctgtttcagatcytgtgcgcaggtggcagtgagtacccttttcctctctattcttgtgttgttcgctactgccccctaatggacacacagcaacattaacagcaatgtgaaat

SEQ ID NO: 49728 - DNA, 201 bp, Homo sapiens
tgtctgatggccatctgatggggttggggctccgaaggaaaatgggggatgtgtccctcttgtggttgatgtctttttgtctcctgtgcttgaaacagatrccagcaatacagagagaagccgggcagggagccccaccgcccctgtgcatgatgagtccctcgtgggacctgtggacccatcctccggccagcagtccca

SEQ ID NO: 49729 - DNA, 201 bp, Homo sapiens
acagcaaggaccaagtacaatgttcccctgatatttaatttgctaaaacatgtaagaagaagaaagttcttacattgttaggtcccaaagagagtgccacyaagcaaccttgccaaaaccaccttgctggagcttcttattatctttttttagcgaatggcaataaagtcattttgtcaagctaaccaagtaccataatga

SEQ ID NO: 49730 - DNA, 201 bp, Homo sapiens
agcattaactgctgaccttgccatctgtgagcaggtgttgaatgagctcagttccctcccagcccttctttttccctggtgggtcattggctcctgagtargatagatgcatgcaatagaagagctgttaatagcatttactctttcttaatccttattaatcccattcatatttcagtgtctgaaacttggcaggatgtc

SEQ ID NO: 49731 - DNA, 201 bp, Homo sapiens
ggctcatcatacacagtggagatctttgcacaagtaggggatgggatcaagtcactggaacctggccggaagtcattctgtacaggtgagtgtagccccarctgcctcttggactcctccctgagtggtgctgaccttgcaggtcagtcctcccaagtctgtagtttgtctggttttgtgtgatgtgcagtgatggacatt

SEQ ID NO: 49732 - DNA, 201 bp, Homo sapiens
ttatttcaacatgtaatttctgtgaagtattaatgagttattttatgtcttcttttgtactaagtctttgatatctagtctgtattgtgtgcttgtagcayatctgaatgcaaactggtcacctctcaggggcttggcagccgcatgtggctagagggctgctgtatcagcacaggtttagacaattatgttgtggttgtt

SEQ ID NO: 49733 - DNA, 201 bp, Homo sapiens
tttgtttgctcaaattgcctttataaaatagattgatactctataataagcaaatgttgtgaatttggaattttcaaattgaggcttactaataatgttawctattttatccgagtttatttgggtttcttataaaatgtaatttctcaagaagattttgctgccctaaaaaaaaaaaaaagaaaaagaaaaagacaaaaa

SEQ ID NO: 49734 - DNA, 201 bp, Homo sapiens
atgtgagttcattattgataggcagctgtggcaggaagggaaggatctgaatgcagaattggaggatgagggacttctgttgcatctgaaatcagtgttgrggaaatgacttcacttctgtgaatctctgctgcctcatctttaaagggggataataaactctccttcttgagcatattgtgagggtttgatgagcaagca

SEQ ID NO: 49735 - DNA, 201 bp, Homo sapiens
ttattgccagcttaacttgtttttatgacatcttcaggaagaaaacctctgctgtctatttaatggagatgaattgttaaacttttaccatttgcaactayacgtctctatgagtcagacttttattgatcgtgtacaactaaatgaaacccggaaatgaaggaaatgtaacaagcgattttatgtattttttgtttgctc

SEQ ID NO: 49736 - DNA, 201 bp, Homo sapiens
tgcagcttggaactcttgggctgaagtgattcttcttccttagcctccccagtagctaggactatagtgccaccatgcctggctaatttaaattttttttktgtgtgtgtgtgtggtggagatgggttctcactgtgttgctcaggctggtcttgaactcttgggcttaagcgatcttcccatcttggcctcccagagtgc

SEQ ID NO: 49737 - DNA, 201 bp, Homo sapiens
taccatgtctccttttccagcctcattccctgagatgtagccggagttccagttcagccaacctgcccgttgttttctctcctggaactgggtgtttgagyctcctgcatggagtgttcttccttcccagctaaagtcctggtcatcccatttccatctgaaaggcccccttgttcatgaagcctctcatggtccttcccc

SEQ ID NO: 49738 - DNA, 201 bp, Homo sapiens
gtagcaagcatgcagacattctcatgacatcctggcagatatcaagaccaaagaacatcccatgttccctcttgaaggcttgtaataactgccataaattrtcttgtgggaatggagtggccctggcctaagctgtgctgtaccggactctcctggtgacagttttagtggctgcatatgtttgcagaagaaggaagcgtg

SEQ ID NO: 49739 - DNA, 201 bp, Homo sapiens
aatgctgtgtacacgcttggtcactcttccctttcttgagatgacatgtccccttcttggagacccaagatgattgacaacaataacattcctttacaacrttttcttctcatctagagcactgggaggctgccttttaacagagatatcacagagtagcaagcatgcagacattctcatgacatcctggcagatatcaag

SEQ ID NO: 49740 - DNA, 201 bp, Homo sapiens
gctttggttctcctgtgtgccaggaacagcagtaaactttatgtcctaagattagtatggttggaaatgcatgtggcagtggttcccaaacactggtgtgyagatggaacacagcccgtgaagttttcagcggtccttgttaaaaagagataaaggaaagagataaaggataaagtgctgagattctcgtgaagctaaatg

SEQ ID NO: 49741 - DNA, 201 bp, Homo sapiens
tgtaaagtttaatttttagtcattacaactcctggttagtactcaggctctgcttgatttcccctgcctttttgatgttgttaggcagcctttctgtctgkatctaaatcattttctgggcttttagatccagacaagtgagagtcaccctctgagacagttccatttcacctcctggccagaccacggtgttcccgacac

SEQ ID NO: 49742 - DNA, 201 bp, Homo sapiens
tgatacaaagaagagaaagagagggatcagtttttccaagtgtgcatttcatttcagtgtaaatattttgtgaggtggggcatccctgtctcctggagaartatatttttaatctaattgtttactttctttgcatagcccctagtccaattcctgacccttcagtagcaactgttgccacaggggaaaatggcataacgc

SEQ ID NO: 49743 - DNA, 201 bp, Homo sapiens
gctctccagttttataggtgaggaagctgagctcaagtggttttcctgtggcccacctgggtgtcatagcagagtgagccctggaacccaggcctgcctcrtcctgacttctgtgatctcgggcgatcacatagatcgcagtgttcgctcttgcatcatgtgtgtttgacaacttttctgggtgcccctggccctagggta

SEQ ID NO: 49744 - DNA, 201 bp, Homo sapiens; identical to SEQ ID NO: 9324

SEQ ID NO: 49745 - DNA, 201 bp, Homo sapiens
tccagagcctgagcccttgaccacaggagctcacgcctcctctcatttcctgtgaatgattgtgtgcaatgtaagcacagagcttctgcactctcatgatmaagtgctctctccatggccagaaacagcagtttctgaggggctcatgttgtaggtgatgatacaaagaagacagagagagggatcaggtgtcctaagtgt

SEQ ID NO: 49746 - DNA, 201 bp, Homo sapiens
gagatgaggcaattctcatccctccctcttgcttctttctgttcatcagcttcattctcagagcagctccctctgcacacttaaggagcccagctgctccygtttcacaccctgcagctgccccaccagccagctgccccaccaaccagggtctggtccagggaaacgtgtcttgagtggggtctgattagcaaagtctgc

SEQ ID NO: 49747 - DNA, 201 bp, Homo sapiens
tacttaataaaacaaaaagacgcatgactgacctgatttagaactctttgcatgagagacatgtgctgtgaagaatcatcttaccgtttcggagctggacrgtgccttagaatcatctaggccgatgtctttaccttcaggcccctgcagccctcaggaggggttttgctctatctgcagcactacctgtgcttttctgta

SEQ ID NO: 49748 - DNA, 201 bp, Homo sapiens
tggggtttgggagttgggcgggggaatgacctgtttgaaaataattttgggtgctaatttctgggacccatgttcattttctgtctctctctttcgttttyctatcaggaccagtatgttttcctcaatcagtgtgttttggatattgtcagatcccagaaagactcaaaagtagatcttatctaccagaacacaactgca

SEQ ID NO: 49749 - DNA, 201 bp, Homo sapiens
aacacctggcctcaagtgatcctcctgctttagcctcctgagtagctgggaccacaggcttacaccaccatacctggcaaattttttttttttttttttttggagaggcagagtcttgctccgttgtccaggctggagtgcagtggtgtagtcatggctcgctgcagcctctgtctcctgggcttaagccattctcctgcc

SEQ ID NO: 49750 - DNA, 201 bp, Homo sapiens
tggcagtttctgaggggctcatgttgtaggtgatgatacaaagaagagaaagagagggatcagtttttccaagtgtgcatttcatttcagtgtaaatattktgtgaggtggggcatccctgtctcctggagaaatatatttttaatctaattgtttactttctttgcatagcccctagtccaattcctgacccttcagtag

SEQ ID NO: 49751 - DNA, 201 bp, Homo sapiens
accttgtttgtttaaagaccattaaagaacgtcttcaatttattctggattgagttttcctcaaaccaaaccacccctcagttcaccccccagagctgttsaggcccttcctgggggcttgtggctgtggctgcctcagatcagagcagaccctgggctgcatcatccttccacattgtctctctaaagtacctgaagcca

SEQ ID NO: 49752 - DNA, 201 bp, Homo sapiens
tcatttgcttgtgccgagccgccaagtgccccctcctgctggcgacaggtccggatgtgggccagttctcagcccagggaaaatgaacagtgtcttctccrtggtgcccagaacagtctgagtcagtggaatgtgctggccagtcaggcagaagggaacttccacttcttttttaaaaccttggtggaaactgtgctggca

SEQ ID NO: 49753 - DNA, 201 bp, Homo sapiens
ttctgggttccttccggctgtccaaatcaaatttaattttcacacccagaccttgtccctgctctcatccttcagcccaccctcctgttccccattcagcyagaccccctgccagtcagttcaagtgctaggcatggggtatcgagtctcaggccggtccacagacattccagcacctggtggtaagaggtgagtgctgcg

SEQ ID NO: 49754 - DNA, 201 bp, Homo sapiens
ccggtccacagacattccagcacctggtggtaagaggtgagtgctgcgtggacccactgaggaaggctctggctgtgctgggggaggggagtttatgctcrtcctcatagaaggataagcaggaattaagtgggcaaaggagggagtgaggaagctctcactttctaggtagtaggaccagcatgaaccaaggtaggggat

SEQ ID NO: 49755 - DNA, 201 bp, Homo sapiens
gttgtatttttaaaatagagccgatcccagtttctgatctccgtgttgccctcacgggtgtgaggaaggctgctctctcctggagcaatggcaatggcacygcctcctgccgggttcttcttgaaagcattggaagccatgaggagttgactcaagactcaagacttcaggtcaatatctcgggcctgaagccaggggttc

SEQ ID NO: 49756 - DNA, 201 bp, Homo sapiens
tcttttaaaacccgctcccagcactgaaccccagtcattcttaatgaaggtgactgcatatatcttgttccattaatgcatgttgtatttttaaaatagarccgatcccagtttctgatctccgtgttgccctcacgggtgtgaggaaggctgctctctcctggagcaatggcaatggcactgcctcctgccgggttcttc

SEQ ID NO: 49757 - DNA, 201 bp, Homo sapiens
actccaaacagaggatgtcggtatagacaatccctaggatcttgtcccctttatgactgatcacacagttccactgcttgcccttgaggctttggtgtccrcgcatgcctattcagtctgacccacaagaggccaggccagctctgttccaggtgctgaaaatcccattaaaactccactcactagcctgttccctggggg

SEQ ID NO: 49758 - DNA, 201 bp, Homo sapiens
tgactgatcacacagttccactgcttgcccttgaggctttggtgtccacgcatgcctattcagtctgacccacaagaggccaggccagctctgttccaggygctgaaaatcccattaaaactccactcactagcctgttccctgggggtgctgaatcagcatttaatggggaaggccacgagctaggctctggtgggtagg

SEQ ID NO: 49759 - DNA, 201 bp, Homo sapiens
ggtctgtaaaatcccaaacccaggtagataaaaccaagaagtgacagggctggaagggatcttaggaattagttcataaagaacttcaggctcagagaagrcatgtgagttgcctaaggtcacacagcaaatctgaagcaaatcagggctagaaacccatagacgatggtcatgagcactggttttgagtcatccatttga

SEQ ID NO: 49760 - DNA, 201 bp, Homo sapiens
gactgatcacacagttccactgcttgcccttgaggctttggtgtccacgcatgcctattcagtctgacccacaagaggccaggccagctctgttccaggtsctgaaaatcccattaaaactccactcactagcctgttccctgggggtgctgaatcagcatttaatggggaaggccacgagctaggctctggtgggtagga

SEQ ID NO: 49761 - DNA, 201 bp, Homo sapiens
tctattaaggaacatttcaaactttgacagattcagaaggaatgatatgatgagcgccatgttcccttcacccatagtgttctgcatttggccagtcctakttcctctgcgcccccagctgggcgatgttaatgtgctcccagctgtcacatcaggccactgatagacgccacagtgtgggatgctactttcaaatgatat

SEQ ID NO: 49762 - DNA, 201 bp, Homo sapiens
agatgttttgagtttatcctccaataggcaatgaagttgacaaggttttatgaaggaataaccaagtccctggagtcctgtggctgttgccacagtaatgygtcctgctgtaaacaggacaggtgtgtcctgttgagaatgtgagcgggctcttccagcctcctggtccctcctgactctgccacgcccctcacctcactg

SEQ ID NO: 49763 - DNA, 201 bp, Homo sapiens
tctaaactaacaaggtttacacatgtgacaaacatccaggttgccagggctcaaaagagggttcacatcgactcccttctcattcactgagtcctttttcrggagctttggccgagtttgtgctgcgtctgggcatctaggtgtcgagttcttccctagtgttttcagcctcggcttcctcctctgtaaaatgggagtaac

SEQ ID NO: 49764 - DNA, 201 bp, Homo sapiens
ggatgtgcacacaacctatcaagaatacttcactttgtgaggcccaaaaacagctcctagcacagtgtagagcagacttggtcagaacttcaatccttgayttttttttttttttaacccgaatttcatgaggtttttctgagacatccactggactgtcatataccgtgtgctgggctctcattttatccttacaattat

SEQ ID NO: 49765 - DNA, 201 bp, Homo sapiens
ctttcctttcagaacagaacaatccatatgcatgtatactccaaggcaaccccttgacttttctgggaaatttactttcttgggaataacctaagttattkctgaataaaatgaatcttaagagcatggctctacatcaggaactctttcctttctttccacttccaggtgacttgctcatagattttacagaacaaactg

SEQ ID NO: 49766 - DNA, 201 bp, Homo sapiens
aaaaaaaaaaaaaaaaaaaaaaaaaaaaaagcaagctcatacctccagcctgggttttgagagcctgtctgaaaaaaacaaaacaaaaccctcaagtaaayaacctaatgtagcacgttaaggaactagaaaaataagaacaaactaatcttcaaattagtaaaaggaacaaaataataaaggtcaaagctgaaataaatg

SEQ ID NO: 49767 - DNA, 201 bp, Homo sapiens
agaatggcgtgaacccaggaggcggagcttgcagtgagctgagatcatgccactgcactccagcctgggcgacagagcgagactccatctcaaaaaaaaamccaaaaaaaacagtgcttgttgttcttttgttgttattgttaaaggatcattatctcattatcaacaacattggcaggtaattgagcaactgtttgtctc

SEQ ID NO: 49768 - DNA, 201 bp, Homo sapiens
ttatagaaacagaagctgttttttttttctaaagatccaaactcatgttgccacacaaacaacaaaataaaccagtgtgttccaaaaacaagcatttgctytacccacacgcacagttggaaagatgcaggtttgattgaagaagtcggaagccagtgaggtaatggcagattcttttaggggctcctgttaattttagta

SEQ ID NO: 49769 - DNA, 201 bp, Homo sapiens
gcctggctgctctgctttttacccatagctctggctctaatatatgacactgcccctccctgaattagaatggaggctacagggggatgctggtctgttarttgactgatgcatcttcagcacttaagacagtgtctggcacagagtaggaacagaatatggtcctgtaacaaatactgaaggttgtgctctgtgcacctg

SEQ ID NO: 49770 - DNA, 201 bp, Homo sapiens
agcaattctcctgcctcagcctcccgagtagctagaacacaggtgcccgccaccacatccggctaattttttgtatttttagtagaggtggggtttcatcrtgttggccaggctggtctggaactcctgacctcaggtgatccacctgccttggcctcccaaagtgctgggattacaggcgtgagccactgcgcctggctg

SEQ ID NO: 49771 - DNA, 201 bp, Homo sapiens
atttttgtatttttagtagagataggctttcaccatgttgaccaggctggtcttcaactactggcctcaagtgacccacctgcctctgactcccaaagtgytaggattacaggcatgagctaccacacccagcctttttttaaaacaaaaccaaaaccaaaagagacagggtctctggtgtgcagtggtgtgatcatagct

SEQ ID NO: 49772 - DNA, 201 bp, Homo sapiens
caggcatgtgccaccatgcctggctaatttttgtatttttagtagagataggctttcaccatgttgaccaggctggtcttcaactactggcctcaagtgayccacctgcctctgactcccaaagtgctaggattacaggcatgagctaccacacccagcctttttttaaaacaaaaccaaaaccaaaagagacagggtctc

SEQ ID NO: 49773 - DNA, 201 bp, Homo sapiens
aatagaactggtaagcaaataggcttttctgttaaaccatcatgtttcttaaaggaaatcagtataattaataaacataatgtttccaaatattgtttttsttttaattatctaagaaaaaactttaaaaattttcataacactaatgcttatttattatatgaaatacagacaagtaagtagaaaaaacttacatggaaa

SEQ ID NO: 49774 - DNA, 201 bp, Homo sapiens
tgagattacaggcatgaggcactgcacctggcccaaatcttctcagttctaaatggctgtgataaaaactacattgacaatttttttttttttttttttttggagatggagtctcgctctggtgcccaggctgaagtgcaatggcgcaatcttggctcactgcaagctccgcctcctgggttcacgccattctcctgcctc

SEQ ID NO: 49775 - DNA, 201 bp, Homo sapiens
cttcctgcctttttttttttttcttttgagaccaagtcttgctctgtcacccaggctggagtgcaatggcacgatctcggctcgctgcagcctccgcctcmcgggttcaagtgattctcctgcctcagcctcccgagtagctgggattacaggcatgtgccaccatgcctggctaatttttgtatttttagtagagatagg

SEQ ID NO: 49776 - DNA, 201 bp, Homo sapiens
tattaggaagttccagtgggctaataaaagctctgggtaaacgttagttgttcttttaaatgtcctgaggtgcttatgattggagtttaaacagcacaccwgtttttcagatttcggaaccacttaagagaggcacagtgtaaagaaggtggagatgagaatatcacctttactcctgatacagtcttggagaatgcagct

SEQ ID NO: 49777 - DNA, 201 bp, Homo sapiens
aatggcagctattatcttaactattagagcggcagtttggcgtggcactaataatgatgatggtgacagtttcactgagtgcttactacctcagctattcktccaagtactttgcatcacttagctcatttaaccctcacaataaagcgataaggtaggtgctgttctaatctctgttttacagatgctaaaactcggcag

SEQ ID NO: 49778 - DNA, 201 bp, Homo sapiens
ctgtcctaccacggagtctgttttatatgagaacaagttatttaactcctctgagtgttaatttcctcatttttttcctttctttcttttttttttttttwaagggccagtccccattctcacagggtgtttggaaggagtaactgaaggggggtatataaagccgctggcagccaggcatggtggctcacgcctgtaatc

SEQ ID NO: 49779 - DNA, 201 bp, Homo sapiens
ttctgtcttccagtcaggactaatatagtacttttcagaggtgatagccagttaactgatgactttttttttttttttttttttttttttttgagatggartctcgctctgccacccaggctggagtgcaatgatgcgatcttggcttactgcaacctctgcctcccggattcaagcgattctcctgccttgcctcctgag

SEQ ID NO: 49780 - DNA, 201 bp, Homo sapiens
gaatatttctgtcttccagtcaggactaatatagtacttttcagaggtgatagccagttaactgatgactttttttttttttttttttttttttttttgaratggaatctcgctctgccacccaggctggagtgcaatgatgcgatcttggcttactgcaacctctgcctcccggattcaagcgattctcctgccttgcct

SEQ ID NO: 49781 - DNA, 201 bp, Homo sapiens
ctgtgcaaatgtaaagtttaatttttagtcattacaactcctggttagtactcaggctctgcttgatttcccctgcctttttgatgttgttaggcagcctktctgtctggatctaaatcattttctgggcttttagatccagacaagtgagagtcaccctctgagacagttccatttcacctcctggccagaccacggtgt

SEQ ID NO: 49782 - DNA, 201 bp, Homo sapiens
atttccactttgttcttttgctaccaaaacaccacgggtttggtctaggtcctgctcctcacctttacagaaagccaatcactgagatgacaaatattgcyggggaagaaagctttaatcgggtgctgcagccaaggagatgggagctgaatctcaaatccatctcgctgactgactaaaaccaggggtttatacagcagg

SEQ ID NO: 49783 - DNA, 201 bp, Homo sapiens
tgtaagggagagtggttgaggtcaagatctgggttctggttcttgtgcctcctctctggctgtgtgtccttcaacaagctgcttactgtctctgggcctcygtgccctctgcaactgggttgttggtctatttaaatacttggagaaaaaagctgggcatggtggctcatgcctgtaatcccagcactttgggaagccaag

SEQ ID NO: 49784 - DNA, 201 bp, Homo sapiens
cactgtccaggctcacacagccaatgctggagggctgtgtggcacccagagagcacagttgctgcttggaataaaccttcacttatagtccggagcagggkggttctaaagctcccttagctttcccactagtaagcttccaggttctggtacagtttctcagcctcggcactactgacgtttggagtctgatgagtcttt

SEQ ID NO: 49785 - DNA, 201 bp, Homo sapiens
ggttttcacatatatgggcagtgtcccaacaggctgctggggggtggccgtttgtgatggcctcaccagtctttcccagagagggaagtgcacatttttargctacttttgctctgactgatacacttggctgcctaacaaaaagccagagaagaactaagatttttagcatcattcaaaatgcttgccattccttttgct

SEQ ID NO: 49786 - DNA, 201 bp, Homo sapiens
gatgcttccagctttgttcttttggcttaggattgtcttggcagtgcaggcttgtaaagagcctatttctaaataagatcccactcataggtattgggggygagaaatccaacatatctttttggggcacagtttaacccatatcacctctacatttccactttgttcttttgctaccaaaacaccacgggtttggtctag

SEQ ID NO: 49787 - DNA, 201 bp, Homo sapiens
ccagggaggttgagactgcaatgagctgtgattgcgccactgcactccagtttgggtgatgcagtgagatcccatctctaaataaaaaaaaaataaataawgcccctagcatggtgcctggcacatggtaggccctcaaaagatgaccctccaaagtggccaggactcaccatgcattcagggaatatggattcttttggt

SEQ ID NO: 49788 - DNA, 201 bp, Homo sapiens
gttctgggaagcctctgtggaagggaggttttgttaagtgaactcccctggtaaacggagtgattggcccccaattagcttgctgttcggattaactgtartacatcacactttcgaaagtgaagatatgcctattttttcccctctaggtctataaagtagatttttgccattagtaaaatttaaagtgattgggggcta

SEQ ID NO: 49789 - DNA, 201 bp, Homo sapiens
taagtctgcagaactgaccccctggagagtcaccaccttggtcacagacagcagagggaggaatcaggaagtctctgctgtagttgcgggatccaggggtstatgttctgagctgtgatcctgggatcaggaagctgcagccaccgctgaggttttggttctagagccaggcagcgtgagctccagtcattgcatccacac

SEQ ID NO: 49790 - DNA, 201 bp, Homo sapiens
acatgctttccttgcactggcacattgtatgctcacaatagccctgtgatgtggttggaagtagccttattttatagataggaagccaaggctgagagagktgctagacaggtatcacagctggaaagtggcagaggtgagattaagcctctggtatttctcacctggagcctgcgcttgtaactctctttccagtgtgga

SEQ ID NO: 49791 - DNA, 201 bp, Homo sapiens
gacacaggatgcatgatgtagtaatggtgactgttggctgaccacacgccaagcttcgtgtgacatgctttccttgcactggcacattgtatgctcacaayagccctgtgatgtggttggaagtagccttattttatagataggaagccaaggctgagagaggtgctagacaggtatcacagctggaaagtggcagaggtg

SEQ ID NO: 49792 - DNA, 201 bp, Homo sapiens
ctgagcctctgtggatttatctgcagatgggacagtataggcctcacctgtctcagaagtatcatcaagagggccttggctgggctggtggctcacacctrtaatcccagcactttgggaggccaaggtgggtggatcaggaggtcaaaagatcgagaccatcctggctaacatggtgaaaccccatgtctactaaaaata

SEQ ID NO: 49793 - DNA, 201 bp, Homo sapiens
tctctgagcctctgtggatttatctgcagatgggacagtataggcctcacctgtctcagaagtatcatcaagagggccttggctgggctggtggctcacayctgtaatcccagcactttgggaggccaaggtgggtggatcaggaggtcaaaagatcgagaccatcctggctaacatggtgaaaccccatgtctactaaaa

SEQ ID NO: 49794 - DNA, 201 bp, Homo sapiens
ggaagttcatgtgcgtcacagaagagctgaaattcttgagagcactgagtgtgtgcatttctcagctcgattttggagtgtgccttttgtgaactcattaraaagcgtaatggcaaaagagcaggtcctctcgacagcacttggagaggaagctgggcgtcatgatagtaacagttttcccttctccttcctttcttctga

SEQ ID NO: 49795 - DNA, 201 bp, Homo sapiens
ttatagacaaaggctgcctttcatgggcttttgtctgtggaatccctttgacatcaggaatctgctggtaggaaacaaaggctcctcccagtggcttctcygtaaggagaatccacttaaaattaaaaaaaaaattaattttggagtagatagtacgtaaacatggcacaattttttttgttttttggacaaggtgtttgc

SEQ ID NO: 49796 - DNA, 201 bp, Homo sapiens
atctctgttttggtaccagtgccatgctcttttggttactgtagccttgtagtatagtttgacgtcagctagcatgatgcttccagctttgttcttttggyttaggattgtcttggcagtgcaggcttgtaaagagcctatttctaaataagatcccactcataggtattgggggtgagaaatccaacatatctttttggg

SEQ ID NO: 49797 - DNA, 201 bp, Homo sapiens
tgaatattctttcctcttaatatcagtatttctacagggtaattttaacacctgcctggaattgcattgtctcaaaggacccgtttcattcaatggtcccwttgaatgaaagtcaagaaggcttgctataagatctaaactcttaggggggttacctttctattatcaaataacctttattgttattggaaaaagtcagct

SEQ ID NO: 49798 - DNA, 201 bp, Homo sapiens
attacagtttacttgtgtgtaaacttaggctcagagaggctgggtaacttatcccagcttgcacaaaagaggacctgaatttgagcagaccgtaggttgarttctgtccttctatgctgcctttctatgaataatatgtttacatatatatatatatatatatatatatatatatatatatatatatattttttttttttt

SEQ ID NO: 49799 - DNA, 201 bp, Homo sapiens
tgtcttttaaggatgtggataatggtaagaggatcaccactgagggagatgcatgatgttgtgctacttgctattgcccagaacttactgtaacaataatrtaatatgctgggggtctgcgaagtgctgagtgctctcatactgcattttacatttttaacacaacttcatggagcaggtattattatcatttctgtctta

SEQ ID NO: 49800 - DNA, 201 bp, Homo sapiens
tgctgtcatccatttattcatcaacaggtagttattaggtatctactctgtgctgggccctggcctgaacttggctttggtggatgagactgacaagttcyctgttctcacagagctgagagtctggggataaagatcccttattatggtttcttttgtggtgttgtggggagagggtgatgattagggtttgggtactgg

SEQ ID NO: 49801 - DNA, 201 bp, Homo sapiens
gccactgcacccagcccacaaatatatatttatttctttcacaaacattgaggccatctgtacatgtggttttgtaatctgccttttccccaacttgccarttaattatgaatattctttcctcttaataaaatatttctacaggatgatttgaacacctgcctggaattccatcatctgaaacagagttggcagataaga

SEQ ID NO: 49802 - DNA, 201 bp, Homo sapiens
gagaagttctgctgcagtgagtgtggggcaagtttcccagacccttgttgggtcagggcaggtggttgtggcccagttgtttggccttctgcaggctgcasccctgccctgctgcctgccagtggggtgagggcctggccacctggtacttaacaagtttggttctacatgtgttcccgtgagtggaggacaaaatgaaaa

SEQ ID NO: 49803 - DNA, 201 bp, Homo sapiens
cacctgtagtcccagctacttggaaggctgaggtaggaggatggcttgagcccaggaggtcgaggctgcagtgaaccgagattgtgccactgctgcactcyagcctgggtgacaaagcaagacccggtctcaaaaaaaaaaaaaaaaaaaaaaaaagataaataagggatgggtagactatataattaccatggggacatg

SEQ ID NO: 49804 - DNA, 201 bp, Homo sapiens
tgggtagattgcaaaaattttctcccattctgtaggttgcctgttcactctgatggtagtttcttttgctgtgcagaagctctttagtttaattagatccmatttgtcaattttgtcttttgttgccattgcttttggtgttttagacgtaaagtccttgcccatgcctatgtcctgaatagtattgcctaggttttcttc

SEQ ID NO: 49805 - DNA, 201 bp, Homo sapiens
cttgagctcaggtttgagaccagcttgggcaacatgctgaaactccacctctacaaaaacaaaaccaaaccaaacccaaaaattagccaggcatgctggtrtacacctgtagtcccagctacttggaaggctgaggtaggaggatggcttgagcccaggaggtcgaggctgcagtgaaccgagattgtgccactgctgcac

SEQ ID NO: 49806 - DNA, 201 bp, Homo sapiens
ctgtgtgacagggaaagcatgtcttgtattttctctctctttcccttctgtcttttgagtttggaaaattatattttgagttacatgactaattacatgastaattttagcaaatttactagaaattgatgttctgccaatgattggaaatcccttcctcccctccactcttctaaaccaaaacagtgctgtgtcctgaag

SEQ ID NO: 49807 - DNA, 201 bp, Homo sapiens
tgggaattgaggttttgcagaatcattggaagagctggtgtattagtttgctagggctaccagaacaagtaccaaaggctgtgtggcttgaacagaaatakactttctcatagttctggaggctgaaggtcaaagattaaggcaacggcaggtgtggtttcttctgaggcctccctcttggcttatagatgactgtcttct

SEQ ID NO: 49808 - DNA, 201 bp, Homo sapiens
aatctctgctgcctcatctttaaagggggataataaactctccttcttgagcatattgtgagggtttgatgagcaagcactttatcagctgctgtgcaaawgtaaagtttaatttttagtcattacaactcctggttagtactcaggctctgcttgatttcccctgcctttttgatgttgttaggcagcctttctgtctgg

SEQ ID NO: 49809 - DNA, 201 bp, Homo sapiens
aaactcttgacctcaagtgatctgcccgcctcggcctcccaaaatgttgagattacaggcgtgagccaccatgcccctcttacattcttttcttctgttcrctacagccgtggagagctccgggttgtcctgcacatgtgcactgccctctcttttatggaccttttaggctggctgcaccctccgtctgtgtcaccctcc

SEQ ID NO: 49810 - DNA, 201 bp, Homo sapiens
ctaaacagagttgtttctaaagtgcagatctggttgtgccattccaccgtcaaaaattattttttggctccttgttgccttcagggtgataggacaggtgrctgctcacctctccagcttctcttactttctttcttcttcttcttcttcttttttttttttttttgagacggagtctttccaggctggagtgcgatggtg

SEQ ID NO: 49811 - DNA, 201 bp, Homo sapiens
tccagcacctgttgtttcctgactttttaatgattgccattctaactggtgtgagatgctatctcattgtggttttgatttgcatttctctgatggccagygatgatgagcattttttcatgtgtcttttggctgcataaatgtcttcttttgagaagtgtctgttcatatccttcgcccactttttgatggggttgtttg

SEQ ID NO: 49812 - DNA, 201 bp, Homo sapiens
aagtctctcaaattatgagctttattttaaatcctccaatctgttcggtgactatctataaataatttttgatggaacttgctgtcatttttcctgattgrcacattttgaccatgaccatctggaagtttttgctagctctgttttctgcaaggaatctatgttttattagtctcctgaagttggcttccttgtcatgtt

SEQ ID NO: 49813 - DNA, 201 bp, Homo sapiens
tgtaacagaagcccagtgctaggcaggatggggatgatagaggttatccaaggctcagttgtatgaaacagaaactgtgagctattttaaccaaaagggayttatcctgggaattgaggttttgcagaatcattggaagagctggtgtattagtttgctagggctaccagaacaagtaccaaaggctgtgtggcttgaaca

SEQ ID NO: 49814 - DNA, 201 bp, Homo sapiens
cagtgtgtcctgtcctaggtgacatcgagggcacgccgggcttcctccaagtgcacacccgtgagttcatgcctggctctcaccaccctttcctgctgtcytgctccgtgccaggcccagacacaggatgcatgatgtagtaatggtgactgttggctgaccacacgccaagcttcgtgtgacatgctttccttgcactgg

SEQ ID NO: 49815 - DNA, 201 bp, Homo sapiens
agagtgagccctggaacccaggcctgcctcgtcctgacttctgtgatctcgggcgatcacatagatcgcagtgttcgctcttgcatcatgtgtgtttgacracttttctgggtgcccctggccctagggtaagacatgcatagagtccaagtcatcatttaggtcaaatctctaaagtcaacttacaaaaaggaacaaaga

SEQ ID NO: 49816 - DNA, 201 bp, Homo sapiens
ttttcctgtggcccacctgggtgtcatagcagagtgagccctggaacccaggcctgcctcgtcctgacttctgtgatctcgggcgatcacatagatcgcastgttcgctcttgcatcatgtgtgtttgacaacttttctgggtgcccctggccctagggtaagacatgcatagagtccaagtcatcatttaggtcaaatct

SEQ ID NO: 49817 - DNA, 201 bp, Homo sapiens
aaacaacacagcaccaggaactccatcatagagaccgcaggatgctgtgtgcgcgcacatgcgtgtgcacctagtgagatgtaaacatttacctggagtaraagaaattctttccccagagcccaaatttggctagtctccttatgtacacagctttgacagggattccatatgttttgctcatctttgcttttttgcagc

SEQ ID NO: 49818 - DNA, 201 bp, Homo sapiens
taggtgttacttctcaccgaagttcccagatagcacaggctttgctaaacaacacagcaccaggaactccatcatagagaccgcaggatgctgtgtgcgcrcacatgcgtgtgcacctagtgagatgtaaacatttacctggagtaaaagaaattctttccccagagcccaaatttggctagtctccttatgtacacagct

SEQ ID NO: 49819 - DNA, 201 bp, Homo sapiens
acacacacacacacatacagataaacaaacacacatttccacccaccccagagcaccctgcacttttcaagtgactagttaggtggggcagggttaaggaraccatcagaggacattgttgaggcacccaagacacgacagaaagccacctctagggctgaagggctagaggaggacagggtgtttctggagcccagtgag

SEQ ID NO: 49820 - DNA, 201 bp, Homo sapiens
aactcctgacctcaagtgatctgcccgctgcagcttcccagagtgctgggataacaggcgtgagccacaccgcctggccgcttttgccttttcttgacatygccaatgcatcctgtccccgagcgtctctgagttttaagtctcagatttgttttctttggagacaaactgcaggtaggtgttacttctcaccgaagttcc

SEQ ID NO: 49821 - DNA, 201 bp, Homo sapiens
ggctcctatgtgggtgcggttggcagtggtggggtgtcctgcacatggtaagcttgcgtgagagagtgaaaggggctgaaatctggtctgtgtgccctgcrtcaagccatgcacccagggctgggtccagccaggggaaggtccctttgactgatttgctaaaaggacttgtagatttgtgtgggcctggggtccctgctt

SEQ ID NO: 49822 - DNA, 201 bp, Homo sapiens
ctattggtaacaaccctcatttttttgagcacttgctatgctgctaactgctttatgcacactatttctttaatccttaacactatttctttaatccttayatctacccatgagatagggttttgttattcaggcagtggcaaaacctgcggcttagagaggttaaaaaaaaaaaacaacaaactgcctcaaacaaagtca

SEQ ID NO: 49823 - DNA, 201 bp, Homo sapiens
aagaaaacagagctacagagtgggtgtcaggatccttgcttgcgagtgacagaaaccagactttggatagctcagacagaaggaacaatttattggctcaygtggattttcctgctagcgggaggccttagagaaagagatgaggcaattctcatccctccctcttgcttctttctgttcatcagcttcattctcagagca

SEQ ID NO: 49824 - DNA, 201 bp, Homo sapiens
tttgggaggctgaggcaagtggatcacttgaggtcaggagttcgagaccagcctggccaacatggtgaaacccccgtctctactaaaaatacaaaaattasctgggtgtggtggcgggtgcctgtagtcccagctacttgggaggctgaggcaggagaatcacctgaacctgggaggcagaggttgcagtgagctgagatc

SEQ ID NO: 49825 - DNA, 201 bp, Homo sapiens
aaactttttagagtctggcacccaggaaagttagaggcccctttagctttctatctaacagctgtgtcaacccaagttgggccttcagaggaacttatcaygtctgctggttgatgttggcgttgtcatttgcaggtttcatagcatttgcagaggatccccaggataactccatgaggaggacaggcacttaatctgcat

SEQ ID NO: 49826 - DNA, 201 bp, Homo sapiens
gagttcctgtcaagagtgttggcagtgaagttgttccccttggcaatttctatgctgatctcgggttactgcatgagacacagaatctgcgtttccctccmttcagcatcactggggaggacagccttactttggagttttttttctgatcagttacatgatggtttcatctttaagactactgataacaggcagctctgc

SEQ ID NO: 49827 - DNA, 201 bp, Homo sapiens
ttataaagggcttttcctccacattttagtttgatcccccacctgcatgaggaaggaaggaaacgtgttctgattttacaggggaacacattggggctgakaacagcaataggaattgaaactttttagagtctggcacccaggaaagttagaggcccctttagctttctatctaacagctgtgtcaacccaagttgggcc

SEQ ID NO: 49828 - DNA, 201 bp, Homo sapiens
ccaggcgcggtggctcacgcttgtaatcccagcattttgggaggccgaggtgggcggatcacttgagtccaggagttcgagaccagcctggccaacatggkgaaacctcatctctaataaaaatacataaaattaggtgggcgtggtgatgggcatctgtaatcccagctactcaggaggctgaggcaggagaatcgcttg

SEQ ID NO: 49829 - DNA, 201 bp, Homo sapiens
tgttgctgagctagaattaaagtccacacacggccaggcgcggtggctcacgcttgtaatcccagcattttgggaggccgaggtgggcggatcacttgagkccaggagttcgagaccagcctggccaacatggtgaaacctcatctctaataaaaatacataaaattaggtgggcgtggtgatgggcatctgtaatcccag

SEQ ID NO: 49830 - DNA, 201 bp, Homo sapiens
ggttaaagctacaagttaggacccctgaaaatgaaagatggtttggaagtgaatctgaagtaaattgtcactgtatggtttcagaccgttttctggtagtwtgtgctgtgtgacacaggttgtccctgtgttgtgcagtggttttgagcacaacattggccctaggcctgcagtgtggggtgcaggccctctgctgagggc

SEQ ID NO: 49831 - DNA, 201 bp, Homo sapiens
ctgggcgtggtggctcacacctgtaatcccagcactttgggaggctgaggtgggtggctcacctgaggtcaggagtttgagaccagcctggccaacgtggkgaaaccccgtctctactaaaaatacaaaaattagccaggtgtggtggcgggcacccataatcccagctacttaggaggctgaggcaggagaattgcttga

SEQ ID NO: 49832 - DNA, 201 bp, Homo sapiens
tcaaccaatttgtggagagtccattttgcaaagccttagcacagtgccaagcacaagctacacacccgggatgctgctgaatgcagatgagagcatgccarctctgctgaagttgggggctgggggcagtggatggctgtgagtggtgtgaagccccgggccacagtgaagaccctggaatggctgagagactgggattcc

SEQ ID NO: 49833 - DNA, 201 bp, Homo sapiens
atgtttgttcacagagccattcaaagtgcagtggatacattataaattgtacaattatttgtaattaaaaaaagaacaacagcaaaaaacccaaagtgcartggatgcaaagaccaatggattttcatgtaacagaatatgaaaagttcaccgacacagtttcacattccacgatgcagagaagtttttaataactgccat

SEQ ID NO: 49834 - DNA, 201 bp, Homo sapiens
tacgtagtgtgacctctagtcagcaaatggccacttggctgtattttaaatttaggtacactttgctgcttggggtccatcttgaggggattgcctttttyaggttcatgtttgttcacagagccattcaaagtgcagtggatacattataaattgtacaattatttgtaattaaaaaaagaacaacagcaaaaaacccaa

SEQ ID NO: 49835 - DNA, 201 bp, Homo sapiens
ccccttggtgctgggatattgaatgtgctgcttacttgaaatgtcttggtaatttaaaatgatattatttgcattatcttgaattgagacctttagattaktaaacagtcactttatttgaggctttgttcctgatatctaaaacacatacaattaaatgctaccatttaaaagggacagtttagaagagtgtccagtcac

SEQ ID NO: 49836 - DNA, 201 bp, Homo sapiens
aagagcatagaacttggaaatggtcatgaggacaaggtgaccccgagggggtggctgtgggaaaggggatgcggaggtgcaggaagcaccggtagaggggytgagtgtccttatctagcttaaagccctgagcacagggctgcatgggagcaggtccatcagctgctgcgtattgagcacggcacatgtgcctctctgtcc

SEQ ID NO: 49837 - DNA, 201 bp, Homo sapiens
gaaagagagggaaaggagagcacagagagatgacagaagagaagagaatgagagaaaagagcatagaacttggaaatggtcatgaggacaaggtgaccccragggggtggctgtgggaaaggggatgcggaggtgcaggaagcaccggtagaggggctgagtgtccttatctagcttaaagccctgagcacagggctgcat

SEQ ID NO: 49838 - DNA, 201 bp, Homo sapiens
ccagctaatttttttttgttttttttgtttttttagtagaggtggggtttcaccatgttggccagggtggtcttgaactcctgacctcaggtgatccaccygccttgacctcctaaagtttggtctctttttgtatcagcttctatacagacttaaccccatttttaagtcacagccagcatggtcaacttctgtcagttt

SEQ ID NO: 49839 - DNA, 201 bp, Homo sapiens
cttgaaatcctgctcagcactcagcacagtgcacatgctgcttcctccatgggcattctgggatcccattaggaggacttgagttctgtgtgctcagactrccttgtttcccctgttgcttgttaccaatattcagcatttctttaattctgcctttttgtaatgttagttttttctgtgtacagtacacctctcctccag

SEQ ID NO: 49840 - DNA, 201 bp, Homo sapiens
gagtagctaggattacaggtgactgccaccacacccagctaatttttttttgttttttttgtttttttagtagaggtggggtttcaccatgttggccaggstggtcttgaactcctgacctcaggtgatccacccgccttgacctcctaaagtttggtctctttttgtatcagcttctatacagacttaaccccattttta

SEQ ID NO: 49841 - DNA, 201 bp, Homo sapiens
gcaagctctgcctcccaggttcacgccattctcctgcctcagcctccagggtagctgggactgcaagcacctgccaccgcgcccagctaatttttttttgkatttttaatagagatggggtttcaccgtgttagccaggatggtcttgatctcctgaccttgtcatccgcatgcctcggcctcccaaagtgctgggattac

SEQ ID NO: 49842 - DNA, 201 bp, Homo sapiens
aatggggagagggactcattttgcatctttgatctctcttttttattttgagatggagtctcggtcttgtcgcccaggctggagtgcagtggcgcgatctyggctcactgcaacctccacctcccgggttcaagtgattctactgcctcagcctcccgagtagctaggattacaggtgactgccaccacacccagctaatt

SEQ ID NO: 49843 - DNA, 201 bp, Homo sapiens
agggcccttttcaaggtttgaaataaggctccatgacaatggcctgatttggatgggtcttggaatacccttttttttttttttttttttttttttgagayggcgtctcgctttgttgcccaggctggattgcagtggcgcgatctcagctcactgcaagctctgcctcccaggttcacgccattctcctgcctcagcctc

SEQ ID NO: 49844 - DNA, 201 bp, Homo sapiens
gttatcatgtgcttctgcgtcatgcagcgttttctgagaatggggagagggactcattttgcatctttgatctctcttttttattttgagatggagtctcrgtcttgtcgcccaggctggagtgcagtggcgcgatcttggctcactgcaacctccacctcccgggttcaagtgattctactgcctcagcctcccgagtag

SEQ ID NO: 49845 - DNA, 201 bp, Homo sapiens
attcaactataaaatcatgcctgctggcctctgagcagtaggcagggctggtgtatgccggaggccaccaggggacataacacctgccatagggtcagaayaggtgggtgttagtcaccatccagatggtcagataccggaattgccacagaaatgaacatgacatgcagagcaggcagagcaggtgccaaaagttggtat

SEQ ID NO: 49846 - DNA, 201 bp, Homo sapiens
aggtcacacagctaatggatggagcaggtctttaatcccagatctgggttccaagaccagtccttttctctttacgctgctctgtccctgctatctttatktcagaaaaccactgagcttccttctagatgtcagggtttggcaaaaaagttatcatgtgcttctgcgtcatgcagcgttttctgagaatggggagaggga

SEQ ID NO: 49847 - DNA, 201 bp, Homo sapiens
gtcatttcattcattctgagtggcatctgcgccagggctacctggagtttttccagctccccaggcctagcaaaggcagggatcctgtctcattcagctgyatttcttgagctgtgcttagaaggcctgccacacagtagggaatcaggaacagtcgcgtttacagagctctcgggtgatagaagggaaagtaaaggtata

SEQ ID NO: 49848 - DNA, 201 bp, Homo sapiens
acatacttgtacagcatctgggacatggacggcctctcaaaaggagtgctgctgttcttgctacctgcaccactgtaactgatgttgtttcatcatcctcrtcaccatcattgttattgattgtaaatggaagcacagtggtcatcttccaaatatgccactctgactctgtgaacttgtcactttataaagaggaaattc

SEQ ID NO: 49849 - DNA, 201 bp, Homo sapiens
ctcccgagtagctgggactacagacgcatgccaccacagccggctaatttttgtatttttactacaggcagggtttcaccatattggtcgggctggtctcraactcctgacctcaagtgatccacctgccttgcccttccaaagtgctgggattacaggcgtgagccactgtgcctggtcttatatttcttttctattttt

SEQ ID NO: 49850 - DNA, 201 bp, Homo sapiens
cattagctgggcatgatggtgtgtgcctttaatcccagctacttgggaggctgaggcaggagaatcgcctgaacccgggaggcagaggttgcagtgagccragatcacgccactacactccagtctgggtgacgagcaagacttcgtctcaaaaaaaaaaaaaaaaaaaaaagaaataatggtgccatacctttctcatga

SEQ ID NO: 49851 - DNA, 201 bp, Homo sapiens
aggcaggagaatcgcttgaacccaggaggcggaggttgcagtgagccaagatcacgccattgcactccagcctgggcggcaagagcaagactccgtccctwaaataaataaataaataaataaataaataaataaataaataaataaaataaaataaataaaaaaagaggttaaggtttatacgcaggccatttctaatag

SEQ ID NO: 49852 - DNA, 201 bp, Homo sapiens
agcccgtgggtcctgcccttccaggctgccaagagtttaagttgctgcctcccggtctctgtgcccttttcctgcctgtggaaggccctctctctgtttargaacgtggatgtggcaggggctgggcgggcacttggcctttataacaacagaagaggattttcagtgacgaggaagcatcccgcccttctggttccctgt

SEQ ID NO: 49853 - DNA, 201 bp, Homo sapiens
gattttgtaaccctttacattctggaaactgttcaacatgacttcttttttttttctttcaaccaatttgtggagagtccattttgcaaagccttagcacrgtgccaagcacaagctacacacccgggatgctgctgaatgcagatgagagcatgccagctctgctgaagttgggggctgggggcagtggatggctgtgag

SEQ ID NO: 49854 - DNA, 201 bp, Homo sapiens
tgtcccacctgagagtagtagcatctgagggctagccacactgaacaagccacacacctgacctcagcatcctcttctgtgaggggaatgctctctgctcytctacctgcatgcaccgtgtttgtggaagtgctctgtgtaggacagggaaagcaccttgcagagagcaagggcccactggctgcagagagcctggtgggt

SEQ ID NO: 49855 - DNA, 201 bp, Homo sapiens
gtgctctgtgcacctgggatagagcaggagcaagacacatcattcctgccctcacagggttatggtctcctaggtgacaaggtagtgcacacttccatagstcttactctgggacaagtactgtgccaaatgcttcctcccagccgcctgatgaggtagctactgttagttatcaagtctgatttacaggtgaggcaaaga

SEQ ID NO: 49856 - DNA, 201 bp, Homo sapiens
cactggtcctatccactccacctagcctggaggcttaattacttccagaacctttagagggagggagatggcatggctctttcttggaaagtctggaaggrcaccatgggctagaggggacagacacatgcctcatgtggcctcacaggtcagcctaggacctgtgacagtgacagggagacaggtttggcttaacacaag

SEQ ID NO: 49857 - DNA, 201 bp, Homo sapiens
aagtgattctcttgcctcagcctcctgagtagctgggattacaggctcccactaccatgcccagctaatttttgtatttttagtagagatggggtttcacsgtgttggccaggctggcctcaaactcccgacctcaagtcatctgcccatcttggcctctcaaagtttgtgattacaggtgtgagccaccatgcccaggag

SEQ ID NO: 49858 - DNA, 201 bp, Homo sapiens
tgtggtggcacatgcatgttgtcccagttgcttgggaggctgaagtgggggggatcacttgagcctgggaggcaggttgtgccaagattgtgtcactgcaytctaacttgggtgacagagtgagatcctatctcaaaaaagaaaaaaaggtaacgcttagatgaaattctgctaaatttttctctagatagcaatttacac

SEQ ID NO: 49859 - DNA, 201 bp, Homo sapiens
cgtcatctctaccaaaaaatacaaaaaattagccgagtgtggtggcacatgcatgttgtcccagttgcttgggaggctgaagtgggggggatcacttgagmctgggaggcaggttgtgccaagattgtgtcactgcactctaacttgggtgacagagtgagatcctatctcaaaaaagaaaaaaaggtaacgcttagatga

SEQ ID NO: 49860 - DNA, 201 bp, Homo sapiens
ggaaggctgaggcaggagaattgcttgaacccagagggcagagattgcagtgagccgagatcgcaccactgcactccagcctgggcaacagagcaagattytgtctcaaaaaaaaaaaaaaaaaaaaaaaaaaaaaaaaagcaagctcatacctccagcctgggttttgagagcctgtctgaaaaaaacaaaacaaaaccc

SEQ ID NO: 49861 - DNA, 201 bp, Homo sapiens
agcataaaataacctgttataactataagattctttttataagcctcatggtaaccacaaagaagaacctttagtagatacacaaaaaataaaaagcaagraatcaaaacatactactagagaatatcacttaacctcaaaggaagatagtaagagaggacggaaggaacaaagagtctataaaacaaccaaatggcagta

SEQ ID NO: 49862 - DNA, 201 bp, Homo sapiens
cttcttcaaatatacagacatcaacacagagtcacaaggatcaagaataatcagggaaacgtgatattaccagagaaacaaaataaagtgcaagtggttgmccataaagagatgggagatgtatgaactgtctgacagagaattcaaaatacatgttttaaggaagcctagcaaactttaagaaaatacagataaagaatt

SEQ ID NO: 49863 - DNA, 201 bp, Homo sapiens
gattacttgagccagggaggttgagactgcaatgagctgtgattgcgccactgcactccagtttgggtgatgcagtgagatcccatctctaaataaaaaawaaataaataaagcccctagcatggtgcctggcacatggtaggccctcaaaagatgaccctccaaagtggccaggactcaccatgcattcagggaatatgg

SEQ ID NO: 49864 - DNA, 201 bp, Homo sapiens
aaaccccgtctctactaaaatacaaaagaattagctgggtgtagtggtgcatgcctataatcccagctactcaggagacagaggcaggagaatcgcttgamtccgggaggaggaggttgcagtgagccgagattgtgctatagcactccattctgggcgacaagagcgaaactctgtctcaaaacaaaacaaaacaaaact

SEQ ID NO: 49865 - DNA, 201 bp, Homo sapiens
ttgtgagataaaataattagattgtactcatggaagcatatatgggcagatcttgctgaaatcttctaataaagcaaatctcaattaataatggtaattaragcctgtgcaaacaatgggaagagtactgccgttggtttttcttcctgttaattagtttaataaataaactggtgggtaccttgtacaggcttgaatcac

SEQ ID NO: 49866 - DNA, 201 bp, Homo sapiens
ggggaggctgagcccatgcgtggacccttaggctgagcccatgcctgcttcagatgttccacacctttcaccacaatttatttatttatttattttttgaracggagtctcgctctgtggcccaggctggagtgcagtggcgtgatcttggctcactgcaacctccgcctcctgggtttaagcaattctctgcctcatcct

SEQ ID NO: 49867 - DNA, 201 bp, Homo sapiens
gggtggagtgcagtggtgcaatcacagatcactgtagccttgacttcccaggctcaggtgattctcccacctgagcctcccgagtagctgggactacagcygtgtaccactatgtctggctaattttttgtatttttagtagagatggggttttgccatgttgcccatgctggtcttgaactcccggcctcaagagatcct

SEQ ID NO: 49868 - DNA, 201 bp, Homo sapiens
atcactccattgcactccagcctgggcaacaagagtgaaactccatctcaaaaaaaaaaaaaaaaaaaaaaattaaaaataatagtagttggtagtttttwaaaaaatgtaccttttaggaaaaaaaaaaaaaccatggtttttgtttctccccaaaatttgggaactttttttttcctgattggtaaaatctcagtttgt

SEQ ID NO: 49869 - DNA, 201 bp, Homo sapiens
aggggaggctgagcccatgcgtggacccttaggctgagcccatgcctgcttcagatgttccacacctttcaccacaatttatttatttatttattttttgrgacggagtctcgctctgtggcccaggctggagtgcagtggcgtgatcttggctcactgcaacctccgcctcctgggtttaagcaattctctgcctcatcc

SEQ ID NO: 49870 - DNA, 201 bp, Homo sapiens
acaccatctgtactaaaaataccaaaaaaattagccaggtgtggtggcatgcacctgtaatcccagctacttgggaggctgaggcaggagaatcgcttgascctgagaggtggaggctgcagtgagccgagatcactccattgcactccagcctgggcaacaagagtgaaactccatctcaaaaaaaaaaaaaaaaaaaaa

SEQ ID NO: 49871 - DNA, 201 bp, Homo sapiens
ttctgactctattttgctggcttgttatgagtcagtcatttttttttaatgaaatgaatacctttgtcttaatatgaagctaggcatatatgataaaggtyagatgatttttcaaatatgaaatcagaattctacccatactcccaaattagagagcagtctgatgtgttcccctttactgtgaccagtggcttcataggg

SEQ ID NO: 49872 - DNA, 201 bp, Homo sapiens
ttctataagaattgaaggccgggcctggtggctcatgcctgtaatcccagcactttgggaggctgaggcaggtggatcacctgaattcaggagttcgagamcagcttggccaacatggtgaaacaccatctgtactaaaaataccaaaaaaattagccaggtgtggtggcatgcacctgtaatcccagctacttgggaggc

SEQ ID NO: 49873 - DNA, 201 bp, Homo sapiens
ttgaactggggagtggtgtttggagcctttgggtggggtgggctgtgaggagcctgtgtgtgtgtctgcccttactgggctgggtttagggcaagcttcaygtgcttcctttcttttaagggactctctgagacagggttattatcccctttttgcagatgagggcactcaggctcagtgaggttaaataagctgcatggc

SEQ ID NO: 49874 - DNA, 201 bp, Homo sapiens
actaccagcagtagagcacaccttagaatactgagtgtgtgtgcgtgtgtgtgtatgtggggggtgtgtgtgtgtgtgtgtatgtggggggtgtgtgtgtstgtgtgtgtgtgtgtgtgtgtgtgtgtgtgtgtgtgtgtgtagtcatttgccaaatgggtattcagatattcttggagagcaggtgtttcctggttattt

SEQ ID NO: 49875 - DNA, 201 bp, Homo sapiens
gctattttttttgtatttttagtagagatggagttttgccatgttggctggtcttaaactcctgacctcaggtgatccacccgcctcggcctcttaaagtkctgggattacaggcatcagccaccgtgcctggctcatttcatcatcattttaagtggctacagagtattcaactgtatgacagtaccatgatctagttaa

SEQ ID NO: 49876 - DNA, 201 bp, Homo sapiens
tagctttgaaaactaccagcagtagagcacaccttagaatactgagtgtgtgtgcgtgtgtgtgtatgtggggggtgtgtgtgtgtgtgtgtatgtggggkgtgtgtgtgtctgtgtgtgtgtgtgtgtgtgtgtgtgtgtgtgtgtgtgtgtagtcatttgccaaatgggtattcagatattcttggagagcaggtgttt

SEQ ID NO: 49877 - DNA, 201 bp, Homo sapiens
ttttgagacagagtttcgttcttgttgtccaggctggagtgcaatggcgtggtcttggctcactgcaacctctgcctcctgggttcaagcgattctcctgyctcagcctcccaagtagctgggattacaggtgcccgccaccatgcctggctattttttttgtatttttagtagagatggagttttgccatgttggctggt

SEQ ID NO: 49878 - DNA, 201 bp, Homo sapiens
aaaacccaaaacaactcaaacttctcaggtgagtcagataatcaattagctttgaaaactaccagcagtagagcacaccttagaatactgagtgtgtgtgygtgtgtgtgtatgtggggggtgtgtgtgtgtgtgtgtatgtggggggtgtgtgtgtctgtgtgtgtgtgtgtgtgtgtgtgtgtgtgtgtgtgtgtgtag

SEQ ID NO: 49879 - DNA, 201 bp, Homo sapiens
aaagaaccaccctgacatggagctggtattatccacaggttacaatggactggacctcctcttccagtcccatataatttttttttttttttttttttttwaattttgagacagagtctcactctgtcgcccaggctcgagtacagtggtgatcttggtttactgcaacctctgcctcccaggttcaagcaattctcggtc

SEQ ID NO: 49880 - DNA, 201 bp, Homo sapiens
agaccagagatctcatgggtttgtgtttcttcattgatacttttaaggggagcaacttaatcagtgggaaaccagatctcaaaggatgggacagataaacscagggtacagagaagagcttgggggagtgtcaagcttatttgcccaaaagggctgaccctaccttaccgccattaatacatgtccttcatgcatccctgg

SEQ ID NO: 49881 - DNA, 201 bp, Homo sapiens
ctttgatgagcttttccaggaatatggactggtctgccctgatctacttgaataatctgtctcaggccctattcggtaaatacatgtaggaggtgcagctsccagggaagggagggatgttacctggagaggacagagtctgaagttcaggaaatacagcaagagccttcctcagggatgaaacatgtgatcttatggtct

SEQ ID NO: 49882 - DNA, 201 bp, Homo sapiens
agagatatgccctgtcaaagggagatcccattgcaaagagattcactgccaagttccccctcccactagctccctggagcaattttcagcttttagagtgkttagaggcctcagggtgtaaagcgagagagagaatgccttccagccagcgagagagaatgccttccagccggtgacattgagaatagcaggaaagaggca

SEQ ID NO: 49883 - DNA, 201 bp, Homo sapiens
aaggtttaccatttattaggagctttgagaccaagttccttccacacaagagatatgccctgtcaaagggagatcccattgcaaagagattcactgccaarttccccctcccactagctccctggagcaattttcagcttttagagtgtttagaggcctcagggtgtaaagcgagagagagaatgccttccagccagcgag

SEQ ID NO: 49884 - DNA, 201 bp, Homo sapiens
aagttattctggtttgcagactgggagacaggtttaatgacacagtcatgtcagagagaggggaagaggagaatacgtagggggtctgttttgatgtgtawgtacatgtaggattttcatgtagaggagttggggaaaattttagaagttttaggtgtaaatgcagctggtaagatccttatgacttagtttctttttttt

SEQ ID NO: 49885 - DNA, 201 bp, Homo sapiens
ttcaatacaacatcaacccgtatcttctaccatcaaataagacaaagggagaccccttgggcacagaaggtggcttgggtgagttacaaagggtaccttcygtctcccttactggttcttactttcagtaactaaatgttctaaaaaataaattgctcttccatgtgtatggagatttagaatttataaagggcttttcct

SEQ ID NO: 49886 - DNA, 201 bp, Homo sapiens
atgtaaatgatgagttaatgggtgcagcacaccaacatggcacatgtatacatatgtaacaaacctgcacgttgtgcacatgtaccctagaacttaaagtrtaataaaaacatatatatatatataaaagaaatgggacagattccttgaaacacacatgaaatgagttacgcttttgagattctccttgaagaagcttct

SEQ ID NO: 49887 - DNA, 201 bp, Homo sapiens
gaggattgcttggcccaacagttgcagactagcaccagcctgggagaccctgtctcaaaaaaaaatttttttttatagaaacagtttaaattattaaattrtttctaggcctacaggagaaacttctgggaaatcctagagagtaatgttcattattgttgttttaaaattttgaaataattgttttttggaaaggttgaa

SEQ ID NO: 49888 - DNA, 201 bp, Homo sapiens
aggaaatgcatactttgatagaaaatggacaaaaaagttgtattggtagaattaaatgaactaatgcatgtcaagcactgagcactttgactcaatagtamtaataataataataacacaatgtatcattatgatagtgttatatctctttagcaatcttgatagttgacttgtataattcacagtacagaagcttattct

SEQ ID NO: 49889 - DNA, 201 bp, Homo sapiens
ccaggctggtctcgaactcctgacctcaggtgatccacccgtctcagcctcccaaagtgctgggattgcgggctgggattgcgggcatgagccaccatgcycaacaacagatttattataagcaaaagctctttggggtcctcaataattttaagagcataaaggagaccaaaaagtttaagatgtgctggtcaagacaga

SEQ ID NO: 49890 - DNA, 201 bp, Homo sapiens
aatagaggcagtgccatgaagcagcattggtatctgttgatgggtgtgtgcattggcataactctctgctgtttatatcacaggcctaaacattaggcatrtgctggcttgaagtctgagactatcctaaggaaataatctgaaatgcaaccaaaggcttattcagaaagacgagtctcagcattatttataatagaggaa

SEQ ID NO: 49891 - DNA, 201 bp, Homo sapiens
tgaagggactaattctaggtcacacagctaatggatggagcaggtctttaatcccagatctgggttccaagaccagtccttttctctttacgctgctctgyccctgctatctttatgtcagaaaaccactgagcttccttctagatgtcagggtttggcaaaaaagttatcatgtgcttctgcgtcatgcagcgttttctg

SEQ ID NO: 49892 - DNA, 201 bp, Homo sapiens
gggctaatatatcccaccacataggaaataccactgttaacattttactgtaaataattctgtaacctttagaattctcacaaacaccacacacacacacmccccatatgtgcacacatgcatacatcttcatcttcatgtatttgctttcatctttttgcaaaactggaatcaaacatgttcatatttctttttaagatt

SEQ ID NO: 49893 - DNA, 201 bp, Homo sapiens
caagcttccaagttctgatagccatcccatcccttctggggtttcacagctctatttggggctgaacgtggcagatctctggggcctccaacatgagagcytgggctttacattcctgcaggcaggtgaagcctcctgacccaaaaggtgagtagtgggcccctgttggggccagcagttttggatgatgccactagatgg

SEQ ID NO: 49894 - DNA, 201 bp, Homo sapiens
tttcaccgtgttagccaggatggtctccatctcctgaccttgtgatccgcccgcctcggcctcccaaagtgctgggattacaggcgtgagccacgacgccyggccaagcttccaagttctgatagccatcccatcccttctggggtttcacagctctatttggggctgaacgtggcagatctctggggcctccaacatgag

SEQ ID NO: 49895 - DNA, 201 bp, Homo sapiens
gccaaagttgtcccagaacttttctgcccacagtgttggtttagaggaggcagggagacactgtattgctgacctgttatctgcatacttaaaaaaaaaamaaaccaaactaggctaccctgcaaaatagcacagcattctctgctcctagcacttagtttgataaaaactaccttacccaggtatagcctaggaattgag

SEQ ID NO: 49896 - DNA, 201 bp, Homo sapiens
aacctcccgagtagttgggactacaggtgcctgccaccacacccagctaatttttttgtatttttaatagagacagggtttcaccatgttggtcaggctgrtgtcgaactcctgacctcgtgatccacccgccttgtcctcccaaagtgctgggattacaggcgtgagccaccgctcccggctaatcttataaggacacga

SEQ ID NO: 49897 - DNA, 201 bp, Homo sapiens
agcttgcagatggctgtcttctccccatgcctccacatggtcttccctctgcttgtctgtgtcctaatctccttcttttttttttttttttgagatggagycttgttctgtcgcccaggctggagtgcagtggcatgatcttggctcactgcaacctctgcttctcgggctcaagcgattctcctgcctcaacctcccgag

SEQ ID NO: 49898 - DNA, 201 bp, Homo sapiens
agggttggtttcctgtgaggccttttttttttttctttttttgagacagagtctcactctgttgctcagagtggagtgcagaggcgtgatctcagctcackgcaacctctgcctcctgggttcaagcagttctcctgccccagccttcaggcgcctctcttcgtagcttgcagatggctgtcttctccccatgcctccaca

SEQ ID NO: 49899 - DNA, 201 bp, Homo sapiens; identical to SEQ ID NO: 9373

SEQ ID NO: 49900 - DNA, 201 bp, Homo sapiens
ttcagagggggccttggctcagtaggtgtgaatcagggaagccacattgtcctcagggtgctgtatgaagctgggtgtgggcggattcctcccacaccttyacactggcctgcctccaactcatacagatctcggagcggtcggtacttcattcataggtccctgttcaggcagcagttctgtgggctgtggccctctccc

SEQ ID NO: 49901 - DNA, 201 bp, Homo sapiens
agggtgaaccacacttttaaagccccggctgtggttcggagggttagtgctgtatgccttttatttccctttccctttgaggtactgaaaggatgaaaagktggtgtcatgttttggggagaatcttacttctcaaatggaaattgcactttttgctgaatcctttgcatttttttggtagtaagcagttcattgagtatc

SEQ ID NO: 49902 - DNA, 201 bp, Homo sapiens
aaacaaaacccaaaacaactcaaacttctcaggtgagtcagataatcaattagctttgaaaactaccagcagtagagcacaccttagaatactgagtgtgygtgcgtgtgtgtgtatgtggggggtgtgtgtgtgtgtgtgtatgtggggggtgtgtgtgtctgtgtgtgtgtgtgtgtgtgtgtgtgtgtgtgtgtgtgt

SEQ ID NO: 49903 - DNA, 201 bp, Homo sapiens
ctccgtctgtgtcaccctcctgctcctcctccacctggctagttcctgttggccacttttggaaattcatgccagtccagtccaccctgagtacatcctckttctgtgtcactgagctcactatgctgggttttatctatgtctccctcgcaactagatcattcacgtcttgaagttaggcatcatgcgttcttcatttct

SEQ ID NO: 49904 - DNA, 201 bp, Homo sapiens
aatgtgagggggcagtgagaccagaggggctagtgggctgtggctgagtttgaattttattctaagtgtcatggaaagtaggaggacggttttttccaccrgggtcctttttgattattttattcttcgtgacgatcctacttaaaaaaaaaaatcttattcaccaaaaaggtgtgtttgtgaaacaatagagtgtacaac

SEQ ID NO: 49905 - DNA, 201 bp, Homo sapiens
aaggtaatgcatttacatgttacataaaattcatatcatacagaaaggcagaaggaaaacagggagaattacttgttcccttttctctcttcccctcccarttcctttaacaggaagaatgtctcactagtcatgtgatctacagcaaatcctttaacctcttcaaacccgcatctcttatatgttacaggacagtaataa

SEQ ID NO: 49906 - DNA, 201 bp, Homo sapiens
tctcagctcttagccatcactccatggttctgtgctgagacaagggatgtagaaagcccagcacagtgtctgttacatagtaggtgcttagtaagttagasttcctttttatcctcagaatgcgtttgcaagtatagcctcccacagtgcttttactttaatctttccccttactgggcaaaaaaatgtttgctgccctgt

SEQ ID NO: 49907 - DNA, 201 bp, Homo sapiens
aagctacacacccgggatgctgctgaatgcagatgagagcatgccagctctgctgaagttgggggctgggggcagtggatggctgtgagtggtgtgaagcyccgggccacagtgaagaccctggaatggctgagagactgggattccaggagaccgaggtttgaggggaggcttttcattgtttgattagctctttttttc

SEQ ID NO: 49908 - DNA, 201 bp, Homo sapiens
ggaggatcacttgagcctgagaggttgaggctgcagtgagccgtgatcgtgccattgtaccccagcttgtatgacagagtgagactgtctcaaacaaacamacaaacaaaaaacagaaaacaaaacccaaaacaactcaaacttctcaggtgagtcagataatcaattagctttgaaaactaccagcagtagagcacacct

SEQ ID NO: 49909 - DNA, 201 bp, Homo sapiens
atcgagaccatcctggctaacacggtgaaaccccatctctactaaaaatacaaaaaaaattagctgggcatggtggtgggtgcatgtagtcccagctactygggaggctgaggcaggagaatggcgtgaacccgggaggcggagcttgcagtgagccaagatcgcaccactgcactccagcctgggggacagagcgagact

SEQ ID NO: 49910 - DNA, 201 bp, Homo sapiens
ttttagatagtacaaaagaaaataacttcacaaatttgtaattagcatttgcagcttgggtcattaagtttagtattagggggcaggatttggtgtcagckgtgaactaatgcctgaggaaaaggtgtaacacctttatttcatagatgacatcaactccagatacacaagggaaaagcacaggaaggaatccttttttgt

SEQ ID NO: 49911 - DNA, 201 bp, Homo sapiens
ggtgggaggatcacttgagcctgagaggttgaggctgcagtgagccgtgatcgtgccattgtaccccagcttgtatgacagagtgagactgtctcaaacamacacacaaacaaaaaacagaaaacaaaacccaaaacaactcaaacttctcaggtgagtcagataatcaattagctttgaaaactaccagcagtagagcac

SEQ ID NO: 49912 - DNA, 201 bp, Homo sapiens
cctcttgtctgtgtagtgtgtgaagcctgtgtgtgttagttgggatttctttgctgtaaggtgctgccaaccagggaatctccatcctgccttaggggtcytcatgcggcccaggccggttccttgtgctgccaccctgccctgttggagtgacaggcagagctcatgctccagcttttaggttaggttctgttttttttt

SEQ ID NO: 49913 - DNA, 201 bp, Homo sapiens
ccgacctttccccttcctggcatttccataggggctgaggcagagcagctgaaggggcattcccatttcacagatggggaactgagggagagaagtgaaakagcggagcacccagcccgtgccatgggagctgagccagcgggcacgtcctcttagcctctggagcctgttggggtttgaacccgcaggggaagcggtcta

SEQ ID NO: 49914 - DNA, 201 bp, Homo sapiens
ttggccagaactgtgggccgtactgcattcttcccgtgtctgtcactgctgagtcgtgagcttgatctcttttcttagtgtttgctccttttgtccagctrtgggggccagcagaagctttgggtcatctgtaccagtgactttgctgtgaagatgtaagggagagtggttgaggtcaagatctgggttctggttcttgtg

SEQ ID NO: 49915 - DNA, 201 bp, Homo sapiens
ccttgtgatctgcctgccttggcctcccaaagtgctggaattacaggtgtgagtcaccgcgcccaagtataggccacttttaagaattactcagagttagyttataagaggcgaatcagtggagtcctccagtttggttcacacataattattaggttgaaccatataaagttactgtttttggtcctgtgaatattagta

SEQ ID NO: 49916 - DNA, 201 bp, Homo sapiens
atgcacagtacagaagcggggaagtcaaggtgtgctgggcaaggaaacatctttatgtgacccacaaagagtgaagcagagggaagaaccagaagttattytggtttgcagactgggagacaggtttaatgacacagtcatgtcagagagaggggaagaggagaatacgtagggggtctgttttgatgtgtaagtacatgt

SEQ ID NO: 49917 - DNA, 201 bp, Homo sapiens
tttataggattgctgtggaggattaaatggatctgcatgacaaatgcttagcatgaaaaaatccctcaacagatattggctgctattttattatcttattrtgctgagacactggcataatttacaattcaaaaattaaatttttttaatcttatactgtagtttacaaggccctttcacatatatgagcttgttcaatcc

SEQ ID NO: 49918 - DNA, 201 bp, Homo sapiens
agcaaggacctggggatggaccttctctggccagctacagggtatagagctggtgggaaatgcaggagcctgtgctagcagttgaccattaacatgggaaygccacctcccagcgggcactgctgccgcatacttgcgaggttgctgaagcttgtagtttagagcaggaccatcccactagatgtgcaatgtgagcctcag

SEQ ID NO: 49919 - DNA, 201 bp, Homo sapiens
ggttgaaccagcttagtgctccctgggggtggttaagttcaaggacttcagggtccgattgaccttgggctgaatcttgacctggggctgtaagatgctcrgtcaggaccttaacttttccaaggctcggtgtctacatctggaaaatggggataaacacagttcctccctgctgggattattgtaaggcttgaatgagat

SEQ ID NO: 49920 - DNA, 201 bp, Homo sapiens
acaaaaaactagccagtcatttataagaatgagttacagctataggtgcaggcggtaaatactctccaagatatctaaataaattaaaaggctatgtagaraacaatgtatatataatgttacctttaaagtgacaaaaaaaggtgaatatagatacttgtgtatcagaagagagaggtattccatttactgaagagttag

SEQ ID NO: 49921 - DNA, 201 bp, Homo sapiens
gcatttctttaccttttactcttttactatttattagttaggattaggttcagccacgaataacaccaccaaaaacaacaacaacaaaacccaagtatccrtggcttaaacaagacaggggtttatttctctctcctgtaacagaagcccagtgctaggcaggatggggatgatagaggttatccaaggctcagttgtatg

SEQ ID NO: 49922 - DNA, 201 bp, Homo sapiens
cagagtcattggaagggccgctgtattagtttgccagggctgctgtaataagatcaaggtcttgggggttaggacttcaacatatgaatttgggggtggcrgagcacaagtcagctcataacagctggggaggaggctttaggcctggccctgagaaattactcccagactaaggctgcagaactgaccccctagagagtc

SEQ ID NO: 49923 - DNA, 201 bp, Homo sapiens
agagagtttatttgcagatgaggcagggaagccggcctgttctcatcttgctgtgcctgatgccttgtgcttggggcactgttcactgtgctgcctgctgscctgcttgtctctgccttttggacgggagataggccaccccacagtgccacacctgccttcagggaagcttttgggtgttccttgtctggcttctgggtt

SEQ ID NO: 49924 - DNA, 201 bp, Homo sapiens
tctatagatagatagatatagatataatctttgttatcaatttgtataagctctttggaaattagtccttcgattgtcatttgtattgcaaacacattccscctcccccatgccaattattttagatgtagcacttgttccttaggaactcagagataaataagaccctagggtggtgaagagagcatagaatttggaaca

SEQ ID NO: 49925 - DNA, 201 bp, Homo sapiens
aagaaaaaattttaattaattgtgcaatcatgatgaaaatttatattttctgtaatttttttctagcctcatctgtgggcgatttaacttagttgaaattrtaatacattatttgtatattgtttatgtgctgttatcctttaagtattttcttgtgttgctacattgcccttttgttgctacattgctacatttaaagaa

SEQ ID NO: 49926 - DNA, 201 bp, Homo sapiens
acctgccaccgcgcccagctaatttttttttgtatttttaatagagatggggtttcaccgtgttagccaggatggtcttgatctcctgaccttgtcatccrcatgcctcggcctcccaaagtgctgggattacaggcatgagccaccgcgcccggcccggaatacccttaaaatatagccagaaagggctgaggatgggta

SEQ ID NO: 49927 - DNA, 201 bp, Homo sapiens
gaggaggctttaggcctggccctgagaaattactcccagactaaggctgcagaactgaccccctagagagtcaccaccttggtcatagacagcaagcagaragggaggaatcaggaagtccctgctgtagttgctggatccagcggtgaatgttctgagctgtgatcctgggatcaggaagctgcagccactgccacagtg

SEQ ID NO: 49928 - DNA, 201 bp, Homo sapiens
aatttgattatacatcaattatgttcaaagtaaaaaacaaggtaatttgaaacagctgcttttatccaggtgtatacacggtgtatacatacacagatatrtatgaaatgtggaactctatacccgtatgtatggagttcctcataagagtctttttgagaaaatagttccattgctaaaaatacccaatggaaacttctg

SEQ ID NO: 49929 - DNA, 201 bp, Homo sapiens
gcgcctggccgtatcttgttatttttatttatatctttaattttgagttagttgagttttttggtcatttgcctctgcttcttcttctttttttgttttcyttttttttttgagacagagttttgctcttgttgttcaggctggagtgcaatggcgtgatcttggctcactgcaacctccacctcccaggttcaagtgatt

SEQ ID NO: 49930 - DNA, 201 bp, Homo sapiens
agggaagccggcctgttctcatcttgctgtgcctgatgccttgtgcttggggcactgttcactgtgctgcctgctggcctgcttgtctctgccttttggaygggagataggccaccccacagtgccacacctgccttcagggaagcttttgggtgttccttgtctggcttctgggttcagtgggagggcccacccagcctg

SEQ ID NO: 49931 - DNA, 201 bp, Homo sapiens
gtacctgtatccataggtttggagagtgtctgtttctccataccgtctcatctgaaatgaaaatttttacatgtttgctagtctgaaaggtgaaaaattgkatcttgttttttttttttttttttttttttttgagacggagtcttgctctgttgcccaggctggagtgcagtggcgctgggctcactgcaagctccgcct

SEQ ID NO: 49932 - DNA, 201 bp, Homo sapiens
aaagtgtcccctcagtttgtacctgtatccataggtttggagagtgtctgtttctccataccgtctcatctgaaatgaaaatttttacatgtttgctagtmtgaaaggtgaaaaattgtatcttgttttttttttttttttttttttttttgagacggagtcttgctctgttgcccaggctggagtgcagtggcgctgggc

SEQ ID NO: 49933 - DNA, 201 bp, Homo sapiens
gtggtcccacctacttgagaggctgagttgggaggatggcttgagccctgggaggttgaagctgcggtgaaccttgatagcgccactgcactccaacccargcaacagagtgagaccctgtctcaaaaagaaaaaaaataaaaaataatttattttagggggtcttagtaaagaaagacccccaaaagtccatgattttat

SEQ ID NO: 49934 - DNA, 201 bp, Homo sapiens
agtaggggcgacagggcccctggagcataggactgagaagagcattgagagggagaggatttccaggtctggtggtgggtgagctagcatgctgctgccarttttgcagcaaggacctggggatggaccttctctggccagctacagggtatagagctggtgggaaatgcaggagcctgtgctagcagttgaccattaaca

SEQ ID NO: 49935 - DNA, 201 bp, Homo sapiens
tttttgcttcaggtgtgtatccaccaagaatttcaaatttatgtggatttattttattggtacataatctgtaaacttcttaaggcattaacatgaaaagwttttttctttttattttatattgtggctcaggttatattttgaagatgttttgagtttatcctccaataggcaatgaagttgacaaggttttatgaagga

SEQ ID NO: 49936 - DNA, 201 bp, Homo sapiens
gaacacttcagcgtgaattcagtgtcagattaatccctccttccccaaagtccactggctttcgtctctctctgccgtgacacatatcggaatctactgtrtatatatatatatatatatatatatatatatatatatatatatatgcactaagctctcaaaaacagtcattcctatgaattgaggtgtacaaagtttgaa

SEQ ID NO: 49937 - DNA, 201 bp, Homo sapiens
ataagactctttatgtacatctgtaaacacacacacacacacacgcacacacagtactttgaaaaaattggatgctgttttttttttgagatggagtcttsctctgttgcccaggctggagtgcagtggtgccatctcagctcactgaaacctcaacctcctgggttccagcgattctcctgcctcagcctcctgagtagc

SEQ ID NO: 49938 - DNA, 201 bp, Homo sapiens
gtctcgatctcctgacctcatgatccgcccgcctcggcctcccaaattgctgggattacaggtgtgagccaccgtgcctggcctcaatatatttttctctkactcttccttccccaatcctgcttcctggaggtagccaatgtttatagtttggtgtacatctttataagactctttatgtacatctgtaaacacacacac

SEQ ID NO: 49939 - DNA, 201 bp, Homo sapiens
aagctaatgaaacaaactcatcaaacattaatgatgtgacatatcataatgctgcttaaatgttaatacagcaatttatcctcacccagacttgtacattktaaagactatcaattatcatagctacagaagggtggctgaccagcggagaaaaggaacacttaatatctatggtatagtttctgtactactgctggattt

SEQ ID NO: 49940 - DNA, 201 bp, Homo sapiens
ttcaagcgattctcctgcgtcagcctcccgagtagctaggattacaggccaccatgcccagctaatttttgtatatatatttttttcagtagagacggggwttcaccatgttacaggccaggctggtcttgaactcccttgaactcaggtgatccacctgcctcagcctctaaaagtgctgggattacaagtgtgagccac

SEQ ID NO: 49941 - DNA, 201 bp, Homo sapiens
aatttgaaacagctgcttttatccaggtgtatacacggtgtatacatacacagatatgtatgaaatgtggaactctatacccgtatgtatggagttcctcmtaagagtctttttgagaaaatagttccattgctaaaaatacccaatggaaacttctggcctgggatttccaagttcaccctcggctgtgcatctcaaagt

SEQ ID NO: 49942 - DNA, 201 bp, Homo sapiens
atgacataattacattaatggagaacatgaagatgaatttaaatggtcttttgttcatctaaaatcaagattgaagttagtcttagtgaccctgggtgaayggggaagggagtgtattttctgcactagattctccatatatgttattttttttctgtaacaaccctgtgaggtattatgatttcatagatgaggtaactg

SEQ ID NO: 49943 - DNA, 201 bp, Homo sapiens
gcacaggtgcccagccttctggaataaagacaggaactaagcattaaaaatagcacgccattcatttgcttgtgccgagccgccaagtgccccctcctgcyggcgacaggtccggatgtgggccagttctcagcccagggaaaatgaacagtgtcttctccatggtgcccagaacagtctgagtcagtggaatgtgctggc

SEQ ID NO: 49944 - DNA, 201 bp, Homo sapiens
gccaccgcacccggcctgaatttttttttgttttgtttatttatttcttggttttgctggcctttaagcaacccaagactagggggctttcactccgtccytagagagctcaaagggcctgacttaggggacacagtcagtgaaggggatgaatgaatgagtttcagatccaggtgttctggataagtcactttacctttc

SEQ ID NO: 49945 - DNA, 201 bp, Homo sapiens
gacaaaagcctcttctcacctttagagaaattaagtcttattggtagaaaatattttagagaggttctggtctaagcctctcattttgcagatgagaaacyacccaaggcccaagatggatggatttatcaaagccggttggtgctggaacttggatttaatttcaggtcttttattattactatggaacaaatcttaact

SEQ ID NO: 49946 - DNA, 201 bp, Homo sapiens
ttagcccaacagtttcccacgcccgcccccacccccacaaccttgtttgtttaaagaccattaaagaacgtcttcaatttattctggattgagttttcctyaaaccaaaccacccctcagttcaccccccagagctgttgaggcccttcctgggggcttgtggctgtggctgcctcagatcagagcagaccctgggctgca

SEQ ID NO: 49947 - DNA, 201 bp, Homo sapiens
ttattagagacagggtttcagcatgttggccaggatggtcttgatctcctgacctcatgatctgcccacctcggcctcccaaagtgttgggattacaggcrtgagccaccgtgcccggcctgtttttgtttttaagagacagggtcttgctttgtcacccaggctggagtgcagtggtacaaacgtaattcactgcaatct

SEQ ID NO: 49948 - DNA, 201 bp, Homo sapiens
tttttcattcctggactaaaacattaagttctttttaaattcagcattttctagttcttgggttctttctctccatttatttccttgtacttgacaaggartattggcccatgttctgagggaaatgcttttaaaactaggctgggggtattgcccttgtaagggtaatttgggattattggcccctttttgtgaatgtct

SEQ ID NO: 49949 - DNA, 201 bp, Homo sapiens
atgtggtagttattgttaatagctaataatgatcttcaactgggtaaaataccattgtgtgtttgagagggagagagagagagaagggtaggaggagaggragaatatcttttgttcaaagccaaatgttgctacttctgaagacgagtgcaccttatgggtatagccagctataatgtttatcaaacatatacttttttt

SEQ ID NO: 49950 - DNA, 201 bp, Homo sapiens
cttggcctcacaaagtgcagggattataggcgtgagccactgtgcccggcctttttttttttttgagatgaagtctagctctgttgccaggctggagtacrgtggtgtgatcttggttcactgcaacctccgcctcctgggttccagggattctcctgcctcagcctcccaagtacctgggattacaggcacgtgccgcca

SEQ ID NO: 49951 - DNA, 201 bp, Homo sapiens
gccctttctgccatgtgaatctttgcccagccctgagggggtgagggctggccaagggagccgggccatggtcggagagaaggctgaggctccttgagaarcatttggagtttgagtcagttgtgtcttttaaaaaaattacccattttggacttgcctgtggaagcaattagagagatcacaggaccgtttctgattccc

SEQ ID NO: 49952 - DNA, 201 bp, Homo sapiens
ctgaccgtaggtgatctgcctgccttggcctcacaaagtgcagggattataggcgtgagccactgtgcccggcctttttttttttttgagatgaagtctarctctgttgccaggctggagtacggtggtgtgatcttggttcactgcaacctccgcctcctgggttccagggattctcctgcctcagcctcccaagtacct

SEQ ID NO: 49953 - DNA, 201 bp, Homo sapiens
taatacaaggatttggagaaccccagtaaaatgctggagggacttagactctgatctctattgggatgtgtcaaattggagatttggtgggcttttctgcygtgtttactgcgatgggtgtgtgtatttgaagtctgtatgtggcctttaaggatgtgtttggggcgcagaagttctgggtaacagagaggctctcaaacg

SEQ ID NO: 49954 - DNA, 201 bp, Homo sapiens
cccggtaaacaaatgggtttcctgtcacctgagcatggatgctgctgtaggtacctctgctcatatgtgggtgctagtctcaaaatgtcagaggtggcagraaaaatatctgaaaatccagcccagttccctaaatttgcagttgaggagacagacctggagaggaacagtaactttctcaagaccatccaggtagtagtg

SEQ ID NO: 49955 - DNA, 201 bp, Homo sapiens
aaccttgcactctttcctgataagacattaacctctgcatgggcttgctggcccaaccttttgattaactggacctattttcttgtagatctaatacaagsatttggagaaccccagtaaaatgctggagggacttagactctgatctctattgggatgtgtcaaattggagatttggtgggcttttctgccgtgtttact

SEQ ID NO: 49956 - DNA, 201 bp, Homo sapiens
atgccggaaggctcagtgcttagtaggcccggaaaagcaatttttgaactggcatctcattccccttttctaagacaggaaggacggtcagagatgattcyaacatgaggactttgctagttgcagtgtctgactcctcccattctcatagcagttttgcacagtagttttggtttgtgtgtatgttttaggcaatgtgac

SEQ ID NO: 49957 - DNA, 201 bp, Homo sapiens
taatttctcaagaagattttgctgccctaaaaaaaaaaaaaagaaaaagaaaaagacaaaaagggaagccactggttgctaatggctcctgcggctctgaygatcctcgatgaagtgttctttgattaagtgtcaagatgagtggtgcagacctttgacagacacatgattgtggttggagaaagcccagcattaactgct

SEQ ID NO: 49958 - DNA, 201 bp, Homo sapiens
ccggggaaagcctccgcgcgggctccaggccgtccctggcccggctcttcccggcgctgggcacatctggcgggcacgggcccggcttcctagccggaggmggccggagggggcgtgtttgcggaggtctggggacgcagagccgggcggcctggctgagcctttgccgacagacctccgacccggcctgcaggggcccga

SEQ ID NO: 49959 - DNA, 201 bp, Homo sapiens
ctgatgggcacttggcttgtttccatgtcttggctattgtgaatagtgccgcaatgaacatgggcaaattgccgtgttgagttaaggaagctcttttccastctgagtttgcaaatagcttttcatatatgagcgttgaatattatcaaatgcttttctgcattcactgagatgactttatgtatttaaaaaaatctgatg

SEQ ID NO: 49960 - DNA, 201 bp, Homo sapiens
gcctcccggggaaagcctccgcgcgggctccaggccgtccctggcccggctcttcccggcgctgggcacatctggcgggcacgggcccggcttcctagccrgaggcggccggagggggcgtgtttgcggaggtctggggacgcagagccgggcggcctggctgagcctttgccgacagacctccgacccggcctgcagggg

SEQ ID NO: 49961 - DNA, 201 bp, Homo sapiens
aagtaacttgtccagggttacacgatggctttagaggcaggcctgaaattctggtcttggacccttgttaagtgcttctaccctttatcacatagacctargtgatacaggagcttcagggatccaagaggggtgcatcccctaccttcaagccagaggctaatggactggctggtttgttagtttgtctgcttttctttc

SEQ ID NO: 49962 - DNA, 201 bp, Homo sapiens
caccttcttccaaagctctggggttacaggtgtgagccactgtgctctgcctgctttttggaagtgagacttttaaggcctagagaggggaagtaacttgyccagggttacacgatggctttagaggcaggcctgaaattctggtcttggacccttgttaagtgcttctaccctttatcacatagacctaagtgatacagg

SEQ ID NO: 49963 - DNA, 201 bp, Homo sapiens
agcctctggagtagctgagattacaggcacgccatcacgcccagctaacttttgtatttttagtagagatgggttttcaccatgttggccaagctggtctygcactcctgacctcaagtgatctgcctgccccggcctcctgaagtgctggggttacaggtgtggtgtgagccaccacgcccagcctcttctttttttttt

SEQ ID NO: 49964 - DNA, 201 bp, Homo sapiens
caggctggtcttgaactcctgacctcaagtgatccacccgccttggcctcctaaagtgttgggattacccacgtgagccactgcgcctggtcgtcttttarcccacatctgttggtggcttactgtgtgctatggtgagggatactatggtgagtaggggcgacagggcccctggagcataggactgagaagagcattgag

SEQ ID NO: 49965 - DNA, 201 bp, Homo sapiens
gggcaccttatataacatcaccatctctccagaagtggaccacgtctggggggaccccaactccactgcacagtacacacgtaagtctcttaggatgcccytctaaggaacagcctctctaactgtctcttggaggaggcactggttaaatgatggccagtgtgcttctgggatccaggttgactctgaaactgctgaagt

SEQ ID NO: 49966 - DNA, 201 bp, Homo sapiens
agaagtatatttttaatctagttgtttactttctttgcatagcccctgttccagtttctgacttccgagtgacagtggtcagcacgacggagatcggcttrgcatggagcagccatgatgcagaatcatttcagatgcatatcacacaggagggagctggcaattctcgggtagaaataaccaccaaccaaagtattatca

SEQ ID NO: 49967 - DNA, 201 bp, Homo sapiens
cagctgagctctgattggctgaagcagacgagctctgactgcttggttcatgtgagctctgaaagtcccaagtcaaaagggtgtggggttttgggaaactyggagtacgtagtgtgacctctagtcagcaaatggccacttggctgtattttaaatttaggtacactttgctgcttggggtccatcttgaggggattgcct

SEQ ID NO: 49968 - DNA, 201 bp, Homo sapiens
cgagatcttggctcactgcaacttctgcctcttgggctcaagatattctcttgcttcagcctcccaaggagctgggattataggcactcgctaccacaccyggctaatttttgtatttttagtagagacagggtttcaccatgttggctaggctggtctcaaactcctgacctcaggtgatccacccacctcagcctccca

SEQ ID NO: 49969 - DNA, 201 bp, Homo sapiens
aaaaattcagtgtcttttttctttttttttgagacagagtcttgctctgttgcccaggctggagtgcagtggcgagatcttggctcactgcaacttctgcytcttgggctcaagatattctcttgcttcagcctcccaaggagctgggattataggcactcgctaccacacccggctaatttttgtatttttagtagagac

SEQ ID NO: 49970 - DNA, 201 bp, Homo sapiens
gataagggtagcatcttacttactgctgaaaaattcagtgtcttttttctttttttttgagacagagtcttgctctgttgcccaggctggagtgcagtggygagatcttggctcactgcaacttctgcctcttgggctcaagatattctcttgcttcagcctcccaaggagctgggattataggcactcgctaccacaccc

SEQ ID NO: 49971 - DNA, 201 bp, Homo sapiens
gccttggcctcccaaagtgctggattgcagatgtgagccaccgcccctggccaatattttttatagtaataaaattctgcatttccatgaattgatgtgargagaactgaaaaacacatgctaatctaaaaaaatgctgtgccttaggaatgggacttaatgttgctttatgagttgtttttaagtgtaggttcattgctt

SEQ ID NO: 49972 - DNA, 201 bp, Homo sapiens
acccaggctggagtgcagtggtgcaatcttggctcactgcaacctccgtctcccgggttcaagcgattctcctgccctcagcctctggagtagctgagatwacaggcacgccatcacgcccagctaacttttgtatttttagtagagatgggttttcaccatgttggccaagctggtctcgcactcctgacctcaagtgat

SEQ ID NO: 49973 - DNA, 201 bp, Homo sapiens
atctcaattttccctcttgtaaaatggagctgagagcatcccttatatcacaggaatgtcattaggattacttaaggtgttggaatgtttcctggcctagrggaagagctcagtagaagcttgctattgccctaatatcattactatcccagatatgcattttcttgttatttccctgttaggcgttaagtgtgtgaaagt

SEQ ID NO: 49974 - DNA, 201 bp, Homo sapiens
tctctgctcactgcaacctctgcctcctgggttcaaacgattcccctgcctcagcctcccgagtagctgggattacaggcatgcgccactacacccagctyattttgtatttttagtagagacagggtttttccatgttggtcaggtggtcttgaactcccgacctcaggtgatccgcccaccttagcctcccaaagtgct

SEQ ID NO: 49975 - DNA, 201 bp, Homo sapiens
gtgtagaccaaccagggtgaatgagtgtatgactggaaatgcaaagacgggcaggatcaagggacagtttagagcaggggtgtccaatcttttggtttccytgggccacactggaagaagaattgtcttgggccccacataaaatacaccaacactaacaatagctgatgagctaaaaaaaaaaaaatcacaaaaaatctc

SEQ ID NO: 49976 - DNA, 201 bp, Homo sapiens
ctccatctcaaaaaaaaaaaaaaaacaaaaaaaccccacacacaacaaaaaataaatattgcctgtacctatcacctgaggagcccattgttaatggttgkgtgtctttttagtcttttaaaaaatgtgttaaaaaatgtagttgtcataatgtccgtatataaatttttaagtggagttgatagatttcatttgaagggc

SEQ ID NO: 49977 - DNA, 201 bp, Homo sapiens
attcttctgcctcagcctcctgagtagctgggattataggcgtgtgccgccacccccaactaatttttgtattttttagtagagacagggtttcaccatgytggtcaggctggtctcagactcctgacctcatgatctgcccaccttggcctcccaaagtgctgggattataggtgtgagctggcactgggtggcttctat

SEQ ID NO: 49978 - DNA, 201 bp, Homo sapiens
aatgttttaagaaagtttatgaatttgtgttggtctgcattcaaagccatggtgggctgcatgcgggccatgggttggccaagcttggtttagaggcggaygcagtacgggagagttttcccttctcttctgatgtaactccatgtcttggtggcggtgttctagatgtaggcatctttaggcaggggagtgtgcgtggaa

SEQ ID NO: 49979 - DNA, 201 bp, Homo sapiens
cgggaggcagaggttacagtgagccgatattgtgccactgtactctagcctgggcaacggagcgagactccatctcaaaaaaaaaaaaaaaacaaaaaaamcccacacacaacaaaaaataaatattgcctgtacctatcacctgaggagcccattgttaatggttgtgtgtctttttagtcttttaaaaaatgtgttaaa

SEQ ID NO: 49980 - DNA, 201 bp, Homo sapiens
agtagctgggattacaggtgcctgctaccatgcccagctaatttttgtatttttagtggcgacggggttttgctctgttggccaggctggtctcgaactcstgacctcaggtgatctgcccacctcggcttcccaaagtgctgggattataggcgtgagccaccatgtccagcctatttattttatttttgagacggagtg

SEQ ID NO: 49981 - DNA, 201 bp, Homo sapiens
atgggcatctcagatgctgtgagtctgagggcagatgcccatcagtccaggacagttcctggggacaaaagcctcttctcacctttagagaaattaagtcwtattggtagaaaatattttagagaggttctggtctaagcctctcattttgcagatgagaaaccacccaaggcccaagatggatggatttatcaaagccgg

SEQ ID NO: 49982 - DNA, 201 bp, Homo sapiens
ctctctcctgcaacgtcctgaaatccctcttctgcttccatcaaagataagattttttttttttagatggagtctcactctgtcgccaggctggagtgccrtggtgtgatcttggcttttgcaacctccgactccctggttcaagcgattctcctgcctcagcctcccaagtagctgggattacaggcaggcgccaccatg

SEQ ID NO: 49983 - DNA, 201 bp, Homo sapiens
tagctgggattaccggcatgcaccactacgcccagtgtgtttttgtattttcggtagagacagggttttgccatgttggccaggctggtctcgaactcctmacctcaggtgatctgcacctgcctcggcctcccaaagcgctgggattacaggcatgagccaccgtgccctgccttctttcctttttttgagatagggtct

SEQ ID NO: 49984 - DNA, 201 bp, Homo sapiens
gtagaaaatattttagagaggttctggtctaagcctctcattttgcagatgagaaaccacccaaggcccaagatggatggatttatcaaagccggttggtrctggaacttggatttaatttcaggtcttttattattactatggaacaaatcttaactttttcaagtgcataccatgtgcccggctatgtgctggatgtag

SEQ ID NO: 49985 - DNA, 201 bp, Homo sapiens
gctacttgggaggctgaggcaggagaatggcgtgaacccaggaggcggagcttgcagtgagctgagatcatgccactgcactccagcctgggcgacagagygagactccatctcaaaaaaaaaaccaaaaaaaacagtgcttgttgttcttttgttgttattgttaaaggatcattatctcattatcaacaacattggcag

SEQ ID NO: 49986 - DNA, 201 bp, Homo sapiens
atgattacaatcctaagtaatatcagctgttgcttgcgttggtttctcagctctctcttggtgatctctctctttagctgttgaatgagttcaaagatctrggaagagctttgaaacccctctagcagcatttctgtctccagtcccagcacaggtctttggaggatgagataaaaagggttttgcccagggtcaaatgct

SEQ ID NO: 49987 - DNA, 201 bp, Homo sapiens
caaggctggggtgcaatggcacgatcttggctcactgcaacttctgcctcctgggttcaagtgattctcctgccttagcctcctgagtagctgggattacmggcatgcaccactacgcccagtgtgtttttgtattttcggtagagacagggttttgccatgttggccaggctggtctcgaactcctcacctcaggtgatc

SEQ ID NO: 49988 - DNA, 201 bp, Homo sapiens
atttttagtggaggcaaggtctcactgtgttgcccaggctggtgtcaaactcctgacctcaagtgatcctgcttccttggcctcccaaagtgttgggattwcaggcgtgagccatcacacctggcctggaaccatttctttaagcaaaatctcagacttatccctggataagcctcagcagcctcctctctcctgcaacgt

SEQ ID NO: 49989 - DNA, 201 bp, Homo sapiens
ctccacgaagataatactaagtataaccctcctcacttctccctcttcctctccccctccttctccccttgcccgctcccactccctttcctctccctccwccctctccctcctccctctccctccctttttcttcctcttcccccacctccatctctcacagctggtttctgtctttggatcagtacttctggttaaatg

SEQ ID NO: 49990 - DNA, 201 bp, Homo sapiens
tttttatattctgtaaaaattgccattgggattttgatggagcattgaatttatagatcgctttgagtagtgtcaagtcttccaacaatgtgaagtcttcyaatccatgagcatgggatgtctttgcatgtatttgtgtatttgtatcttctttattttatcgatgttttgtggttttcactctacaagtctttcatctcc

SEQ ID NO: 49991 - DNA, 201 bp, Homo sapiens
agtagctgggactacagacacatgtcaccacgcctggctaatttttgtatttagagatggggtttcaccatgttggccaggctggtcttgaactcctgacytcaagtgatccacccgccttggcctcctaaagtgttgggattacccacgtgagccactgcgcctggtcgtcttttagcccacatctgttggtggcttact

SEQ ID NO: 49992 - DNA, 201 bp, Homo sapiens
ccccatgtctactaaaaatacaaaaatcaactgggtatggtggtgcatgcctgtagtcccagcgacttgggaggctgacacaggagaattgtttgaacccrggaggtggacgttgcggtgagctgagattgcgccattgcactccagcctggtcgacagagcgagactccgtctcaaaaaaaaaagggggtcctcatgatg

SEQ ID NO: 49993 - DNA, 201 bp, Homo sapiens
cgcgctgtcatccccggactccgctccagcaccttctacaacatcacagtgtgtcctgtcctaggtgacatcgagggcacgccgggcttcctccaagtgcrcacccgtgagttcatgcctggctctcaccaccctttcctgctgtcctgctccgtgccaggcccagacacaggatgcatgatgtagtaatggtgactgttg

SEQ ID NO: 49994 - DNA, 201 bp, Homo sapiens
gttgatacagctgagctctgattggctgaagcagacgagctctgactgcttggttcatgtgagctctgaaagtcccaagtcaaaagggtgtggggttttgkgaaactcggagtacgtagtgtgacctctagtcagcaaatggccacttggctgtattttaaatttaggtacactttgctgcttggggtccatcttgagggg

SEQ ID NO: 49995 - DNA, 201 bp, Homo sapiens
gtatgtgaatgtgctgtatgggtgcaaggggttgcagaagtgataatgtgtgtaaacagatggtgtggttggctcattggaggggtggaggccctaagtgrgatgacctctgaggtttactcttcctagagtagttggaaagcaattcagcctcagtggtaagctctcagctcttctagggcaggtccctcttccaccacc

SEQ ID NO: 49996 - DNA, 201 bp, Homo sapiens
tcagatttatagtcagttaacggaggcttaagtgatgtaaagttttatttctctctcacatagaaattagttagaggtagtagtttagggctcttagaggscccaggctgtcatattctacctgcttacacatggctttcaggatctaggtcacctcacagtccatgatggctgctggggctccatcccccttgtctgagt

SEQ ID NO: 49997 - DNA, 201 bp, Homo sapiens
taatggcgatgtagtaatcttgctttgttgcccaggctgttctggaactcctggcttcaggtgtgtgccactgtgcctggcccagttgctctttacatggkggaatatcagaggttaaagacttggtaaaaattcatgcggtgcaataaaccatgtattacataataggggtgacacttgttaacttctcccaggctcagt

SEQ ID NO: 49998 - DNA, 201 bp, Homo sapiens
atcagatttatagtcagttaacggaggcttaagtgatgtaaagttttatttctctctcacatagaaattagttagaggtagtagtttagggctcttagagsccccaggctgtcatattctacctgcttacacatggctttcaggatctaggtcacctcacagtccatgatggctgctggggctccatcccccttgtctgag

SEQ ID NO: 49999 - DNA, 201 bp, Homo sapiens
caagtgatcctcctgctttagcctcctgagtagctgggaccacaggcttacaccaccatacctggcaaattttttttttttttttttttggagaggcagaktcttgctccgttgtccaggctggagtgcagtggtgtagtcatggctcgctgcagcctctgtctcctgggcttaagccattctcctgcctcaccctttgag

SEQ ID NO: 50000 - DNA, 201 bp, Homo sapiens
gtcatgcctccccttgggccctaaggccaagagcatgtgccatttatttttgtattcctacttctatagcccagtgcatattgggggcactcaggaattgytgagcgaataaaagaatgaatgaatacagacccagattgtcaatgattctcaaaccttattttacaaaagaatcacttgaaaagctggttaaagatcaaa

SEQ ID NO: 50001 - DNA, 201 bp, Homo sapiens
attgttcttggcctcagctccacgctcccctcctctgtaaaactgcccctgacaccccggcaggattgaattcctccacctttaagctcccagagtacctyagctctgtctttagcacttcacactgtgtcatgcctccccttgggccctaaggccaagagcatgtgccatttatttttgtattcctacttctatagccca

SEQ ID NO: 50002 - DNA, 201 bp, Homo sapiens
atatcacaggaatgtcattaggattacttaaggtgttggaatgtttcctggcctaggggaagagctcagtagaagcttgctattgccctaatatcattacyatcccagatatgcattttcttgttatttccctgttaggcgttaagtgtgtgaaagtgtgtgtgtatatttaaaaggtcaaagtaaaattctttagaacct

SEQ ID NO: 50003 - DNA, 201 bp, Homo sapiens
cgcttgcctttaggggaagctgatgactgctttagcgtaaagagagggccaggaggtcaacttccctacagtcccgtgcctgcttctgggttggggctggkgagagtgctgcccactgaactctctaaatgttaaaagatacaaagaggaagcacagagtgaaaagggagaccccagaggacagcagaacatcccgaagca

SEQ ID NO: 50004 - DNA, 201 bp, Homo sapiens
gagtgatgctgagctagtcttagagtaaatgcagacactggatggtagcgagttcagtgcagtttttatggagggacagcttgctgcctgctgatgaagcyggacaagactgggtagtgaagtcaaaggcccacacctaactctgaggctcttgggggcaactgtgttgtgcagagaaggtaggagggcagaggaagagga

SEQ ID NO: 50005 - DNA, 201 bp, Homo sapiens
ctacagtctaggagggaggtggcaggggtgtagaccagggatcacaaagcaatggcttgccatctgcttctgtatacccagagagctaagaatggtttgtrccttattaaatggttgaaaaaatcaaaagaatatatgctgtgatatgtggaaattctgtgaaattcaaatgtcagtgtctgtaaatagtttttttttttt

SEQ ID NO: 50006 - DNA, 201 bp, Homo sapiens
gggatgacaggagcccaccaccacgcttggctaattttgtgtttttagtagagacaggttttcaccatgttggccaggctggtcttgaactcctgacctcrggtgatccacccaccatggcctcccaaagggctgagattacaggcatgagccaccgtgcccggcctgatggattcagtttatgtgcaaaatttaagagga

SEQ ID NO: 50007 - DNA, 201 bp, Homo sapiens
ctggttttcacgtgtctcctgaagccacccctaaggagaaggcttcgatgtcatcttctggtcagagccgagcacagtggtcctcttcagagacagatccrtgcagcaggatggcacctctgttgtcctcccagactagcagtaggtacacgtgggcttcgcaggctgttttctgccctggaatgctgctgttttttagac

SEQ ID NO: 50008 - DNA, 201 bp, Homo sapiens
cttttctgccagtcatgtttcttaaaggaaatcggtagaatttataaatgtcatgttttccaaatactgttcttcttttaattacctaagaaaatcttttwaaaaatttttataaagatagtaatgcatattcattatataaaacatagacaagaaaagaataacaagtaaatcattaactggagataaccattgatcact

SEQ ID NO: 50009 - DNA, 201 bp, Homo sapiens
ggccttctctaggggaaaaacatgtagtttatgcaacttttcttttccctttctgctctggatttgaccttttgttccttcaggtgattgaaaaaattcgraaagtcacctgtttcctcagaattgctttaagacaagactaagtgaaccaacaagaatgaagtcagctttttggaaatacctcccaagaggccttgctct

SEQ ID NO: 50010 - DNA, 201 bp, Homo sapiens
acaggtgcgagtcccaccccagaggggccttgagaggctgcaagtgtcctgggtgggctgcctgcttcaggaggacttattattggggaaaaatacccccmctacttattactaagggccgaatgctttatgttcacacaacaactccatgttgtgtgactttggacatgttccttaactttctttatcttggtcttctca

SEQ ID NO: 50011 - DNA, 201 bp, Homo sapiens
ccatgttagccaggatggtcttgatctcctgacctcgtgatccgcccacctcagcctcccaaagtgctgggattacaggcctctgcgcctggccttgcatkgacaattaatttgtttatggaaagccagttatccaatgatggtgaacaaatgcaacttgactgtataatacttattttggttttggaccaaagtcaccat

SEQ ID NO: 50012 - DNA, 201 bp, Homo sapiens
gggccaccacacctgtcctgtgctaggctcttaacgtccttcccagatgttatgtcccttcccttggtggctgctgctttctgccacattttaccttgcckttccgcaccttctaccatgtctccttttccagcctcattccctgagatgtagccggagttccagttcagccaacctgcccgttgttttctctcctggaac

SEQ ID NO: 50013 - DNA, 201 bp, Homo sapiens
gcatgatctcagctcactgcaacctctgcctcctgggttcaggtgattttcctgcctcagcctcctgagtagctgggattacaggggcccgctaccacgcmcagctaatttttgtattttgagcatgttggccaggctggtcttgaactcctgaccttgtgatccccctgcctcggcctcccaaagtgctgggattacagg

SEQ ID NO: 50014 - DNA, 201 bp, Homo sapiens
tcttgagatggagtctcactctgtcacccacgctggagtgcagtggcatgatctcagctcactgcaacctctgcctcctgggttcaggtgattttcctgcytcagcctcctgagtagctgggattacaggggcccgctaccacgcccagctaatttttgtattttgagcatgttggccaggctggtcttgaactcctgacc

SEQ ID NO: 50015 - DNA, 201 bp, Homo sapiens
gaggagaacatgaagaatagttggaaactattgaacctccaagatttttctgtctttgttaacaactagcagttacatgctagcattatttatttatttakttagttagttagttagttcttgagatggagtctcactctgtcacccacgctggagtgcagtggcatgatctcagctcactgcaacctctgcctcctgggt

SEQ ID NO: 50016 - DNA, 201 bp, Homo sapiens
gctgggactacagatgcatcacgcccagctaatttttgtattttcagtagagacggggtttcaccatgttgtccaggatggtctcgatctcttgacctcakgatctacctgcctcagcctcccaaagtgctgggattacaggtgtgagctaccatgcctggccattttttttttttttttttttttgagacagagtctcac

SEQ ID NO: 50017 - DNA, 201 bp, Homo sapiens
ggctcctgccaccacgcccggctaattttttgtatttttagtagagacggggtttcaccgtgttagccaggatggtctcgacctcgtgatcctcccgcctyggcctcccaaagtgctgggattacaggtgtgagccaccgcacccagcctttttttttttttttttttttgagatggagtctcgctctgttgtgcaggctg

SEQ ID NO: 50018 - DNA, 201 bp, Homo sapiens
ggatcacttgaggtcacgagttcgagaccagcctggccaacatggtgaaagcccatgtctactaaaaatataaaaattagccaggtgtggtggtgggcgcytgtaatcccagctactagggaggctgggcaggagaactgctggaacccaggaggcggaggttgcagtgagctgagattgcaccactgcattccagcctgg

SEQ ID NO: 50019 - DNA, 201 bp, Homo sapiens
cctgccttggcctcccaaagtgctgagattacaggcatgaggcactgcacctggcccaaatcttctcagttctaaatggctgtgataaaaactacattgayaatttttttttttttttttttttggagatggagtctcgctctggtgcccaggctgaagtgcaatggcgcaatcttggctcactgcaagctccgcctcctg

SEQ ID NO: 50020 - DNA, 201 bp, Homo sapiens
tcacgagagctgatggttttataaatgggagttcccctgcacaagccctcttgcctgccaccatgtaagatgtgactttgcgcctccttccccttccaccrtgattgtgaggcctcgccagccatgtggaactgtgagtcaattaagcctctttcctttataaattacccagtctcaggtatgtcttcatttgcagcatga

SEQ ID NO: 50021 - DNA, 201 bp, Homo sapiens
tgagaaacattcaccatatctcaataagctctcctcagccagttggtccttttgtggttgaaaaaagtgccatatctttggttgggcatccaataaaatayggtatttaggggctacctgtatggaaaatccatatccttaaaggttagctcaccaggaggatgttgagaaatggcacagggggctgggcgcggtggctca

SEQ ID NO: 50022 - DNA, 201 bp, Homo sapiens
aaagcccatgtctactaaaaatataaaaattagccaggtgtggtggtgggcgcctgtaatcccagctactagggaggctgggcaggagaactgctggaacscaggaggcggaggttgcagtgagctgagattgcaccactgcattccagcctgggtgacaggcaagactctgtctccaaaaaaaaaaaaaaaaaaaggcac

SEQ ID NO: 50023 - DNA, 201 bp, Homo sapiens
agctggaaagaaaccaaatgggcatgtagaggtctggggcttgatggcagtgtggcctaggatggcttgtgaggctcacttctgaagccctgcacaaggamtttcttggccagtgtctgcctttcagttccccatgctgtgctccaaccagcccaggaaccagccctgctcagagtgaccatgcacactcgtcctcctgtg

SEQ ID NO: 50024 - DNA, 201 bp, Homo sapiens
ctactctaggggcaaagggagctggatggggactgtgtcctaggtcaagggacagctgctgctctgctctaaatcaattttcatgctgaaagcagggcctrttgtaggcagatctgatttttaaagagaaaataagtctggatttttatgagaaattttaagagttggcaagaattgtaaattaaaaaaagaaaaaacaat

SEQ ID NO: 50025 - DNA, 201 bp, Homo sapiens
ggtatgaactcacacaaacaggttacattaaatggctatataacgcaaggggttgttgcgctccaaaccctttgcgtcatactgtcctggatgtctacctyggactactcctgactgaagcacagccactttccttagaaattggcttgtttttcctgaaagttagaaaactgttaacagaaactaggaattcaagtcagg

SEQ ID NO: 50026 - DNA, 201 bp, Homo sapiens
ttgccatgcacccagggtgcagggagacctgtcttgcaggtgttcaaacaacttttgtcagcctcagtgtcagggacttttgttgcgtagagcagtcaccraatcctatggtgagaagagaaatcgttggagatgggggtgcaggggtggaagctcttatttcagaagacctgttgtgaggtaagactcagaccctcagct

SEQ ID NO: 50027 - DNA, 201 bp, Homo sapiens
ttcagctagcagcagacttctcagcagaaacttacaggccaggagagagtgggatgatatattcaccatgctgagggaaaacaacctgccaaccaagattrctatacccagcagaactggccatcaaaaatgaaggcaagataaaagactttaccagagaaacaaaagctgagggagttcatcaccactagacatgtctta

SEQ ID NO: 50028 - DNA, 201 bp, Homo sapiens
ctggtcaagacagagccctgtggactatggaagggattgaagccattctgtggatcctataggcttcttttctaagcgaatgattagtgtttattcagtarccctatgtcaggtggtttctgtatgaatgagaggtttgcctttccagctgcggcggggctttgggcaagttgctgtctctgtgctccttcgtttgctcat

SEQ ID NO: 50029 - DNA, 201 bp, Homo sapiens
aaaatacctcacagggttgcagtgaagatgtaaggatgatgatgatgacaacagcagctcaaatagatcatttaacttaattctcgccaaagcaaggcagrtacaaagatcatcctgttggcagatacagacagggagggacagagaggttaattaagcaagctacctgcccgcagttacatggccagaagcagtggcact

SEQ ID NO: 50030 - DNA, 201 bp, Homo sapiens
atactattctggtggtagtgaataagtctcacgagagctgatggttttataaatgggagttcccctgcacaagccctcttgcctgccaccatgtaagatgkgactttgcgcctccttccccttccaccgtgattgtgaggcctcgccagccatgtggaactgtgagtcaattaagcctctttcctttataaattacccagt

SEQ ID NO: 50031 - DNA, 201 bp, Homo sapiens
gaaaagacattgctatggtttggctgtgtccccacctaaatttcaccttgaattgtaatccccatgtttcaagggtgggaccaggtggagataattgaatkggggggtggtttctcccatactattctggtggtagtgaataagtctcacgagagctgatggttttataaatgggagttcccctgcacaagccctcttgcc

SEQ ID NO: 50032 - DNA, 201 bp, Homo sapiens
agtttccacatttttaaatgggtggagaaaacaaaatctacaaagaataatgtttcatgacacatgaaaattatgtaaaatatacatttaacgcttgtaartaaagttctgttggaactcagctacagtcgttagtttacatatcatcgatggctggtttcgcagtacaagggcacagtttaaagcctgccaggcctaaaa

SEQ ID NO: 50033 - DNA, 201 bp, Homo sapiens
agaatagaagttccccaaagcatgccttcttgtttttctcagaggacagtcttttcattcatgttttacagattggtccaacaagtgcagttcttctagtytcctatctagataagcaggatattagaaggaataggagaggcctgcaaaaagctatgatagggtggaaataggataggagaaactgaaaaaaggggaggc

SEQ ID NO: 50034 - DNA, 201 bp, Homo sapiens
ccaggctcatctggaactcctgacctcaggtgatccgcctgcctcggcctcccaaagtgctgggattacaggcgtgagccaccgcccccagccttccagtygtattcttgacaaatggttttccatgaagttgtggacaccttccagggtcacaattaaatggttaaatgagtcacgattaaataatgattgtgggtacct

SEQ ID NO: 50035 - DNA, 201 bp, Homo sapiens
actcctgaggctaggcatttgccaagtgaggtctgggatttgaacccaggcagctgaacttcagaatcctggtgtttaaccactataccatgctggccttmatgttattgagcaggataaggaattgtcactcttgacttgtttttgaaacatgaaaacccttctcttaaattcaaaagtaatacatagctgggcacggtg

SEQ ID NO: 50036 - DNA, 201 bp, Homo sapiens
gccactgcgcccggctctgagctgcaaatttaatagggaaactgaaggaagaggttctccacagcaccagtggggctgagacctgttttcctcaactaccyttttttttttttttttttttttttttgagacagagcttcactcttgttgcccaggctggagtgcaatggtgcgatctcatcttactgcaacctcttcttc

SEQ ID NO: 50037 - DNA, 201 bp, Homo sapiens
gtctgcccgagcctttcctgctccctgagaatcctcagcatgttttcctgctgagcaaggagtgaggaatgaagcccactacgaagcccgagctgcaaatktatttatttatttatttatttagagacagagtcttactctgtcgcccaggctagagtgcagtggtgagatctcagttcactgcaaccaccgcctcctggg

SEQ ID NO: 50038 - DNA, 201 bp, Homo sapiens
gtcagaggtcaaggccagtggtctatcagaacccagttcctgcaggagccagtgccggtactaggtagactcagatgactgaatggtcctcgggatctgarggccagtgggggagatgaggcctggcctcccggaagtgctcagtaaacatttgttaatcatttcctgcctagggaagctctgtggtatgctcaggagaat

SEQ ID NO: 50039 - DNA, 201 bp, Homo sapiens
ggagatgaggcctggcctcccggaagtgctcagtaaacatttgttaatcatttcctgcctagggaagctctgtggtatgctcaggagaatcttgcttctcrtgggggaatgggtggttgtcatttgggtggcctgactgccagcctgcttgctggctctctgggagttggggtggtggcatcaacctgcagaggcggggca

SEQ ID NO: 50040 - DNA, 201 bp, Homo sapiens
acttcaaagaaagtgctgccctcccagtggtgatgaagaccttccgctggccccagcctctgggatctggcctttacttgggtattcatgtggccctgggrgttggctttgctgaagttgggcagagcaggtgggttctggaatgtgcaggggcaaccagagtgtccatctgtttgggtgaagccagctgtttaggtctga

SEQ ID NO: 50041 - DNA, 201 bp, Homo sapiens
aggataaaaagcaggcatcttgctggagggtctctgttgctcagtagaaattattttgtaatgttttttgaaaaccacaaacatggacatattatggactrgataccacatttgcatcaggatttttttttcaaccagtacagtacataacaaagaaatctctaccctgcagaccctctgggggtgtgagagcgctccttg

SEQ ID NO: 50042 - DNA, 201 bp, Homo sapiens
ccttgctgtaggtaatacttgctttgaagtactggtgtggatggcctatgccctggcagtcttactaggtgggactggctgtcctctcattctcatgggawtggcctcatgctggtagctgacttcctccccgtgagaccgtaggtctaaactaacaaggtttacacatgtgacaaacatccaggttgccagggctcaaaa

SEQ ID NO: 50043 - DNA, 201 bp, Homo sapiens
gatgggtggggaccatctgtgctctcctggaaaggaaattgtggtttctttcttttcttttttctttcttcttcttttttttttttttttttttttttagyttatgggaaagggagacttgtgtctcaattgagtctttgtggcgttgtattacagagagtcacagaaaatgttctatgtaaatgactatgtgctctgatt

SEQ ID NO: 50044 - DNA, 201 bp, Homo sapiens
aggaggaaatgaaggctcagagaattgagtaacttgcttgaagtccaaagctgaggagtggagccagaattcaaactcgagtttgtctggcttccgaatcstgctatttcctcagcacagtggccgtcctccaaggctgtcacatgttccttccctggtgattcacggcacctggctacctccttttagactcactttgtg

SEQ ID NO: 50045 - DNA, 201 bp, Homo sapiens
ggatgggtgctattttccaaggaaagcccctcctggtggggggccataggaaacagctggtgcaaaggcctggaagactcactggcatctttctggaatarcaaggatcagcttggtgggaagtggaatgagctgggggtggagtggggtggggtggattttggagtctgagcttgagatacctgcttggagatgctgagc

SEQ ID NO: 50046 - DNA, 201 bp, Homo sapiens
ctgccaggctgggttgggagatgaatgtgtatgcatgtgtgaatggattcatttctgatgataaaaatactttatgcttatttatgtgaaacttggaaaayagaggaaaagtataaaattgaaactaaaagtcatccataatccttctaagtagctttatcatttaatgttttagtatatttccttcctgttttttttttt

SEQ ID NO: 50047 - DNA, 201 bp, Homo sapiens
attcatttctgatgataaaaatactttatgcttatttatgtgaaacttggaaaatagaggaaaagtataaaattgaaactaaaagtcatccataatccttytaagtagctttatcatttaatgttttagtatatttccttcctgtttttttttttttccttaattctgggtgtatgcaaaggattttgtaaccctttacat

SEQ ID NO: 50048 - DNA, 201 bp, Homo sapiens
tgcccagggagggttagatacctgggaggatagagcagaggccctccttctccccgacccctcgcctctgcaggctggtggggaggggggcaggggagtcsagttaccctctctccacgctttcttcttgtgtatgtgtgcgtgtacgtgcgtgtgtgtgttgtgtgtgtgtgtcttgggggatggagaacccctctcagg

SEQ ID NO: 50049 - DNA, 201 bp, Homo sapiens
aaactgtgttcttgaaaaaattatcacgcccattttagagatgaggcacagagaggtggagggacttgcccagatccaggtatgtggctctcctgtaatckcgcttctattgctttgtgatcagcagcaacttagtagctttcaaagcttcaattttcttgtgtgccaaatggggctaataaataccttagaggattgtga

SEQ ID NO: 50050 - DNA, 201 bp, Homo sapiens
acagagtctgaagttcaggaaatacagcaagagccttcctcagggatgaaacatgtgatcttatggtctgactagcctcaagccagctgagctcattgccrtgcaacttggtagttaatgattgctagtaagaagtttaaaaggatcatcccctcaaagaatgtcagagttggaaaagaccttagggacattaggctagga

SEQ ID NO: 50051 - DNA, 201 bp, Homo sapiens
agatgtgtgccacctctcctgggtaattttaaaattttttttttgtagagatgggggtctcactatgttgccacagctggcctccaagtcctgggctcaarcgatcctcccgtcttggcctcccaaagtgctaagattataggtgcaagccacctctcctggcttgcttctttcccgtaaattgaggtgtgttattccact

SEQ ID NO: 50052 - DNA, 201 bp, Homo sapiens
tttttgtatttttactacaggcagggtttcaccatattggtcgggctggtctcgaactcctgacctcaagtgatccacctgccttgcccttccaaagtgcwgggattacaggcgtgagccactgtgcctggtcttatatttcttttctatttttctaccctgatcaaccttttcttttctatctctctcactgtttctacg

SEQ ID NO: 50053 - DNA, 201 bp, Homo sapiens
agtctacgaagaggggtgcctcaggcccatggtaaattttatgtaagtgttggttgtatataagatgatgaagtccgggcgcggtggctcatgcctgtaaatcctagcactttgggaggccgaggcaggcagatcacctgaggtcaggagttcgagaccagcctggccaacatggagaaaccccgtctctactaaaaatac

SEQ ID NO: 50054 - DNA, 201 bp, Homo sapiens
ttgcagtgagccaagatcacgccattgcactccagcctgggcggcaagagcaagactccgtccctaaaataaataaataaataaataaataaataaataawtaaataaataaaataaaataaataaaaaaagaggttaaggtttatacgcaggccatttctaatagatgttatggaagccccaggttttggggcatcaggg

SEQ ID NO: 50055 - DNA, 201 bp, Homo sapiens
tactaaaaatacaaaaattagccgggcgtgttggcatgtgcctgtaatcccagctactggggaggctgaggcaggagaatcgcttgaacccaggaggcggwggttgcagtgagccaagatcacgccattgcactccagcctgggcggcaagagcaagactccgtccctaaaataaataaataaataaataaataaataaat

SEQ ID NO: 50056 - DNA, 201 bp, Homo sapiens
aaccaattagttacaaagtagggtctagaaatcagatttcctgaatcatattttagtgttttgtgaataatagtactctgaccccctcttgccaaattatrccctgggttttgttgttttgggaagattgtttactgtcatttctagagtatgaatgagtctttctaattgcatattttttctttccctttctatcatgaa

SEQ ID NO: 50057 - DNA, 201 bp, Homo sapiens
ccaccatgcccggctaatttttttgtagtttttagtacaaatggggtttcaccatgttggctaggctggtctcgagctcctgacctcaggtgatctgcctkccttggcctcccaaagtggtgggattacaggtgtgagccactgtcccaggccagatggaccattttaaagattaggtaactgagctctaggggtcaagag

SEQ ID NO: 50058 - DNA, 201 bp, Homo sapiens
cgcaatctctgctcactgcaagctccgcctcccgggttcacgccattctcctgcctcagcctcccgagtagctgggactacaggtgcctgccaccacgccyggctaattttttgtattttttttttttttagtagagatgggttttcaccatgttagccaggttggtctcgatctcctgacgtcgtgatccgcccacctcg

SEQ ID NO: 50059 - DNA, 201 bp, Homo sapiens
ggggacctagttatgagtcctgtttcttttttttttctttttttattttgagactgagtctcgctttgtctcccaggctggagtgcagtggcgcaatctckgctcactgcaagctccgcctcccgggttcacgccattctcctgcctcagcctcccgagtagctgggactacaggtgcctgccaccacgcccggctaattt

SEQ ID NO: 50060 - DNA, 201 bp, Homo sapiens
gtgttcccctttactgtgaccagtggcttcataggggacctagttatgagtcctgtttcttttttttttctttttttattttgagactgagtctcgctttrtctcccaggctggagtgcagtggcgcaatctctgctcactgcaagctccgcctcccgggttcacgccattctcctgcctcagcctcccgagtagctggga

SEQ ID NO: 50061 - DNA, 201 bp, Homo sapiens
atgagcttggtcatttaaaaaaatttattttttcctagttaggtaacagtggtataacaacattaaaagaaatgtagaaactagagaaaggaaaaaaaaaagccctttatcccccccatcacaaaactattataatttcaaaatagttacaagtacaatgtattccaagtggcttcttatttaagataattatattcacag

SEQ ID NO: 50062 - DNA, 201 bp, Homo sapiens
ccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttcctctt

SEQ ID NO: 50063 - DNA, 201 bp, Homo sapiens
agaaacaaaagtgtaggctgggtgcagtggctcacgcctgtaatcttagcactttgggaagccgaggtggggagatcacttgagcccagaagttcaagatyggcttgggcaacatagtgagactccgtctctattaaaaaaaaaaaaacaagtctaacatcaggtagacttcagggctgtgaaagaagtgacatagggtaa

SEQ ID NO: 50064 - DNA, 201 bp, Homo sapiens
gtttgtgtttgctaaacatatctttagctgcgtaagagaaagaaggaaaatagtaaagatgaacagtactgttttctacttgaagttctagttggcccccmctcccttccatgtaggaaccttagcttgctttccacaccctcccaccactggactcacaaaggcccctgatgagtgcctccggtaagacagggggaaatt

SEQ ID NO: 50065 - DNA, 201 bp, Homo sapiens
tgaaggaggctcctctagtgaaagaaaaaggcatccagtgttaatagtatttcttcccagttgcatggggcttgcatattagagataaaggaaacatcttwgctactactgagccataagtggtctcacctttcttgaaacataaggccgtcttggtttgttgttctgttttgtgcttttcacagaggcatggacactgaa

SEQ ID NO: 50066 - DNA, 201 bp, Homo sapiens
cttggtgactgttcagtggtaggcaaatgtcagaacccagtatgcaaatgtggaagtggacagatttgagtcagttatctcagctggtgttatgaaatacrgaaatttttggcgttggtggtggagggcgttggcataggaggcgtgaatgctctttgtttcttgctgttatgggagtatctcttgattgccccatcatct

SEQ ID NO: 50067 - DNA, 201 bp, Homo sapiens
tttaggctggtcgtggtggctgatgcctgtaattccagcactttgggaggccaaggcaggtggattgcctgagctcaggagtttgagaccagcctgggcarcaaggcaaaacgtcatctctaccaaaaaatacaaaaaattagccgagtgtggtggcacatgcatgttgtcccagttgcttgggaggctgaagtggggggg

SEQ ID NO: 50068 - DNA, 201 bp, Homo sapiens
tgtaatcgtagctacttgggaggtggagacaggagaatttcttgaaccgggtgggggaagttgcagtgggctgagattgtgccactgcactccagcctggrcaacagagtgagactctgtgtcaaaaaaaaaaaaaaaaaaaggttccattcaagatgtcaagccccacgggactgagggtaacatgagggtaacagacag

SEQ ID NO: 50069 - DNA, 201 bp, Homo sapiens
atttttctctagatagcaatttacactctcattatagtgtgtgagaatgcctgtttctttacagcttcatccacaatgaacattataataatgaacacccygcccccctccttttgtaacttgaataggcaaatgaaaaagaagcaaactgtgctaggcctttcttggattgctgtaaagaaacaccacctgagactgttt

SEQ ID NO: 50070 - DNA, 201 bp, Homo sapiens
tggtgctcattgaattgagccacagccccaaggtcatgttttcaaggttggcatttgggaggccttgtcagaaggtcttataccatattccagtcacccaragtgctgcccgccatgcctgttcgttcagcaggatttccctgagcacctgctctgtgccaagccctatgctaagcaccaagggagtaaatatggagggca

SEQ ID NO: 50071 - DNA, 201 bp, Homo sapiens
tcttggaaagtctggaaggacaccatgggctagaggggacagacacatgcctcatgtggcctcacaggtcagcctaggacctgtgacagtgacagggagayaggtttggcttaacacaaggaagggccttttgaggagcaaactcccctgaggggtcagccctctcatgggagcagctcaggggagaaggctcagccttgg

SEQ ID NO: 50072 - DNA, 201 bp, Homo sapiens
gcagcaagctgactccaactgtgggttcgcagaggaatacgaagtatgttgctgtaaatactgtttttaattgtgtcaggttccaacccaagctgggatcygaggggagttggtggatgggtggcaggtagctgaaagaacactcgagggactgtaggcagttgggacatggctttattctctctcctacagagtcagcag

SEQ ID NO: 50073 - DNA, 201 bp, Homo sapiens
tgttctttttcttttgttttacagagctgagtttggtgaaacttcaggaggttttagctagtggcgatccaaagacattaaatattgctttgtgggtacgwctccaccttgcgtcttacttggtgactgttcagtggtaggcaaatgtcagaacccagtatgcaaatgtggaagtggacagatttgagtcagttatctcag

SEQ ID NO: 50074 - DNA, 201 bp, Homo sapiens
ttttgttttacagagctgagtttggtgaaacttcaggaggttttagctagtggcgatccaaagacattaaatattgctttgtgggtacgtctccaccttgygtcttacttggtgactgttcagtggtaggcaaatgtcagaacccagtatgcaaatgtggaagtggacagatttgagtcagttatctcagctggtgttatg

SEQ ID NO: 50075 - DNA, 201 bp, Homo sapiens
gtggccccgtttccttctagaagttgagttccctgggcttgtgagaacccttgtacatctgcctccattaaactcacatttggagatctcgtaaatgaacscagtgcagtccgggggcagagtgaaggctcagactgcagccggacatggctcagttaccctaggtgggttagcagctgagcaggtactggtctcaaaacc

SEQ ID NO: 50076 - DNA, 201 bp, Homo sapiens
acgttgtcatatatttgcacatgcagatatcatatgttaaacaatatcacattgttgaagaaaattacactggaaagcgtaaaatatagtttggatgccayattgagtgtaacttaatccacccgattcagaacttttgtagagtgcctcggagttcctatttggaaatatcagttagcagttttagtcagtagagtaaca

SEQ ID NO: 50077 - DNA, 201 bp, Homo sapiens
ggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttcctc

SEQ ID NO: 50078 - DNA, 201 bp, Homo sapiens
agaggggaggaggcacagaggaacaaaaatccttgtgaattatgataattacatagtgtttaaatgaagggtggcaaggtgtgtaagtccataggtaaggkttcttttttctttttcttttcttttttttgagatggagtctcactctgtcacccaggctggagtgcagtggtgcaatcttggctcactgcaacctccgtc

SEQ ID NO: 50079 - DNA, 201 bp, Homo sapiens
cctggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttc

SEQ ID NO: 50080 - DNA, 201 bp, Homo sapiens
tacctggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcact

SEQ ID NO: 50081 - DNA, 201 bp, Homo sapiens
gctgtgtgaccctgctatctgcacagggacttgagcctctcagaatctgttactgcatctggaaaatggaaatctggaaatgtcactgcatctgtagcaayaaccaggccattttgttactaggtttaagtgagggaaggcatgtaaggcactcagtccagatcatggcacttagtaggcctgagcacatttgctcccacc

SEQ ID NO: 50082 - DNA, 201 bp, Homo sapiens
taagattataggtgcaagccacctctcctggcttgcttctttcccgtaaattgaggtgtgttattccactgcttaaaagcctacatggcttcatatcgctsttagtataaacccaaacagtggtctgcaagactctgaaccttagatcaggatgatcagacccctccctcccctccaccctccgacctcatcctggctacc

SEQ ID NO: 50083 - DNA, 201 bp, Homo sapiens
taaaaagtcatggagaaggttttctgtgtgcagctaagagaggaggtggcagacatttatttatttatttatttatttatttatttatttatttatttatwgagacgaagtctcactctgttgcctgggctggagtgctgtggcacgatctcggctcactgcaacctccatctcccgggttcaagcgattctcctgcctca

SEQ ID NO: 50084 - DNA, 201 bp, Homo sapiens
ggagcaggctgaggtcacccagcaaggtattagagaagacaagatgggaacctgggtcaccggcctgggcctcatattttcaaagtgctatttttttttttcccgtgttttcactttgatcttacttttaatgatagggacgtatcactgtgtcttctcaaaatggtgggtgtgaatggaatttttcaaagttgaatcaat

SEQ ID NO: 50085 - DNA, 201 bp, Homo sapiens
tgaaaggctaaataaagagaactttttattttttccatgttaatacatggatgatattaaccatgatgtttaatagctacagaatactgcatgaaatggakgtactataattcatttagcctttttcgtatttagagatttaagcagtagccaatttttcaccattacaagtggtgcaaggaccaatatcttcatgaatac

SEQ ID NO: 50086 - DNA, 201 bp, Homo sapiens
aggatccgaggcagcctgcagacctactatcatcttctttttcttttttataattggcaatcatccttggctacccagtagcatcttttttttttttttttgagatagagtttcactcttgttgcccaggctggagtgccatggcgcgatctctgctcactgcaacctctgcctcctgggttcaaacgattcccctgcctc

SEQ ID NO: 50087 - DNA, 201 bp, Homo sapiens
tcaggattaatttccagatatctttctggtattagacacataccacttgcctaataacgttccaaaaggaattcattgtttacattgctattagaacataygagattgcctgtttcattatgtccgtcccagcactgggtattatcattaaaaaaaaaagattttaaatttatttattgagttatttacttgagacagagt

SEQ ID NO: 50088 - DNA, 201 bp, Homo sapiens
gcagaatcacttgaacctgggaggtagaggttgcagtgagccgagatcgggccactgtactccagcctgggtgacagaacaagactttgcctaaaaaaaamaaaaaaaatacagattcccaggcttcaccctctacagtctatggaaaggcatgggaatctatattataacaagccattgagtttctttttctttttcttt

SEQ ID NO: 50089 - DNA, 201 bp, Homo sapiens
actgagggttgccaggctgaatgggatccctgcggggctggtgacctggttctaggctggtgctcagcagagctgcctcctggtgggttagtggacttgtkaaacatagttgcctctcctattccctgttcttgggggatgaagaagaaagtcttgtactctatcccttcccattctaaaattggggtaacggaggcccaa

SEQ ID NO: 50090 - DNA, 201 bp, Homo sapiens
caatttttgcttttgttgctgtgctttttgtgtggtatccaagcaaccattgtaaatactatgtcaagaagctcttccccaatgtgtttttttttttttttaaacaaattttacagtgtacagctttaggtctaatgtttaaggcttgaatctattcagagtttatttttgtgtctggtgtaagatagaggtccagtttta

SEQ ID NO: 50091 - DNA, 201 bp, Homo sapiens
cgtctcagcctcccaaagtgctgggattacagggtgaaccactgcgcggcccattaggtgctcagtaatttgttgaatgaattgaagacatgggacttgarttaggcttttattattattattattttttgagacggagtctcactctgtcacccagtctgggagtgcagtggcgtgatcttggcgcactgcaacctccgc

SEQ ID NO: 50092 - DNA, 201 bp, Homo sapiens
tccagtgtgccacacgctttcttgccactaggtccttgcatgtgatggagtaactcttgtacctctgtctccctaaatagacggggttctccaaggacatygtgccacagggcctggtaacccagtaggtgctcagtaatttatttatttatttattttttttgagacagagtctagctctgtcgcccaggctggagtaga

SEQ ID NO: 50093 - DNA, 201 bp, Homo sapiens
tgtcctcatctgtatgatggggataacaagaatacctactttataggattgctgtggaggattaaatggatctgcatgacaaatgcttagcatgaaaaaawccctcaacagatattggctgctattttattatcttattgtgctgagacactggcataatttacaattcaaaaattaaatttttttaatcttatactgtag

SEQ ID NO: 50094 - DNA, 201 bp, Homo sapiens
tcggcctcccaaagtgctgagattacaggcgtgagccactgtgccaggccccattttttgttttttggttaactccctgttcattaaaaaaaaaaaatctrtatctatagatagatagatatagatataatctttgttatcaatttgtataagctctttggaaattagtccttcgattgtcatttgtattgcaaacacatt

SEQ ID NO: 50095 - DNA, 201 bp, Homo sapiens
gtttcttaagtctgggggacaggcactgagcagaggccgtggtggggaacaggagcctgtcttcatggctcttactggccactgggcaagactcagatagyaccaaccaaccagtcacagttgtgatgtaggatgtgactgtgaatgacatccctgctgcccgcttcagagaaagggctgccacttgccagagaaggaatg

SEQ ID NO: 50096 - DNA, 201 bp, Homo sapiens
tgtgtgtttcccttctaatataatgccactgatgatattataattaataggtaacattatgcatgacaggcactgtgtgctaagggttttaatgcattatytcatttggccatttcagaaataccaagaggtaggtgctgttcttgtttatttgtttgttttttttttttgatagggagtcccactctgtcacccaggctg

SEQ ID NO: 50097 - DNA, 201 bp, Homo sapiens
taaataaataaataaataaataaataaaataaaataaataaaaaaagaggttaaggtttatacgcaggccatttctaatagatgttatggaagccccaggktttggggcatcagggttggaaaggaagccaaaaatgggtgtgtccaaaggacagatgcattgagaatgggttgtaaaatttcagccattgtgtagattaa

SEQ ID NO: 50098 - DNA, 201 bp, Homo sapiens
gactcaatatagggtgggatagggcggtgggtaaaagccgttacaattttgtccaaatggtatgggctgatttacttattagggaggtacaaatggcttcrtgttataaagtgtcaagatccttatttggataaggcaaccagagtgtagacgagagagtaagagtaagaaaacaaggagaaaaatgagtgtcttaaggat

SEQ ID NO: 50099 - DNA, 201 bp, Homo sapiens
aaaagtgaaaaggaatagccgaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcacatctgaatgcaaactggtcacctctcaggggct

SEQ ID NO: 50100 - DNA, 201 bp, Homo sapiens
aaaaagtgaaaaggaatagccgaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcacatctgaatgcaaactggtcacctctcaggggc

SEQ ID NO: 50101 - DNA, 201 bp, Homo sapiens
tctttctggtattagacacataccacttgcctaataacgttccaaaaggaattcattgtttacattgctattagaacatatgagattgcctgtttcattaygtccgtcccagcactgggtattatcattaaaaaaaaaagattttaaatttatttattgagttatttacttgagacagagttttgcttgtctcccaggctg

SEQ ID NO: 50102 - DNA, 201 bp, Homo sapiens
aaaaaagtgaaaaggaatagccgaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcacatctgaatgcaaactggtcacctctcagggg

SEQ ID NO: 50103 - DNA, 201 bp, Homo sapiens
caccttggctcctcaaagtgttgggattacaggcgtgagccaccgtgcccagccaatattttaaatttaatgtttacatttgcacacatgccaattgggcwtcatggtggctgcctcacaccactttttgtccgtgtgtgagactcacatagaggctgttttctgtgatccttttttaaaaaataattacatttttttaat

SEQ ID NO: 50104 - DNA, 201 bp, Homo sapiens
tggtaggaaacaaaggctcctcccagtggcttctctgtaaggagaatccacttaaaattaaaaaaaaaattaattttggagtagatagtacgtaaacatgrcacaattttttttgttttttggacaaggtgtttgcagtgaaagcatttcccttttttgtcccctacctgcccatttcctctccctggaggtgacgtttgt

SEQ ID NO: 50105 - DNA, 201 bp, Homo sapiens
ataggttatcaagatccaggggagagaagaacttacttaaagtcacaaaaccaattagttacaaagtagggtctagaaatcagatttcctgaatcatattktagtgttttgtgaataatagtactctgaccccctcttgccaaattataccctgggttttgttgttttgggaagattgtttactgtcatttctagagtatg

SEQ ID NO: 50106 - DNA, 201 bp, Homo sapiens
gatacacaaatatatgtgtgagtatacatatatttaatacatatatatttaatatttaatacacacacacacacacacacatatatatatatatatatatwtttttttttttttttttttttttgagacagtcttaccctgtcacccaggctggagtgcagtggcatgatcttggctcactgcaacctccatctcctgggt

SEQ ID NO: 50107 - DNA, 201 bp, Homo sapiens
gccaatattttaaatttaatgtttacatttgcacacatgccaattgggcttcatggtggctgcctcacaccactttttgtccgtgtgtgagactcacatakaggctgttttctgtgatccttttttaaaaaataattacatttttttaatgctcagggaaaatgtcaaataattgtttatgttttgtactgaaatctgcac

SEQ ID NO: 50108 - DNA, 201 bp, Homo sapiens
ttttaaacatatacatatagatacacaaatatatgtgtgagtatacatatatttaatacatatatatttaatatttaatacacacacacacacacacacayatatatatatatatatatttttttttttttttttttttttttgagacagtcttaccctgtcacccaggctggagtgcagtggcatgatcttggctcactg

SEQ ID NO: 50109 - DNA, 201 bp, Homo sapiens
ttataccctgggttttgttgttttgggaagattgtttactgtcatttctagagtatgaatgagtctttctaattgcatattttttctttccctttctatcrtgaagacctaaaaagtgagtaatctctttattttttttaataacttgtacttttctattgaatatggacttcactgaatgtaaaaaatcctgataagttt

SEQ ID NO: 50110 - DNA, 201 bp, Homo sapiens
cctctgctcatgcttcgttgagcaaaacttagtcacattgcaacatctagctccatgggagctgggaaatgtggtctttgtttccaacaggtatgcacacacagggctaaaaatctgggtgggtatgatgaagggaaaatgggggaatggattttgggggtcaagactggtctctctctgctgtccctccctgaacagagg

SEQ ID NO: 50111 - DNA, 201 bp, Homo sapiens
aaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttctg

SEQ ID NO: 50112 - DNA, 201 bp, Homo sapiens
taaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttct

SEQ ID NO: 50113 - DNA, 201 bp, Homo sapiens
ataaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttc

SEQ ID NO: 50114 - DNA, 201 bp, Homo sapiens
gagctcttagatgaggatattgatgtccagagaagacagggagcaggctgaggtcacccagcaaggtattagagaagacaagatgggaacctgggtcacckgcctgggcctcatattttcaaagtgctatttttttttttcccgtgttttcactttgatcttacttttaatgatagggacgtatcactgtgtcttctcaaa

SEQ ID NO: 50115 - DNA, 201 bp, Homo sapiens
cccagaagaagcatcttcaaaatccacattcagcagttcattttgataatggatatttcagggaatcagtgcatttttgagctggaccagactttcaagayagctgaaacccctcagagctcttagatgaggatattgatgtccagagaagacagggagcaggctgaggtcacccagcaaggtattagagaagacaagatg

SEQ ID NO: 50116 - DNA, 201 bp, Homo sapiens
cctaggttcaagccatccttgtatcggcctcccaggtagcttagtctacagctgtgtgccaccacacccggctaatttttgtagaaactgggtttcacccygttgcccaggctggtttcgaactcttgagcttaagtgatctagtcaccttggcctccggaagtgctgggattacaggcgtgagccatcgtgcggcctggc

SEQ ID NO: 50117 - DNA, 201 bp, Homo sapiens
aaaaataaactttcacatcatgttacccctggatacatttttgtggccatgcatctgcacgaatattcaatccctgctacaggcaagacactgagtgggaygttgcagggctaccaaggtgaggaggtcccaacccctgtcctcaaggagttgatgtaacacctacccaggattaatttcatttctctcagaggtcattaa

SEQ ID NO: 50118 - DNA, 201 bp, Homo sapiens
atcctcttggaaaaccccacgcttatcaggaaaaggagatggaagtgaaaaaataaaaatatatataaaaaaaggaaaacctagtgttagcaccccttatscagcaggccccccacctggacccccacctgtattcacattcctcccacacttacagtcagtggcttcattaatctctaaggttccatgttctgctcccca

SEQ ID NO: 50119 - DNA, 201 bp, Homo sapiens
ctcatagagcttttttcttcttttttgtatatccaggatttctttagcggtcttttgtaattatagtaaaagcactgaggttagatttatgggttttttttgaggaggatagactgaatccctttcccgcctcaaggctatagtgggtcggcacagtttgtgtttgctaaacatatctttagctgcgtaagagaaagaagg

SEQ ID NO: 50120 - DNA, 201 bp, Homo sapiens
gtatatgggaataagtggggtgctggatcttgtgggcaggctatgggatctgggaaaggggttagcacctgggcctggagggacctggaatctaggggggscatacatctaagctaaatgtggctgtggcttgcaaactcagaggcctttcgggcagcctggtgaaatgataaatgggcagttgctgtttattctcagtcc

SEQ ID NO: 50121 - DNA, 201 bp, Homo sapiens
tttcctgaatcatattttagtgttttgtgaataatagtactctgaccccctcttgccaaattataccctgggttttgttgttttgggaagattgtttactrtcatttctagagtatgaatgagtctttctaattgcatattttttctttccctttctatcatgaagacctaaaaagtgagtaatctctttattttttttaa

SEQ ID NO: 50122 - DNA, 201 bp, Homo sapiens
ggtgctctcattttatttttagagctatattttagctctaacgtgattgttgggtgaacacttgcagaatgaaatatgactgacacctaccagctgtctayacattcctggttatatcttaggaaggcagtgtgtgctagcaccttgggaagagaatgttgagttcaaatcctagttttgccccttgcaccaataccttga

SEQ ID NO: 50123 - DNA, 201 bp, Homo sapiens
ccagcttggccaacatggtgaaacaccatctgtactaaaaataccaaaaaaattagccaggtgtggtggcatgcacctgtaatcccagctacttgggaggytgaggcaggagaatcgcttgagcctgagaggtggaggctgcagtgagccgagatcactccattgcactccagcctgggcaacaagagtgaaactccatct

SEQ ID NO: 50124 - DNA, 201 bp, Homo sapiens
tttcttcaacttcacaccttagtttctttacttgtaaattgggttgatagtgggctgctgtcagaattaaggacatcgttttgtcaaggattttgcatacrggaagtcatggtgacagctgttgttactgttgtcctgaggagtggggacaggagaggaggaaaacaggctggtccaggtgtctttccttaaaggaggctc

SEQ ID NO: 50125 - DNA, 201 bp, Homo sapiens
ggaaaattttagaagttttaggtgtaaatgcagctggtaagatccttatgacttagtttcttttttttcttcttttcttttctttctttctttcttttttyttttttttttttttttaagacagagtctcactctgttgcccaggctggagtgcagtggcgcgatctcagctcactgcaacctccgtctccccagttcaag

SEQ ID NO: 50126 - DNA, 201 bp, Homo sapiens
gggtatgcgtgctttcagttttgatacatactgccaaattaccttccagaaagtttttcttaaataccaatgcagagttgagtcaacagtgcaggagtgtrcagatgcctcaccaacttgccagttccggatctgatatgttttttggtttattgcattcatttatcagaaaagctttctcaaaaacaaagtatgaaataa

SEQ ID NO: 50127 - DNA, 201 bp, Homo sapiens
gcccattcagagaagctctgaaccctgcaaaagctcccacgtggaggccagtgagctggttataatccagagactgtcagtttttcctagtacatatttgracctgagcctttgtttctgcaaagagtctggtactgactcacacagtgtcagcagcccccttccatcccctggcacacccctccctcattcctactgagc

SEQ ID NO: 50128 - DNA, 201 bp, Homo sapiens
tggggaaaattttagaagttttaggtgtaaatgcagctggtaagatccttatgacttagtttcttttttttcttcttttcttttctttctttctttctttytttttttttttttttttttaagacagagtctcactctgttgcccaggctggagtgcagtggcgcgatctcagctcactgcaacctccgtctccccagttc

SEQ ID NO: 50129 - DNA, 201 bp, Homo sapiens
tgtaagtacatgtaggattttcatgtagaggagttggggaaaattttagaagttttaggtgtaaatgcagctggtaagatccttatgacttagtttctttyttttcttcttttcttttctttctttctttctttttttttttttttttttttttaagacagagtctcactctgttgcccaggctggagtgcagtggcgcga

SEQ ID NO: 50130 - DNA, 201 bp, Homo sapiens
tttgttcaaagccaaatgttgctacttctgaagacgagtgcaccttatgggtatagccagctataatgtttatcaaacatatactttttttttttttttttgagatggagtttttgctctgtcacccaggctggagtgcagtggcatgatctcagctcactgcaacctccacctcccaggttcaagtgatttctcctgcct

SEQ ID NO: 50131 - DNA, 201 bp, Homo sapiens
gtggatctcaaactttagcatccatcagcatcaccaggagggtggttctaccctcagagtttctaattcggaattgcgtttctgccagtttctgggtgatyctactgctgtggcaccagggtgcacacttggagtggtactgtccccaggatagtgggagcccttcaggcatcatttcttttattgttctttaattcatgg

SEQ ID NO: 50132 - DNA, 201 bp, Homo sapiens
tccctcttgcttctttctgttcatcagcttcattctcagagcagctccctctgcacacttaaggagcccagctgctcccgtttcacaccctgcagctgccycaccagccagctgccccaccaaccagggtctggtccagggaaacgtgtcttgagtggggtctgattagcaaagtctgcttcacagagctgtccctggaaa

SEQ ID NO: 50133 - DNA, 201 bp, Homo sapiens
cctgggaggcgggggttgcagtgagccgacatcgcgccactgcactccagcctgggccacagagcaagatttcatctcaaaaaaaaaaaaaaaaaaaaaaagaaaaagaaaaaaagaaatgcaggtaggtgcttctagctactgctgtgggatagcaaggtagttaccaaactgataagggtagcatcttacttactgctg

SEQ ID NO: 50134 - DNA, 201 bp, Homo sapiens
gcagaagcaaatatgagaatccagctgtttcttactaagcagacattaaagagatttgcaaatatctaaaataatgctatctctctcacttttttttttttgtattggaaacatcattttccatacaatgtcatttatgttaacaggtgacagatttatttatttttattttttatttttttgaaacggagtttcactgtg

SEQ ID NO: 50135 - DNA, 201 bp, Homo sapiens
gattccagggcatatgcacatggcctcccttcccctcaaaatttacaaaagcaaatccaattaaattgtgcaggcattctaggaagtcaagtttatgtgcyttttttctttttcaaggatgctttgaaaatagaggcagtgccatgaagcagcattggtatctgttgatgggtgtgtgcattggcataactctctgctgtt

SEQ ID NO: 50136 - DNA, 201 bp, Homo sapiens
aagccattctcctgcctcaccctttgagcctccttaattttttatttatttattttttttttgtagagacagggtctcattatgttgtccagcctgatatkgctatttttttttttttaatggcgatgtagtaatcttgctttgttgcccaggctgttctggaactcctggcttcaggtgtgtgccactgtgcctggccca

SEQ ID NO: 50137 - DNA, 201 bp, Homo sapiens
ttatttggttagaaatatggcatcaggagcggccacttgctgttaggagtaattgataacagttacattaataggattccagggcatatgcacatggcctyccttcccctcaaaatttacaaaagcaaatccaattaaattgtgcaggcattctaggaagtcaagtttatgtgccttttttctttttcaaggatgctttga

SEQ ID NO: 50138 - DNA, 201 bp, Homo sapiens; identical to SEQ ID NO: 9344

SEQ ID NO: 50139 - DNA, 201 bp, Homo sapiens
ttaagagtaactagtttaaaacttagcacttttccctccttgcctcaaaaaagtgaagctacagtatagttttaaatttactagtcaagttacaaaattcyttttttttttttttttttttttttggagacagagtctcgctctgtcacccaggctggagtgcagtggcacgatcttggctcactgcaagctccgcctccc

SEQ ID NO: 50140 - DNA, 201 bp, Homo sapiens; identical to SEQ ID NO: 9330

SEQ ID NO: 50141 - DNA, 201 bp, Homo sapiens; identical to SEQ ID NO: 9331

SEQ ID NO: 50142 - DNA, 201 bp, Homo sapiens
ttccccaatcctgcttcctggaggtagccaatgtttatagtttggtgtacatctttataagactctttatgtacatctgtaaacacacacacacacacacrcacacacagtactttgaaaaaattggatgctgttttttttttgagatggagtcttgctctgttgcccaggctggagtgcagtggtgccatctcagctcac

SEQ ID NO: 50143 - DNA, 201 bp, Homo sapiens
atacaatcatttcagtagatgcagaaaaaacatttgaccaaaaaatattgttaactgtgctttcttttctgaacttaagaacttgcttttccaaaaccttmccagaatccctgtatgaatcaacaaaatttagttcttaacacatttctccttctttaaaatggtgacattagctgggcatgatggtgtgtgcctttaatc

SEQ ID NO: 50144 - DNA, 201 bp, Homo sapiens
atgcaggagcctgtgctagcagttgaccattaacatgggaacgccacctcccagcgggcactgctgccgcatacttgcgaggttgctgaagcttgtagttyagagcaggaccatcccactagatgtgcaatgtgagcctcaggtataatttaaagttttctagaagccacactgaaaaaaaagtgaaaaggaatagccgaa

SEQ ID NO: 50145 - DNA, 201 bp, Homo sapiens
ccttccccaatcctgcttcctggaggtagccaatgtttatagtttggtgtacatctttataagactctttatgtacatctgtaaacacacacacacacacrcgcacacacagtactttgaaaaaattggatgctgttttttttttgagatggagtcttgctctgttgcccaggctggagtgcagtggtgccatctcagctc

SEQ ID NO: 50146 - DNA, 201 bp, Homo sapiens
gtttagagcaggaccatcccactagatgtgcaatgtgagcctcaggtataatttaaagttttctagaagccacactgaaaaaaaagtgaaaaggaatagcygaaattggtattaatagcattttacttaacttagtatattaaaagtattatttcaacatgtaatttctgtgaagtattaatgagttattttatgtcttct

SEQ ID NO: 50147 - DNA, 201 bp, Homo sapiens
ttccctgcgggccttggccattcctgtcctggcctttactggcagtctctattctaaaatgtgggcatcccacatgaggtccagcttctcctgagatcccyggaggtgcagctgctgtgatggtgaccttgtttagcagatgctccctgcagtccaaactcccacccatcgtcctgccctttgatccatttcccatgaact

SEQ ID NO: 50148 - DNA, 201 bp, Homo sapiens
cattcagagaagctctgaaccctgcaaaagctcccacgtggaggccagtgagctggttataatccagagactgtcagtttttcctagtacatatttggacytgagcctttgtttctgcaaagagtctggtactgactcacacagtgtcagcagcccccttccatcccctggcacacccctccctcattcctactgagcatt

SEQ ID NO: 50149 - DNA, 201 bp, Homo sapiens; identical to SEQ ID NO: 9334

SEQ ID NO: 50150 - DNA, 201 bp, Homo sapiens
taagccattctcctgcctcaccctttgagcctccttaattttttatttatttattttttttttgtagagacagggtctcattatgttgtccagcctgatattgctatttttttttttttaatggcgatgtagtaatcttgctttgttgcccaggctgttctggaactcctggcttcaggtgtgtgccactgtgcctggccc

SEQ ID NO: 50151 - DNA, 201 bp, Homo sapiens
agctaaagatggattcagtgttttttttttctttttctttttttttttttgaggcggagtcttgctctgtttcccaggctggagtgcaatggtgcgatctyggctcactgcaacctctgccgcccagattcaagcaattttcctgcctcagcctcccaggtagctgggatgacaggagcccaccaccacgcttggctaatt

SEQ ID NO: 50152 - DNA, 201 bp, Homo sapiens
ggagaagaaatctctctgccatcactttcttatgattctccttctgtgtacctttcttagctggtcacccttctgcagatgtcctgaaatacacgtatgasgatttcaaaaagggagcctcagatacttatgtgacatacctcataagaacagaagaaaagggacgttctcagagcttgtctgaagttttgaaatatgaaa

SEQ ID NO: 50153 - DNA, 201 bp, Homo sapiens
gctataggaattgagactaagttggagctgggtgatcagggaaggttttaaggaagagatctgggacaaatagctaaagatggattcagtgttttttttttctttttctttttttttttttgaggcggagtcttgctctgtttcccaggctggagtgcaatggtgcgatctcggctcactgcaacctctgccgcccagatt

SEQ ID NO: 50154 - DNA, 201 bp, Homo sapiens
agcattatttatttatttatttagttagttagttagttcttgagatggagtctcactctgtcacccacgctggagtgcagtggcatgatctcagctcactrcaacctctgcctcctgggttcaggtgattttcctgcctcagcctcctgagtagctgggattacaggggcccgctaccacgcccagctaatttttgtattt

SEQ ID NO: 50155 - DNA, 201 bp, Homo sapiens
aaattgaggtgtgttattccactgcttaaaagcctacatggcttcatatcgctgttagtataaacccaaacagtggtctgcaagactctgaaccttagatyaggatgatcagacccctccctcccctccaccctccgacctcatcctggctacccactccctgttcacagactacagtcacctggctctagtacaacagac

SEQ ID NO: 50156 - DNA, 201 bp, Homo sapiens
tgttttcttatatatattttacatgacaaaattatatttaaaacatattaaactttaaaaaaccatagtttataatttataagccatgtagcatatttctrtttttgagacaggatcttactctgtcacccaggctggagtgcagtggctcgatcatggctcactgcagccttgacctcctgggctcaagtaatcctcctg

SEQ ID NO: 50157 - DNA, 201 bp, Homo sapiens
tggtctgcaagactctgaaccttagatcaggatgatcagacccctccctcccctccaccctccgacctcatcctggctacccactccctgttcacagactrcagtcacctggctctagtacaacagacacttgaacctaccccgcccctctccctcagggcctggtactatcctcctcgctccttcttatcactcaggccc

SEQ ID NO: 50158 - DNA, 201 bp, Homo sapiens
ccctctccactgtgactgtttcctgggaaactagtcaggggctggttttataggaattatccagtcgtattattattattattattattattattattattattattattattgagactgagtctcgctgtgtcgcccaggctggagtgcggtggtgccatcttggctcactgcaacctccgcctcccaggttcaagcaat

SEQ ID NO: 50159 - DNA, 201 bp, Homo sapiens
cccctctccactgtgactgtttcctgggaaactagtcaggggctggttttataggaattatccagtcgtattattattattattattattattattattattattattattattgagactgagtctcgctgtgtcgcccaggctggagtgcggtggtgccatcttggctcactgcaacctccgcctcccaggttcaagcaa

SEQ ID NO: 50160 - DNA, 201 bp, Homo sapiens
aatgagaagacaattactgttgtgcatcaaccatggtgtaacatcacaggcttacgtccagcgacttcatatgtattctccatcactccaggaataggcartgagacttggggagatcccagagtcataaaagtcatcacaggtaagatgactggctcccagggatgatgacaaaccatttcttattatggtgtattctag

SEQ ID NO: 50161 - DNA, 201 bp, Homo sapiens
tcccctctccactgtgactgtttcctgggaaactagtcaggggctggttttataggaattatccagtcgtattattattattattattattattattattattattattattattgagactgagtctcgctgtgtcgcccaggctggagtgcggtggtgccatcttggctcactgcaacctccgcctcccaggttcaagca

SEQ ID NO: 50162 - DNA, 201 bp, Homo sapiens; identical to SEQ ID NO: 9345

SEQ ID NO: 50163 - DNA, 201 bp, Homo sapiens
tcagggacctctttttgctctttgttatcccacagggcttgtgtggctggcttcaccaacattaccttccaccctcaaaacaaggggctcattgatggggytgagagctatgtgtccttcagtcgctactcagatgctgtttccttgccccaggatccaggtagggagaagacaacagtcctggcactggttcagtggcat

SEQ ID NO: 50164 - DNA, 201 bp, Homo sapiens
ctaggagagattcctagaaatgagttcactgagaatatgagcttaagagaaagtgaggatttaaagccagatctgtctgccttcaaatccagcgctctttmtactgatgtgagttctcctgtcttttttacctatcagaattctagaactctcccagagaaaccaggcagatactgctccacaccggtgagctgcttctca

SEQ ID NO: 50165 - DNA, 201 bp, Homo sapiens
atgccactctgactctgtgaacttgtcactttataaagaggaaattcaagcttggaggggccttctggcatgacgtttattgaattgtggggcacaagatrcttccctgcttgttccattttcctttctcttgtttattctcctgccttatttatttattttttcttttgagacagagtcttgctctgttgcccaggctgg

SEQ ID NO: 50166 - DNA, 201 bp, Homo sapiens
aatgttacgtgggttgtaaatgtaattgttaatattatttaaaaatttttgaaaagtgatttttagtggtggccttatcatatctacatattattactccmccattttgggatgtttaggtcgaatcctggttttttcttcttttgctgttgtaagtcatgtatattggcaattagcctaggagagattcctagaaatgag

SEQ ID NO: 50167 - DNA, 201 bp, Homo sapiens
cccactggctctgtttggttcctctgggctcacacacagggagctacgtatgtctctctcatttcctttggtatgttctctgggttaaatgtccccagctrtctgatctgttccctgcgggccttggccattcctgtcctggcctttactggcagtctctattctaaaatgtgggcatcccacatgaggtccagcttctcc

SEQ ID NO: 50168 - DNA, 201 bp, Homo sapiens
tctcaactgcatgtttttgtgtgagtccagaatttctttacattattgtaacagagtgaacgcagaagcaaatatgagaatccagctgtttcttactaagsagacattaaagagatttgcaaatatctaaaataatgctatctctctcacttttttttttttgtattggaaacatcattttccatacaatgtcatttatgt

SEQ ID NO: 50169 - DNA, 201 bp, Homo sapiens
catggtttcttggatagtattacatagggtgaagctaattttatttcagtaaaaaatatgcaggtcaatttaaataaaaaaatagataatagtataaatgkcttgtggctacagtaaaaatgatgatggtacttgaatgtccaaattaatttaagtgatatatgtgttcatagataccatttcattttaacgtggttctgc

SEQ ID NO: 50170 - DNA, 201 bp, Homo sapiens
ctgatatttcgttgaaagtcattgtcttactcatccttgtataagataagtcacacaatgagtggtatcagggttgcagggtttccccctgtgaggacacratgggatgaaccgtgtgtgggatggtctgttaaagaaaaacaagaagccatgtgttggaaacaacctaagtattgagcggtggaggattgctgaaattgt

SEQ ID NO: 50171 - DNA, 201 bp, Homo sapiens
agggtttttctgtgtggctcaggctggacttgaattcctgagcccaagtcatccttccgcttcagccaattgagtagctgggattacaggtgcactgtccstcccagcaagttgggtctttaaataaagagtggggtttggtgagcagggtgggtgcactgttctaggaggtgggcaggacagaggtcagtggtggtccct

SEQ ID NO: 50172 - DNA, 201 bp, Homo sapiens
ggggtttcaccatgttgtccaggatggtctcgatctcttgacctcatgatctacctgcctcagcctcccaaagtgctgggattacaggtgtgagctaccaygcctggccattttttttttttttttttttttgagacagagtctcactctgtcacccaggctggagtgcagtggcatgatcttggctcactgcaacctccg

SEQ ID NO: 50173 - DNA, 201 bp, Homo sapiens
gaatacagagtagagaagggtcaccttgtcatgttggtattggaagatactgcccagatgaggagcttcgcctgcaacagttagggaggtgttttgcgaayatttgaattaaatacatggtaaagatgttagtttgtaatatgtttttagtatatttttctccatctattagatttaaaaaacagattagaaattaaatgt

SEQ ID NO: 50174 - DNA, 201 bp, Homo sapiens
ggtcacagcccatgtggcaagaccccccatgatgccttgcacaaggtcagcctcctgggcccagagcaggtgagggaagggcagtggatatgtcgggaggrtggagtgggcaggtggtgaataactggcactcgggttatcttttcttgaggttaggattgctctccagttttataggtgaggaagctgagctcaagtggt

SEQ ID NO: 50175 - DNA, 201 bp, Homo sapiens
tgactttggacatgttccttaactttctttatcttggtcttctcatctctgtaaaattgggatcataatggcaccaacttatagttttttttttttttttwtttcttttgagtcaggatctcaccctgttgcccagactggagtgcagtggtgtgatcttggctcagcccttgggctcaaacgatccccccacctcagcct

SEQ ID NO: 50176 - DNA, 201 bp, Homo sapiens
aaaaaaaaaaaaaaaaaaagaaaacaggaagtagggaggggcaaggaggcatctggtgcagtgatctgactagtttcagttctttgttactccctgaaggycctttcctgagaaaggaactcagataaaacaaatacaagtttcaggctttaatagcagaagggtaaatttctatgtttattcaaaaacaacttgtctatg

SEQ ID NO: 50177 - DNA, 201 bp, Homo sapiens
aaagcaaggcagatacaaagatcatcctgttggcagatacagacagggagggacagagaggttaattaagcaagctacctgcccgcagttacatggccagmagcagtggcactgaacgacttccttcaggcggtctgagtccaggtctcagctcttagccatcactccatggttctgtgctgagacaagggatgtagaaag

SEQ ID NO: 50178 - DNA, 201 bp, Homo sapiens
tgaacattagagcatgcagtttgctgagatgtcttgtacttagaaaatccaatttataaaaaacctcaaatagaacagtaaatttagggaattttttttttctgatgataaaattagataactctgttgcatggattctgtaaaacacagctccctcctgttacgccatgaattgggttcaatttacaacacccctttagg

SEQ ID NO: 50179 - DNA, 201 bp, Homo sapiens
tttcaccattacaagtggtgcaaggaccaatatcttcatgaatacagcattttctgtaaagcagaaattctttcttcaggattaatttccagatatctttytggtattagacacataccacttgcctaataacgttccaaaaggaattcattgtttacattgctattagaacatatgagattgcctgtttcattatgtccg

SEQ ID NO: 50180 - DNA, 201 bp, Homo sapiens
cattttgaaaacgaggcagtgtcagctcccacagaaggtctaattttaaacatgcaaataattttcagttccacttttccttcttcctgttagagggaagytgtcccctgttgccatttctgaaacttgggcggacaatgtcgttattgtgttacaaacgatttgcgtctccagggcaggagttgggtgatatttttctgg

SEQ ID NO: 50181 - DNA, 201 bp, Homo sapiens
cttttccattaaagtgtggatggtgtactgtaaacaaagactagctctcttgagctgccacgtttctataacttatagaaacagaagctgttttttttttctaaagatccaaactcatgttgccacacaaacaacaaaataaaccagtgtgttccaaaaacaagcatttgctctacccacacgcacagttggaaagatgca

SEQ ID NO: 50182 - DNA, 201 bp, Homo sapiens
caatggcgtgatctcagctcactgcaacctctgcctcccgggttcaagcaattctcctgcctcagcctcccgagtagctagaacacaggtgcccgccaccacatccggctaattttttgtatttttagtagaggtggggtttcatcatgttggccaggctggtctggaactcctgacctcaggtgatccacctgccttggc

SEQ ID NO: 50183 - DNA, 201 bp, Homo sapiens
caaaaataaacataaaaataaacactttatgtacacaatctcacatcactttcacagtcttggaaggcagatatttctgttatcctcattttacagctgaygcctatctaaggcttgtataaaagtcagtcactgtccaggctcacacagccaatgctggagggctgtgtggcacccagagagcacagttgctgcttggaa

SEQ ID NO: 50184 - DNA, 201 bp, Homo sapiens
ttaaatttaggtctgtcttgttctgcagtccatataccatataactttgccaaatacaacactatggtgtgtgtgtgtgtgtgtgtgtgtgtgtgtgtgtgtatgcacatgtgtggcctttattgaacactgtggtgtgtgtgtatgcacgtgtgtggcctttattgacttattgaattgatcctgaatcttccctactcc

SEQ ID NO: 50185 - DNA, 201 bp, Homo sapiens
tccgtgagtccacgtgtgcccttgtctctgcttgctgtgcctttctctttcctccacgttgctaaattccgtccatttttcaaggctcagttcagatcatycttctttgctttatcattttacatactgtgtatggtttggcctcttggtctgctgctctctgtgtctgttgtatggagcgcttttctatctggtattacg

SEQ ID NO: 50186 - DNA, 201 bp, Homo sapiens
ccatgtccctacaaaggacctgaactcatccttttatggctgcatagtattccatggtgaatgtgtgccacatttttcttagtccagtctatcattgatgkgcatttcggttggttccaagtctttgctattgtgaatagtgctgcaataaacatacatgtgcatgtgtctttatagcagcatgatttataatcctttggg

SEQ ID NO: 50187 - DNA, 201 bp, Homo sapiens
cctggccagcatggcgaaacaccatctctactagaaatacaaaatttagccgggcatggtggtgtgtgcctgtaatcccagctactaggggagctgaggcwggaggatcgcttgaacctgggaggtggaggttgcagtgagccgagattgtgccactgcactgcagcctgggcaacagagcgagactctgtctcaaaaata

SEQ ID NO: 50188 - DNA, 201 bp, Homo sapiens
gtcagtactagacttagcattgttatgttattttgtccagaggagggtgaggtagtacaatcagagacggggaaactgaggtggtgctgcttctggctcakcctgacacttgcagttctaaggttattatttcatctcttaagttgggcaagtttgtgtgtatgcttttgagatgacaataatatttataaaacataattc

SEQ ID NO: 50189 - DNA, 201 bp, Homo sapiens
agctgctcaggaggctgaggcgggagaattgtttgaacctggcaggtggaggtgcagtgagcagagatcatgccactgcactctggcctgggcaacagagygagactctgtctccaaaaaaaaaaaaaaaaaaaaaaaaaaaaaaaaatcttcagtgcagggcctgtctgctctccagggaaggctgcagtattgtcaggt

SEQ ID NO: 50190 - DNA, 201 bp, Homo sapiens
attggaagccatgaggagttgactcaagactcaagacttcaggtcaatatctcgggcctgaagccaggggttcaatacaacatcaacccgtatcttctacmatcaaataagacaaagggagaccccttgggcacagaaggtggcttgggtgagttacaaagggtaccttccgtctcccttactggttcttactttcagtaa

SEQ ID NO: 50191 - DNA, 201 bp, Homo sapiens
ttaatagagatggggtttcaccgtgttagccaggatggtcttgatctcctgaccttgtcatccgcatgcctcggcctcccaaagtgctgggattacaggcrtgagccaccgcgcccggcccggaatacccttaaaatatagccagaaagggctgaggatgggtaagaacccaggatatagagtcttcccataaaagggagg

SEQ ID NO: 50192 - DNA, 201 bp, Homo sapiens
gtagccagatctttgcagacatcacaattaatttcttagtaaacttttctataaaattaatgaatcgaaatatataaaaaggtagggctttaggctggtcrtggtggctgatgcctgtaattccagcactttgggaggccaaggcaggtggattgcctgagctcaggagtttgagaccagcctgggcaacaaggcaaaacg

SEQ ID NO: 50193 - DNA, 201 bp, Homo sapiens
aaagtccactggctttcgtctctctctgccgtgacacatatcggaatctactgtatatatatatatatatatatatatatatatatatatatatatatatrcactaagctctcaaaaacagtcattcctatgaattgaggtgtacaaagtttgaatttgtatcaaagatgtaattattatttttaaaaccttttcactata

SEQ ID NO: 50194 - DNA, 201 bp, Homo sapiens
actcctctgctcacctctaaccaaagagccacctaattgttctgcatggtgaccattgcctgttagattcttggtgaatagattcctagcctcatcttttkttatttttatttttttaataaatggtagaatgaggatgcaggaaacttggaaaagcagagtcaaagttcaactagcacaggagcagaaggtaaattctgt

SEQ ID NO: 50195 - DNA, 201 bp, Homo sapiens
cacatcagtaagatggggaatgacaacccttatgggactgcagtgaggcttagccaagttggtgctgtggaaggccctactggattccaaagcatgatacrgatgatgaatactttatgtggctgaggtgcttccagcaggcacgtgggaagcatccatgtaagattggggtcatgcaaaatggggtgggatcacatcgcg

SEQ ID NO: 50196 - DNA, 201 bp, Homo sapiens
ttggggtcatgcaaaatggggtgggatcacatcgcgggatgaagcacttggatgcaaaggcctgtgtggtccagcctgagtctggctcaacacacagggtyggatcctggctgcgctccttactgctgtatgtacagatttggctcagagggaatgcaggattggcaacatgcatctagtctttcttgtggtctcctggtg

SEQ ID NO: 50197 - DNA, 201 bp, Homo sapiens
tcctggccagaccacggtgttcccgacaccactgacctgctcatcaacttccggtacctcgttcgtgactacatgaagcagagtcctcccgaatcgccgaytctggtgcattgcaggtacgcagatggcacgtcacgtgtgacagatttcaaatgtcattatatatttatgagcactttacaaaagcaaagcctaagaggg

SEQ ID NO: 50198 - DNA, 201 bp, Homo sapiens
tgtgatggtaggtggtacccacaatgatggcccttcaggggatttgaagattgtgaaggaggaccaagaggagctgtttggaccacctgtgatccaaggcrggaactaggaagacacctaccggaagtctttgtggatcttttgggattggattggattagcagatacagagcgtttgacctatagtaaccagctgactgt

SEQ ID NO: 50199 - DNA, 201 bp, Homo sapiens
agctgtttggaccacctgtgatccaaggcgggaactaggaagacacctaccggaagtctttgtggatcttttgggattggattggattagcagatacagarcgtttgacctatagtaaccagctgactgttcagcaaacgcttcacttcctaaaaggcttcttctttccaaggcaaactggggcatgtgaggaacaggaac

SEQ ID NO: 50200 - DNA, 201 bp, Homo sapiens
ttaaaggatacctctattccccaggtcctttattgattcatcttatttttatttgtataataaatcattagaatagtgcctggtgctctattgcactcacktgcatatactgtataaagctttgtacatattacttgtttagtcctcacagcagccctaggaggtaggtactattattttgctcattttgcaggcaagaaa

SEQ ID NO: 50201 - DNA, 201 bp, Homo sapiens
ggtcatcccatttccatctgaaaggcccccttgttcatgaagcctctcatggtccttccccctaccccagccaggtatactttctctcctcttggaattaycctataggaagaacatggtggcttgacctgggttccagtctcacccatctgtttacctggggagtgatcttgagtgggtcaatttatgttctcagtgcct

SEQ ID NO: 50202 - DNA, 201 bp, Homo sapiens
ttttgcacattcattgttgtattagagtttgtttttttgtcttaccttgttttaataaattataatcttatgggagatgacactgtcttttctttgtttcrtatataaaaagtgttttgctgatatacgtagaatcaagttggtctggagttactctggataagggatgaaatcagggagctcttgtgttcaaaggggcct

SEQ ID NO: 50203 - DNA, 201 bp, Homo sapiens
tttctcctcattttttagcttccatttttacttcctttagtattgagaaagtaccaggctcacttcaaagagttgacttcaaagctcccaccagctcagamatacttgccactgaagcctgtaggaattggcatcaatggaagaccctgtggcggttgcatttaagattttttttgggacttctatttttataattctttt

SEQ ID NO: 50204 - DNA, 201 bp, Homo sapiens
attttttagcttccatttttacttcctttagtattgagaaagtaccaggctcacttcaaagagttgacttcaaagctcccaccagctcagacatacttgcsactgaagcctgtaggaattggcatcaatggaagaccctgtggcggttgcatttaagattttttttgggacttctatttttataattcttttaaatggtaa

SEQ ID NO: 50205 - DNA, 201 bp, Homo sapiens
gaagcctgtaggaattggcatcaatggaagaccctgtggcggttgcatttaagattttttttgggacttctatttttataattcttttaaatggtaaaggrggagggttacaaaatatctgcgcctttaagatatcaaacataagccagtgaagttccaaaaaaaaaaaaaaagatgtcttagagaaatgaaaaggatttt

SEQ ID NO: 50206 - DNA, 201 bp, Homo sapiens
gaacaactcttttttctttttctttttctttttttgtttttgagatggagtttcgctcttgttgtacaggctggagtgcaatggcgccatctcagctcacygcaacctccacctccccagttcaagtgattctcctgcctcagcctcccgagtagctgggattacaggcacgggccactatgcccggctaattttgtattt

SEQ ID NO: 50207 - DNA, 201 bp, Homo sapiens
gagttactgagtatcaagtggtggggctggaacccggagtctaactctagaccactgtggtgcagtgatgttcataacagctatccacagtcaccgagctrggaatttattggttctgcattacttaataaaacaaaaagacgcatgactgacctgatttagaactctttgcatgagagacatgtgctgtgaagaatcatc

SEQ ID NO: 50208 - DNA, 201 bp, Homo sapiens
ttctaggtcacacagctaatggatggagcaggtctttaatcccagatctgggttccaagaccagtccttttctctttacgctgctctgtccctgctatctktatgtcagaaaaccactgagcttccttctagatgtcagggtttggcaaaaaagttatcatgtgcttctgcgtcatgcagcgttttctgagaatggggaga

SEQ ID NO: 50209 - DNA, 201 bp, Homo sapiens
ggggtctcctagattctttcaaggtatttctgggtattgttttcataatactactaacatgttatttggcttctttactctcattgtatcatgagtgtacrgtggagtcttgcagattctatatgatttgggatgacactgtcactcttacagctaatggaatgtatgctttcatattgtttaaaaaactttatctttttt

SEQ ID NO: 50210 - DNA, 201 bp, Homo sapiens
tgttggccaggctggtgtcgaactcctgacctcaagtgatctgatctgcctgcctcagcctcccaaagtgctgggattacaggcatgagccagtgtgcctrgcttcctgcagtttttttattgattggatgaatgtttgtatatcccatgagccagatgaggcacactgtccatgcacatagcaagatggtaacacttaca

SEQ ID NO: 50211 - DNA, 201 bp, Homo sapiens
gtgtgatcttggttcactgcaaactctgcctcctgggttcaagtgattctcctgcctcagcttcccgagtagctgggatcacaggtggctgccaccatgcscaattaatttttgtatttttggtagagacggggtttcaccatgttggccaggctggtgtcgaactcctgacctcaagtgatctgatctgcctgcctcagc

SEQ ID NO: 50212 - DNA, 201 bp, Homo sapiens
gctgaagggctagaggaggacagggtgtttctggagcccagtgagagctggggcagtggtggacacagctgtgtcaggacaggaggcccagagcaggaggygatggaggaaggcactgactcctttctcctgtggcccttcaggggcctgcccattggctcatagtggaacccggtcacagcccatgtggcaagacccccc

SEQ ID NO: 50213 - DNA, 201 bp, Homo sapiens
aaacctggagagctttgtcacttgctgaaatccaagctgccctgtgaatttatccccaaacactgctccttttgagaaacttgtacaagctgccttaattyagtcaattcaaatgggttgatgggggctgttcccaaggcccaggacaggcaggggtttgtgacctgcagccctggaactgcctttgggtttcatggtctc

SEQ ID NO: 50214 - DNA, 201 bp, Homo sapiens
gtgtggacagatgatgctggtcagcaggcaggaaaacgatctgccaggcgctgggggtggggcagaggattgttcttcctgaccttggtatgaaaaccgtrtggagttcttagtgaggaaaatcactcttagcccaaattcctgcgaaggccgatgggattgtttttaagatttgttggattgctggatttgttgaaggga

SEQ ID NO: 50215 - DNA, 201 bp, Homo sapiens
ttgaggttaggattgctctccagttttataggtgaggaagctgagctcaagtggttttcctgtggcccacctgggtgtcatagcagagtgagccctggaayccaggcctgcctcgtcctgacttctgtgatctcgggcgatcacatagatcgcagtgttcgctcttgcatcatgtgtgtttgacaacttttctgggtgccc

SEQ ID NO: 50216 - DNA, 201 bp, Homo sapiens
tataagaaggaggaagggcagaaggttgtgccccacccttaaaggacacttcctagaagtcacccagtacctctgctcatgcttcgttgagcaaaacttaktcacattgcaacatctagctccatgggagctgggaaatgtggtctttgtttccaacaggtatgcacacacagggctaaaaatctgggtgggtatgatgaa

SEQ ID NO: 50217 - DNA, 201 bp, Homo sapiens
gggttaaacagcccatgagtgatgcagtgaccagagctttctctgtgcccactgaggcatgtgagtaatgcagacacacgcctgtcttctcactgcagccyatgctgtgtactcagacagagaaggagggtgaggtatttgcctgatggttgacaaactttctggaaagggccagattgccaatattttaagctttgcagg

SEQ ID NO: 50218 - DNA, 201 bp, Homo sapiens
agggtgaggtatttgcctgatggttgacaaactttctggaaagggccagattgccaatattttaagctttgcaggtggtatagagtctgttgcaagcattygactctgccattgtagtgtgcaagcagtcacagaagatacagaaggaatgagtgggaccattcccactagatgttatttaccatggcaggtggatttggt

SEQ ID NO: 50219 - DNA, 201 bp, Homo sapiens
aaatacatggtaaagatgttagtttgtaatatgtttttagtatatttttctccatctattagatttaaaaaacagattagaaattaaatgttaaaaatatrtttgaaataaacttgaagtattaaaagaagcctaaattaaacttcttttgagacttaatctgtataattattttcttgatgtgtttttgggaagttttcc

SEQ ID NO: 50220 - DNA, 201 bp, Homo sapiens
ggaattggatcaccctggaacctagctggggctaggatggttgttgcatgtgattttcagcaggactctaagggatctccaaagctggttggctggctagygaggttgggcgagggaataactcatttgcttaacttttcatatgtaacaactgggttttgggtttcacaagagacaaggtaggcaggcaggctcaggtgg

SEQ ID NO: 50221 - DNA, 201 bp, Homo sapiens
tgagcctcccgagtagctgggactacagctgtgtaccactatgtctggctaattttttgtatttttagtagagatggggttttgccatgttgcccatgctrgtcttgaactcccggcctcaagagatcctcttgtctccaaatcgcttcgcagaagtgctgggattacaggtatgagccaccatgcccagccaagttagtt

SEQ ID NO: 50222 - DNA, 201 bp, Homo sapiens
gttgggattacaggtgtgagccaccgcgcccggccccatgaaacctcttatattgggtttgagattaaatccacaatggattgtgtgtattatatatacasacacagacacacgcaaatgtattaaaatgtataatatgaagcagtggaacttccctgatagcacaatttaaatatttcctttttgacaaacgtgcatagt

SEQ ID NO: 50223 - DNA, 201 bp, Homo sapiens
tagatacacaaatatatgtgtgagtatacatatatttaatacatatatatttaatatttaatacacacacacacacacacacatatatatatatatatatwtttttttttttttttttttttttttgagacagtcttaccctgtcacccaggctggagtgcagtggcatgatcttggctcactgcaacctccatctcctgg

SEQ ID NO: 50224 - DNA, 201 bp, Homo sapiens
gagggtgggctccttaccctcttgttgaatcaggagaataggctgtaatagaaataaaagcgtttttaaaatgaatgctgataggctgggtgcagtggctyacagctgtaatcccagcactttggaaggccatggtgggcagaccacctgaggtcaggagtttgagaccagcctggccaacatggcgaaacccatctctac

SEQ ID NO: 50225 - DNA, 201 bp, Homo sapiens
tttcctgaaagcacacaaagcaaagcacggctctgcagtgtgacccaccgtgtgctgtgtggacagatgatgctggtcagcaggcaggaaaacgatctgcyaggcgctgggggtggggcagaggattgttcttcctgaccttggtatgaaaaccgtgtggagttcttagtgaggaaaatcactcttagcccaaattcctgc

SEQ ID NO: 50226 - DNA, 201 bp, Homo sapiens
ccacctcggcctctgaaagtgctgggattataggcatgagccaccatgccctgcctcaagcatctattttgtgcaagagcttgcagaagttctttcctgcyacagccgtggttggccacattgctcccccatgaatatgtggaaactgacacttcaggagaattggtggctcacccatggcattcagctagtgggttatgg

SEQ ID NO: 50227 - DNA, 201 bp, Homo sapiens
tgtcatttttcctgattggcacattttgaccatgaccatctggaagtttttgctagctctgttttctgcaaggaatctatgttttattagtctcctgaagytggcttccttgtcatgttctactcttctaccaataaatacggatttcttgattaaaaaaacgtcaaataggttatcaagatccaggggagagaagaactt

SEQ ID NO: 50228 - DNA, 201 bp, Homo sapiens
gggggttgcagtgagccgacatcgcgccactgcactccagcctgggccacagagcaagatttcatctcaaaaaaaaaaaaaaaaaaaaaaagaaaaagaawaaaagaaatgcaggtaggtgcttctagctactgctgtgggatagcaaggtagttaccaaactgataagggtagcatcttacttactgctgaaaaattcag

SEQ ID NO: 50229 - DNA, 201 bp, Homo sapiens
taaaaataaaaaactggagagaaaagagccaaagaaatgggagtcacgggcaccctgacaaaactcctggagctcctcagagcactattttaggggggaamacctgccataaaggtttgctctgttacattgtgaaagagagggaaaggagagcacagagagatgacagaagagaagagaatgagagaaaagagcatagaa

SEQ ID NO: 50230 - DNA, 201 bp, Homo sapiens
gatttagaatttataaagggcttttcctccacattttagtttgatcccccacctgcatgaggaaggaaggaaacgtgttctgattttacaggggaacacaytggggctgagaacagcaataggaattgaaactttttagagtctggcacccaggaaagttagaggcccctttagctttctatctaacagctgtgtcaaccc

SEQ ID NO: 50231 - DNA, 201 bp, Homo sapiens; identical to SEQ ID NO: 9333

SEQ ID NO: 50232 - DNA, 201 bp, Homo sapiens
acagagcaagattctgtctcaaaaaaaaaaaaaaaaaaaaaaaaaaaaaaaaagcaagctcatacctccagcctgggttttgagagcctgtctgaaaaaaacaaaacaaaaccctcaagtaaacaacctaatgtagcacgttaaggaactagaaaaataagaacaaactaatcttcaaattagtaaaaggaacaaaataat

SEQ ID NO: 50233 - DNA, 201 bp, Homo sapiens
gttcagagatctctaggggtctcctagattctttcaaggtatttctgggtattgttttcataatactactaacatgttatttggcttctttactctcattktatcatgagtgtacagtggagtcttgcagattctatatgatttgggatgacactgtcactcttacagctaatggaatgtatgctttcatattgtttaaaa

SEQ ID NO: 50234 - DNA, 201 bp, Homo sapiens
ccttccttaaggacctgaaggtctcttctcctaagggctaggttggttcagaaagtgagaagggctggaccttttgtggggagaggatacagcagggtccraacagctgggctgacaccgggcagcagcccagcagcagtcggagctgcagggtcagctcaccatgggctgaacttgggcattgcctgtttaggcagagtc

SEQ ID NO: 50235 - DNA, 201 bp, Homo sapiens
tgaaggtctcttctcctaagggctaggttggttcagaaagtgagaagggctggaccttttgtggggagaggatacagcagggtccgaacagctgggctgayaccgggcagcagcccagcagcagtcggagctgcagggtcagctcaccatgggctgaacttgggcattgcctgtttaggcagagtctgcccgagcctttcc

SEQ ID NO: 50236 - DNA, 201 bp, Homo sapiens
tgcaggccaagtcaagtgaccaaagctaaaggggaaggaagggctggctggacttagcagtgaccacagacagagttgaagccttcacggttggcgttggycttgttcactgctgtgtgccaagctgctgacagcatctggctatcgcaggttcgtaataagtgtttgctgagtgaatgaaagaatattggtgttggggat

SEQ ID NO: 50237 - DNA, 201 bp, Homo sapiens
tatcccacagggcttgtgtggctggcttcaccaacattaccttccaccctcaaaacaaggggctcattgatggggctgagagctatgtgtccttcagtcgytactcagatgctgtttccttgccccaggatccaggtagggagaagacaacagtcctggcactggttcagtggcattttgctccacgtgtccatagaaggc

SEQ ID NO: 50238 - DNA, 201 bp, Homo sapiens
tactgaaacagattgtagaactttgtaaactggctgcctttctactcctctgctcacctctaaccaaagagccacctaattgttctgcatggtgaccattrcctgttagattcttggtgaatagattcctagcctcatcttttgttatttttatttttttaataaatggtagaatgaggatgcaggaaacttggaaaagca

SEQ ID NO: 50239 - DNA, 201 bp, Homo sapiens
tcttattgggaagcctttaggctgagactcaggtcagtactagacttagcattgttatgttattttgtccagaggagggtgaggtagtacaatcagagacrgggaaactgaggtggtgctgcttctggctcagcctgacacttgcagttctaaggttattatttcatctcttaagttgggcaagtttgtgtgtatgctttt

SEQ ID NO: 50240 - DNA, 201 bp, Homo sapiens
gacgggaaaactcggctttgtactaggtctgtctgtctcagtaagggaaaaggccagagtctgtgttcttaacccctctgtctcacaactatttatttcarttctataattctggaatgaaagtgagcagagggagacggggagtcacactctctgtgtccagacacatgggctgagtgaattccacagctaagtatgact

SEQ ID NO: 50241 - DNA, 201 bp, Homo sapiens
tttgtatcaggctatcgtcctgtaccgatttagaactctatgaatatgtgctgtgtttttgagtctagcagggaatgttctagatgcctgggtacattgcrtgctctggggtgagcttggtggttgttgtggaaagagtgaaattcaactcctgtgttggtcaaaagagagattttcttttttctgctataattatataaa

SEQ ID NO: 50242 - DNA, 201 bp, Homo sapiens
ttatcatagctacagaagggtggctgaccagcggagaaaaggaacacttaatatctatggtatagtttctgtactactgctggatttggttttacccaaamtgttactgagaagtgtttttgaggcatgttttcaacagaacatattgcaaagttgctttcctcaaaggggtgaatgttccttgaccaggatgagagcaga

SEQ ID NO: 50243 - DNA, 201 bp, Homo sapiens
agcaatttatcctcacccagacttgtacattttaaagactatcaattatcatagctacagaagggtggctgaccagcggagaaaaggaacacttaatatcyatggtatagtttctgtactactgctggatttggttttacccaaactgttactgagaagtgtttttgaggcatgttttcaacagaacatattgcaaagttg

SEQ ID NO: 50244 - DNA, 201 bp, Homo sapiens
actcataaaactggtattttccagtctttgtttctaagaaggtctgaccatctttaaaataagctaatgaaacaaactcatcaaacattaatgatgtgacrtatcataatgctgcttaaatgttaatacagcaatttatcctcacccagacttgtacattttaaagactatcaattatcatagctacagaagggtggctga

SEQ ID NO: 50245 - DNA, 201 bp, Homo sapiens; identical to SEQ ID NO: 9346

SEQ ID NO: 50246 - DNA, 201 bp, Homo sapiens
gagttcctcataagagtctttttgagaaaatagttccattgctaaaaatacccaatggaaacttctggcctgggatttccaagttcaccctcggctgtgcrtctcaaagtccacacagcctcaccaaaatagcccttctgggtacttttttctgtgtgttcttggaggaggccatcgtgcctccagctccctaaggcggaa

SEQ ID NO: 50247 - DNA, 201 bp, Homo sapiens
tgggtgcccttggtctccagcttccagtgggccagtctggcgagagaccctagctggagatgaggggaggtagccttggcctctctccttgcccttcctcrctgctgctaccccaggattcttgcccatcccttactggttttccttaaccccaccctcacccttgaaaacagactctttaaaactctcctcactcaccct

SEQ ID NO: 50248 - DNA, 201 bp, Homo sapiens
atgtttactgtctggcctattacagaagacgtttgctgacccctgatttagggcattcatgaggcttgatgagatgttgaaaatcagctgtctcctcccgycactctcttctgattgtgggtaggctctggtgcaccagctctccagtgatctcctatctgatgctcagagttctttttccattgcatggatgtcaaataa

SEQ ID NO: 50249 - DNA, 201 bp, Homo sapiens
catatacagaacattccatccaacagctgtagaatacacacttttcaactgcacctggaacattctccaggtagatcatatgttagaccacaaaacaagtsttaacagatttaagaagtgtgaaatcatatcaagtatcttttctgatgatggcatcaaactagaaataaataacaggaggaacttaagaaaattcacaga

SEQ ID NO: 50250 - DNA, 201 bp, Homo sapiens
atcttgagtgggtcaatttatgttctcagtgccttacaaaatggggcagaggatacctaacccccaggagctggtgtggctggggtaccttacacagggcctgactgtagtagcttctctccaagcattggtgtcttacctcttctgtttctctaatggtgttttgcacattcattgttgtattagagtttgtttttttgt

SEQ ID NO: 50251 - DNA, 201 bp, Homo sapiens
cagagtggaccactgatgtcatagctgcaggtttggctgaattgggatggtgcagaaagccgtgttaaccatttctttttctctgaggcctggaggaggakccttgtgactggaaccacagttgggactggcagtggtttttcctgctggcaaggaaaaaaaaaaagagaaaagaaagagttcgacttatcagcacaaaga

SEQ ID NO: 50252 - DNA, 201 bp, Homo sapiens
cgttccgcaccttctaccatgtctccttttccagcctcattccctgagatgtagccggagttccagttcagccaacctgcccgttgttttctctcctggarctgggtgtttgagcctcctgcatggagtgttcttccttcccagctaaagtcctggtcatcccatttccatctgaaaggcccccttgttcatgaagcctct

SEQ ID NO: 50253 - DNA, 201 bp, Homo sapiens
ggggcccgctaccacgcccagctaatttttgtattttgagcatgttggccaggctggtcttgaactcctgaccttgtgatccccctgcctcggcctcccaragtgctgggattacaggtgtgagccactgtgcctggccttatttatttatttttgagacagggtctcactctatcacccaggctggagtgcagtggtgca

SEQ ID NO: 50254 - DNA, 201 bp, Homo sapiens
ggtactctccatgtggccagaaatggcagtttctgaggggctcatgttgtaggtgatgatacaaagaagagaaagagagggatcagtttttccaagtgtgsatttcatttcagtgtaaatattttgtgaggtggggcatccctgtctcctggagaaatatatttttaatctaattgtttactttctttgcatagcccctag

SEQ ID NO: 50255 - DNA, 201 bp, Homo sapiens; identical to SEQ ID NO: 9339

SEQ ID NO: 50256 - DNA, 201 bp, Homo sapiens
tgttgaccagaagccttaccaataacacaaagtcaattaacacatgtgttatatgttatatgtatgatatactgtattcttacaatctaagaagctacagaagaaaattctattaagaaaattataggaaaatgtgtttactgttcattaagtggaagtagatcatcataaagatcttcatccttgtcttcatgttgagag

SEQ ID NO: 50257 - DNA, 201 bp, Homo sapiens
gggtgattgcacaaacatttcacccggaactttaaaagattctcctacttttttttaaaaaagcgaaaaaacttcactttacaatagcatgttgtttggtytttatatttttttggtagaacggagcctttgaagattttcaagtactcagataacacaagtgaagcactatttcagaacatgcaggctggctatgtttat

SEQ ID NO: 50258 - DNA, 201 bp, Homo sapiens
aatacacttccacctctctaataaaagtgacaacttgtcttgggcattagaaacttggaggcaactccagggctctccctggaaaatcaagatcttgaatmtgagaagtgctgacaaagccctcacaggatccccagcccaggggtaaaggaacaagatgtttaaaaatttgagccacttccattcagctttcactttctg

SEQ ID NO: 50259 - DNA, 201 bp, Homo sapiens
tttttttaaaaaggctgacaacagtaaaaataagttagtgggagccgggcacggtggctcacgcctgtaatcccagcactttgggaggccgagatgggcgrgtcatgaggtcaggagatccagaccatcctggcttacacggtgaaaccccatctctactaaaaatacaaaaaaaattagccaggtgttgtggcgggcgcc

SEQ ID NO: 50260 - DNA, 201 bp, Homo sapiens
gaatgagagagcaaattcaatcgggcaaaaacaatgatattccgtaaacaataatgacataagcctaggaaatgttttaagaataaagctttggccgggcrcggtggctcacgcctgtaatcccagcactttgggaggccgaggcaggtggatccgaggtcaggagaccgagaccatcctggctaacatggtggaaccccg

SEQ ID NO: 50261 - DNA, 201 bp, Homo sapiens
ggaaaatggtgtgaacccgggaggcggagcttgtagtgaaccgagatcacaccactgcactccagcctgggcgacagagcaagactccatctcaaaaaaataaaaaataaaaaaaataataagttagtgggatctggatataaagttttttattttatataaaggcaggttcaaacactattacaattgctacatttgtag

SEQ ID NO: 50262 - DNA, 201 bp, Homo sapiens
tctttgcagttatggaacagtttgtatcttgcttggcgtggaggttgcccatatctgcacatgtgataaaatggcataagtagtatatacacacacggtaccaggccagctcctaatcttatgctatcattacgtgggatggaaccgttgggagaaatagggtgaagagcacccaggacatctctgtactgtcttatcaac

SEQ ID NO: 50263 - DNA, 201 bp, Homo sapiens
ttttgagatggaatcttactctgtttacccaggctggagtgcagtggtgtcatcttggttcactgcaacttccaccttccaggatcaagagattctcctgyctcagcctcctgagtagctgggattacgggcatatgccaccacgcctggctaattttcgtatttttagtagagatgcggtttcaccatgttggccaggct

SEQ ID NO: 50264 - DNA, 201 bp, Homo sapiens
tgctcacatttatgtgcatgtgtgccagtgtgtgtttatgtccatgtgtgtatgccgtcacatgtgcctgtctgtgtgcacgtgtgtgcctgtctatgtgygtgtttgtgtgtgtattgctgtcttataaatcgtcacatcagccctgttaggagggcacttggcttactttacaggtgaggaaactgactcaggtttgtc

SEQ ID NO: 50265 - DNA, 201 bp, Homo sapiens
aaaataaagcaaggttgggctgggcatggtggctcacgcctgtaatcccagcactttggaaagccgaggcgggtggatcacctgaggtcaggagttcgagrtcagcctggccaacatggtgaaaccttgtctctactaaaaatacaaaaattagctgggcatggttgcgggcgcctataatcctggctactcgggaggctg

SEQ ID NO: 50266 - DNA, 201 bp, Homo sapiens
gatggcaagtgctcccgtggccagggagagatggataaagctggagagacagataaacaaaacagtcaagtctgttggcaggaagcgaagagggcctgagctctggtggagactggtccctggagcttccacagtttaaccggaagggagtagggcaagacagttgctgatggggataggtgtggagctttggtgatgggc

SEQ ID NO: 50267 - DNA, 201 bp, Homo sapiens
agttcgagatcagcctggccaacatggtgaaaccttgtctctactaaaaatacaaaaattagctgggcatggttgcgggcgcctataatcctggctactckggaggctgaggtgggaggattgcctgagcccagaagtttgagactagcctaggcaacatagtgaaaccccatctctacaaaattaagtgggcttggtggt

SEQ ID NO: 50268 - DNA, 201 bp, Homo sapiens; identical to SEQ ID NO: 9406

SEQ ID NO: 50269 - DNA, 201 bp, Homo sapiens
attaaataaaggaaaaagcaatgggtgaaattaattttaataatacattttatttaatccaatctgttcaaatatcatttcaacaaaaaatcgacatttgaaaaattcagatatcttaagtaattttatacaaaagtcttcaaactccaggatgtattattttacacgtccagcacatctcaactctaactcaccaccttt

SEQ ID NO: 50270 - DNA, 201 bp, Homo sapiens
tgagcccagaagtttgagactagcctaggcaacatagtgaaaccccatctctacaaaattaagtgggcttggtggtgcatgcctgtagttcaaactcctcrgtaggccaagacaggaggattacttgagcccaagaggatgcagtgagctgggttcacaccactgcactccagcctggtgacagagcgagagactgtctcc

SEQ ID NO: 50271 - DNA, 201 bp, Homo sapiens
gagatttcttgcacgtagggaccacgctctttaccaccgagcctaccaccctggcagacactcctccatcacgtgcatttgttgagtgagtgggtgaataggatgtgggtgagcacgtctctacaatcctctgtctgtgtggggcctggcacacgagaatgcctggtggaaattacttcgtcctacaggcactacaggatt

SEQ ID NO: 50272 - DNA, 201 bp, Homo sapiens
ctcttgccacctcagttcatgaataataggtgtgaaaatgcttctcacattaggcagtaatactgataaacccatagaaatgtttcctttaaagaaggcattttttttttttttttttacatcttccaaaggttaaaagcactagttctggactgaaagagaaaaggaaatatttatagtaaaacaggaagggaatcttca

SEQ ID NO: 50273 - DNA, 201 bp, Homo sapiens
cccaccttgtgttccatgaaaactgaagaggcagaggtcaaattcaggtggatcactttttcaaaggttgccaaccctgcttcatgtaaaccattagaaayattagatcccatttgaatgtctacagtcgtagtctttctgtgaatttatgaatttatattattattaagctgaggacacaggatcacagccatgttcaat

SEQ ID NO: 50274 - DNA, 201 bp, Homo sapiens
tcttgccacctcagttcatgaataataggtgtgaaaatgcttctcacattaggcagtaatactgataaacccatagaaatgtttcctttaaagaaggcattttttttttttttttttacatcttccaaaggttaaaagcactagttctggactgaaagagaaaaggaaatatttatagtaaaacaggaagggaatcttcat

SEQ ID NO: 50275 - DNA, 201 bp, Homo sapiens
tgttccatgaaaactgaagaggcagaggtcaaattcaggtggatcactttttcaaaggttgccaaccctgcttcatgtaaaccattagaaacattagatcycatttgaatgtctacagtcgtagtctttctgtgaatttatgaatttatattattattaagctgaggacacaggatcacagccatgttcaatgagagctgg

SEQ ID NO: 50276 - DNA, 201 bp, Homo sapiens
cctcccacctcagcctctcaagtagctgggaccatgggcatgtgctaccatgcctgtttttgttttttttgtttttctttgtttttttttttttttagagrtatggtcttgctatgttgcccaggctggtctcaaactcctgggttcaagcgatcttgtctcctcagcctccaaaagtgctaggattacaggagtgagtca

SEQ ID NO: 50277 - DNA, 201 bp, Homo sapiens
ggcagatcacctaaggtcaggagttcgagaccagcctggccaatatggtgaaaccctgtctctactaaaaatacaaaaattagccaggcgtggtggcgggrgcctataatcccagctacctgggaggctgaggcaggagtagagtaagacaaagggtgaggaagtcagatgacattaaggcaattgtaagaaaagcaagtc

SEQ ID NO: 50278 - DNA, 201 bp, Homo sapiens
aggagaccgaggtgggcagatcacttgaggtcagaagttggagaccagcctggccaacatggcgaaaccctgtctctactaaaaacaaaaattagctgggygtggtgatgggcgcctgtaatcccagctactcaggaggctgaggcaggagaatctcttgaatccgggaggccgaggttgcagtgagccaaaatcgtgcca

SEQ ID NO: 50279 - DNA, 201 bp, Homo sapiens
cacagaccgggaacatcccagaacccactcacaacaatgcaaaccaaggaagacttctcctgccacctctctcctttctctgtcctttcccaacttcgggraagaaggagcagaaaccatggtcatcggactgcggaaggagaggactgagcatgggcgggtgagaagtatgaagacgctgaccacgtgccttccccacca

SEQ ID NO: 50280 - DNA, 201 bp, Homo sapiens
gtgcctgcttctattacaacactctctactcgcagactctgtcagctggagtttggaaatctttatatctgatttttctgtattttaatggtgatgtttctttttttttttttttttgagacacagtctcgctctgtctcccaggctggagtacagtggcacgatctcagctcactgcaacctccgcctcccaagttgaag

SEQ ID NO: 50281 - DNA, 201 bp, Homo sapiens
ttcaagtgttcgccagccccatgtagctcattggttttcatactggaaagcgtgtacatagcgtcttcatcagccatggtgtcttgagctgtttgcccctscattcaagattcgaagtggtccccttccagcctggaccttgacctattaattgtccatatttaaactgtggaatataagtgagtcccgaaaattattttt

SEQ ID NO: 50282 - DNA, 201 bp, Homo sapiens
tctttttttctttattagtcttgctagcggtctatcaattttgttgatcctttcaaaaaaccagctcctggattcattaattttttgaagggttttttgtrtctctatttccttcagttctgctctgattttagttatttcttgccttctgctagcttttgaatgtgtttgctcttgcttttctagttcttttaattgtga

SEQ ID NO: 50283 - DNA, 201 bp, Homo sapiens
aaggtgctgggagtcttgcaggcagccctccagtcagtcctgtgttattcctctctctgactcagggaaccatcctgatgggcagcagcccccagccgacrgcaggccggggaatgaagccactggctgctctccttccctcaatgccgtctgctcagtctcctggagggtcagtgatgagggaaggagccccaacttcct

SEQ ID NO: 50284 - DNA, 201 bp, Homo sapiens
ttatatctgatttttctgtattttaatggtgatgtttctttttttttttttttttgagacacagtctcgctctgtctcccaggctggagtacagtggcacratctcagctcactgcaacctccgcctcccaagttgaagtgattcttctgcctcagcctcctgagtagctgggattacagatgtgcaccaccacacctggc

SEQ ID NO: 50285 - DNA, 201 bp, Homo sapiens
acaccacactgccgtgagcaccaggctggctgactcattgttccctacatgcctgatgtctgctcctgctctagggcttttactcattctctcctaccagsctgaaagggccaacacatctcataaacaaccccaaagccaacccaccccaggcctggctgcagcatcagcctcctgcctttgctgaccacaccagctgtt

SEQ ID NO: 50286 - DNA, 201 bp, Homo sapiens
ttatggagtcaggatgcccgggtcacacccagcctcacccccgatgtggtgtataaccttggacaagtcacttaaacactcagcctcagtctcctcctttytaaaatgaggaccaaaaaataaagacaaaaaataaaataaaataaggacaataatagtgctagcctcacaagccatatgagaagtgaataacgccatcta

SEQ ID NO: 50287 - DNA, 201 bp, Homo sapiens
atctcagctcactgtaacctctgccctgtgggttcaagggattctcctgcctcagcttcccgagtacctgggactacttgcgcacacaaccgcacccagckaattctttgtattttagtagagatggggcttcaccatgtcgcccaggctggcctcaaatgcctgagctcaggcaatccgcccacctcggcctcccgaagt

SEQ ID NO: 50288 - DNA, 201 bp, Homo sapiens
tatttttattatatctttctgtgtatgttactataaacacactttagactgggcttctgggcacttaggcagttgtgcttctcttggtgccttttccccatttttttttttttttttgatttgcatgtatgacagttttcatgtcttacggggaaggctattgggaatcccactttgtagaagataggtatgctcctttct

SEQ ID NO: 50289 - DNA, 201 bp, Homo sapiens
tttctgtccctcttatgagagatctccttaacccatttatgcctgaggttgcaactttttgaattttgaaatcagaccttggtgatgaccttgagcagtargatataaataactcccacatgcttagcgttccaataatggaacactaggcataaatgagttccgtgcagctgggatgctttaccaagacctgagccacaa

SEQ ID NO: 50290 - DNA, 201 bp, Homo sapiens
ggctgaagcgggtggatcaccttggggtcaggagtttgagaccagcctggccaacatggcgaaactctgtctccactaaaaatacaaaaattagccaggcrgggtggtgggcacctataatcccagctactcaggaggctgaggcaggataatcacttgaacccatggggcggaggttgcagtgagctgagaccacaccac

SEQ ID NO: 50291 - DNA, 201 bp, Homo sapiens
ttttttgtatatttagtagagatggggtttcaccgtgttagccaggatagtctcaatctcctgaccttgtgatacacccacctcggcctcccagagtgctrggattacgggcgtgagccaccgcgcccggcccctacacgcccactttttaagctcacagatctgttctcatcttgatgtgactctgtaatattcttccag

SEQ ID NO: 50292 - DNA, 201 bp, Homo sapiens
agagtgcctcaggaaagtgcatgccttctgtgaatctactatccctcttttgttttttgttgttgttgttgtcattgttgtgtttgtttgtttgttttgaraaggagtctcactctgtcgcccagattggagtacagtggaacgatctcggctcactgcaacctccatctcctgggttcaagtgatcctcctacctcagcc

SEQ ID NO: 50293 - DNA, 201 bp, Homo sapiens
agttggaagtgtgaggtcagcctgggcaatgtatcgagacccctgtctccaaaacaataaagggaaaaaaaaaagaaacaaaatgggcatttaggctgggygcagtagctcacacctgtaatcccagcactttgggaggccaaggtgagcggatcacctgaggtcaggagtttgagaccagcctgaccaacatggagaaac

SEQ ID NO: 50294 - DNA, 201 bp, Homo sapiens
ttggaggtcatgtctttccttttcacaacaggaagggctggcaccttctgctctttcggtcctgacaactgtctgctcagagcatcagccaaacaaggccytgtcatcccagccaggaaggatgcgcggtgcatgggagtggcaggacatttgtggaaggagtacagccgaccccccagtttcctccagtccttgtcccca

SEQ ID NO: 50295 - DNA, 201 bp, Homo sapiens
cgcagggaaaggacgtgatggcagtggggattccctcttgctttgagcccttctgaatgcaagcagaaaaagaaacccttttatattactttttaattgamtataataacagaaacaatgaaaagaatgtgaccttgactttgcaactctatttcccaggcatattcctaacaacacctaagaaagctaggatgtaggtag

SEQ ID NO: 50296 - DNA, 201 bp, Homo sapiens
tagttgaaaatgaggactgagatacttgtacactaaactccgtggcagcattattcaccatggccaaaaactagaaacagcccaaatgttcatcagcagargaacaaacaaacaaaatggggcatattcatacaatggaatatcactcatccttaaaaaggcatgaaactttctgacacctgctacgacacagatgaacct

SEQ ID NO: 50297 - DNA, 201 bp, Homo sapiens
aaagcgagaaataaaaaaaagaatcaccaacttccctgcaagcattcaacaaatgcccatagtataaaaccaacaagaggagtcaaaccgcctcttctgcwtccccaccagccacactccgacacccccactgcgccccatctttctgtccctgatgcttgtcaaattgttccatcgtcagccccaccagagctcatgcta

SEQ ID NO: 50298 - DNA, 201 bp, Homo sapiens
aaggaaggatgaagagacagagggcatttttagggcagtgaaacttctgtgtgatccactgtaatggtggatccatctcattatccatagaatgtacagcktcaggagtgaacccaggccaggcacagtggctcgtgcctgtaatcctagcactttgggaggctgaggcgggtggatcacctgaggtcaggagttcaagac

SEQ ID NO: 50299 - DNA, 201 bp, Homo sapiens
gagtgaacccaggccaggcacagtggctcgtgcctgtaatcctagcactttgggaggctgaggcgggtggatcacctgaggtcaggagttcaagactagcytggccaacgtggtgaaaccccgtctccactaaaatacaaaaattagccaggcatgatggtgggtgcctgtaatcccagctactcgggaggctgagacagg

SEQ ID NO: 50300 - DNA, 201 bp, Homo sapiens
ccaggcatgatggtgggtgcctgtaatcccagctactcgggaggctgagacaggagaatcgcttgaactcgggagatggtggttgcagtgagccgagatcrtgccactgcactccagcctgggcagctgagcaagactccatctcaaaaaaatagaagagtgaacctgaggttcacttatggactttgggtgataataaca

SEQ ID NO: 50301 - DNA, 201 bp, Homo sapiens
agccaggaggcacctcacagagactggaagcacagagggaggtgggccagctggggcccgaggatccagacttggtgagactcacagaccttggcccactrccctcctccctcctccctcctcacccacttttctcccttcttcacatcagtactggtggcagcaccctgagctgaaggagaaaagttcatattcaacatc

SEQ ID NO: 50302 - DNA, 201 bp, Homo sapiens
tctataatctctgtatttataacacatgccttaaaataccaattgcatatatttcttttcttttggtttttgaattatcatacagtaaaattgacttttgscttggtgtagttctgtgaatttaagtctagacttctgtgaccactagaacaatcaagccggagaacagttctgtctttccccaaaatttgctcatgctgc

SEQ ID NO: 50303 - DNA, 201 bp, Homo sapiens
gcaaagtttgtgcaataaagtatctttgtggtattggattttcgagagccaccgttatcaatgggagagtgactgttgaatgctacaggcgtgtgcactcycccgtgggcatgaagagaggtccacgggctggctggattgggagactccggtcatttctgcaaggagagcgccacaggactgccttgttccctgggctgt

SEQ ID NO: 50304 - DNA, 201 bp, Homo sapiens
gcagtatccctaaatctgggaaaggttgtaaaaaaaaaaaaaaaaaaaaaaaaaaaaaaaaaagatgctatcttaaagatgcatttttttctggcatgtaraagttggaaacagactaaatatgtagctacagactttagtaacgcagatcgtagagctactgtcaataggatgtcatgcaagaatgacaaggaagcctga

SEQ ID NO: 50305 - DNA, 201 bp, Homo sapiens
tggttttgaaacttgaagaggatatatcgctcagcccagtcaaagaggagcgaaggattgagccagcaatccaacattgttttcaccctctaacaatatgycctatgatgaatctgtgttgtagaatttgaggaaagatgcttagtgtggtacccaccataatgagtacctggaatgttacagcaggtactcagagctggt

SEQ ID NO: 50306 - DNA, 201 bp, Homo sapiens
ataacagaggcataattttatgttgagaagcaaatatttcttttagagtaaacgttgaggtataatcggaagacaaattacattttacctaatggaggggkgaaactgggctagcacatgggcagtgtatcattatgaattttaaatttttaaaaatttatatgtatttaggaggtacaagtgcagatttcttttttcaat

SEQ ID NO: 50307 - DNA, 201 bp, Homo sapiens
ctatgtatggcttcgatttatattaagtgctacaaagatagtgaacaaggtgcaaggtggagagtaagcatgtggcctactgagactctgtggtccgggartctccccaacggagggaacattgaaactgacagctgaagagtgacagagctggttaggtgaagagcaggaggaaggaagctccttacaggctggaagacc

SEQ ID NO: 50308 - DNA, 201 bp, Homo sapiens
accctgctgagggagagtccaacgtgttccaggaactgaaatgggaccagtgtggtgacagctgcaagggctgcgcagactggaagcccacactggggaakgcaccaaggcctgggtcatgcggggtttctttggagcctggaaaaatgattgtattttgtgcaacttgtagtagaaagcccactttgggatgctgtagta

SEQ ID NO: 50309 - DNA, 201 bp, Homo sapiens
aacctgtaagttgatattatgaagaaggtgaaccatgaaggagatgatggacagagaacagtggctgggaaatgagaccccaaggatggcaagtgctcccrtggccagggagagatggataaagctggagagacagataaacaaaacagtcaagtctgttggcaggaagcgaagagggcctgagctctggtggagactggt

SEQ ID NO: 50310 - DNA, 201 bp, Homo sapiens
ataaatgtctgtgatattatcttctcccaggatattttgatttcttgttcactcaaggggacatcatctttgggattcttttgttcctctacccctggagyagtattgtccgatagaaataaatagaatgagggctacatgtgtaattttacatttccaagtagcccacattaaataaaggaaaaagcaatgggtgaaatt

SEQ ID NO: 50311 - DNA, 201 bp, Homo sapiens
gtgaaaaacaggtcatgggccaggcaagatcaaggaggggcagcagagggcacttctgggcgagcagtacagtggcatcgcagaaggacaggtgggagggraagggataggctgcatcagctgcctttgaaaacgccatcgagcaatagtattgcagccatttataccataatatttcctacagaggacctcgtttagttt

SEQ ID NO: 50312 - DNA, 201 bp, Homo sapiens
taccaggaatccaactatccaagtgttttgttgttcctgcaataagtttgatttaaactctggaaaactgttttttaaaaaaattccatgtcgatcactarcatccctctcccactcccctctccctaccccgataagccttcacatttattttgagacagaaaagagaatggctgggctctgattctgactgccaagctt

SEQ ID NO: 50313 - DNA, 201 bp, Homo sapiens
tgcagttcagatctttaaaaatctgctagatttcatttcctgtctctctcacgctgtaaattgtagaaattgatgccactgtgtttgtgagccatgcaaasaattgaaaatcatttttttcctaaaatttggttaaaatccctagatgtccttgatgtggcattattaacagtgcttgtgtattttgcatatatggtcttt

SEQ ID NO: 50314 - DNA, 201 bp, Homo sapiens
aaataaggacaataatagtgctagcctcacaagccatatgagaagtgaataacgccatctatgcaaagcacttggaagagtacctaatgtggaataggcamccactaacatagtattattattttattgctgcatcccaacataaatcatttagagacctctttcataggaaaaataattctatctgattgatcacaaaga

SEQ ID NO: 50315 - DNA, 201 bp, Homo sapiens
ttttctataccattcctttaagtcatagaatcagatgagcttaggggctagaaggaagagggagcgatgggaaggcagtcgttggtcatgccctgggcctrgatcgcgggaatcagtcattcagaaagccccatatgttgggtgggtctcacagcttacagagaagccagctgaggtgtgcaggttaagaaacttgatcta

SEQ ID NO: 50316 - DNA, 201 bp, Homo sapiens
agatatctgtttgaggtcctgctttcaattctttggggtatgtacccagcagtagaattgtggggtcgtagggtaattctatgtttaattttttgaggaamtgccatattgttttccacagtggctggaccgttttacattcccaccagtggtagaaagggtcccaattattccacattctcagcaacgctgtcttttgtt

SEQ ID NO: 50317 - DNA, 201 bp, Homo sapiens
tgttgttcctgcaataagtttgatttaaactctggaaaactgttttttaaaaaaattccatgtcgatcactagcatccctctcccactcccctctccctaycccgataagccttcacatttattttgagacagaaaagagaatggctgggctctgattctgactgccaagcttatagatatcccagctctagagctgcgtg

SEQ ID NO: 50318 - DNA, 201 bp, Homo sapiens
caagtttcttaccttctctgtgcttcatttcctcgtctgtcaaaggaggatactaatagaagcgacttcaaaaggggtattctgaggattacgtgagataycacctatgtaatagatgatgcgtgtgacatatttgttaaccgcacctggcaggaactgctccctcctcttgccacctcagttcatgaataataggtgtga

SEQ ID NO: 50319 - DNA, 201 bp, Homo sapiens
ttgctacatgcagaaggcaagcatgccccgtcacgtacagttgctgaggctgcctgccttcttcaggcatgactgtagggcttgacaagtgacaatgatgrtttaaaatgcacacaatgccagtgttttcattatgatctctgttagttatgctaaggtatctgcaagaacatccaaagtcggggccccaggaatacacag

SEQ ID NO: 50320 - DNA, 201 bp, Homo sapiens
tgccccgtcacgtacagttgctgaggctgcctgccttcttcaggcatgactgtagggcttgacaagtgacaatgatggtttaaaatgcacacaatgccagygttttcattatgatctctgttagttatgctaaggtatctgcaagaacatccaaagtcggggccccaggaatacacagatttcaccttctgcctttctttc

SEQ ID NO: 50321 - DNA, 201 bp, Homo sapiens
tgtaacaagtgtttgttcatctaccctgcatgtactggaagagataaaagttggaaaatagatcaaaacgcacgtacactattatttttctcttcaaggcyggcagaaaaagcagccttggagtgggctcatcagtgagcaagcccctgagctgggaggtggaggttggatgcgtctgcattcccactcggtgttgggacc

SEQ ID NO: 50322 - DNA, 201 bp, Homo sapiens
acaattacaagagcccgaccttctgtgaacactgtgggaccctgctgtggggactggcacggcaaggactcaagtgtgatggtgagtccagtgggggatgwgcatggcccgacgtggaccccctaggggatggagcaaggctttctggggaactggagggaggatgtagggggtaccacttccacacccagcccagacaag

SEQ ID NO: 50323 - DNA, 201 bp, Homo sapiens
gtggatcacctgaggtcaggagttcgagatcagcctggccaacatggtgaaaccttgtctctactaaaaatacaaaaattagctgggcatggttgcgggcrcctataatcctggctactcgggaggctgaggtgggaggattgcctgagcccagaagtttgagactagcctaggcaacatagtgaaaccccatctctacaa

SEQ ID NO: 50324 - DNA, 201 bp, Homo sapiens
gaatgagggaaaacttctaaggagacttgagccatgggaagaattaatgagggaaccagggaatgaatgaggaaagtggatggcaactggggcatccatcmccacctctgcagttcccagtagattctcagcatatgtgcaataaccaaatcaatgaataaatgcacttacctaagataaagagaagccagaccatggcaa

SEQ ID NO: 50325 - DNA, 201 bp, Homo sapiens
ggaaggcggcacagcatcttccgcattctccccttcttcatcccaatcctgttcacatgtctggtggaacccagagcgacctctcagtggaggcaggaggrgttaggttttcaaatcattacctaaagcagacatcacaggaggccaacattagcctcaagaatccgttcctggccccaaaggacactgacacgcttttct

SEQ ID NO: 50326 - DNA, 201 bp, Homo sapiens
tagcgaaaaattggaaacaacacaaatacccaatgacagatttattgaataaattattatatggtcagagaaaataatactatataaccattttaaatgawgatgtaaatgcttaaacatcaatacagaatgttgtttatgaaatcataagtgagaatatatagtatttccttttaagcaagaacatttgcatgtataagc

SEQ ID NO: 50327 - DNA, 201 bp, Homo sapiens
gcttagaacttcccaggggttcctgggcgttatttcatggctcttctgcctgcttcgtttcatttctttcctcgaatactctttcctttccgctccattcygttccccgctctctcctaccacctacatttcaagtgctcccctcccctttttcttttgtcccctctcctctccctcccctgccctggtttgttttccatt

SEQ ID NO: 50328 - DNA, 201 bp, Homo sapiens
agagaggaagttgagactgctaagaatttgccaatcagatacaccgggtgattgcacaaacatttcacccggaactttaaaagattctcctactttttttwaaaaaagcgaaaaaacttcactttacaatagcatgttgtttggtctttatatttttttggtagaacggagcctttgaagattttcaagtactcagataac

SEQ ID NO: 50329 - DNA, 201 bp, Homo sapiens
taagagacagtgtctaatagaaaacagaaacaccccatggcctgggaaaggagatggcgggtctacaggatgctggcatcaagaatatctagaggtgtccrctacacctaatggataccaagaacagatgtgaattttttgttttagatgaaattttacgataaaaaaatcccaattttgtagatatatgatggatgttgt

SEQ ID NO: 50330 - DNA, 201 bp, Homo sapiens
gaataaattattatatggtcagagaaaataatactatataaccattttaaatgatgatgtaaatgcttaaacatcaatacagaatgttgtttatgaaatcrtaagtgagaatatatagtatttccttttaagcaagaacatttgcatgtataagcatgaaaaataatgaaaaactaacagttgttaattgggaggtaggat

SEQ ID NO: 50331 - DNA, 201 bp, Homo sapiens
taagcttctttgcacacacatgtgcaaatcagcagataagattaagactgcatgatgtcatagcacctggtgcctgcttctattacaacactctctactcrcagactctgtcagctggagtttggaaatctttatatctgatttttctgtattttaatggtgatgtttctttttttttttttttttgagacacagtctcgc

SEQ ID NO: 50332 - DNA, 201 bp, Homo sapiens
atgatgtcatagcacctggtgcctgcttctattacaacactctctactcgcagactctgtcagctggagtttggaaatctttatatctgatttttctgtaytttaatggtgatgtttctttttttttttttttttgagacacagtctcgctctgtctcccaggctggagtacagtggcacgatctcagctcactgcaacct

SEQ ID NO: 50333 - DNA, 201 bp, Homo sapiens
aggaaagaaacaaaggaagaagcttgaatcaccttttccaacaccccgagttgttgtttttgagatgtcttaattattcaaaccttgcttgtcaaagtaastgattaaataccacaagtgaatgcaaaaggcaacgattgatacgtgatatggataatgctttgttctgggaacatgttgggaatgacctttcttgggagg

SEQ ID NO: 50334 - DNA, 201 bp, Homo sapiens
cacttgttattaattagggtcatttggattaaattgttaaagtttttaaagttcctagatgagggatatatcacctatggaagggtgaaaatatgataaakccatttaggaagctacaaaatgtgaaaattcctgtggacttggattccgaagttcaagcccagctctgccgtttatcaacagggctctgaggcacccact

SEQ ID NO: 50335 - DNA, 201 bp, Homo sapiens
ctggtctcaaactcctgacctcaggtgatccacccacctcagcctcccaaagtgacgggattacaggcatgagccaccgtgcccagcccctctttgcttckaaaacatcaatcagctccatgtgatgactcctgctgttttatggtttgtataaatgtatggggtgcaggtgtcatttcgttacctatgtggattgcacag

SEQ ID NO: 50336 - DNA, 201 bp, Homo sapiens
acccctgcccaggacagagagtaagagttacaggcagaggggctgggagctgtaaaaccaggggccctaatgggacggcaccgtctggggacatagatgtrcaggataattcatgaaatctgaacctgaatctgaatgaggctcaaatcaaaagaatcttcacaatgaattttctgtgtgctagatcaaaatgactttgta

SEQ ID NO: 50337 - DNA, 201 bp, Homo sapiens
tggagtgcagtggtggtgcgatctcggctcactgcaacctccacctcccaggttcaaatgattctcctgcctcagcctcccgcatagctggggttacaggygtccaccaccacacccggctaatttttgtatttttagtagagatggggtttcactatgttggctaggctggtctcaaactcctgacctcaggtgatccac

SEQ ID NO: 50338 - DNA, 201 bp, Homo sapiens
ctagtgttcctggattcacatcactgcccttgactcccacactcccaatatgcaccagttgaacattcttggtcaatatcactttgaaatttttcttttakgaaaaagaaaactgagtttcactttctattcatagaacacacaaagctctacttccggttatggcttcagggcatgagtgtgtgagttactttgaacaag

SEQ ID NO: 50339 - DNA, 201 bp, Homo sapiens
tctccttcaagagagtgcctcaggaaagtgcatgccttctgtgaatctactatccctcttttgttttttgttgttgttgttgtcattgttgtgtttgtttstttgttttgagaaggagtctcactctgtcgcccagattggagtacagtggaacgatctcggctcactgcaacctccatctcctgggttcaagtgatcctc

SEQ ID NO: 50340 - DNA, 201 bp, Homo sapiens
tttctaaaaataatgatttttaaaagagtagagcaaagttgtgggtttgccagccttaaccattccctgtgattgcctggatagacatgggccatatccgygctgaagggggccaggctcatggacttcccaacagattccaccccagagaacgcacaggctattagtcatgatagcgaatggccagaagaagcaggtgca

SEQ ID NO: 50341 - DNA, 201 bp, Homo sapiens
ccacgggctggctggattgggagactccggtcatttctgcaaggagagcgccacaggactgccttgttccctgggctgtcctgcccctgtgcgggctggaygtggtgctataaaagatgattcaggagtggcacaggctgagggggactaggctggagaaggtggagggaagagggagcactccgtgccctcttcctgtcc

SEQ ID NO: 50342 - DNA, 201 bp, Homo sapiens
ctgaaccccacctccagagttgagtcccacctcctacctcacttcccttccagcacgaggatcactaccagggagagccagggtcaacttcctcccagccrtggcactttaggctttcctccctatccgcaaggctctgtcttacctccagagagagttgtttagcaccagggggttcttccactcttgctcactatctgc

SEQ ID NO: 50343 - DNA, 201 bp, Homo sapiens
tcaccacaacctccgcctcccaggttcaagcaattccccacctcagcctcccgagtagctgggactacaggcacccaccaccatgcccggctaatttttgkattttttttttttttttttttttttttttagtcgagacggggtttcaccatgttggccaggctggtctcgaactcctaacctcagatgatctgcctgcct

SEQ ID NO: 50344 - DNA, 201 bp, Homo sapiens
gcctcaagtgatcctcctatctcagcctcccaaagtgctgggattacaggcatgagccctcatgctaacctatttgttgcttttaaagcattaatcatggrataagaaaaaggaataagttattcttctgctgtataacactctgtaaatgaagaggtcattcctaaaccatatcctggttttgttgttgttgttgtttgt

SEQ ID NO: 50345 - DNA, 201 bp, Homo sapiens
agatggggtttcaccatgttggccaggctggtctcaaactcctgacctcaagtgatccacccacctcggcctcccaaagtgctgggatcacaggcatgagycaccatgcccagcctactctccctcctttgaaaccttgctgacaaactacctactctataaatcacgctcagatacactaaatcctacttgtcattcaga

SEQ ID NO: 50346 - DNA, 201 bp, Homo sapiens
ttggtctgtgaccctcccctcaaacagtcaccttctccctaaagttgccaccggctttaggaatcacctgctgttcccttccctgtgcaaccacagcaccyctacatccacctgaccaatccattgagcttctccccatcagggaccatggcttatccactcacaggctggagcagcagccctcagctccttcctgaataa

SEQ ID NO: 50347 - DNA, 201 bp, Homo sapiens
gattttttttttttttgcgacagtctcactctgttgcccaggcggctcaatacaacctccacctcctgggttcaagtgattctcctgcctcagcctcccargtagctggggttacaggtgtgtgccaccatgcctggctaatttttgtatttttggtagagatgggatttcaccatattggccaggctggtcttgaactcc

SEQ ID NO: 50348 - DNA, 201 bp, Homo sapiens
ctcaggctcccaaaatgctgggattataggcatgagccaccgcgcttggcctctgccttgatccttgatggcaaaatcgttcttctccatctccttgtctytcccccttaaaacttctgtcacttcaggaacctcttctccaccaccagtcttagagaaatatctgataaatagcatagagcagtttaatatgtgttgttc

SEQ ID NO: 50349 - DNA, 201 bp, Homo sapiens
gggttccgcccagcccctcacttagaatcctccctttggcctttctcaaaccacactccttcctgtgaagccaagaggtcgtctctgttcctaaactactycccaggacctcggaattccatacctaaacagcctcaagcctgtgtagacatctccctaggttctgtccttgaaaggggcaggaggagactttcccgatat

SEQ ID NO: 50350 - DNA, 201 bp, Homo sapiens
ttttctggagagggagtctacaaatctgatcttatttgcatgatatttgccaagttctcagtgcatttacaaaattaactgttattagtctgataaaaatmatgagtttatttctttaatgctataaacctgtcattcatcctataatatatgcacatttgccagccatttccttgtttactcaatatttgattagctgtg

SEQ ID NO: 50351 - DNA, 201 bp, Homo sapiens
tgccctgtggttgggtgatatgtaatttgaatttagccttggcttctattccatgaggaatgatgtcttttagcttacatggcattgttgaactcacagarcgaggcttattgattaaataactttctgatcgtagaaatctatgtttcattcagtttggcacagatacaggttttgatgctataaaccattttcatttga

SEQ ID NO: 50352 - DNA, 201 bp, Homo sapiens
aattatacaactgattttgttaaatctatcactttgatcttgtatttaatcatcattttttttaagacagggtctcactctgttgcccaggctggctttgkactcctaggctcaagtgaacctccagcctcagcttcatgaatagctgagattacaggcatgcacctctgcacccaacttaaataccatttctttaaaaca

SEQ ID NO: 50353 - DNA, 201 bp, Homo sapiens
ttctgtggtgaccaggcaaggagtctcactgtcagaccagaacaatgtttctactattacctcctatgccccacggcctcggttgggttcacatcaaaacrtaaaggttaattctgttaagaaaccacccaggtgagactttcagatgcaaattcatgcccagacgcaccgaaggtcctcacactttatggattactgatt

SEQ ID NO: 50354 - DNA, 201 bp, Homo sapiens
gcctccattgcctcttctgtaaaatcggatcagtaggccatttttcaaaggttgttgtgaggatttaataaaatcaggtaaagcaacagacagcgcccagygcagtgctttgagccatgataaaaattaatttagcctccttctcttccctttctaaatgataagttacatgaagaccaggtgcaagaaaaatgcctttct

SEQ ID NO: 50355 - DNA, 201 bp, Homo sapiens
gcaccctgtcactttcaataagtatacaatcggcacatgctaagtgccctaagtgcctggcaccatcccattgtctggccagcaggtcaactggactctcscttgtgccccccgctcatctgctgggttgtaacacgcaagcatctagatgccacagggcatcccacctagattccccaggcttcctggggctcaaaaaca

SEQ ID NO: 50356 - DNA, 201 bp, Homo sapiens
cttgcagagtttggcatttcctttcccccagccttaaaacatattcactctgctcagacctaccagaaggaacagctagtgaagagccaggtggagcaagygtccacccaagtcaagtggtgaaactgtggggtcagaagacctggactgagtttctaagccaccactgatgtaagcacagagtgattgccaaagtctcac

SEQ ID NO: 50357 - DNA, 201 bp, Homo sapiens
taagatatcggctttcctggctcagttaatttaatcattgcaccgagtgctgtgagacagcccatgtgatttcctgggagtaagctccacacataggtctsctgcccacaatgattacatggatgatgacttacaaccaaggaagacattccagtctcaacagcaggaaagtgctgagctcattctgtcctttatgctggt

SEQ ID NO: 50358 - DNA, 201 bp, Homo sapiens
gctttcctggctcagttaatttaatcattgcaccgagtgctgtgagacagcccatgtgatttcctgggagtaagctccacacataggtctgctgcccacartgattacatggatgatgacttacaaccaaggaagacattccagtctcaacagcaggaaagtgctgagctcattctgtcctttatgctggttctcacttga

SEQ ID NO: 50359 - DNA, 201 bp, Homo sapiens
gagggttgccctatttggagtcacacaactaaaggcttagaggaggtttgagaagtaagtattcttaagcagcctctttgaatgtaattttttttggtctwtctacaaaatcatagattaagaatctgttttataattttttaatcttcaggaaattgagaaatactcaccagaatattatttaaaaactcttagcagaat

SEQ ID NO: 50360 - DNA, 201 bp, Homo sapiens
ctgcccatgcatggaagttatgttctttaagccttcttaggcaccaacaagaaaaaaaaatgagtttattttttgtgctcattaggttgcaggagaccctwgaaagtcatcatcaaatagttataactgaggataggtcaccagacaagtatgctggctttaaaactggcctgctgcataataagaaataagttgccttat

SEQ ID NO: 50361 - DNA, 201 bp, Homo sapiens
tggcgtcactcaccatctgccagaggaaccacaaaatcgacggcatcttcaaagatgatgtaagccctggtttgggtcaaatgtaaaaccacagagccggraagtatgcagatgtggaaagaagaatctagaacttccaatcttagagtattagaactaagaagaaccttaagattatattttattgacaataaaactggg

SEQ ID NO: 50362 - DNA, 201 bp, Homo sapiens
ctcctgagtagctgggactataggcacgcgctgccacacccagctaacttttgtatttttagtagagatggggtttcaccatgttggccaagatggtctcratctcttgacctcatgatccacccaccttggcctcccaaagtgctgagattacaggcgtgagccaccgcacctgggcttttttaaaaatcttctttatag

SEQ ID NO: 50363 - DNA, 201 bp, Homo sapiens
gggtcaaatgtaaaaccacagagccggaaagtatgcagatgtggaaagaagaatctagaacttccaatcttagagtattagaactaagaagaaccttaagwttatattttattgacaataaaactgggcccaacccatgtgtttgaagccactttcaatgctttcacgtgattctcattggacgttacaggaccccatgag

SEQ ID NO: 50364 - DNA, 201 bp, Homo sapiens
ccatgagggctggcattttgtccctacatgtgtccccagccactctaacagggcctgacacataccaagttgtgaacaaatatgtgcagaatgattgtgtwagtgtttcagtaggggacacacttggtattatgtgcacagctagatttggggtgtcgcagagctgtcagtgacggctcaactgagacctgaaggggaagt

SEQ ID NO: 50365 - DNA, 201 bp, Homo sapiens
aagtatggtcttctggggcaataagccactatgttcctttccttgcaccctgcaacacccccacccacacatcccagaaaagagcacaacagttcaggttsaaggtcaaactcctagctccatcaccttctgccgtaccatagccctgggggaaatgaagacagtgtttctcctctcactggtctttctactactagtttc

SEQ ID NO: 50366 - DNA, 201 bp, Homo sapiens
tttgtcatccaggctcgctgcttaagagatactgaacagatcttcagagaaggtccggttgaaattggtctcccatgctccatcaaaaatgaagcaaggcygccatgtttaccgacaccgggaaaaagaggtagctgtcctgatcagcagtctaatcactgtcagtcattaatctcaattaaccctaacctaatgcccttg

SEQ ID NO: 50367 - DNA, 201 bp, Homo sapiens
cagagtataatcaccaactaggtccaaaagaaaagcaaagtcgtgtcctgggttcctttttccaagttccgagttgtgggaagatgggttgtggcagctcygggagcagacacataggatttcctccttcctcagctctcaggagggccgctggatccaaggcaggggtcaggtatttccgagatgaagtgaactgaatag

SEQ ID NO: 50368 - DNA, 201 bp, Homo sapiens
agctggccaggcgcagtggctcacgcctataatcccagcattttgagtctgaggcagaaggattgcttaatgtcaggagttcatgaccagccttggcaacrtagtgagaccttgtctctacaaaaaattttaaaaattagccaggcatggcgatggcacacatgtggtcaagagtctgaggtgggaggactgcttgctcaa

SEQ ID NO: 50369 - DNA, 201 bp, Homo sapiens
agtggctcacgcctataatcccagcattttgagtctgaggcagaaggattgcttaatgtcaggagttcatgaccagccttggcaacatagtgagaccttgyctctacaaaaaattttaaaaattagccaggcatggcgatggcacacatgtggtcaagagtctgaggtgggaggactgcttgctcaagaggttgaggctgc

SEQ ID NO: 50370 - DNA, 201 bp, Homo sapiens
aacttcttggagtgtcattctctccatttgcaaagtgaagaaaattgtgatctctgatagcagtgatgctgcgagaaaggagcatgtgccagtgtgtgggstattgctgggtggagctggaggagtcagctgtgccagatcacataggacctgtaagcaggtgaaccatatacgttatcctccagatggggactgtttata

SEQ ID NO: 50371 - DNA, 201 bp, Homo sapiens
gagtgtcattctctccatttgcaaagtgaagaaaattgtgatctctgatagcagtgatgctgcgagaaaggagcatgtgccagtgtgtgggctattgctgrgtggagctggaggagtcagctgtgccagatcacataggacctgtaagcaggtgaaccatatacgttatcctccagatggggactgtttatagagtgaaag

SEQ ID NO: 50372 - DNA, 201 bp, Homo sapiens
acataagcgcctctcgtgagcccctctcaggctgcaatgagacaaactccctcgcctcctatggaattttatgttaaccaaattatattgattaatgtgasatttgcttcacttttgtttttcagggacctgaagctagataacatcctgttagacaaagatggacatatcaagatcgcggattttggaatgtgcaaggag

SEQ ID NO: 50373 - DNA, 201 bp, Homo sapiens
atcctccagatggggactgtttatagagtgaaagagcacgttattaatcactaagcttgggtaacaggtacaaacccagattgtcctgggcagactgtccygtagagttgtcctgcgttaagtcatatgaaggagtttgatccttttctaagaacaggaggaaccctttaaatgctttatctaccaatgtatacaagtgcc

SEQ ID NO: 50374 - DNA, 201 bp, Homo sapiens
gtgaaagagcacgttattaatcactaagcttgggtaacaggtacaaacccagattgtcctgggcagactgtcccgtagagttgtcctgcgttaagtcataygaaggagtttgatccttttctaagaacaggaggaaccctttaaatgctttatctaccaatgtatacaagtgccattcaggttctctccagcgtttcagag

SEQ ID NO: 50375 - DNA, 201 bp, Homo sapiens
gccatctcaatttctttcctcttcaccttgcaacaccttggtgtggctgccttactctgatgtattcctgtctacagattttgggtgccgggtcttttccmcggcaaaccttccttcccgatttccatctgcttcttgcagaatccggcttccacagcttgcttctctctgcagcttcactcccttcttttcttttacgtg

SEQ ID NO: 50376 - DNA, 201 bp, Homo sapiens
tgaactcacagcactcggcttgcactgcaaactcacctatacgttggcagctgtctcctcactgggcacttaattcatgaacaactaggagggaaagacarcaagacagccaggggtctgctctttggctctttgcatttttttttacggggtcttgctctgtcgcccaggctggagtgcagtggcacgatctcagctcac

SEQ ID NO: 50377 - DNA, 201 bp, Homo sapiens
acttataagtgggagctgaataatgagaacatgtggacacagggaggggaacaacacacactggggcctgtcgggaggtgggattggagggagggagagcrttaggaaaagtagctaatgcatgtggggcttaatacctaggtgatgggatgatgggtgcagcaaaccaccatggcacatgtttacccatgtaacaaacct

SEQ ID NO: 50378 - DNA, 201 bp, Homo sapiens
cacacactggggcctgtcgggaggtgggattggagggagggagagcgttaggaaaagtagctaatgcatgtggggcttaatacctaggtgatgggatgatrggtgcagcaaaccaccatggcacatgtttacccatgtaacaaacctgcacgtcctgcacctgtatcccagaacttaaaataaaaataaaaattaaagaaa

SEQ ID NO: 50379 - DNA, 201 bp, Homo sapiens
aaatataaaaaattagctgggtgtggtggcacgtacctgtaatcccagctgctcaggaggctgaggcagggcaattgcctgaacccgggaggcggaggttkcagtgagccgagatcgtgccactgcactccagcttggtgacagagtgagactctgactcaaaaaaaaaaaaattaagtgctaccttccctggccaggcca

SEQ ID NO: 50380 - DNA, 201 bp, Homo sapiens
tggtttgttagtttgtttgtttttgaggcagggtcttgttctgttgctcaggttggagtgctgtgactcaatctcggctcactgcaacatctgcctcccargctcaagcaattattgtgtcagcctcgagagtagctaggactacaggcatgcaccaccacacctggttaatttttatgtttttagtagagacagggtttc

SEQ ID NO: 50381 - DNA, 201 bp, Homo sapiens
gtcagttttggatttttcctgctttctcttgtgggcatttagtgctataaatttccctctacacactgctttgaatgtgtcccagagattctggtatgttrtgtctttgttctcattgatttcaaagaacatctttatttctgccttcatttcgttatgtacccagtagtcattcaggagcagattgttcagtttccacac

SEQ ID NO: 50382 - DNA, 201 bp, Homo sapiens
gattcgaaggttctactcctttcctctccagccctcacatcgggttcctccaagtctgagcctctttaagctcctaggaggtcccagcatcccctcatctygtggacgtctgctcaatctctgagctacttcctgtacatcttcagctcccaagatgtctcttgtcctctggaaagctcttcctgatcctccacatcagga

SEQ ID NO: 50383 - DNA, 201 bp, Homo sapiens
attgccccttttgccctcaaaaaccaaacaaaactggagctgtgttctccctcctcagtgccttagagaaatgttagcctctcttgtgtgattctaagtcratgctgccctgcagggtctttatgagtgttccgctgctgtctctcctacaaacgtgtctgtaagcaccttcagggaggggactctgtggcctggggaagg

SEQ ID NO: 50384 - DNA, 201 bp, Homo sapiens
tcagtgccttagagaaatgttagcctctcttgtgtgattctaagtcgatgctgccctgcagggtctttatgagtgttccgctgctgtctctcctacaaacrtgtctgtaagcaccttcagggaggggactctgtggcctggggaaggccgactaggtgaggcagagaattaaaacacaggaacacacaactgctgggacag

SEQ ID NO: 50385 - DNA, 201 bp, Homo sapiens
gaggggactctgtggcctggggaaggccgactaggtgaggcagagaattaaaacacaggaacacacaactgctgggacagaggccatctggcaggcacccrtcgttcctgtgaggagaactcaaatctcagaagctcatgcatttcgtagcagagtcaggagctacacatgaaaaacacacctgtgctccctcaactgggg

SEQ ID NO: 50386 - DNA, 201 bp, Homo sapiens
gggactctgtggcctggggaaggccgactaggtgaggcagagaattaaaacacaggaacacacaactgctgggacagaggccatctggcaggcacccatcrttcctgtgaggagaactcaaatctcagaagctcatgcatttcgtagcagagtcaggagctacacatgaaaaacacacctgtgctccctcaactggggatc

SEQ ID NO: 50387 - DNA, 201 bp, Homo sapiens
ggaggaatccatatggcagagggcagagaagcgaatggaaggggaggaagcaaagatggttcaggaagctggttggcgaaggaagggaggtaaggccatarcagcgggagaagccacggcagaagttgttagaggttgcaaaaccggagggtgtttataagcgggagtgggagacaggcagaaatcacaagaatggcaagg

SEQ ID NO: 50388 - DNA, 201 bp, Homo sapiens
gcgtgccaccatgcccggctaatttatgtatttttagtagagacagggtttcaccatgttggccaggatggtctcgatctcttaacctcatgatccgcccrccttggcctcccaaagtgctgggattacaggcgtgagccactgcgcccagccggaaacatcatactttctatggcacactagacactcagtaaatccaga

SEQ ID NO: 50389 - DNA, 201 bp, Homo sapiens
aataattcttagagtaaaaagtttggttgggtgcagcgactcacacctgtgatcccagcactttgggaggccaaggcaggaggatcacttgaggtcaggartttgagactggcctgagcaacctagtgagaccctgtgtctacaaaaaataaaaaagaaactagctgggtgtggtggtgcatgcctgcagtgtaactagtt

SEQ ID NO: 50390 - DNA, 201 bp, Homo sapiens
gatatgtggttcagagacgtttctggttgctttgacgccgccttgtgggcaagtctcggaaattgcatgtgtccctggcccagcaaattgagcaaagattktattaggtgcatcttatatttccttatcattctccctgggtctaccttcagatgattccttaaggcaaagcctattttttctaaattataaagtaaactt

SEQ ID NO: 50391 - DNA, 201 bp, Homo sapiens
gcagggcttgtggaaagggagaatggggagttattgtttaatgggtgcagaatttcagacttgcaagatgtaaaagttctggagatgaatgcccaacaatrtgaatatacagaacactgctgaactatacattgaaaatgattaagatggtgaatttcagccgggcgcggtggctcacgcctgtaatcccagcactttggg

SEQ ID NO: 50392 - DNA, 201 bp, Homo sapiens
aaattataaagtaaactttagcatgtaaatatcgaggtaagagtagtgggtagcatttttatattggaaatcagtaacattgcaaaattctgtttgcaacwttattttcagaaacggggacaagtgcatcatcaaagcagatatttatcataacatttatagttgtcccataagacaaatcatcttgactttgctactttt

SEQ ID NO: 50393 - DNA, 201 bp, Homo sapiens
tgtaaaagttctggagatgaatgcccaacaatgtgaatatacagaacactgctgaactatacattgaaaatgattaagatggtgaatttcagccgggcgcrgtggctcacgcctgtaatcccagcactttgggaggccgaggtggccagattaccagaggtcaggagtttgagaccagcctggccaacatggggagagcgc

SEQ ID NO: 50394 - DNA, 201 bp, Homo sapiens
tgtcccataagacaaatcatcttgactttgctacttttcactggatctcacaagaagcttataagaagcgggccagatatgattcccgtttttcacaaacragaagggtgaaagggtcctcccaaaactacacaataagggattaagccagaagtagagcctgtgacgttttacatggccagaaaaactcttgtgctgctg

SEQ ID NO: 50395 - DNA, 201 bp, Homo sapiens
gttccgagttgtgggaagatgggttgtggcagctccgggagcagacacataggatttcctccttcctcagctctcaggagggccgctggatccaaggcagrggtcaggtatttccgagatgaagtgaactgaatagggcggctacccgaaaggcagtcctcagcattattccaggaaacatcagggcagaacctgaaagag

SEQ ID NO: 50396 - DNA, 201 bp, Homo sapiens
cagctccgggagcagacacataggatttcctccttcctcagctctcaggagggccgctggatccaaggcaggggtcaggtatttccgagatgaagtgaackgaatagggcggctacccgaaaggcagtcctcagcattattccaggaaacatcagggcagaacctgaaagaggaaaagaagtacacagctgaaagttaggg

SEQ ID NO: 50397 - DNA, 201 bp, Homo sapiens
gttagttttccttctaacaaacaggaccctcagctgcaggtctgttggagtttgctagaggtccactccagaccctgtttgcctgggtatcagcagcggtrtctgcagaactatatttattaatactacaaaaatatctatgcttcatcaaaataatgagattaaatgactttttaaaaatcttggttttggccaggtgca

SEQ ID NO: 50398 - DNA, 201 bp, Homo sapiens; identical to SEQ ID NO: 9407

SEQ ID NO: 50399 - DNA, 201 bp, Homo sapiens
gcagtgcagtggcatgatcttggctcactgcaacctccacctcccaggttaaagcgattctcctgcctcagcctcctgagtagctgggatcacaggtgcaygaccacactcacctaaatttttgtatttttagtagaggtggagtttcaccatgttggccaagctggtcttgaactcctgacctcaagggatctgcccgcc

SEQ ID NO: 50400 - DNA, 201 bp, Homo sapiens
catgatcttggctcactgcaacctccacctcccaggttaaagcgattctcctgcctcagcctcctgagtagctgggatcacaggtgcacgaccacactcasctaaatttttgtatttttagtagaggtggagtttcaccatgttggccaagctggtcttgaactcctgacctcaagggatctgcccgcctcggcctcccaa

SEQ ID NO: 50401 - DNA, 201 bp, Homo sapiens
ctaggttctgcagaaatacttatccttgcagatgtgtttggctgaaacccttgagatacaggcattcagtccagtccctggcctatatactgtaccaacgstgattctgcaagactctctcactgttggtttcctgcccagcagattgtcctgggcagtgtactagtctgttctcatgctgctgtaaggacatacctaata

SEQ ID NO: 50402 - DNA, 201 bp, Homo sapiens
ttgagatacaggcattcagtccagtccctggcctatatactgtaccaacgctgattctgcaagactctctcactgttggtttcctgcccagcagattgtcytgggcagtgtactagtctgttctcatgctgctgtaaggacatacctaatactgggtaatttataaaggaaagaggtttaactgactcacagttctgcatg

SEQ ID NO: 50403 - DNA, 201 bp, Homo sapiens
agaggtggaggaggtggaagggaggcaggagaggcaggcacacttggtgtaaatttgattgaaaaaatctacatattagtggactggtgcagttcaaatcyaggttcatcaagggtcaattgcacttaaaatacctacagaccagctctccccaacctgccctacccactgtccaccagaaatattgttgacttcttcact

SEQ ID NO: 50404 - DNA, 201 bp, Homo sapiens
cacaggatccccagcccaggggtaaaggaacaagatgtttaaaaatttgagccacttccattcagctttcactttctgactatgatccaaacaagcaatarcttagaaaactccctcaacaatcaattaaaggcacttttaatgaccaaacacagataaaatgaaaactaatctcaaaattaaccaatttttttaaaaagg

SEQ ID NO: 50405 - DNA, 201 bp, Homo sapiens
tcctgtttgtttgtttcttggtttgtttgttggtttgttagtttgtttgtttttgaggcagggtcttgttctgttgctcaggttggagtgctgtgactcartctcggctcactgcaacatctgcctcccaggctcaagcaattattgtgtcagcctcgagagtagctaggactacaggcatgcaccaccacacctggttaa

SEQ ID NO: 50406 - DNA, 201 bp, Homo sapiens
cctgaactccaagttctcaccatggcctgtggacagccccatgggcacacccacctcgtctgtcttctctaccccttgctcaactccacgcagcccatccsccttcccagaacgtgcttggcagctccgacctcacacccatgtttcggccgggaacgttcacctgccattgtctgtgtgactcagtcctctcctcgtgca

SEQ ID NO: 50407 - DNA, 201 bp, Homo sapiens
ggttaaacaacagacatttctttctcacagttttagaggcagaaagtccaagattaaggtccagcagtgtcagttcctgatgaggactctcttcctggctkgtagacagctgccttcttgttgtgtccttacagcagagagagagagagataaactctggtctctctttcatgtgagacttctagccctattggatcaaga

SEQ ID NO: 50408 - DNA, 201 bp, Homo sapiens
tgggtgattacaacattttcaaggattcttccccagggcagctgcttgtgggagagctgaggtctagaaaggaggagttgagagcaggaaaggaaccaagsctgaccccacccccatgccagcattttgatttatggaaccctgggagaagagtttctccaaaatgatacttcatggcctccagcagatccccctcaaaga

SEQ ID NO: 50409 - DNA, 201 bp, Homo sapiens
tccatttttccttttgacatcttcgatgatcaagatacctgctaaggatttgttcagaaatcagaattagttgtaaggcagttgcctgaacaactgaaagygtaatgaccccacagagagcactaaggcaacagaaagtacggcgaggtgggattattaggttggtgcaaaagtaattgtggtttttgccaatacttttaa

SEQ ID NO: 50410 - DNA, 201 bp, Homo sapiens
cccaggctcaagcaattctccagcctcagtcttccatgaagctgggactacaggtgcatgccaccaatgcccagctgatttttgtattttttgtagagacrggttttgccatgttccccaggcaggtctcaaattctggagctcaaagcaatctgcccgcctcagcctcccaatgtgctgggattacaggcatgagccacc

SEQ ID NO: 50411 - DNA, 201 bp, Homo sapiens
catgttgatcaggctggtcttgaactcctgacctcaggtgatccgcctgtcttggcctcccaaaattctgggattacaggcatgagccaccatgcccagcytttttttaaatttccattacttttaatggcaaaaactgcaaattactttcacaccaaattaataggatatttgatgagttttaatataattatcgttttt

SEQ ID NO: 50412 - DNA, 201 bp, Homo sapiens
atttgtttgaaaatgatgggaaactaatgatatagaacataaatatctcttcctttcatagaaagacatatctgaggagggactgaagagggaaggcaggytccaggtacaatctgtcagcactactgctggctgtcctctgcagcctggagctgctttcttgcacagactgtccaataaacttaaacaaacttcaactac

SEQ ID NO: 50413 - DNA, 201 bp, Homo sapiens
gctcaagtgatcctcccacctcaacctcccaaagtgctgggattacaggcataagctactgcacctggcccatacttactattttaattcacttttgagaycatttttgttggtgaaagctaatatttaatctctttattatactacttagtagaagtcttagcaacaaagcaaaacgctacccaactatgtgattttttt

SEQ ID NO: 50414 - DNA, 201 bp, Homo sapiens
tgaaggaggcaaacgtgttcggctaatgcataaaatacagtagatagactctcccagaatatggggttccaaaagaacgttgaggataaggagatctttgktgaccctatgcatttaaacattttaaatggcctttgtccccatcgttagcaggctgagctgttccatcaatggtgggtgggtgggtggtctgactctctg

SEQ ID NO: 50415 - DNA, 201 bp, Homo sapiens
ggatatagggcaagtcacttattccttttgcttccttttttttttttttttttttaaggagtcttgctctgttgcccaggctggagtgcagtggtggtgcratctcggctcactgcaacctccacctcccaggttcaaatgattctcctgcctcagcctcccgcatagctggggttacaggcgtccaccaccacacccggc

SEQ ID NO: 50416 - DNA, 201 bp, Homo sapiens
tgtgattttttttttactagttatcatctttcttctgtgcacattgtgaaaaagtttttttttatgtttcttttaacagcagtcacttttacctaagaaayctttctatctcataaagaaatgcaaaagctattggtgtagcttaatttgccaaaatttttctgaattgatgtttaccaaatttggctgagcagatgtaat

SEQ ID NO: 50417 - DNA, 201 bp, Homo sapiens
tggaagagtatgaaagataaacctagggatttaaaaatatagagactattgtaggcagggggaaattcctaaaaatttctcttatgttttctctgacttcmaatcaacttaaaaatgtaaatgaaaggtttgggttacatttaggaggggttgccaggcagtcaaggagactatgtcttagcaatgatcaacataggcagc

SEQ ID NO: 50418 - DNA, 201 bp, Homo sapiens
gtgtagcttaatttgccaaaatttttctgaattgatgtttaccaaatttggctgagcagatgtaattggaaaccattgaatgctttgtttctcattcccaratttactattgattaatctgtgttctttcttccacatgtgagaggttttgatacaagtgatgactattgttattttaattctgtgagactctcccccaac

SEQ ID NO: 50419 - DNA, 201 bp, Homo sapiens
gctgaataatattgagctccatttggggtttggatttaaacactgatgccttgcctttcagcagaatcgactctgtccagcacatggtagctgatattcadgaattctttttgttcagttccacaataatatgaaccacagtaggctcatttggtgctaatctgagcataataggcaatgttacagccagtcttcattgta

SEQ ID NO: 50420 - DNA, 201 bp, Homo sapiens
gatttccacatttgaataaggttaataaggaagacattaagttaaacctacaagccttagtcggtatcccaaggtgcagctgggagccccaggtttccccyactccatgtccaaagctgtctacttcttttcatcaggaccctgggtccctatacacggagaggagaggagggggagatatcaaagcaagacaggatggct

SEQ ID NO: 50421 - DNA, 201 bp, Homo sapiens
cttggaaaaaagatacaatgtgctaattctccagtggagcgaagatgttgtgtggtacacagatgagagattatccatcaggatgagggggaaggaggccrcttgtcatcaaagtgctagatcctctgaagctcggcttcctcagctgacaactgggatgatgaatttgtttctcttagaatttgtttgaaaatcactgag

SEQ ID NO: 50422 - DNA, 201 bp, Homo sapiens
acactgagaatactccaaaacttgtcttttctctctcttctggctttatgtggaaagtatgtttcctcaccaagacctctatacccttgttctcaaacaamttttaagcctaagaaaacaaattgtgtgttctctggggatgtgagcatcattcatttgcctgaattcccatctaagtttcatcccttcccttctatcaag

SEQ ID NO: 50423 - DNA, 201 bp, Homo sapiens
aagatggaaatgtcattagtgagggacagagacaggaaggcaggtggtgttttcggtgagcagaaatgtctggactggagagggtcctaatgggaaatggwaggtcctgtgagtcagcgtcagactccagagagccttgaatgccagccgaggacccgaggatgtcagaactctccaagccctagagatcaccttgtctag

SEQ ID NO: 50424 - DNA, 201 bp, Homo sapiens
gaaattgtttatcttcactggggatgagggaagtaaggcacccaaatgcactcgttctgaggagtttttgctgaatgtattgcagatgagaccagagagamttgtgtagttggagtcaaacccctcttctgagtgtatgtagcatctcaagaatcaagtaggcgacatcctggtggggctctataagtccccacattagag

SEQ ID NO: 50425 - DNA, 201 bp, Homo sapiens
cacctcagcctcccgagtagctgggactacaggcacccaccaccatgcccggctaatttttgtattttttttttttttttttttttttttttagtcgagayggggtttcaccatgttggccaggctggtctcgaactcctaacctcagatgatctgcctgccttgacctcccaaagtgctgggattataggcttgagccac

SEQ ID NO: 50426 - DNA, 201 bp, Homo sapiens
ctcttaaagtattaggcaaagtattatgtcccatctgtggaactgttagagggttactggaaatgctttttgtctggaagttggggttgccataaaacaartctgcggacactacagaaaagacttcagtcctacaatgtgtcctgggatgtggctggattcctgggggaggtttctacccacacagctcctcctttgtct

SEQ ID NO: 50427 - DNA, 201 bp, Homo sapiens
cggtgagcagaaatgtctggactggagagggtcctaatgggaaatggaaggtcctgtgagtcagcgtcagactccagagagccttgaatgccagccgaggrcccgaggatgtcagaactctccaagccctagagatcaccttgtctagcccttcctttacacacgaggaaactgagactcagaaaacttatccaaggcgac

SEQ ID NO: 50428 - DNA, 201 bp, Homo sapiens
agtcacaagagaggtggtgcagaatcggtggagcaggagatgaagcaagtgggtcgtgaggcacaaggggaagggtaaagttgaagcagcgggtgagggcygggcgtcgcggcacccagcaccgagctggcaaaatgaaggaagaggcaagtttgaaagggaaggcagggagttctgtatgggacctggtgagtttggggt

SEQ ID NO: 50429 - DNA, 201 bp, Homo sapiens
atgttggccaggctggtctcgaactcctaacctcagatgatctgcctgccttgacctcccaaagtgctgggattataggcttgagccaccgcacctggccrgtgtttattttttaagtacacaaggagaactatatccctccattcttcttttggcctggaaaaactgggtaaaacgtaaagctaggatttatgtgcactt

SEQ ID NO: 50430 - DNA, 201 bp, Homo sapiens
ggggttggagaaggaaccccttttcccacccaacacaggtgtctctcaggactctgtctcttttttaagaaatgggaatccaaattctaaaataaagttayttcttccctctccttctaggtcttcctggcagaattcaagaaaaccaatcaatttttcgcaataaaggccttaaagaaagatgtggtcttgatggacgat

SEQ ID NO: 50431 - DNA, 201 bp, Homo sapiens
agcaagtgggtcgtgaggcacaaggggaagggtaaagttgaagcagcgggtgagggccgggcgtcgcggcacccagcaccgagctggcaaaatgaaggaaraggcaagtttgaaagggaaggcagggagttctgtatgggacctggtgagtttggggtccccttggagatttccaggagagagtcgaatgcgtgactttat

SEQ ID NO: 50432 - DNA, 201 bp, Homo sapiens
tagcccttcctttacacacgaggaaactgagactcagaaaacttatccaaggcgacgtgggtagtcagtctctcggatagctgtcgtgttatttccaccgygcagtggctttctaattgggtactttggaaccccaagtttccctagagagtcctcagcagtccccatatggtaagggggagagaggaagttgagactgct

SEQ ID NO: 50433 - DNA, 201 bp, Homo sapiens
tggctctttacatcaaaaggcaaatgataggacacaatgacatttagtgtgcagcacctgtaagctgctgaaactggcttggggtctgcatttgcttatcragaaagaatgcctggaagcctggttccctgtccaatcagagttgcaggggtctgggttgtaaatcagagttaggaagagtctcaaacttcgcctgattat

SEQ ID NO: 50434 - DNA, 201 bp, Homo sapiens
agtcctcagcagtccccatatggtaagggggagagaggaagttgagactgctaagaatttgccaatcagatacaccgggtgattgcacaaacatttcaccyggaactttaaaagattctcctacttttttttaaaaaagcgaaaaaacttcactttacaatagcatgttgtttggtctttatatttttttggtagaacgga

SEQ ID NO: 50435 - DNA, 201 bp, Homo sapiens
ggctctttacatcaaaaggcaaatgataggacacaatgacatttagtgtgcagcacctgtaagctgctgaaactggcttggggtctgcatttgcttatcargaaagaatgcctggaagcctggttccctgtccaatcagagttgcaggggtctgggttgtaaatcagagttaggaagagtctcaaacttcgcctgattatt

SEQ ID NO: 50436 - DNA, 201 bp, Homo sapiens
aaccttagaatccatcttagctgatgaaggggcaactgtcttggtctctcagatcacacgtgaatggagagtgaagatgagaccgactgaaatttagagtkcacagaggacagatcacacagcttagtcctgaggcaggctattccagcacatatttttgtctacagaaactctcatttctggttaaacacccagggaaat

SEQ ID NO: 50437 - DNA, 201 bp, Homo sapiens
ttccaccatgttttctgttttaaagaaccttaggctccttaaaatgccctataactcatggttacttcataaataaacatctagctgatgtaagaataacyggtaactactccagacacccaggggacctgttacttttctaagttaatgtttagactctcctgtttcttaatgcccttgacaggttttatttaagtttga

SEQ ID NO: 50438 - DNA, 201 bp, Homo sapiens
attattgtttttattatatatttttcttttcttttcttttctttttttaagacagagtcttgctctgttgcctaggctggagtgcaatgacatgatcttgrctctctgcaacctctgcagggagccaagcgattcccctgcctcagcctccagagtcgctgggattacaggtgccccccaccatgcctggctaattgctgt

SEQ ID NO: 50439 - DNA, 201 bp, Homo sapiens
aagtatctgtaaagtgctcatataacgacatttcctaagggtaattgttaggtgttctttggtttaagggagaaactaactaaatccgtgctttaaaaaakataggtctgtacatttccatttatgtcctcactggcaaaagtcattaagctacatcagcaaaggcagaatgacctggctcacctgcgagacgggccacca

SEQ ID NO: 50440 - DNA, 201 bp, Homo sapiens
tttccacaattagttggaactatgatttttgtatcctgtatagcttgtgcctttgcaatttattttcttgggtcataaacagtgcctttcttacaaatttrtatacccatattatgtaagaatggcgtttacttacttctgttacactaaccatagctatttccctgggtaggtctttactgttaagtttggttattttct

SEQ ID NO: 50441 - DNA, 201 bp, Homo sapiens
gcatctcattcccagggcaagaatagttgttctcaacatctgtcccaagctccagtgatgttccaaggacccaacaggccagcctcaagcactctaattayttgtgacagaaccacatctaatacatgggttagtcatttgtgataaaataaaaattttaccttgtttttagctatcagaactattaaaccatgtctcacc

SEQ ID NO: 50442 - DNA, 201 bp, Homo sapiens; identical to SEQ ID NO: 9412

SEQ ID NO: 50443 - DNA, 201 bp, Homo sapiens
agggtgacaccagaaaaggtcagggtgctttaactctggctttgtgagttagtgatccctctagactcaaacagaattaaggaaatcttcagaaagtcccracagggcaaaaactcccgtaactgaagatgattcttagtgatttttcctgatttgtggagaaatgaagttttgtctaaaagacccaattggcccaggaaa

SEQ ID NO: 50444 - DNA, 201 bp, Homo sapiens; identical to SEQ ID NO: 9413

SEQ ID NO: 50445 - DNA, 201 bp, Homo sapiens
gcaaagggcgcctcctaaagacaaatttgtaagtcatctacctgctaattcagcaacgtgacagatacggaacccagcaaatcatgatgtttacccaaccrtctcctttagataaaacttccaaactctgcaggaaattaggacttcattaatatctgtgaaattaatgcctgtcaaaagctcctaatttgtctctcttgt

SEQ ID NO: 50446 - DNA, 201 bp, Homo sapiens; identical to SEQ ID NO: 9414

SEQ ID NO: 50447 - DNA, 201 bp, Homo sapiens
acccagcaaatcatgatgtttacccaaccgtctcctttagataaaacttccaaactctgcaggaaattaggacttcattaatatctgtgaaattaatgccygtcaaaagctcctaatttgtctctcttgtggagtcaaagaacactggtatttagcatactggagatcccttttgtcttagctagatgaggtattacaggc

SEQ ID NO: 50448 - DNA, 201 bp, Homo sapiens
catacatatatttaaagacgtggcgtagggagagcttctaaaacctgcaaagccaaagctgcacagctcctgcaagttagcgatccactctaagtttttcwgttgttgtttctgtcttcttgcctctcatgaacttctgtttctgatttcaagagtaacctgctgggcaccatcagcctttgtttcagtgacctgcgattt

SEQ ID NO: 50449 - DNA, 201 bp, Homo sapiens
tatctgtgaaattaatgcctgtcaaaagctcctaatttgtctctcttgtggagtcaaagaacactggtatttagcatactggagatcccttttgtcttagmtagatgaggtattacaggcccaagatctccaggtatgttactgattctccttccaggtctttattatttcaaatagttttctttctttatacaaaggcag

SEQ ID NO: 50450 - DNA, 201 bp, Homo sapiens
catgctgtttgcagcagtcaattgagttgaattagaattccaaccatacattttaaaggtatttgtgctgtgtgtatattttgataaaatgttgtgacttmatggcaaacaggtggatgtgtaaaaatggaataaaaaaaaaaaaagagtcctcttaatcgtttacttccccgcttgccccccacaagaacttgcttctgc

SEQ ID NO: 50451 - DNA, 201 bp, Homo sapiens
gggggaggaggaggagaatcctgctatgaactgtgtatgaagcaaggtcttccaggacatttgacatcatctggtggaaccaaatcctgccatttaggacrctgatgcccagcaaagccaaggacttcctcatggacacacatttcgtgatggactctaaaccaggacccgatggcccaccggtgctctattgcactgtat

SEQ ID NO: 50452 - DNA, 201 bp, Homo sapiens
caggagtagagtaagacaaagggtgaggaagtcagatgacattaaggcaattgtaagaaaagcaagtctgcataatattcggagtcactagcctacctcawcacatggctggaaataactttagatattatatttaaaatagaataattaatataagcagactgttgacagtctgcaggtgtgctggaacattttcctgac

SEQ ID NO: 50453 - DNA, 201 bp, Homo sapiens
gccctatgtggttaagcctggttactttaaataagtctaggtagattaagactgcataatcttccaaccaactctaaagactgcttactgctgctttggcraatcttcagtggatattacaaagcatctataattagccattagaatccaaatttcagaaaacgtacttttgcactcactaaggtcttggctgaatgaaag

SEQ ID NO: 50454 - DNA, 201 bp, Homo sapiens
tagcctacctcatcacatggctggaaataactttagatattatatttaaaatagaataattaatataagcagactgttgacagtctgcaggtgtgctggarcattttcctgactatacggagctcttgtgattttttttaaatagacactcccctaaaatgaacacgagtaacctcatttaaggatgggcatctatcttca

SEQ ID NO: 50455 - DNA, 201 bp, Homo sapiens
agcaggtaatgaaggaacaaaaagcagtgtaaagaagagagggactgggggcagggatgtgtgttattttatatagggttgtcctgcaaaggcctgtgagygagggacatttgcagatacaagaagaaactgactcagactttgagaacctcctgccagatgctcagagttcagattctggggttcccaaacctactattt

SEQ ID NO: 50456 - DNA, 201 bp, Homo sapiens
gcaaagttaaaaggtcagtgagcaacactttccaaaacacagacactcgtggattccactcgctgcaggcctgggggcagctctaccccattttccttccmgtcgtcctctcctcactctgggttcccacatacccctgccccagcacccagcatcctcctgacacccagagaccccaacaggacccctaccaggagacaa

SEQ ID NO: 50457 - DNA, 201 bp, Homo sapiens
cgttgcataaagtgtatgcacataagggataagcatgatggtagccgatgactggctcagaactcccatgtcaatctgagggtgtgattacactggcctcrggtcaccaggctccctaccacttcctactggtgatttgataatggcgatggttattctttatgggctgtagaacacattgacatcttcagatctctttga

SEQ ID NO: 50458 - DNA, 201 bp, Homo sapiens
cttcgatgccggtcctctcatcaccactcccagttcccctccactttgcactttagcctagactcaaccttgccaatagaaatgagaactttacctcaggktatagttaaaggttttggaaaaagagagatcagtgcttctttttggaagatacagactgagagtttggctgagagctccctgtgcacgagaggctggcca

SEQ ID NO: 50459 - DNA, 201 bp, Homo sapiens
tttcattattccatttggaagcaggccccttaccatagctcttccatctccatttttgcctccatctttactccttattcacaagccagagaacaatggtrcatacatgccatgtcaaaagcacttttcttttcattaatctgttgaaactcatatgaaaatttatagttgttgcagcaatgcaagcttattttatcataa

SEQ ID NO: 50460 - DNA, 201 bp, Homo sapiens
aactaaacgactaccctccatgtcaatgtgtcttaactaccatggtgtggtttcttctgagttcagcacggttagatgagcacacatggtgcagtgactcsatctatgcaccacctttctctactggaactatcaaggaagagccagctgtgcagtgtgtcttgatgtcattcaaccttcatttgtcaaaaatgcttaagt

SEQ ID NO: 50461 - DNA, 201 bp, Homo sapiens
cccatggacataatgaccaataatgaccttcaagtcattctttcttattctttttggtctgttaatggcatagtgggatggtttaatagattaacaacagygctcagcttgtcttgaacttggatttgtcctttcttctccttatgtcactttatgggagatcctacatcatcccttaaaatgacactttgttccgccctc

SEQ ID NO: 50462 - DNA, 201 bp, Homo sapiens
gtgagacaccatctcaaaaaaaaaaaaagaataaatctttgtaatatttaaaactttttatatctagatccaaattgacactccatctctaaatttttatrtgtcaaaaaaatctaattttaaaaaccaaagttatggaataacctaactagaaaattccttgttgatgacaaggaggagagcattcttttaagaaagctc

SEQ ID NO: 50463 - DNA, 201 bp, Homo sapiens
gaattacacagtattggtctacaaaatttcacttatgttatggagaggtgataaaaatctgttctaagggtgtagctacaggaataaaataaaaggaacartctaaaagaaaatactgttgcagagagatttcatggtagagtagatgaaatatctacagaatgcctgttaagtgtacatagttgaaatgctttataattc

SEQ ID NO: 50464 - DNA, 201 bp, Homo sapiens
cttctaactaacctgagcacagaagcaaatatgtaccctttggaaaggaagcagtgaaatggactgcagacctcaagggtggtccccagggatggagcttrtagctgaggcatcttatggaaagcctgatgtggaggcataaagctttagggagcaggaagaggcacttagtccatctgagaacaaagcttctccttccta

SEQ ID NO: 50465 - DNA, 201 bp, Homo sapiens
tctcttgggagggttaaatgtggggcatccaacatactataaatctccattgctgttaattaataatcactagtaacgtagtcttcttctcaccctcatgktagtaaacactgactgtgccctgtgatctcttagactttaatggccaattcaacccccccaatgctcaccactagtgtggcgtctgattcagacctgaga

SEQ ID NO: 50466 - DNA, 201 bp, Homo sapiens
cacaacagtcctgtaagttagagaatgcagtagtaattggaaactgaagcccagaggggctaattcatctgcccacatttccacagctaataaatgtctgygaaataaaactagagctagaattttctgtatccaaatgccatgcccttaccattgccaacagtgtgttgctgcatcatttgcaaaaactaaaattgttga

SEQ ID NO: 50467 - DNA, 201 bp, Homo sapiens
tctgcccttattctcagacaataagtactagcctttagtccagtttctcttttaccctatttattagcccactttctggcattaactctacctagcctggytcccatgataagcctttgtcagcactctgctctcattagttcccctttgccatggatagtctgatctccaaaccttgcattctcccctctcattctcccc

SEQ ID NO: 50468 - DNA, 201 bp, Homo sapiens
ataaactttacctctgacatcctcaactcttccttctctctgcagtttcttccttattcccaagacatactgcattatgcatcttccccaatcttgaacaycatctcttcttttttttcacctttttacctccttgagtttttttttctttccctaacacattcctttaaaaagtagtttatatttatcagtttctttttc

SEQ ID NO: 50469 - DNA, 201 bp, Homo sapiens
tcacagctgctcaggaaacttgtaatttgattgactacaaacaagtgataggttagaccacataaatagattagaatccattagtataaaagaaaaaaaaytgcaaaaaccaatgagctcattcaaaccagtaaatagagaaataaatatagtcaatacaaaaaaaattaaagaattctatgtttttacatttattctttt

SEQ ID NO: 50470 - DNA, 201 bp, Homo sapiens
atgtagaaattgtgtatataactatatatttatagtttataaaaatataaactatatgtagacatatatgtatataaacatatatgtatagatatatgtayaaaatatgtttaatatacatataaacatatatgatttttacagtaaaaacctgtatagggtccccataataattcactttcattccctgcatttaaaagt

SEQ ID NO: 50471 - DNA, 201 bp, Homo sapiens
ataaaagaggtgcatgaggaagccaggtctagtcaggaaaaatgcccatgggattttagtttctgcctcaatgggggggctattgggggtaagtgggaagraacagaagtgaaaggtatctttattacaaacagttttccagttttatagtcaaaacttcccccacctaatggcccaaccctgctggtgctactttttcca

SEQ ID NO: 50472 - DNA, 201 bp, Homo sapiens
atgcattttcattcatgcattttaatctctatatgtttggaaaatacaaggatgataaatcagccagttctcatttatttaattatcaaactttttaaaamgcagcttcaaatgaaaaacactctgttaatactcttggcaaatgatacaacagggctgctgatcagaaactgctctgtgatcttagggggttatgagatc

SEQ ID NO: 50473 - DNA, 201 bp, Homo sapiens
attgaaactgacagctgaagagtgacagagctggttaggtgaagagcaggaggaaggaagctccttacaggctggaagaccctgctgagggagagtccaaygtgttccaggaactgaaatgggaccagtgtggtgacagctgcaagggctgcgcagactggaagcccacactggggaaggcaccaaggcctgggtcatgcg

SEQ ID NO: 50474 - DNA, 201 bp, Homo sapiens
gcaggaagcgaagagggcctgagctctggtggagactggtccctggagcttccacagtttaaccggaagggagtagggcaagacagttgctgatggggatrggtgtggagctttggtgatgggcacacaaaggcgcttcccttagactgcatgtgtcccccatggagtttgatggctggaggaaggaaaagagaaagcaac

SEQ ID NO: 50475 - DNA, 201 bp, Homo sapiens
agcctgctcaggagtatgattttctccaacaaaggggcaggttcagagaaggcgaagtggctgggtttttccagagtagaatttctcctaacatttagaascagaaggagataaacttgtgctaaccggtgattctgctaagactcaaagaggttaaagtagtttgttcatgtttgatcacctgtacgtggcagagctggt

SEQ ID NO: 50476 - DNA, 201 bp, Homo sapiens
ctttgctatgcaccttcccaaaggaactgttgaattagaaacttctgcagagattataaacctttagaaaataaagcattttatcctgcacaagaatattsacattcttaccaggaatccaactatccaagtgttttgttgttcctgcaataagtttgatttaaactctggaaaactgttttttaaaaaaattccatgtcg

SEQ ID NO: 50477 - DNA, 201 bp, Homo sapiens
aacactgagccatctcccactaaattatagtaatacaaatgctgtccaaacattttattaaatgaagaagtttgctatttcttatttcatttgctactgargaagagaatgcttgatatttttttcaattgatgagagtatattatacttctattgctttctatttatatggaatttgtccccatcaggttcagttatgtg

SEQ ID NO: 50478 - DNA, 201 bp, Homo sapiens
atgtaagaggcattactgcttcatttaacctccaaaagcctttataaattagatattattattattccagtttttcagatgaggaaactgaggctcaaggrgtagagccccttgtccaggtcttataaccagtcagtggtagagtcaggttagttggaccatccagattagtctaaccatcaagcatttgctttaaaccgc

SEQ ID NO: 50479 - DNA, 201 bp, Homo sapiens
tgattcgaatattttgtagctgttttgaggggtccttttcgcatccagaccaggatttcacctggacagctggagtgggaaagaagtggatacatttcaarctcctagggctgtagttaatgtgtcctgtcataaccactgcagaacagtgtaggtcagagaatgcaaccactggtggcatgtataacccttcaccaataa

SEQ ID NO: 50480 - DNA, 201 bp, Homo sapiens
gtgctatctcaagacacccagccatgctgctaagaaggcgcattataaagaagcatcaaacattctgcagtttcaaaaagtgaaacgtatatttgcttgartgttcatctaaacactacccataggaaaattcaaacgaaactccagggaattttaatccacatgccacattttcttagtcttttgcaagatagagtcaga

SEQ ID NO: 50481 - DNA, 201 bp, Homo sapiens
gccttggcttggcggttttggtcttcagagcatccctagggccctctcataaggttgcagtcagacctgagatgaggtcactcccttatatggcccctggrtggatgcagctaggaggttgagattcccccaccccgtcttcctccatatgtggccccaaagtaggaagttcctgctgctttggtctttgggtgaaaaaca

SEQ ID NO: 50482 - DNA, 201 bp, Homo sapiens
ttagacccctcaacttcaactttaaaatcttatttctcttcctgcatcacggtgaccacctcctcacaagtgcaagaatagatgacgatattccagcatgytgtgattctcctaaaaacctgctgctcctagggactctgtggagtgagtttcctggaccgaagtcacttctcagatcttcatgttacacccatgatgttt

SEQ ID NO: 50483 - DNA, 201 bp, Homo sapiens
gctgacacatggtcctgcacagaaattctgtaacattagcttgagcatccatccctaaaccattgctgtgaactccaagtgcccagtaagaggctggcccrgttgtgaccgtcattgcctgttttctggtctttcctccaaggccaggatcgcagcagagcctaacctgccattcattattgatggagtttctcagaccta

SEQ ID NO: 50484 - DNA, 201 bp, Homo sapiens
gagctggtcccagcagcgccgcggcacagcttagaacttcccaggggttcctgggcgttatttcatggctcttctgcctgcttcgtttcatttctttcctygaatactctttcctttccgctccattctgttccccgctctctcctaccacctacatttcaagtgctcccctcccctttttcttttgtcccctctcctctc

SEQ ID NO: 50485 - DNA, 201 bp, Homo sapiens
taaaactccatccctctatgttcaatcctagctgacaacctcacttggtgtcacggtgatgcataagaaaatggagctggggctaccgaagttgaaacctracaccttctaaatagggcgaatgtgagttatgcgagttttgccgacaatgtggaatttggagcacaatcatgaaaaaaaaaaatcctttctatagtaaag

SEQ ID NO: 50486 - DNA, 201 bp, Homo sapiens
tgtagagagggggtttcaccatgttggccaggatggtctggaactcctgacctcaagtgatctcctcgccttggcttcccaaagtgctgggattacaggcrtgagccaccatgcccagactattttattatatattttaaatattataattctttttacagcttaaattaggacttaaaatgttaatttttcctcaaataa

SEQ ID NO: 50487 - DNA, 201 bp, Homo sapiens
taaaaatcttggttttggccaggtgcagtggctcacacctgtaatcccagcactttggtaggctgaggcgggtggatcatgaggtcaggagatcaagcccrtagtggctaacacggtgaaaccccgtctctactaaaatataaaaaattagctgggtgtggtggcacgtacctgtaatcccagctgctcaggaggctgagg

SEQ ID NO: 50488 - DNA, 201 bp, Homo sapiens
gaattcactgaacatgaggaagtgatgagaagtggtgaggaatgggttggggagatattctcggcattgccatttatttagaacagggtttctcagcctcmgcactattggttttgggggggtgcttgggggactagcctgtcatcgtaggttgttgagctgtatctctgacctcaccctactagataccagaagcacacc

SEQ ID NO: 50489 - DNA, 201 bp, Homo sapiens
tgtttactaagccttttttaaaaaaaacaaaatagtactgtatgtctgtttacatctttagtagtgtgtaagggaagattgttttctttagagttcttttraacaatttcaaggctattcagaaggatccattttaagaaaccaaaacatctttttaaaatgccttgtttaatatatatctttagccataatggaatcccc

SEQ ID NO: 50490 - DNA, 201 bp, Homo sapiens
tgtttctagttttattattattaaactgtgctgcaatgaacagtcttgtaagtatattttcttacactttccttatcactttaaagtcatttaatacacayttccttctataaagcttgtagaggtctcttatccaaattgctatggcgagatctgcttcataattcatattttataaaggtaataaagttacatgctgta

SEQ ID NO: 50491 - DNA, 201 bp, Homo sapiens
agatagatccacagagtgctggctggaggaatccatatggcagagggcagagaagcgaatggaaggggaggaagcaaagatggttcaggaagctggttggygaaggaagggaggtaaggccatagcagcgggagaagccacggcagaagttgttagaggttgcaaaaccggagggtgtttataagcgggagtgggagacag

SEQ ID NO: 50492 - DNA, 201 bp, Homo sapiens
ggagtatattacatgatactgaggtttagggtgcgattgatcccatcacccaggaactgagcatagtacccaatagttagtttttcaaccctagacccccyccctcccacctttacttgtccccggtatctatcgttgccatctttatgtccatgagtacccaatatttagctcccacttctaagtgagaatatgcattat

SEQ ID NO: 50493 - DNA, 201 bp, Homo sapiens
cccaaacatatctcccctaattcagttccaaccacactttaattcccagtttggacccccatttttctcctgaaactactgctggagagttctctctcttyggagttgcagttccttctgcaacgttgcatggactttggtaccaactggccttggttgctttgtatatgagtcctgtatcccaaggagactataatcttc

SEQ ID NO: 50494 - DNA, 201 bp, Homo sapiens
ctctctcaccactcctattcaacatagtgttggaagttctggccagggcaattaggcaggagaaggaaataaagggtattcaattaggaaaagaggaagtyaaattgtccctgtttgcagacgacatgactgtatatctagaaaactccatcgtctcagcccaaaatctccttaagctggtaagcaacttcagcaaagtct

SEQ ID NO: 50495 - DNA, 201 bp, Homo sapiens
gtcagttcattcatggtctgcatttatggaccttcagtgcatctagaacttttaccttctgcttatcaaatagtatctggaaatactgattattctggatmtgcattgtaatgatattgacactcatgaaaagatgctcaacacccttcctcagtagggaaatacaacacaaatcaataagctctgcttcacacccattag

SEQ ID NO: 50496 - DNA, 201 bp, Homo sapiens
ttaccttctgcttatcaaatagtatctggaaatactgattattctggatatgcattgtaatgatattgacactcatgaaaagatgctcaacacccttcctyagtagggaaatacaacacaaatcaataagctctgcttcacacccattaggatggctattaccaaaaaaagggaaggtggtgttggtgaggctgtgaagat

SEQ ID NO: 50497 - DNA, 201 bp, Homo sapiens
gaaaatatagtgaggcagaatgttagggccaacagaaaggaaagtagggctctagggattacagtcaccaaggtttctacccttgtgcaagagaaccatcrcttaatacttagtcatgtcattttcaattattaaaaataaattcatcacgcctgtaatcccagtactttgggaggctgagatgggcagattgcctgagct

SEQ ID NO: 50498 - DNA, 201 bp, Homo sapiens
tgggctgcccggaccttcaaatgccctcacaggtgatcatgtttcacacattccattctcctcatcctcctcattccacggacacacacaaacctccccaygcacatctgcttccccagggtcccccttacttcctactgtccccaagggtgacctagaaccaggggtagggcctgactccactgctcagtaggaaggaag

SEQ ID NO: 50499 - DNA, 201 bp, Homo sapiens
ttaaatattttgccacatattttgcaattatgtctcccagctttacgtgtattaataacacacaagttttatgtaaaatagtttggaaatgtttacctttktggggcttgtctgtgggatcatatctaagaagtcattcctaattccaagagggcataattattgatctatgttacctagtacttttagtggtttagcagt

SEQ ID NO: 50500 - DNA, 201 bp, Homo sapiens
ggcacatgcgggcttccgtagagtattctctataaaactgttagctcactgcggactgagcactgctgcttccgcttgctgtattgatactaccaaatacygtattttctttgaaaagtgtcacacgcccgcgggaggaagtggggtgtggtgtcacagcagcataggaggacaggagtgtttttgctactggtgtaccca

SEQ ID NO: 50501 - DNA, 201 bp, Homo sapiens
atggtaattgtgcttgggtggagatggcagagctcagaaacagaaggaatggcgtgaacagagccatagagacagatattcagggaaccttcagcaaatcragagaagtccaggcaggctgggactccgctgagagtcgtgctgtgtgaaggaggcaacttgaacccaataaacggaggctttttaataacaggttaagaa

SEQ ID NO: 50502 - DNA, 201 bp, Homo sapiens
attagaaacttctgcagagattataaacctttagaaaataaagcattttatcctgcacaagaatattgacattcttaccaggaatccaactatccaagtgytttgttgttcctgcaataagtttgatttaaactctggaaaactgttttttaaaaaaattccatgtcgatcactagcatccctctcccactcccctctccc

SEQ ID NO: 50503 - DNA, 201 bp, Homo sapiens
agaaagctttggggaaaaatctatacatatttatgaggggagttaagtgcaggtgccaggggtaaacatatgtccaacatacatcccatgttcactttggrgcacagttgtagcattaaaattagatcctaaatttggctctttacatcaaaaggcaaatgataggacacaatgacatttagtgtgcagcacctgtaagct

SEQ ID NO: 50504 - DNA, 201 bp, Homo sapiens
ataaaaatctttgctcgtatcactaaagtaatctttagagacaaatatatgccaagattttttttaaaaggtgctcaggcccatgcttagatatgtccagrtaatttagttgggcagtatctactcagcacttgtgtgttggcttgggaaaagggttcctggggccgggtgtggtggctcatgcctgtaatcccagcactt

SEQ ID NO: 50505 - DNA, 201 bp, Homo sapiens
gcttcgatttatattaagtgctacaaagatagtgaacaaggtgcaaggtggagagtaagcatgtggcctactgagactctgtggtccgggaatctccccarcggagggaacattgaaactgacagctgaagagtgacagagctggttaggtgaagagcaggaggaaggaagctccttacaggctggaagaccctgctgagg

SEQ ID NO: 50506 - DNA, 201 bp, Homo sapiens
ggaaggaagctccttacaggctggaagaccctgctgagggagagtccaacgtgttccaggaactgaaatgggaccagtgtggtgacagctgcaagggctgygcagactggaagcccacactggggaaggcaccaaggcctgggtcatgcggggtttctttggagcctggaaaaatgattgtattttgtgcaacttgtagta

SEQ ID NO: 50507 - DNA, 201 bp, Homo sapiens
agccccatttgttgcaaaaataaaaggtaatgccctttctcagaaacgtcttctagggaatttgacaaaatgttatgaaacccagaagtcataggtcctcyggaaaagctgaggatagcagcatttcatggcatctgtgacagcagcagtgccagacccgttgccattggcccacctagggcatggatgcatgtcgtgcac

SEQ ID NO: 50508 - DNA, 201 bp, Homo sapiens
atagagaaagttcaggactgactacaaaggaatctaaaatgagatgttaggtagaagataaaggacagagatagacattgagaaactgggctcagagaccrctcctcctacacccagagtctatgaagttacagaaaccagaagaagaagaggtgggttgtgttctgtgcagttgaggtgttgaaattgaggcccacgtgc

SEQ ID NO: 50509 - DNA, 201 bp, Homo sapiens
ctgcaaggcagaacatatactaatttaccgttctgtgcaaaactggaaagaatattgacgctcagagctggagaccatatgctcttctcattacacatttwattttttaaaatatatttttaaattttgcaggtacacatccaagctaagaaagcccattgacatgatcctcttggtacaaataccacatgttcactggaa

SEQ ID NO: 50510 - DNA, 201 bp, Homo sapiens
gataaaggacagagatagacattgagaaactgggctcagagaccgctcctcctacacccagagtctatgaagttacagaaaccagaagaagaagaggtggrttgtgttctgtgcagttgaggtgttgaaattgaggcccacgtgcagatcttcacaggcttaaatcagagaaatgtcaggggcatcttggaggcattagtc

SEQ ID NO: 50511 - DNA, 201 bp, Homo sapiens
ttgtgcacggcactatgctagcttctgtaaggaatagatatgtcaatggtgcccggcctccagagcttacagtgtggtaggaaagaagacaaccttggaaraaagatacaatgtgctaattctccagtggagcgaagatgttgtgtggtacacagatgagagattatccatcaggatgagggggaaggaggccgcttgtca

SEQ ID NO: 50512 - DNA, 201 bp, Homo sapiens
tttgtggcataaaccagaagctaatggctgaagcgctggccatgattgagagcactcaacaggtaggagcatgtgccgtggacacgttcccgccatggcckctcagcaaggatgtccatgcacttctgctgcttcacctgtggcagccctatgggaaatgccgggatgtatttctgagcaccggccttgcccttggctttc

SEQ ID NO: 50513 - DNA, 201 bp, Homo sapiens
cacatgtgcctgtctgtgtgcacgtgtgtgcctgtctatgtgcgtgtttgtgtgtgtattgctgtcttataaatcgtcacatcagccctgttaggagggcmcttggcttactttacaggtgaggaaactgactcaggtttgtcagttgcctaaggtccaattaataacacagggcaaagccggtttcaaatcaggtctatg

SEQ ID NO: 50514 - DNA, 201 bp, Homo sapiens
gtgaggaaactgactcaggtttgtcagttgcctaaggtccaattaataacacagggcaaagccggtttcaaatcaggtctatgcacctcagaagataacgygtcagactccagcaaatttagaaaggcttcttcaagggagagtgccaggacaggttgactttagtcagtcctgatgaaggtgagtagaaaaatgaggtta

SEQ ID NO: 50515 - DNA, 201 bp, Homo sapiens
gggagagtgccaggacaggttgactttagtcagtcctgatgaaggtgagtagaaaaatgaggttagaaaagaaggggctggtgcaccaggaagcaccacgmcctcctgatgcaaaagggtcatccctggagacctcagggctcctgctctgctccctttcagctcttcgtgcgagaacctgagaagaggctgggcgtgagg

SEQ ID NO: 50516 - DNA, 201 bp, Homo sapiens
gttgttctcaacatctgtcccaagctccagtgatgttccaaggacccaacaggccagcctcaagcactctaattacttgtgacagaaccacatctaatacrtgggttagtcatttgtgataaaataaaaattttaccttgtttttagctatcagaactattaaaccatgtctcaccttccactgcagattaaaattgactt

SEQ ID NO: 50517 - DNA, 201 bp, Homo sapiens
caagtcacagagaagcctagatgtggctacagttttaaggagcaaagtaaaactccatccctctatgttcaatcctagctgacaacctcacttggtgtcasggtgatgcataagaaaatggagctggggctaccgaagttgaaacctgacaccttctaaatagggcgaatgtgagttatgcgagttttgccgacaatgtgg

SEQ ID NO: 50518 - DNA, 201 bp, Homo sapiens
aaaaacagcacagaggggtttctttctccttccagtaggcttcccagcaaatcaaggatgactgcctgtagcacgccgctcctcacctagtctcaaaatastccagaaagttctccctacaccttattctatccagcacctgaaatgctgccagctaggatcttaggggacacagatcctcttaaaaatgcaagcactgct

SEQ ID NO: 50519 - DNA, 201 bp, Homo sapiens
atcaaggatgactgcctgtagcacgccgctcctcacctagtctcaaaatagtccagaaagttctccctacaccttattctatccagcacctgaaatgctgycagctaggatcttaggggacacagatcctcttaaaaatgcaagcactgctgagattcccttcacccattagggtggcttaggcagtaacaaagagaaaat

SEQ ID NO: 50520 - DNA, 201 bp, Homo sapiens
tttttattgtagtgaaaataaacaacataaaatttacaattttaaccactttaagtgtaaagtgcagtggcattaattagattcatgactgtttccagaaygttttcatgacccaagcagaagctctgtacccagtaagcagtaactctccatttccctctcctttcagtcccaggccacccccttctactctttgtctct

SEQ ID NO: 50521 - DNA, 201 bp, Homo sapiens
ccaggcttctcagcagtccgtgacttaggggaaaatgtaacaagtgtttgttcatctaccctgcatgtactggaagagataaaagttggaaaatagatcaraacgcacgtacactattatttttctcttcaaggctggcagaaaaagcagccttggagtgggctcatcagtgagcaagcccctgagctgggaggtggaggt

SEQ ID NO: 50522 - DNA, 201 bp, Homo sapiens
aaaaattaaaagtgaactaaagtctaccttcctctgtgtctcctttgaattctgaaaggccgatctgtattctgacatttaagtagtgttactatttcacrcctaagtagctctagatcctataggaacagctctgtctctgggtcgttccctcaggttggatttgagggcaggccgccgtggttttgcaggcctctgaag

SEQ ID NO: 50523 - DNA, 201 bp, Homo sapiens
agacttcaagatacctaaacacaaatccaactcacaacttatttaattggaaaattgttcattccatgtcctaaaccttagacccaagcaagaggggttcygcccagcccctcacttagaatcctccctttggcctttctcaaaccacactccttcctgtgaagccaagaggtcgtctctgttcctaaactactccccagg

SEQ ID NO: 50524 - DNA, 201 bp, Homo sapiens
tggtttactagccttcggagaaaaaagatacctcgaaaaaaatgactataattattcttttccttcttttcccatcttgtttttctggagagggagtctayaaatctgatcttatttgcatgatatttgccaagttctcagtgcatttacaaaattaactgttattagtctgataaaaatcatgagtttatttctttaatg

SEQ ID NO: 50525 - DNA, 201 bp, Homo sapiens
agacctgagaataggtgggaaggtgtgtggaatgcatgggagtggggctgaactgttgcctccagtcccctcccaccactttctccacatctaaattgacwgtgttaaattctgaaatgtcagcctttctaggaatttgtaagcatccaaacacttagaagaaaccgttcactcaagcactgttggaaatggtttcgctct

SEQ ID NO: 50526 - DNA, 201 bp, Homo sapiens
catctttaacttaattacatttggaaaaaaagaccctttttccaaataaggtcacatctacaaggttctgggggttctgacatgaacatacctggacatawcttctgggggccaccattccacccatacagctgatatcacagaccatgtgtgctctggatgtgcaggtctttgtcaagcatggcagtgggtactaaacat

SEQ ID NO: 50527 - DNA, 201 bp, Homo sapiens
cagctacctgggaggctgaggcaggagtagagtaagacaaagggtgaggaagtcagatgacattaaggcaattgtaagaaaagcaagtctgcataatattyggagtcactagcctacctcatcacatggctggaaataactttagatattatatttaaaatagaataattaatataagcagactgttgacagtctgcaggt

SEQ ID NO: 50528 - DNA, 201 bp, Homo sapiens
gtagaatggattgatgatgaatggatgaacagatgaaaagacacaagctgtacattcaaaaaatgtccaagtgaatgttattccaattaaaagtgcaagarctgaaaggaaaaaatatatcaccagacttaagtaggggagatggcaaacaaaaattcttctgtgaaggtagactttttagagtggaagaggctttgcaga

SEQ ID NO: 50529 - DNA, 201 bp, Homo sapiens
cgacatccaccaatcagcatctgatgattgttcactaaagttttaagtggacttcctaattcagggccacacctggcttacctgtcccccttctaggggaygcagtgcgggggccagtctcttcgatgccggtcctctcatcaccactcccagttcccctccactttgcactttagcctagactcaaccttgccaatagaa

SEQ ID NO: 50530 - DNA, 201 bp, Homo sapiens
tcttagagtattagaactaagaagaaccttaagattatattttattgacaataaaactgggcccaacccatgtgtttgaagccactttcaatgctttcacrtgattctcattggacgttacaggaccccatgagacaagcaaggcaagtgtcatggtccctgttccttggatgagtcttggaggctgccagaggggaaatg

SEQ ID NO: 50531 - DNA, 201 bp, Homo sapiens
gggtgagaagtatgaagacgctgaccacgtgccttccccaccacaagccaccagcactgccctctcgagctagatgagaggacagggtcaactttaaatcrgttttcaattattcatggcattgcacatgtaagttacagaaatgaatcttgagggagcaactgaaggacatgtctaatgtcaccggaaaggtcatgggac

SEQ ID NO: 50532 - DNA, 201 bp, Homo sapiens
gtgtgtatatcagagcaagacaccacactgccgtgagcaccaggctggctgactcattgttccctacatgcctgatgtctgctcctgctctagggcttttrctcattctctcctaccaggctgaaagggccaacacatctcataaacaaccccaaagccaacccaccccaggcctggctgcagcatcagcctcctgccttt

SEQ ID NO: 50533 - DNA, 201 bp, Homo sapiens
taaaataaggacaataatagtgctagcctcacaagccatatgagaagtgaataacgccatctatgcaaagcacttggaagagtacctaatgtggaataggyacccactaacatagtattattattttattgctgcatcccaacataaatcatttagagacctctttcataggaaaaataattctatctgattgatcacaaa

SEQ ID NO: 50534 - DNA, 201 bp, Homo sapiens
cgtttctgttcctagagaacgggcagatgtatatccagaaaaagcctaccatgtacccaccctgggacagcacttttgatgcccatatcaacaagggaagrgtcatgcagatcattgtgaaaggcaaaaacgtggacctcatctctgaaaccaccgtggagctctactcgctggctgagaggtgcaggaagaacaacggga

SEQ ID NO: 50535 - DNA, 201 bp, Homo sapiens
gtcagtgtgtggttttgggtgagtccagcagtgtcctctgcagaaggggaagtgaaaacatttgttcacatggatagtggacctatgtgaggttctggctrtccatgataaagcactggttaagtagacatggggcaccaaaaataatatcttttatagcccccaaacagcgtttgtcttttgtctttttccagggcgcaa

SEQ ID NO: 50536 - DNA, 201 bp, Homo sapiens; identical to SEQ ID NO: 9401

SEQ ID NO: 50537 - DNA, 201 bp, Homo sapiens
cagaattgtgaatctgtttctgtttagtgttctcttccagaggattgcattattcactgaatgtctgttgtctgaaatagaagttcccacagtagtttgtrtacgcatcatttaggaagataagtggtttttcctgttatgtatacaaataaccagtctgtgttaatgtctattatgggtgacatgaacagatccttctcg

SEQ ID NO: 50538 - DNA, 201 bp, Homo sapiens
attgaaagaaatgtctgatattgggatcattttcctaacacaatttccattttcattttctgtaaagcccccacaagagttgacagagttcctgaggtggsgatgagtgagccgtgcctctttctacagtggatgtagtggatgtggcttacagatgccttttacatttccagctgtagacagaaaatgccagaggccaca

SEQ ID NO: 50539 - DNA, 201 bp, Homo sapiens
gaatgaatgagtgaatggatgcatagtcactaaatcagaaatcgtggatactgtaatcatagaacattaggtcataaataccaaggatcctgaggaagaaraagaaagaatatctatgatttggacagccatttttccaattgtggaacattgtttagcatttcaaataatgaaaataaacacatatagaaggcttactat

SEQ ID NO: 50540 - DNA, 201 bp, Homo sapiens
atcccagaacttaaaataaaaataaaaattaaagaaaattacatacctatggcatttagttttctataccattcctttaagtcatagaatcagatgagctyaggggctagaaggaagagggagcgatgggaaggcagtcgttggtcatgccctgggcctagatcgcgggaatcagtcattcagaaagccccatatgttggg

SEQ ID NO: 50541 - DNA, 201 bp, Homo sapiens
ctgatcgtagaaatctatgtttcattcagtttggcacagatacaggttttgatgctataaaccattttcatttgaagtgaaaccaaagctcatcaaagcaygagtgatggggacttaagaggacggactcaactcaattactgaattcccctttgtaacaattctgaaatatgcccaaatgcactctgctcagaccaccct

SEQ ID NO: 50542 - DNA, 201 bp, Homo sapiens
ccgctccccccaccccacaacagtccccagagtgtgatgttccccttcctgtgtccatgtgttctcattgttcaattcccatctatgagtgagaacatgcrgtgtttggttttttgtccttgcgatagtttactgagaatgatgatttccagtttcatccatgtccctacaaaggacatgaactcatcatttttttatggc

SEQ ID NO: 50543 - DNA, 201 bp, Homo sapiens
gatgatggatgcaggcttgcagtaactatggaagccatcacagttcacttacacaaaagtgtttacggagagaccactgcaagagtgctgggaccagagcrtagagggaaaaaaagtcaaacaagtaagctgaaggaactcaggaagactgccttccctttagagcatctattcttgcagaagaaagtggcaataaacaaa

SEQ ID NO: 50544 - DNA, 201 bp, Homo sapiens
ttccagtttcatccatgtccctacaaaggacatgaactcatcatttttttatggctgcatagtattccatggtgtatatgtgccacattttcttaatccartctatcatttttggacatttgggttggttccaagtctttgctattgtgaatagtgccacaacaaacagatgtgtgcatgtgtctttatagcagcatgatt

SEQ ID NO: 50545 - DNA, 201 bp, Homo sapiens
ctctgtttatatgctggattacatttattgatttgcatatattgaaccagccttgcatcccagggatgaagcccatttgatcatggtggataagctttttratgtgctgctggattcggtttgccagtattttattgaggatttttgcatcaatgttcatcaaggatattggtctaaaattctcttttttggttgtgtctc

SEQ ID NO: 50546 - DNA, 201 bp, Homo sapiens
ggagtcactagcctacctcatcacatggctggaaataactttagatattatatttaaaatagaataattaatataagcagactgttgacagtctgcaggtrtgctggaacattttcctgactatacggagctcttgtgattttttttaaatagacactcccctaaaatgaacacgagtaacctcatttaaggatgggcatc

SEQ ID NO: 50547 - DNA, 201 bp, Homo sapiens
tttagacagaggcaaaaaccagatggccaagagaagaggcatttggtaaagaccacaaggcagccaaagggatgggcagcagaagccaggaggtagggtcrgtcacagtagcagagacacagggtcgtcctgccaccgcagtgtgggtgactcaaggagggctaagactagcaacttccagtaagttgctctcacttcccg

SEQ ID NO: 50548 - DNA, 201 bp, Homo sapiens
agggaaccatcctgatgggcagcagcccccagccgacggcaggccggggaatgaagccactggctgctctccttccctcaatgccgtctgctcagtctccyggagggtcagtgatgagggaaggagccccaacttccttgtttctccctgcgtcctaaataagtccggaacccaaagagactgagtgtgtccctggggcat

SEQ ID NO: 50549 - DNA, 201 bp, Homo sapiens
tgtaggcattgcctccatttagtgtctctgcaaacaccaactttgccatacgcagatcacggcctagataacaaaagtgaagatcatgaacttaatggctratttttcttctctttctttcttcccttaaactctgactaagaaatcaccatttgactgcagcaatttcgacaaagaattcttaaacgagaagccccggct

SEQ ID NO: 50550 - DNA, 201 bp, Homo sapiens
aaggggctggtgcaccaggaagcaccacgccctcctgatgcaaaagggtcatccctggagacctcagggctcctgctctgctccctttcagctcttcgtgmgagaacctgagaagaggctgggcgtgaggggagacatccgccagcaccctttgtttcgggagatcaactgggaggaacttgaacggaaggagattgaccc

SEQ ID NO: 50551 - DNA, 201 bp, Homo sapiens
tcactcctcagcctcattcctgttaatttcctgtctgccttttggttgtgcagatcttgctgggtcagaaatacaaccactctgtggactggtggtccttyggggttctcctttatgaaatgctgattggtcagtcgcctttccacgggcaggatgaggaggagctcttccactccatccgcatggacaatcccttttacc

SEQ ID NO: 50552 - DNA, 201 bp, Homo sapiens
tgtatggtcttttgcattttcaggctgctgttgcttttaccctggtggaagataatcactaaaaagtagtctctgtggattatctaatcaatatctcttcratttcagataaaattttatactcacttgggccttaattattgtgctaatatctctaggcttcccaaatccaggagaactgtgtctgtggatctttagaaa

SEQ ID NO: 50553 - DNA, 201 bp, Homo sapiens
taatattcacacattatctttctcttaaatgaaggaataatacatacttcccttcccttgtgtaagattttttgaagtaacttaacattacaaagcatgtytaatgaatattttaaataatggaactttcaaatatatattatgaacattttttaaaccttaacctagggtaaggtttccattcacctttcactggtttcg

SEQ ID NO: 50554 - DNA, 201 bp, Homo sapiens
tctactaaaatataaaaaattagctgggtgtggtggcacgtacctgtaatcccagctgctcaggaggctgaggcagggcaattgcctgaacccgggaggcrgaggttgcagtgagccgagatcgtgccactgcactccagcttggtgacagagtgagactctgactcaaaaaaaaaaaaattaagtgctaccttccctggc

SEQ ID NO: 50555 - DNA, 201 bp, Homo sapiens
acacctgactacatcgccccagaggtaggaatgcagtgacaggctgctcccacctcaccatgccctggccacatgccattgcttctttagcccctgaaaakcagaaggttttaaatatcttcattcaagatttgtacctgttttcttaagtatctcataaacgccaccatgcatgtgggtttctattattattttgtgggg

SEQ ID NO: 50556 - DNA, 201 bp, Homo sapiens
tggtcttgatggacgatgatgttgagtgcacgatggtagagaagagagttctttccttggcctgggagcatccgtttctgacgcacatgttttgtacattycagaccaaggtatggcttctgctccgacaaccctacctcccctctaacctgtctcagcatgataccttcaatggcgccctcattaggagacacgagtcat

SEQ ID NO: 50557 - DNA, 201 bp, Homo sapiens
aggccttaaagaaagatgtggtcttgatggacgatgatgttgagtgcacgatggtagagaagagagttctttccttggcctgggagcatccgtttctgacrcacatgttttgtacattccagaccaaggtatggcttctgctccgacaaccctacctcccctctaacctgtctcagcatgataccttcaatggcgccctca

SEQ ID NO: 50558 - DNA, 201 bp, Homo sapiens
ctgctataacaaaatctcacatactggctggcttaaacagcagaaattcatgttctcgcaggtctggaggatggaagttcaccatcaaggtgttgtctggsttgtttcttcccaggcccctctccatgctttgcaatggtcgccctctctccatgccttcatatcatcttcctcctgtgcatgtctgcatccaagtgttct

SEQ ID NO: 50559 - DNA, 201 bp, Homo sapiens
tccccagagtgtgatgttccccttcctatgtccatgtgttctcattgttcaattcccacctatgagtgagaacatgcagtgtttggttttttgttcttgcsatagtttactgagaatgatgatttccaatttcatccatgtccctacaaaggacatgaactcatcattttttatggctgcatagtattccatggtgtatat

SEQ ID NO: 50560 - DNA, 201 bp, Homo sapiens
tggctagccagttttcccagcaccatttattaaatagggaatcctttcctcattgcttgtttttctcaggtttgtcaaagatcagatagttgtagatatgyggccttatttctgagggctctgttctgttccattgatctatatctctgttttggtaccagtaccatgctgttttggttactgtagcctgtagtatagttt

SEQ ID NO: 50561 - DNA, 201 bp, Homo sapiens
cttgaaaatctaaagttggattgaagaagagaaatgacaacatctcccttttacttatccaagctgtgaatttaaaatacctttcgtttttgtttgtttgkgcctatcaactttgacccatagctcccagaataattttgatattttctgaataaattgacactagactttatacatcactcatgtctttatttagggtag

SEQ ID NO: 50562 - DNA, 201 bp, Homo sapiens
gcacaagacagggatgccctctctcaccactcctattcaacatagtgttggaagttctggccagggcaattaggcaggagaaggaaataaagggtattcarttaggaaaagaggaagttaaattgtccctgtttgcagacgacatgactgtatatctagaaaactccatcgtctcagcccaaaatctccttaagctggtaa

SEQ ID NO: 50563 - DNA, 201 bp, Homo sapiens
cagttagatatctctgagctcagttccccaccatcccacttactagctgtaggtcctcggacaattcacttgaactctttcttttgttgttgtgctagaayacgcgtaacacaaaatttaccatgtgaaccttttttttttctcgttttcctgagatggagttttgctatgtcccccaggctggagtgcagtggcacaatc

SEQ ID NO: 50564 - DNA, 201 bp, Homo sapiens
agtggtgagatctcagctcactgcaacctcctcctcccaggttcaaacgattctcctgcctcagccttctgagtagctgggattactggcacgtgccacawcacccagctaatttttgtatttttaggagagacacgattttgccatgttggccaggctggtctcaaactcccagcctcaagcgatccacccgcctcagcc

SEQ ID NO: 50565 - DNA, 201 bp, Homo sapiens
tcgaactcctcaccttgtgatctgcctgcctcagcctcccaaagtgctgggattgcaggcatgagccaccgtgcctggcctgaaccaatttgaagtgtacrgttcagggacatgagaacattcacagtattatgcaaccatcgccaccacgcatctccagaaccttttcatcatcccaaactgagactctgtccccatcaa

SEQ ID NO: 50566 - DNA, 201 bp, Homo sapiens
tcacacatttgtgagtgctcagtaattaatattatttttaactgaattggataatcttcttatttagcaagttagagattaactcccagagtcccagtatygtaaaaataaaaatgttacattcacattttcccgctatttttcccctatagattaaaaaaaaaaaaacagaaaggaaataatagcagactttgtcactca

SEQ ID NO: 50567 - DNA, 201 bp, Homo sapiens
gccaccgggcagcagcggcgccgtgctcgctccaggtagggccccgcgccccgcgccgccgccgggagggagcgggctggaggggccgagacccgtggcgrgaagggctacccaggcccctcggagagcctccgggaaggggtgagggctgccgggtgagcaggcggagtaggaaatggaaccaagcgggcgcaagagcgc

SEQ ID NO: 50568 - DNA, 201 bp, Homo sapiens
agcggcgccgtgctcgctccaggtagggccccgcgccccgcgccgccgccgggagggagcgggctggaggggccgagacccgtggcgagaagggctacccrggcccctcggagagcctccgggaaggggtgagggctgccgggtgagcaggcggagtaggaaatggaaccaagcgggcgcaagagcgcaccgggaagaatt

SEQ ID NO: 50569 - DNA, 201 bp, Homo sapiens
tcggagagcctccgggaaggggtgagggctgccgggtgagcaggcggagtaggaaatggaaccaagcgggcgcaagagcgcaccgggaagaatttccccgstgggtttctgggacgcaggtcgcacgggatgcgggatgctggcgaccttagccgggtgggggccgccggcctgggggcgcttcctcctttcttctccctt

SEQ ID NO: 50570 - DNA, 201 bp, Homo sapiens
tgttcatttccgctactgtcttgtgctgtggtgcctcgggatggcaactgttacttgaggagctaacttctacctctgttctcctacagacatgtcctcaytgcgtcttcgctcaccatacacggtgcagctcctggaaatttgatttgttttgctgtctcacttctccttcaggcaacaaggggatggtgttcgattatt

SEQ ID NO: 50571 - DNA, 201 bp, Homo sapiens
gtaggagcatgtgccgtggacacgttcccgccatggccgctcagcaaggatgtccatgcacttctgctgcttcacctgtggcagccctatgggaaatgccsggatgtatttctgagcaccggccttgcccttggctttcatatccatgcccacaccccctatctttgagatatttatttaatgcatttgtattatgcagat

SEQ ID NO: 50572 - DNA, 201 bp, Homo sapiens
gggccaggcaagatcaaggaggggcagcagagggcacttctgggcgagcagtacagtggcatcgcagaaggacaggtgggaggggaagggataggctgcakcagctgcctttgaaaacgccatcgagcaatagtattgcagccatttataccataatatttcctacagaggacctcgtttagtttccgagattgagcctct

SEQ ID NO: 50573 - DNA, 201 bp, Homo sapiens
gagaaaatggtgtttacttatttatttttttttattttgagacacagtctcactctgacgcccaggctggagtgcagtggcatgatctcagttcaccacarcctccgcctcccaggttcaagcaattccccacctcagcctcccgagtagctgggactacaggcacccaccaccatgcccggctaatttttgtattttttt

SEQ ID NO: 50574 - DNA, 201 bp, Homo sapiens
catgaaaaataatgaaaaactaacagttgttaattgggaggtaggattataactgattttatttttattatatctttctgtgtatgttactataaacacaytttagactgggcttctgggcacttaggcagttgtgcttctcttggtgccttttccccatttttttttttttttttgatttgcatgtatgacagttttcat

SEQ ID NO: 50575 - DNA, 201 bp, Homo sapiens
tcaaactcaaagtttgaggatggcccacctggaaacaccccaaaagaatgaagtcagagttgtaaaggagggaactttagggtttccatagggagagacasaggcatttttagcaggattacattttttcatacaaggctggtgcatagttccaggaacttggttacaggcagtgtttctttttgggaaagggacatttaa

SEQ ID NO: 50576 - DNA, 201 bp, Homo sapiens
ttatatttgtatttaccttttatgatgggattttggattcagcttttaaaaggcttatccatccctcaaaatgtgctcctcaaaatccaaacctctggacygtgtagtttgtatgtgcatacatttgtgctaattttatcacagagcagaacagatatttgacagatttattgtggagcctgcagttctcttgggagggtt

SEQ ID NO: 50577 - DNA, 201 bp, Homo sapiens
tttcatttctctgtgatttaaaactaactacttagtttcttaaggaaccatcccgattcatcaggcttctaactaacctgagcacagaagcaaatatgtamcctttggaaaggaagcagtgaaatggactgcagacctcaagggtggtccccagggatggagcttgtagctgaggcatcttatggaaagcctgatgtggag

SEQ ID NO: 50578 - DNA, 201 bp, Homo sapiens
tccacaaaccatcctttccaggatggatgtcaggtagtgggaattaagctcaaaactgtgactcacaaacagtttaacttccttcaggttgattttccccrttggtaaaattcccatgaatattctacataaccctttgattcttccaacatcgtttttcccaaacatctttcctgagagctcttcaaaagatggtaaagg

SEQ ID NO: 50579 - DNA, 201 bp, Homo sapiens
tcaaaaaaaatattaaagaactgaaactcaccagatcatggcatccagagactgaagcgccaggcccctggttcatcatgattgcttacttacccctcccragttcctgttttctcatacaaagttacatttcttccctgctatataaatccctagttttagttggtcatggagatggacttcagactgagctctcatctc

SEQ ID NO: 50580 - DNA, 201 bp, Homo sapiens
gcttagtttggctggatatgaaattgtgggttgaaaattcttttctttaagaatgttgaatattggtccccactgtcttctggcttgtagagtttctgccragagatcagctgttagtctgacgggcttccctttgtgggtaacccgacctttctctctggctgcccttaacattttttccttcatttcaactttggtgaa

SEQ ID NO: 50581 - DNA, 201 bp, Homo sapiens
aagggtgacagaagctgctgctggctttagaatgatgcctgaactcttcttctgaaaatgaatgtggttaatttagtcatgacagacacatttctgacttyttcctccctccttttttccccaacgccacctttccccatggtgttgtgtttttgcttttgtttttgtttttgttttcctctgtctggagactgaaagaga

SEQ ID NO: 50582 - DNA, 201 bp, Homo sapiens
ctgttacttgaggagctaacttctacctctgttctcctacagacatgtcctcattgcgtcttcgctcaccatacacggtgcagctcctggaaatttgattwgttttgctgtctcacttctccttcaggcaacaaggggatggtgttcgattattcacacctcagctccttctgtaatctcaaagatccctttcaacaataa

SEQ ID NO: 50583 - DNA, 201 bp, Homo sapiens
aaacagtgcagtgattcctcaaaaagttaaacagagttaccacatgatctagcaattccattcctgggtattctcaaaatagttgaaaatgaggactgagrtacttgtacactaaactccgtggcagcattattcaccatggccaaaaactagaaacagcccaaatgttcatcagcagaggaacaaacaaacaaaatgggg

SEQ ID NO: 50584 - DNA, 201 bp, Homo sapiens
acatgtcctcattgcgtcttcgctcaccatacacggtgcagctcctggaaatttgatttgttttgctgtctcacttctccttcaggcaacaaggggatggygttcgattattcacacctcagctccttctgtaatctcaaagatccctttcaacaataatactctctgtctcttgttaacgccaggcatcagaagccccct

SEQ ID NO: 50585 - DNA, 201 bp, Homo sapiens
accatacacggtgcagctcctggaaatttgatttgttttgctgtctcacttctccttcaggcaacaaggggatggtgttcgattattcacacctcagctcyttctgtaatctcaaagatccctttcaacaataatactctctgtctcttgttaacgccaggcatcagaagcccccttacatagccggcttgtcactggtca

SEQ ID NO: 50586 - DNA, 201 bp, Homo sapiens
tgctgtgcaccccagttcctaacaggccacggaccaccactggtccatggcctgggggctggaggacccctgctctaaagggtcaacataggtgaatttaraaaagtcagcatcctccaagttctcagaaacattctccgattcactgatgagtcgtgaaaatatagtgaggcagaatgttagggccaacagaaaggaaag

SEQ ID NO: 50587 - DNA, 201 bp, Homo sapiens
gggtcagtgatgagggaaggagccccaacttccttgtttctccctgcgtcctaaataagtccggaacccaaagagactgagtgtgtccctggggcatgcgygtgcctgtgtgtgtatatcagagcaagacaccacactgccgtgagcaccaggctggctgactcattgttccctacatgcctgatgtctgctcctgctcta

SEQ ID NO: 50588 - DNA, 201 bp, Homo sapiens
ttcacacctcagctccttctgtaatctcaaagatccctttcaacaataatactctctgtctcttgttaacgccaggcatcagaagcccccttacatagccrgcttgtcactggtcatttctataaagtattctcattctaacacatgctgtctcttccgtggaaaagactaaattcttctctgcaatgaattagatgtttt

SEQ ID NO: 50589 - DNA, 201 bp, Homo sapiens
gtaggtattgttttgtttctgggagggaaggtggtgcctccagcctctccttcctcttgcagctcgcaagcaaacacagatggaggagatgctctggctgyttttaattctgctttctctcccagggttcttacccagaaaacctattggaatttcaaattttcaaacctcaggaaagtgttgtgtcgggaagatgatttg

SEQ ID NO: 50590 - DNA, 201 bp, Homo sapiens
tgaacgaaagggggcctgcggggagggaagaaggtggaaagtttttgtattcttggtaaaaaaaaaaaaaaaaatgcgtgaggaaacatgttttctggagrtggtatcctgtccacaggggagcataaccccttttctgggaatgtattggagcacggacgggggtgccattgctcaggcttctaaacaagccaagtttct

SEQ ID NO: 50591 - DNA, 201 bp, Homo sapiens
cattttcaattattaaaaataaattcatcacgcctgtaatcccagtactttgggaggctgagatgggcagattgcctgagctcaggaattcaagaccagcmtgggcaacatggtaaaaccccatctctactaaaatacaaaaaattagctgggcgtggtggggcgcacctgtagtcccagctactccggagggtgaggcag

SEQ ID NO: 50592 - DNA, 201 bp, Homo sapiens
gactgggtccagaattttctttcaagagtatgggcttgtggtacaagtatgtaacttcggggattcagaagtagacctacacagacaaatctccttataamgtgttatttaattatggtatatttgcctttctggaaattaggaattagagttagtacttcctgtttttaatgcatttgattgatgtcttagagttgctga

SEQ ID NO: 50593 - DNA, 201 bp, Homo sapiens
tcaggaaagtgttgtgtcgggaagatgatttggggttgttttgtgctatcagctgtggggctgggacaggacactgaagcccagtaccccatttggatacygctcttcatcctatttttgcctgggagaagaacagggagaactggctggaggaagaggagaaggggagcggaagaagaagagatttttagagcataataa

SEQ ID NO: 50594 - DNA, 201 bp, Homo sapiens
atggcaatatattctaacatgtattgacttgtcactatcggccgtttgctgtgctaagcactatatgtagatgattgcttgggtgctttgagaacatgtaraagggaaccaagtcctgattcggaggttcaggaaaggctttcagaggacaaggtatcgcgggtgggaatggaagatgtatgggaattagccaaaaggaca

SEQ ID NO: 50595 - DNA, 201 bp, Homo sapiens
ttcactctgaagctgcagatgctgtgttatagggtgttaaagtctctacagtttctatcaatgctgttgcattcatgttttattgcttctgccaaaatacragtatttcaaggatgaagttcatgttctcccaccagctcttgtctaaaatccatgctcaatgagtatttactgtatgcaggttattactgaagagaggac

SEQ ID NO: 50596 - DNA, 201 bp, Homo sapiens
ttaattatggtatatttgcctttctggaaattaggaattagagttagtacttcctgtttttaatgcatttgattgatgtcttagagttgctgattatgttkttgcccctaaaaatgttgctaatgtgctggtttgttaacaaggttatatttgatttcaggtgatttcctttttatggagttcagtctttaatttttttca

SEQ ID NO: 50597 - DNA, 201 bp, Homo sapiens
ttccatttatggatataccacattttgcttatccttgtatctgttgatggttgcttctatcttttgattattgtgaataatgctgccgtgaagaggaacaygcagatatctgtttgaggtcctgctttcaattctttggggtatgtacccagcagtagaattgtggggtcgtagggtaattctatgtttaattttttgagg

SEQ ID NO: 50598 - DNA, 201 bp, Homo sapiens
ttgaaccttggttctccttcccccaggttttatgctgctgaaatcattcttggtctgcagttccttcattccaaaggaatagtctacaggtaaattttgckttgtggaaacaaatgctaagatatcggctttcctggctcagttaatttaatcattgcaccgagtgctgtgagacagcccatgtgatttcctgggagtaag

SEQ ID NO: 50599 - DNA, 201 bp, Homo sapiens
gtaattttttttggtctatctacaaaatcatagattaagaatctgttttataattttttaatcttcaggaaattgagaaatactcaccagaatattatttwaaaactcttagcagaatttttttaaatttttctttatatgtgtaaggcctgcaatgtatctaaaatatttttgtacctaggcactgactaaattgtgtgg

SEQ ID NO: 50600 - DNA, 201 bp, Homo sapiens
aggcggaggttgcagtgagctgagatcacaccattgcactccagcctgggcaacagagcaacagtccatctcaaaaaatttaaaaagttaaaaaaaaaaarggggaagtaggaataaaaattaggagggactggagagagagagagacagagatcttagactggaagggaccccgtgaaacctaaacccacatgcctcggg

SEQ ID NO: 50601 - DNA, 201 bp, Homo sapiens
aagcagaaaaacacctgaaggttttagtttacaataaactcaatattgggcattactgtgatgaaactatgaaaaatatggtgcaggatcttagtccaccrtggcaaaaggcaagaggatggtaatggagctctgggtgccgctgtaacctgcaccaatcagattgtctctctggaggattctggcttcattctgagccaa

SEQ ID NO: 50602 - DNA, 201 bp, Homo sapiens
aggcaagaggatggtaatggagctctgggtgccgctgtaacctgcaccaatcagattgtctctctggaggattctggcttcattctgagccaagtcagtcragaagaaaacggacaaattcaagatatttggaaggtagaggccagaatgtttgcccttcatccagtttcccccagtggccacatctcatgcagctgtggt

SEQ ID NO: 50603 - DNA, 201 bp, Homo sapiens
ttgtttgataaagactctggcagacctctgatttcctgggtaaaattattcagcagcaagttcctgtcattgccaaaggagttgtggccatctgagtcctrgaactatgtagctttgccctgtggttgggtgatatgtaatttgaatttagccttggcttctattccatgaggaatgatgtcttttagcttacatggcatt

SEQ ID NO: 50604 - DNA, 201 bp, Homo sapiens
tcaatttctttcctcttcaccttgcaacaccttggtgtggctgccttactctgatgtattcctgtctacagattttgggtgccgggtcttttccacggcawaccttccttcccgatttccatctgcttcttgcagaatccggcttccacagcttgcttctctctgcagcttcactcccttcttttcttttacgtgtgcttg

SEQ ID NO: 50605 - DNA, 201 bp, Homo sapiens
aaaactaggaattatacaaatttcccctttctttcttacccttcaaatccacccaaacaccaacaccttctataattggaccctctcatgtccattcactsccctaaacttgtgactgaattcagactctcccttgattccttctccaagctcaaacaaatccccttgatccagctccgcccagatctccaggtcctctcg

SEQ ID NO: 50606 - DNA, 201 bp, Homo sapiens
ttccagcatgtggcatgaatgtgcatcatagatgccagacaaaggtggccaacctttgtggcataaaccagaagctaatggctgaagcgctggccatgatwgagagcactcaacaggtaggagcatgtgccgtggacacgttcccgccatggccgctcagcaaggatgtccatgcacttctgctgcttcacctgtggcagc

SEQ ID NO: 50607 - DNA, 201 bp, Homo sapiens
gggttcttcttttctttctgtggcttgagaactcatttttcattgctcagtaatattccattgacaactaatgatttgttatgttcttttgttttccttawaatgacagactccatggatcaagaattttagagtagggaggggtggtagaggttatcaagtcagatcccctcattttgcagcaaaggaaatggagctcca

SEQ ID NO: 50608 - DNA, 201 bp, Homo sapiens
tttgggaagagcaggggactgtaatcgggatctgtccgctttgatggatctcaggtgcgtctaaagaggcgcggcgaggggagacttcaaaagaccaagasgggaggtggacacgggctgttttgaaacagcgctcagtgcaggaggtggccttggcgcatggctggagacaggcgtgtcaggccggcagcttgtctggaa

SEQ ID NO: 50609 - DNA, 201 bp, Homo sapiens
taatgcaacttaatgcttttcttccctgtgtgataaataataacaatgtatgtgataaagttaatacataaggagttcttgctatatgccaggcacagggytaaatactttatatgaattctttcatttaattttaaatatgaacgatagctcccctttcttcttcagagcagaattcccaactctttccatcggctgtcc

SEQ ID NO: 50610 - DNA, 201 bp, Homo sapiens
attttcatagcaccatttggtactgaaaaaaaaatgtattaatacatatgtggatttaacatcatgggtaacatttctatggaaaaaatgtatattccctsacctaaacaaataacttattagtaaagttataaatttttgctgtttcttaaattgggaatctcccattatgaggattggaggattcttggaaacaggaac

SEQ ID NO: 50611 - DNA, 201 bp, Homo sapiens
tatcccagcttgagcatatacacctttttctagtgtagaattaatggaggaaatacaactcacacagcacctgagggactagggaagccatggaaaggacwgtccctaaaacataaacagaatgtcccggtaggtagggttatctccacctccatgaggaaccttatgattcagaaatgagtagttgttgagaataaagtg

SEQ ID NO: 50612 - DNA, 201 bp, Homo sapiens
gcttagatacccacaatactttccacatatggaactcctgataagttggtattaggtgaaagagagacttgttaaattaccaaatgttatcaaaactgggsatccgaatggtgccaggtgatacctgggaccaggtgaacagagaggtcttgtagtggaaagaaactagtgtcagagtcagcagaagtgagccaggttact

SEQ ID NO: 50613 - DNA, 201 bp, Homo sapiens
aactaatatccagtatactgaaagatagcattttactccaaattttttcccactgacagatttttatctttgtaatgagtttatatatatatatatatatmtatatatatagatagatatatgtttctatttaacttttaagtatattctgtaaatatctttgtttcaataagtaataagccactggttataaaatattcc

SEQ ID NO: 50614 - DNA, 201 bp, Homo sapiens
gtcctgaaagtaagcagaaatgttgttgttcttgtcgttttgagagaagttcatctcagctgtgttcagcatttttagggcataagcttcaacattttccrttctgttttcactgatatgttttagctatacaaaagcaggccttctacacagtttttcaaactccaagacacagtctactagtgggcaatgacattaatt

SEQ ID NO: 50615 - DNA, 201 bp, Homo sapiens
atccagtatactgaaagatagcattttactccaaattttttcccactgacagatttttatctttgtaatgagtttatatatatatatatatatctatatakatagatagatatatgtttctatttaacttttaagtatattctgtaaatatctttgtttcaataagtaataagccactggttataaaatattccattatag

SEQ ID NO: 50616 - DNA, 201 bp, Homo sapiens
aaagatctagaaccagaaataccgtttgactcagcactcctgttactgggcatatatccaaaggaatataaaccattctgttataaagatacatgcacacstatgttcattacagcactattcacaatagcaaagacatggcatcaacccaaatgcccaccaatggtagtctggattaagaaaatgtacatacacaccata

SEQ ID NO: 50617 - DNA, 201 bp, Homo sapiens
catagaatactatgtagccataaaaaggaatgagatccctgtcctttgcagggacatggatagagctggaagccatcatcctcagcaaactaacacaggakcagaaaactggacaccttatgttctcacttataagtgggagctgaataatgagaacatgtggacacagggaggggaacaacacacactggggcctgtcgg

SEQ ID NO: 50618 - DNA, 201 bp, Homo sapiens
ggagtcgaaagacaatagctaagtaaataacacacaaataaggtaaagtcaggcacctcaaatacagtgacttgaccactacacattctgtgtacgtaacraaataccacatgtgccccataaatatgcaaaatatgatgtatcaataaaaacaaacacacacaaaactcaaagaacaataaaacaaagacggtgaagagg

SEQ ID NO: 50619 - DNA, 201 bp, Homo sapiens
agctggaagccatcatcctcagcaaactaacacaggatcagaaaactggacaccttatgttctcacttataagtgggagctgaataatgagaacatgtggrcacagggaggggaacaacacacactggggcctgtcgggaggtgggattggagggagggagagcgttaggaaaagtagctaatgcatgtggggcttaatac

SEQ ID NO: 50620 - DNA, 201 bp, Homo sapiens
cccaaagtgctgggattacaggtgtgagccaccccacctatcaagggaagatattttcttaaggggagtatgtaataacaaccatgtccctggtttgttargaaggttataaactttgaaatatacccatcagtttcataaagagcaagacaggttaggaagaaatagtgttcattatacagactagagagctttcagctt

SEQ ID NO: 50621 - DNA, 201 bp, Homo sapiens
taacatgtcagggctttttctgggcgtttaaaatacaggggagaagagaaggagaaaggtactgaccctcgtcaagcctatgcctacttttttttggagtmgaaagacaatagctaagtaaataacacacaaataaggtaaagtcaggcacctcaaatacagtgacttgaccactacacattctgtgtacgtaacaaaata

SEQ ID NO: 50622 - DNA, 201 bp, Homo sapiens
ttacctaattttagagtttctgtggattctaaaccccaaacaactgcagccaagtttttacgacacttgcatttgtaagctggcgacgtttctgactgcarctggatgtgagcaattcacattgccctaaacgcatgcatctgcccagatagacccagctctttctttctgcactttctttctcttcccccggtgcccttc

SEQ ID NO: 50623 - DNA, 201 bp, Homo sapiens
ttctgactgcaactggatgtgagcaattcacattgccctaaacgcatgcatctgcccagatagacccagctctttctttctgcactttctttctcttcccycggtgcccttccctagtccaccctgtccctctatttgcaacaaccccccctgtgactgtgatagcccagtcccccgttgccgggcagagccggcacatgc

SEQ ID NO: 50624 - DNA, 201 bp, Homo sapiens
aggtgggcggatcacgaggtcaggagattgagaccatcctggctaatgcagtgaaaccccgtctctactaaaaatacaaaaaaattagccaggaatggtgrtgtgtgcctgtagtcccaactactcgggaggctgaggcaggagaactgcgtgaacctgggaggtggagcttgcagtgaaccaagatcacgccactgcagt

SEQ ID NO: 50625 - DNA, 201 bp, Homo sapiens
ccttgtaggagaaaagactggagagaggccactgaatctcgttgtgtcattcaccctacctagtcctgctctgccagggtcatgctcaccttccagacccmcccaacagtgaagtcggactgaaaaatcccagaagtgggaattgggagacaaggttgagtgcattagggggatgtctaggattccccctgattcgaatat

SEQ ID NO: 50626 - DNA, 201 bp, Homo sapiens
ttctccctcctcagtgccttagagaaatgttagcctctcttgtgtgattctaagtcgatgctgccctgcagggtctttatgagtgttccgctgctgtctcwcctacaaacgtgtctgtaagcaccttcagggaggggactctgtggcctggggaaggccgactaggtgaggcagagaattaaaacacaggaacacacaact

SEQ ID NO: 50627 - DNA, 201 bp, Homo sapiens
acttcccagcttctgaggctgaaggagaacagatgaggcttgctctggcgtcgttcggtgaaaccactgttcctctctcgctgctttcccgggtttccttrtgcattttgagctgtgcatctgattctttgggtcaaagcaaggactgaaaaagagcagaacacaagaagagatcacaatgaggcaaggtcccggggctga

SEQ ID NO: 50628 - DNA, 201 bp, Homo sapiens
gagggagcactccgtgccctcttcctgtccatgggaaatgaaccatctgtgcctggtgtccaagtccttgacgttccagttgccctttgagagcacacctyaagcctgctgaattcttttaagaaccacctacaagatctgagaagtccgcccatgctttctgtcaactccggcctctttgaccttttcttttgccaaaga

SEQ ID NO: 50629 - DNA, 201 bp, Homo sapiens
aagccagaagtagagcctgtgacgttttacatggccagaaaaactcttgtgctgctgttgatattgttcttctgtttgtttagcaagtctgccttagagaracttcacagcacccctgggcctcacttagcactgatctgtctcccaggagtgggccccggggtggtggagggtcagggatggggttgccgtgcacatcag

SEQ ID NO: 50630 - DNA, 201 bp, Homo sapiens
ccaacaaaaaaataccttctgcgtgcgtgtgtgtgtgtgtgtatttatgtgtgtctgttcacagatgcacccagctaagcccaaacacattacaaggtagwacagatgttcatccccaagagagtctgactgtcttgcttttaagtttagtgcctcaatcctattattccttctccattttgttttggctaataaagcaac

SEQ ID NO: 50631 - DNA, 201 bp, Homo sapiens
taaagcaacttgcccgcaactcatccttggagcagcagtcatgaattaacgaagattttttttccctcttttccattaaaaaaaattttatgtgccactaytatgtcctagggttttgtttttaattgtgggaaaatacacgtaacatgaaatttaccatctgaactatttttgtgtacagttcagtaatgttaaaaatag

SEQ ID NO: 50632 - DNA, 201 bp, Homo sapiens
agaaggttttcatcttgaaaaaccaaaactctgtccccattaaataccagctccctattccccctccccacagctcctggcagccactattccacttcctktctctagaatttaactattaggttggtgcagaagtagttacggtttttgtcactgaaagtaagggcaaaaacttctgttaatacttaaggtaccttatgt

SEQ ID NO: 50633 - DNA, 201 bp, Homo sapiens
caaaactctgtccccattaaataccagctccctattccccctccccacagctcctggcagccactattccacttcctgtctctagaatttaactattaggytggtgcagaagtagttacggtttttgtcactgaaagtaagggcaaaaacttctgttaatacttaaggtaccttatgtaagtggaatcattcagtatttgt

SEQ ID NO: 50634 - DNA, 201 bp, Homo sapiens
tggcttacttcacttagcataatgttatcaaggttcactcacgtagcatgtgacaggtttcccttcaccttgaaggctgaataatattcctctgtgtggakgtaccacattttcttcaacgccttccctatccctcctccctaccctctgcccagaccctggcgactgccactctcagcttctatgagttcaacgtgttta

SEQ ID NO: 50635 - DNA, 201 bp, Homo sapiens
cctcacttcccttccagcacgaggatcactaccagggagagccagggtcaacttcctcccagccgtggcactttaggctttcctccctatccgcaaggctstgtcttacctccagagagagttgtttagcaccagggggttcttccactcttgctcactatctgccttcttccttccagcatgtggcatgaatgtgcatca

SEQ ID NO: 50636 - DNA, 201 bp, Homo sapiens
cacctcctacctcacttcccttccagcacgaggatcactaccagggagagccagggtcaacttcctcccagccgtggcactttaggctttcctccctatcygcaaggctctgtcttacctccagagagagttgtttagcaccagggggttcttccactcttgctcactatctgccttcttccttccagcatgtggcatgaa

SEQ ID NO: 50637 - DNA, 201 bp, Homo sapiens
tccagtgggggatgagcatggcccgacgtggaccccctaggggatggagcaaggctttctggggaactggagggaggatgtagggggtaccacttccacayccagcccagacaagtcatgatcataagtatggtcttctggggcaataagccactatgttcctttccttgcaccctgcaacacccccacccacacatccca

SEQ ID NO: 50638 - DNA, 201 bp, Homo sapiens
tggctggaaataactttagatattatatttaaaatagaataattaatataagcagactgttgacagtctgcaggtgtgctggaacattttcctgactatayggagctcttgtgattttttttaaatagacactcccctaaaatgaacacgagtaacctcatttaaggatgggcatctatcttcagatgtgtccattcaggt

SEQ ID NO: 50639 - DNA, 201 bp, Homo sapiens
ttggtgctgatgttgatgccaacattgaaataaatcagcgtgtgctttattacaggggcctgaacaaacagggctaccagtgccgacgtaagtaagagggktttggttgcattaccatcattctttttatttagttattccttaggctatgaaaatcttaagctgtgatttttttcttcttttcagaatgcaatgcagcaa

SEQ ID NO: 50640 - DNA, 201 bp, Homo sapiens
tttgtttcttaagttgaactatttcccagtctattgaagaaagagacatagtccacactccaaaatccaaatgccaggctcacagacagggggtgctgccytcacagacagatggaaaggtattaaagctgcctgaactgtaggaaaccctctaaacacccccaattactatgatggagcctcagcatgggaagtagaaga

SEQ ID NO: 50641 - DNA, 201 bp, Homo sapiens
tgatgccttgcctttcagcagaatcgactctgtccagcacatggtagctgatattcaggaattctttttgttcagttccacaataatatgaaccacagtargctcatttggtgctaatctgagcataataggcaatgttacagccagtcttcattgtaatttagcagcaattaatgtgcaattataacctgttaccaaaaa

SEQ ID NO: 50642 - DNA, 201 bp, Homo sapiens
tgtccagcacatggtagctgatattcaggaattctttttgttcagttccacaataatatgaaccacagtaggctcatttggtgctaatctgagcataatargcaatgttacagccagtcttcattgtaatttagcagcaattaatgtgcaattataacctgttaccaaaaattgaaagcacattatatagatggaaattgt

SEQ ID NO: 50643 - DNA, 201 bp, Homo sapiens
gggtgtggtgtcacagcagcataggaggacaggagtgtttttgctactggtgtacccaagggcgacagctcactttgccatttcttgctctgactctgacrccaagttcatgggaaccagccatgtctctattcatgggatcaaaggttaagaaagtggagcccaggctctcgaaggctccttctctgaccgcgccctagg

SEQ ID NO: 50644 - DNA, 201 bp, Homo sapiens
atgtttcattcccattttggtgtcctttgatacgagagccacgaaatcaagtgggaaagtaaacttcggagttaaatctttccctagtagctcgaagaatytgagcaagttatcctttgaacccagtgtcagtcacattttaggacctactacatgccatacattctgctatgaataattcattgctgtgttgtcagagaa

SEQ ID NO: 50645 - DNA, 201 bp, Homo sapiens
gatgccagggaggctgagttcctcccaactttatctgatgaagttagcttctttctagactttgtccatagaaatcctcattgatcccaatcagccacttmtaaaggcatgaatggcagaagcttggagggaattgcacaggcttatgacatgctgagaaaattacccagataggcacaggcgccctgacatccagaagag

SEQ ID NO: 50646 - DNA, 201 bp, Homo sapiens
tcggagttaaatctttccctagtagctcgaagaatctgagcaagttatcctttgaacccagtgtcagtcacattttaggacctactacatgccatacattytgctatgaataattcattgctgtgttgtcagagaaaatggtgtttacttatttatttttttttattttgagacacagtctcactctgacgcccaggctgg

SEQ ID NO: 50647 - DNA, 201 bp, Homo sapiens
ttgctgtgttgtcagagaaaatggtgtttacttatttatttttttttattttgagacacagtctcactctgacgcccaggctggagtgcagtggcatgatytcagttcaccacaacctccgcctcccaggttcaagcaattccccacctcagcctcccgagtagctgggactacaggcacccaccaccatgcccggctaat

SEQ ID NO: 50648 - DNA, 201 bp, Homo sapiens
taggcttgagccaccgcacctggccggtgtttattttttaagtacacaaggagaactatatccctccattcttcttttggcctggaaaaactgggtaaaaygtaaagctaggatttatgtgcacttgcagtgatgtttcgagtacagtttctcctctccacactcaactcttctttcttcactgtgcactttatctctctg

SEQ ID NO: 50649 - DNA, 201 bp, Homo sapiens
catcccggctgtccaccacccgcactaattagcagcctcaagtgggaccatatgactaagggccaaagaacacaaggggcggaggcttttccattttctgktttctttctttttgtttgtttgttttgtttgtttgttttgagacggagtctcactctgtcgcccaggctggagtgcaatggtgtgatctcagctcactgc

SEQ ID NO: 50650 - DNA, 201 bp, Homo sapiens
taaaataaatgcaatttctttcaccaaaaaaaaggcgaacattgctaagcataaatgagcacttccttttagaaatgaataaagtaaaactcaaccattakcaacttcccatagctagagctcgcagaggaaaatgttaacacatagcatcatgtttgaattttattattttcatagagaagaaaaccagcaagcaaaccc

SEQ ID NO: 50651 - DNA, 201 bp, Homo sapiens
gtccatatctaaaggtgagttttaggggatctgactgagaagtgttccgggccagctccctagaaacccttgggtgcactgacttcttcctggccagtgtygtctgcttggtcatcagtgtgttcctcccctcctgagttctctccatctttctgttcttctgttttcttgcagtaatcgaggacaggtggtcgctggcac

SEQ ID NO: 50652 - DNA, 201 bp, Homo sapiens
ccacccgcactaattagcagcctcaagtgggaccatatgactaagggccaaagaacacaaggggcggaggcttttccattttctgttttctttctttttgkttgtttgttttgtttgtttgttttgagacggagtctcactctgtcgcccaggctggagtgcaatggtgtgatctcagctcactgcaacctccgcctcccg

SEQ ID NO: 50653 - DNA, 201 bp, Homo sapiens
gcagctaggaggttgagattcccccaccccgtcttcctccatatgtggccccaaagtaggaagttcctgctgctttggtctttgggtgaaaaacaggtcaygggccaggcaagatcaaggaggggcagcagagggcacttctgggcgagcagtacagtggcatcgcagaaggacaggtgggaggggaagggataggctgca

SEQ ID NO: 50654 - DNA, 201 bp, Homo sapiens
agacagaggttgcagtgagccgagattgccccattgcactccagcctgggtgacagagcaagagtctgtcttagaaaaaaaaaaaaaaaaagaagcccctyagttcctgtctgaggctcacctcccctggggccctggaatccatttctttcttgttcttgggaatctcaatctcttatcttccctgtcacctgcattttc

SEQ ID NO: 50655 - DNA, 201 bp, Homo sapiens
gaaagaatatctatgatttggacagccatttttccaattgtggaacattgtttagcatttcaaataatgaaaataaacacatatagaaggcttactatgtkctgggcattgttctgttttatacatattaactcgtttaatctgtgcaatgcacgtaggagtttatggagtttcctcataccttatctcattcagttccca

SEQ ID NO: 50656 - DNA, 201 bp, Homo sapiens
tgagccacaagtgcatccacagcattggtgctgggagagaaaaaaaaacttcagcagagaatgtttacatgaaatgtaaatctgactggctcaagactcakatctcaaggaactgagtccttttagaaagaggaaagaaacaaaggaagaagcttgaatcaccttttccaacaccccgagttgttgtttttgagatgtctt

SEQ ID NO: 50657 - DNA, 201 bp, Homo sapiens
cagcattattttgaactgacaatgttgtaaattttaaactatattttaagtaaaccttaaaagcttattttagaatcctaatctgctttttcagacttttrttcacctcagatctccaactccctttactttttgcttgaactctcctcccttcttcctgctttcctcaactctttcatgctgtgtttaataacatgctaa

SEQ ID NO: 50658 - DNA, 201 bp, Homo sapiens
taaaaagtatttttagtagaggcagggtttagccatgttgatcaggctggtcttgaactcctgacctcaggtgatccgcctgtcttggcctcccaaaattytgggattacaggcatgagccaccatgcccagcttttttttaaatttccattacttttaatggcaaaaactgcaaattactttcacaccaaattaatagga

SEQ ID NO: 50659 - DNA, 201 bp, Homo sapiens
aagttcaaaaagatacccttattcaaggaaacatttctttttttcttgtttctttttttttttttttttttttttttttgagacagggtctcactctggtkgtccaggctggagtacagcacaatctcagctcaatgtaggctgcacctcccaggctcaggtgatcctcccacctcagcctcctgagtagctaggattaca

SEQ ID NO: 50660 - DNA, 201 bp, Homo sapiens
taaaagctgatggaaagcctaacccctttttaaacagtatttctatgactggctgaactccgtggtggatggcaaggctgtgtcctacatcagtgagagcmtgcccgctgcagccaggaggcacctcacagagactggaagcacagagggaggtgggccagctggggcccgaggatccagacttggtgagactcacagacc

SEQ ID NO: 50661 - DNA, 201 bp, Homo sapiens
ttgtttctttttttttttttttttttttttttttgagacagggtctcactctggttgtccaggctggagtacagcacaatctcagctcaatgtaggctgcmcctcccaggctcaggtgatcctcccacctcagcctcctgagtagctaggattacaggtgcacaccaccacacccagctaactttttgtatttttagtaga

SEQ ID NO: 50662 - DNA, 201 bp, Homo sapiens
ttttaaacagtatttctatgactggctgaactccgtggtggatggcaaggctgtgtcctacatcagtgagagcctgcccgctgcagccaggaggcacctcwcagagactggaagcacagagggaggtgggccagctggggcccgaggatccagacttggtgagactcacagaccttggcccactaccctcctccctcctcc

SEQ ID NO: 50663 - DNA, 201 bp, Homo sapiens
gctaactttttgtatttttagtagagacacagtttcgctgtgttgcccaggctagcctcaaacccttggactcaagcaatctgcctgtcttggcctcccaragtgctgggattacaggtatgagcacccagcctcaaggaagaattttttagtcagcaatttgaaaagaataaattttttttttttttttgaaatggagtc

SEQ ID NO: 50664 - DNA, 201 bp, Homo sapiens
gttgcccaggctagcctcaaacccttggactcaagcaatctgcctgtcttggcctcccagagtgctgggattacaggtatgagcacccagcctcaaggaaraattttttagtcagcaatttgaaaagaataaattttttttttttttttgaaatggagtctccctctgtcgcccaggctggagtgcagtggtgcaatctcg

SEQ ID NO: 50665 - DNA, 201 bp, Homo sapiens
tttttgtatttttagtgaagatggggtttcactgtgttagccaggatggtcttgatgtcctgacctcgtgatccacccgcctcggcctcccaaagcgctgkgattacagacatgagacaccgcgcctggcctcaaaagaataatttttaaaatttcaagaaacctatactttgttttggcttggtttctaaaatagaaaat

SEQ ID NO: 50666 - DNA, 201 bp, Homo sapiens
agatgctcagaaagaggaaataaaatgttacagatgtctttgttcgtctgtagtgagctcagcgaggccatgaatttttaaatctagcacagggaaacgtrctacgaagagtctgtgatgcatgcattttcattcatgcattttaatctctatatgtttggaaaatacaaggatgataaatcagccagttctcatttattt

SEQ ID NO: 50667 - DNA, 201 bp, Homo sapiens
ctgtcccatattgtctctgattgtttatgtgctacttttgtcttcccaacagaattctatatcccagagaacagagggagcaggtgctactgttgagttgractgaattattttccaggcctggctgaaggaataatgagaccttacgtttctgttcctagagaacgggcagatgtatatccagaaaaagcctaccatgta

SEQ ID NO: 50668 - DNA, 201 bp, Homo sapiens
aaggcaaaaacgtggacctcatctctgaaaccaccgtggagctctactcgctggctgagaggtgcaggaagaacaacgggaagacagaaatatgggtaacrttgcataaagtgtatgcacataagggataagcatgatggtagccgatgactggctcagaactcccatgtcaatctgagggtgtgattacactggcctcgg

SEQ ID NO: 50669 - DNA, 201 bp, Homo sapiens
ccagggcattgttattttttaaaggaagttattcatctgctctctgcctccaaagagcgcacctgttgaataccagattattcaggagattctgaggacakgtattcacttgttattaattagggtcatttggattaaattgttaaagtttttaaagttcctagatgagggatatatcacctatggaagggtgaaaatatg

SEQ ID NO: 50670 - DNA, 201 bp, Homo sapiens
tcacctatggaagggtgaaaatatgataaagccatttaggaagctacaaaatgtgaaaattcctgtggacttggattccgaagttcaagcccagctctgcygtttatcaacagggctctgaggcacccactttacccctgcccaggacagagagtaagagttacaggcagaggggctgggagctgtaaaaccaggggccct

SEQ ID NO: 50671 - DNA, 201 bp, Homo sapiens
ggaaaataggacaaaaaaaggaaaaggtaatctttaacaagattcattaattaaaaaggcaggaggcggccaggcacggtggctcacacctgtaatcccarcactttggaggctgaagcgggtggatcaccttggggtcaggagtttgagaccagcctggccaacatggcgaaactctgtctccactaaaaatacaaaaat

SEQ ID NO: 50672 - DNA, 201 bp, Homo sapiens
ttccttggcactccttcctcacccccatggggggctggcttcacatggcagcctttcagaacctttcccatattgacctagatccctcagagctggccagkcgcagtggctcacgcctataatcccagcattttgagtctgaggcagaaggattgcttaatgtcaggagttcatgaccagccttggcaacatagtgagacc

SEQ ID NO: 50673 - DNA, 201 bp, Homo sapiens
gtccccatctgagctattaattctatagattctggaaggagaaaaatgaaagtgaaaagtaggtaagaagaaagcatggcagacatgcgcttggaatacgrctgaagacggtagatgtggcaggtggtaggatgctgtggaaagggactgaaatctgaggcctgagtttgaattcaggccctccaagcactttgtaaccat

SEQ ID NO: 50674 - DNA, 201 bp, Homo sapiens
tgctttttttttgtttgtttttttctgagatggagtctcgctctgtcgcccagcctggagtgcagtggtgcgatctcggctcactgcaagctctgcctccygggttcacgccattctcctgcctcagcttcccaagtagctgggactacaggcgcccaccaccatgcctggctaattttttgtatatttagtagagatggg

SEQ ID NO: 50675 - DNA, 201 bp, Homo sapiens
actacaggcgcccaccaccatgcctggctaattttttgtatatttagtagagatggggtttcaccgtgttagccaggatagtctcaatctcctgaccttgkgatacacccacctcggcctcccagagtgctgggattacgggcgtgagccaccgcgcccggcccctacacgcccactttttaagctcacagatctgttctc

SEQ ID NO: 50676 - DNA, 201 bp, Homo sapiens
gtaaataatacattccttgataccaagatgcatgtttcgctcttttcttttgtttcatttgcccgtagagtgctagataatgttcaggggctgggcacagkggggagcggaagagaaaaagaaagataaatggtctgactgtagatcatactggctaactcaggtgccaggaaggctggtcccgaatagaactgcagagga

SEQ ID NO: 50677 - DNA, 201 bp, Homo sapiens
ctttcttctgtgcacattgtgaaaaagtttttttttatgtttcttttaacagcagtcacttttacctaagaaatctttctatctcataaagaaatgcaaamgctattggtgtagcttaatttgccaaaatttttctgaattgatgtttaccaaatttggctgagcagatgtaattggaaaccattgaatgctttgtttctc

SEQ ID NO: 50678 - DNA, 201 bp, Homo sapiens
tcaggctcccaaaatgctgggattataggcatgagccaccgcgcttggcctctgccttgatccttgatggcaaaatcgttcttctccatctccttgtctcycccccttaaaacttctgtcacttcaggaacctcttctccaccaccagtcttagagaaatatctgataaatagcatagagcagtttaatatgtgttgttcc

SEQ ID NO: 50679 - DNA, 201 bp, Homo sapiens
cccaagaattgcctgattaattcccactcatgcagcccaggcccaagctctcaccttctgccctgcttttaacggcagcacatgtcaccgctgacgggacstgcctctctgcgcgtgaccatgcacttgggactctctaaatgtctcaccggagaatcaatagccctagttcagctctaaatgaagtttctcgtcgccccc

SEQ ID NO: 50680 - DNA, 201 bp, Homo sapiens
actttcaataagtatacaatcggcacatgctaagtgccctaagtgcctggcaccatcccattgtctggccagcaggtcaactggactctcccttgtgcccsccgctcatctgctgggttgtaacacgcaagcatctagatgccacagggcatcccacctagattccccaggcttcctggggctcaaaaacatagattgttt

SEQ ID NO: 50681 - DNA, 201 bp, Homo sapiens
cacatgtcaccgctgacgggacgtgcctctctgcgcgtgaccatgcacttgggactctctaaatgtctcaccggagaatcaatagccctagttcagctctraatgaagtttctcgtcgcccccttctcttacaccctaaggataaagactgtctctgagaattttccccaaatcttcctaacatagagataaaaatagtaa

SEQ ID NO: 50682 - DNA, 201 bp, Homo sapiens
tcaactggactctcccttgtgccccccgctcatctgctgggttgtaacacgcaagcatctagatgccacagggcatcccacctagattccccaggcttccyggggctcaaaaacatagattgtttaaatgattttgacagtcttctgataagtgatttcacaacagaattagttcccctgaaatgatctaatccatttaaa

SEQ ID NO: 50683 - DNA, 201 bp, Homo sapiens
gtgctgagctcattctgtcctttatgctggttctcacttgaattccttctttcaccttccttttcccattttcactgtcctgttttctctttcttatcatwccttacggtttctttctcttttgtccccttcatacctcttatttttgcttgtctttgctttgagccacctagaaatgcttatggaattttcttcttctct

SEQ ID NO: 50684 - DNA, 201 bp, Homo sapiens
tttgcttatcaagaaagaatgcctggaagcctggttccctgtccaatcagagttgcaggggtctgggttgtaaatcagagttaggaagagtctcaaacttsgcctgattattcttgttattagggagactaacaagggtgtggcttttcctgtagctgtaggaatttaggaggttgtgatgccagccaagccctgaatcct

SEQ ID NO: 50685 - DNA, 201 bp, Homo sapiens
atagttaggtaaagaagtgaaaccaacagaataagctgaagagtgagctgagagggaaggagagcaggagagaagaagggagtcgacagtgtcctgtgcartgtcaaggaggaagaccaagaaattgaattaaaatacaattgatagtacagagttacatttggtatagagaaaggtctctggaacaaaaggaagaaggtc

SEQ ID NO: 50686 - DNA, 201 bp, Homo sapiens
cctttcagtcccaggccacccccttctactctttgtctctatgaatttgcctcttccaggtagctcatattaagtgttgcttttttttttttttttttttyccaagacagggtcttgctttgttgctcaggctggagtgcagtggtgcaattacagctcactgtagcctctaactcctgggctcaaacattcctcccacct

SEQ ID NO: 50687 - DNA, 201 bp, Homo sapiens
ggctaaacatttttccacaattagttggaactatgatttttgtatcctgtatagcttgtgcctttgcaatttattttcttgggtcataaacagtgcctttyttacaaatttgtatacccatattatgtaagaatggcgtttacttacttctgttacactaaccatagctatttccctgggtaggtctttactgttaagttt

SEQ ID NO: 50688 - DNA, 201 bp, Homo sapiens
gcataaagctttagggagcaggaagaggcacttagtccatctgagaacaaagcttctccttcctagtgccggcagcctgagacacctggagacggggcagsctgtgtgtacctggtgggactgcacctgcatccacagttctcaccaccactcctgcccatgctgttccctttgggtcccacttcctgctccccatgacat

SEQ ID NO: 50689 - DNA, 201 bp, Homo sapiens
taactcctgggctcaaacattcctcccaccttaccctcttgagtagctaggactacaagcgtatgccactgcacccagctggtttcttaaattttttgtaragatgtgagttttgctatgttgcccaggctggtctctaacccctggcctcaagtgatcctcctatctcagcctcccaaagtgctgggattacaggcatga

SEQ ID NO: 50690 - DNA, 201 bp, Homo sapiens
atcaagctacgaacctgctccgtcgcttttaaacctagacacttacatgttcagggctgttgtcacatcattgacttcggcctttcccaaaagtcaataasagaaacaaatgacaaatgactgaattttagcaactgtgattcagagatcattttagagtctactttcccaggtctcatcttacctgactttcacaacagt

SEQ ID NO: 50691 - DNA, 201 bp, Homo sapiens
tggttttgccatgttagttaggctagacttgaactcctgatctcaagtgatctgcccacctttgcctcccaaagttctgggattacagatgtgagctaccstgcccacctggcccataccctgtttttttttaaatccaccatgtggtatccatttataaaaccttattattaatacaatgctatgaaattgatataatgc

SEQ ID NO: 50692 - DNA, 201 bp, Homo sapiens
tttagggtgcgattgatcccatcacccaggaactgagcatagtacccaatagttagtttttcaaccctagaccccctccctcccacctttacttgtccccrgtatctatcgttgccatctttatgtccatgagtacccaatatttagctcccacttctaagtgagaatatgcattatttgattatctgttcctgcattcac

SEQ ID NO: 50693 - DNA, 201 bp, Homo sapiens
accaaattatattgattaatgtgagatttgcttcacttttgtttttcagggacctgaagctagataacatcctgttagacaaagatggacatatcaagatygcggattttggaatgtgcaaggagaacatgttaggagatgccaagacgaataccttctgtgggacacctgactacatcgccccagaggtaggaatgcagt

SEQ ID NO: 50694 - DNA, 201 bp, Homo sapiens
acctcctggctaggatcttccaagagctacagcctctggcctgagggtcagtccaatgctgttagatattgacaaatgcggggctaattttaatggaatayagttttatccttaaaaggtgtgtgtgttttggctttatttgggttcatatagattaggggcatcatcataactcgcttcctagtgcagacctgagtgatt

SEQ ID NO: 50695 - DNA, 201 bp, Homo sapiens
agctcattctgtcctttatgctggttctcacttgaattccttctttcaccttccttttcccattttcactgtcctgttttctctttcttatcataccttayggtttctttctcttttgtccccttcatacctcttatttttgcttgtctttgctttgagccacctagaaatgcttatggaattttcttcttctctgctgta

SEQ ID NO: 50696 - DNA, 201 bp, Homo sapiens
cactgtcctgttttctctttcttatcataccttacggtttctttctcttttgtccccttcatacctcttatttttgcttgtctttgctttgagccacctakaaatgcttatggaattttcttcttctctgctgtatgacatcatttcacgttcttctgtccaagctcttagattgacactattgtatctcaatctcctcac

SEQ ID NO: 50697 - DNA, 201 bp, Homo sapiens
gctcttagattgacactattgtatctcaatctcctcacttcttttctcaaaatgtagttggcacttatttaacatacaaacctttacaagcttactgtcakatttccaactcactgcagattaggaggaaaaatagaaaggaaaaaaaagaaaggatctagtgaggaggatggctgagctgctggagagcagataattagt

SEQ ID NO: 50698 - DNA, 201 bp, Homo sapiens
tatagcttgtgcctttgcaatttattttcttgggtcataaacagtgcctttcttacaaatttgtatacccatattatgtaagaatggcgtttacttacttytgttacactaaccatagctatttccctgggtaggtctttactgttaagtttggttattttctttaaatgtataagaccttaccaataggaataacacttg

SEQ ID NO: 50699 - DNA, 201 bp, Homo sapiens
ggatggatggatggataaatgatggataaatgatggatgaatgatgagtagatgaacagatggttggatggatggatgaatggatgtacctggatggatgkatggataaatgatggatggatgaggaatggatgaacagatgggtggatggatgatgtatggatgatggatggatggacaacggatggatgaacagatggt

SEQ ID NO: 50700 - DNA, 201 bp, Homo sapiens
gtctttactgttaagtttggttattttctttaaatgtataagaccttaccaataggaataacacttgataaataatattgtaatactctggtgatccagtytgatgcagtatccctaaatctgggaaaggttgtaaaaaaaaaaaaaaaaaaaaaaaaaaaaaaaaaagatgctatcttaaagatgcatttttttctggca

SEQ ID NO: 50701 - DNA, 201 bp, Homo sapiens
attagttttgaagggctgccataagaaattaccccaaatttggtggcttattctggaagctagacatttggaagcaagatgtgggcagggccatgcccccmccaagccctcgatttaccagcctctggtggctgcaggcattccttggcttgtggctgcatcacccagtctctgcctctgtcttcccatggccttctcttg

SEQ ID NO: 50702 - DNA, 201 bp, Homo sapiens
ttattttctttaaatgtataagaccttaccaataggaataacacttgataaataatattgtaatactctggtgatccagtctgatgcagtatccctaaatytgggaaaggttgtaaaaaaaaaaaaaaaaaaaaaaaaaaaaaaaaaagatgctatcttaaagatgcatttttttctggcatgtagaagttggaaacagac

SEQ ID NO: 50703 - DNA, 201 bp, Homo sapiens
ctctcaaatatgttcccaaggaggtatctacaaggatgttcacagcagcatgagttataagaaagtggaggagaaggaggaggaaggaagaagaaggaaawaaaggaaaagatgaaacatcaatagaagaaaagatggatagcatatttctttcttcttcttcttcttttgtttgtttttttttattttttttttttattt

SEQ ID NO: 50704 - DNA, 201 bp, Homo sapiens
aaaaaaaaaaaaaaaagatgctatcttaaagatgcatttttttctggcatgtagaagttggaaacagactaaatatgtagctacagactttagtaacgcaratcgtagagctactgtcaataggatgtcatgcaagaatgacaaggaagcctgagaaaatgtcagagaaacttgaaaaaaattttatagtaaaatgttaac

SEQ ID NO: 50705 - DNA, 201 bp, Homo sapiens
agaatggattgatgatgaatggatgaacagatgaaaagacacaagctgtacattcaaaaaatgtccaagtgaatgttattccaattaaaagtgcaagagckgaaaggaaaaaatatatcaccagacttaagtaggggagatggcaaacaaaaattcttctgtgaaggtagactttttagagtggaagaggctttgcagatg

SEQ ID NO: 50706 - DNA, 201 bp, Homo sapiens
tcttcccttctacttctattcttagaccctaagactctgggtctccaagattatgagttctcacaagtggttcctgcttcttagccttcaatttccttgayatctctctatcatacaatgctgaaaacttcatttcttttcagcttgcctgatgtgatattgtccaggttttcctcttaatttttcagctgcctcttcttg

SEQ ID NO: 50707 - DNA, 201 bp, Homo sapiens
gaggaaggaagaagaaggaaaaaaaggaaaagatgaaacatcaatagaagaaaagatggatagcatatttctttcttcttcttcttcttttgtttgttttkttttattttttttttttatttttttattttttgagacagggtcttgctctgtcacccaggctggagtgcagtggcactatctcggctctctgcaacctcc

SEQ ID NO: 50708 - DNA, 201 bp, Homo sapiens
aaaaaaaaagatgctatcttaaagatgcatttttttctggcatgtagaagttggaaacagactaaatatgtagctacagactttagtaacgcagatcgtaragctactgtcaataggatgtcatgcaagaatgacaaggaagcctgagaaaatgtcagagaaacttgaaaaaaattttatagtaaaatgttaacttaaaaa

SEQ ID NO: 50709 - DNA, 201 bp, Homo sapiens
aaaaaatatatcaccagacttaagtaggggagatggcaaacaaaaattcttctgtgaaggtagactttttagagtggaagaggctttgcagatggaagaastgactccaggaaaggcacagcaataggaaaatggaggaatattcaacaggtgcatccagcttcaggggcaaggctgctgttggtcgatgaaaagcatgag

SEQ ID NO: 50710 - DNA, 201 bp, Homo sapiens
ggaaggaagaagaaggaaaaaaaggaaaagatgaaacatcaatagaagaaaagatggatagcatatttctttcttcttcttcttcttttgtttgttttttwttattttttttttttatttttttattttttgagacagggtcttgctctgtcacccaggctggagtgcagtggcactatctcggctctctgcaacctccac

SEQ ID NO: 50711 - DNA, 201 bp, Homo sapiens
cagactaaatatgtagctacagactttagtaacgcagatcgtagagctactgtcaataggatgtcatgcaagaatgacaaggaagcctgagaaaatgtcaragaaacttgaaaaaaattttatagtaaaatgttaacttaaaaagccaaatataattccatacccacaggatgatcatagcatgtaagaaaaaaaaaacac

SEQ ID NO: 50712 - DNA, 201 bp, Homo sapiens
aaggaagaagaaggaaaaaaaggaaaagatgaaacatcaatagaagaaaagatggatagcatatttctttcttcttcttcttcttttgtttgttttttttwattttttttttttatttttttattttttgagacagggtcttgctctgtcacccaggctggagtgcagtggcactatctcggctctctgcaacctccacct

SEQ ID NO: 50713 - DNA, 201 bp, Homo sapiens
tctctctggaggattctggcttcattctgagccaagtcagtcgagaagaaaacggacaaattcaagatatttggaaggtagaggccagaatgtttgccctycatccagtttcccccagtggccacatctcatgcagctgtggtacaaggtcaaaagggtctgaaaaccacatcatgaggagcgaagtccctgatcttggtg

SEQ ID NO: 50714 - DNA, 201 bp, Homo sapiens
gactaaatatgtagctacagactttagtaacgcagatcgtagagctactgtcaataggatgtcatgcaagaatgacaaggaagcctgagaaaatgtcagaraaacttgaaaaaaattttatagtaaaatgttaacttaaaaagccaaatataattccatacccacaggatgatcatagcatgtaagaaaaaaaaaacacaa

SEQ ID NO: 50715 - DNA, 201 bp, Homo sapiens
ttttttaaaaaatattatcagttacatttccctaagaatggaatgggttcttttaagaggatactagttctccaaggaaacagaagtttgttggcatgacrttctggcgttggatggattccggttctcaaggggttcagtattagttaggaacaaacttcatcaactggacttggaattaggtgcagtataattcattca

SEQ ID NO: 50716 - DNA, 201 bp, Homo sapiens
aagaagaaggaaaaaaaggaaaagatgaaacatcaatagaagaaaagatggatagcatatttctttcttcttcttcttcttttgtttgtttttttttattwtttttttttatttttttattttttgagacagggtcttgctctgtcacccaggctggagtgcagtggcactatctcggctctctgcaacctccacctccag

SEQ ID NO: 50717 - DNA, 201 bp, Homo sapiens
acaaggaagcctgagaaaatgtcagagaaacttgaaaaaaattttatagtaaaatgttaacttaaaaagccaaatataattccatacccacaggatgatcrtagcatgtaagaaaaaaaaaacacaaaacttgctaatttaaaaagactagggaaaatagatcagaatagtaactgatttcttttattggtggaaatctgg

SEQ ID NO: 50718 - DNA, 201 bp, Homo sapiens
agaaggaaaaaaaggaaaagatgaaacatcaatagaagaaaagatggatagcatatttctttcttcttcttcttcttttgtttgtttttttttattttttwtttttatttttttattttttgagacagggtcttgctctgtcacccaggctggagtgcagtggcactatctcggctctctgcaacctccacctccagggct

SEQ ID NO: 50719 - DNA, 201 bp, Homo sapiens
tacacagagaaaagcactctgtgtagttcgggtgtaaaacgctgccatctgcctgaaaaactcacacctgagcttgcggttctattgaatgatgtgtgaarattaccacacaaatacctattctgtcttctagatgtcaggtgtatgtcaggtcatgtctgacatacatttctaaaggtctgtgagcagacctttacagaa

SEQ ID NO: 50720 - DNA, 201 bp, Homo sapiens
aaggaaaaaaaggaaaagatgaaacatcaatagaagaaaagatggatagcatatttctttcttcttcttcttcttttgtttgtttttttttattttttttwtttatttttttattttttgagacagggtcttgctctgtcacccaggctggagtgcagtggcactatctcggctctctgcaacctccacctccagggctca

SEQ ID NO: 50721 - DNA, 201 bp, Homo sapiens
aaaaaaggaaaagatgaaacatcaatagaagaaaagatggatagcatatttctttcttcttcttcttcttttgtttgtttttttttattttttttttttawttttttattttttgagacagggtcttgctctgtcacccaggctggagtgcagtggcactatctcggctctctgcaacctccacctccagggctcaggtga

SEQ ID NO: 50722 - DNA, 201 bp, Homo sapiens
aaaggaaaagatgaaacatcaatagaagaaaagatggatagcatatttctttcttcttcttcttcttttgtttgtttttttttattttttttttttatttwtttattttttgagacagggtcttgctctgtcacccaggctggagtgcagtggcactatctcggctctctgcaacctccacctccagggctcaggtgatcc

SEQ ID NO: 50723 - DNA, 201 bp, Homo sapiens
aaggaaaagatgaaacatcaatagaagaaaagatggatagcatatttctttcttcttcttcttcttttgtttgtttttttttattttttttttttattttwttattttttgagacagggtcttgctctgtcacccaggctggagtgcagtggcactatctcggctctctgcaacctccacctccagggctcaggtgatcct

SEQ ID NO: 50724 - DNA, 201 bp, Homo sapiens
tagtagagatggggtttcaccatgttggccaggctggtctcaaactcctgacctcaagtgatccacccacctcggcctcccaaagtgctgggatcacaggyatgagccaccatgcccagcctactctccctcctttgaaaccttgctgacaaactacctactctataaatcacgctcagatacactaaatcctacttgtca

SEQ ID NO: 50725 - DNA, 201 bp, Homo sapiens
tcttcccacccctctctgacctcctgtttcattattttccccttcatcccagagttcacatgatcttgtacccactgtagctatcaggtctctgccttgattttttttttttttgcgacagtctcactctgttgcccaggcggctcaatacaacctccacctcctgggttcaagtgattctcctgcctcagcctcccaagt

SEQ ID NO: 50726 - DNA, 201 bp, Homo sapiens
ggaaactgtgggaatatatgagcgtcagaatcaacgtactgcagaaattcaagtgctaaaccacagaaaagccctcttttacaaagtaggaggaagagcaggggggaaaggtgatagggaggatcccttggggtggtaagaagaggaacagaggagttaggagtatcggaggacaggagaggaaagaatttcaagagagaa

SEQ ID NO: 50727 - DNA, 201 bp, Homo sapiens
agaattagttcccctgaaatgatctaatccatttaaaaagtagtcctccttgttgtattttctctaaagagctaaaaattggaactgtgactgggtatggyggctcacgcctgtaatcccagcactttgggaggccaaggtgggcggatcacctgaggtcaagagttggagaccagcctggctaacatggcgaaaccccat

SEQ ID NO: 50728 - DNA, 201 bp, Homo sapiens
acccacctccccccttttcacagaatcctccccagctgcccacccagggagattagtgacacccctcccacttggtctttcccatggcacagcacttgttstggttgctttttcatcttcaaatctccctgcatgactggatatttgctctgcagtcatggacagattcatattcactttttaaaaattttcatttcgaaa

SEQ ID NO: 50729 - DNA, 201 bp, Homo sapiens
accagctagttctattcagaatggtgcatacaggtctatgggtgccaaccagagtttaaaacaaagggagaaattatttgcctattatctatactattacttttttttttttttttgagtcagagtcttgctctgtcgtccatgctggagtgcagtggtgtgatctcagctcactgcaacctctgcctcccaggttcaagt

SEQ ID NO: 50730 - DNA, 201 bp, Homo sapiens
cttgcttctctctgcagcttcactcccttcttttcttttacgtgtgcttgtctccacgtgattcagtgcttggtcctcttctcttcttactctacatcctycacgagcaacttcattgatgactgtggtcttcgctgtagagtcaatatggcccacctgcacttcttcctgctgcagacactacgtccactttcctgcttg

SEQ ID NO: 50731 - DNA, 201 bp, Homo sapiens
tcttggtgacacccttccatctgctttcctcccttatcatccatcaccagggcatgctctttacatatcttcatgccttttgatctgttagaaaagcatcsccaagatctgtctatttatatatgaatcatatacattgtcaccagctaagatagactgtgtgttatcaatgcctaaaaaggaatatgatcaggttatact

SEQ ID NO: 50732 - DNA, 201 bp, Homo sapiens
gtctatgggtgccaaccagagtttaaaacaaagggagaaattatttgcctattatctatactattacttttttttttttttttgagtcagagtcttgctcygtcgtccatgctggagtgcagtggtgtgatctcagctcactgcaacctctgcctcccaggttcaagtgattatcaagcctcagcttcctgagtagatggg

SEQ ID NO: 50733 - DNA, 201 bp, Homo sapiens
cctaatgctatccctccccgctccccccaccccacaacagtccccagagtgtgatgttccccttcctgtgtccatgtgttctcattgttcaattcccatcyatgagtgagaacatgcggtgtttggttttttgtccttgcgatagtttactgagaatgatgatttccagtttcatccatgtccctacaaaggacatgaact

SEQ ID NO: 50734 - DNA, 201 bp, Homo sapiens
gctggagtgcagtggtgtgatctcagctcactgcaacctctgcctcccaggttcaagtgattatcaagcctcagcttcctgagtagatggggctacaggckcccaacaccatgccctgctaatttttgtatttttactagagatggtgtttcaccatgttgcccatgctggtcttgaactcctgacttcaagtgatccacc

SEQ ID NO: 50735 - DNA, 201 bp, Homo sapiens
gccctattggatcaagaccttaccccatgacctcatttaacccgaattatctccataaagcccttacctacagttacattgtgggttagggcatcaacatrtgtattttgagaggacgccattcagtccaaagcatgaggctgcactgcaaagcctgggccagcaaaacccactggaaaaaagtgagcacaaggcttagtc

SEQ ID NO: 50736 - DNA, 201 bp, Homo sapiens
catgctggtcttgaactcctgacttcaagtgatccacctgcttgggcctcccaaagtgctaggattacaggcgtgagccaccgtacctggcctatactatyacttttaatgtctgtgtatgttttattagcaatagcaaaaacaacaaaaaaaatgacaatgtgagcattattgtttaaaatataagaacaagtactagat

SEQ ID NO: 50737 - DNA, 201 bp, Homo sapiens
ggatggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgt

SEQ ID NO: 50738 - DNA, 201 bp, Homo sapiens
aaaagatgaaacatcaatagaagaaaagatggatagcatatttctttcttcttcttcttcttttgtttgtttttttttattttttttttttatttttttawtttttgagacagggtcttgctctgtcacccaggctggagtgcagtggcactatctcggctctctgcaacctccacctccagggctcaggtgatcctccca

SEQ ID NO: 50739 - DNA, 201 bp, Homo sapiens
gatggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgta

SEQ ID NO: 50740 - DNA, 201 bp, Homo sapiens
aaagatgaaacatcaatagaagaaaagatggatagcatatttctttcttcttcttcttcttttgtttgtttttttttattttttttttttatttttttatwttttgagacagggtcttgctctgtcacccaggctggagtgcagtggcactatctcggctctctgcaacctccacctccagggctcaggtgatcctcccac

SEQ ID NO: 50741 - DNA, 201 bp, Homo sapiens
ttggttgggtgcagcgactcacacctgtgatcccagcactttgggaggccaaggcaggaggatcacttgaggtcaggagtttgagactggcctgagcaacytagtgagaccctgtgtctacaaaaaataaaaaagaaactagctgggtgtggtggtgcatgcctgcagtgtaactagttgggacactgaaggggaggatca

SEQ ID NO: 50742 - DNA, 201 bp, Homo sapiens
tggctagccagttttcccagcaccatttattaaatagggaatcctttccccattgcttgtttttctcaggtttgtcaaagatcagatagttgtagataagyggcattatttctgagggctctgttctgttccattgatctatatctctgttttggtaccagtaccatgctgttttggttactgtagccttgtagtatagtt

SEQ ID NO: 50743 - DNA, 201 bp, Homo sapiens
ggataagtcggagggtgagtatctttttgttaagtagtcttcactgataggcaggttgctgttctatttgtatctcttcaagttgcatatgatttcttgcytaggattttgctgatttcatccttaacagacttttctttgcattctaggattatttagacataagcacatggtggcattcagatgctcatttaaccaact

SEQ ID NO: 50744 - DNA, 201 bp, Homo sapiens
gttctgttccattgatctatatctctgttttggtaccagtaccatgctgttttggttactgtagccttgtagtatagtttgaagtcaggtagcgtgatgcytccagctttgttcttttggcttaggattgacttggtgatgcgggttcttttttggttccatatgaactttaaagtagttttttccaattctgtgaagaaa

SEQ ID NO: 50745 - DNA, 201 bp, Homo sapiens
atttttttttacggggtcttgctctgtcgcccaggctggagtgcagtggcacgatctcagctcacagcagcctccgcctctgaggctcaagggatcctccrgcctcagcctcctgagtagctgggactacagttgcatgccaccatggcctggctagtttgtgcactttgtagagatggtgttttgtcatgttgcccaggc

SEQ ID NO: 50746 - DNA, 201 bp, Homo sapiens
attgatctatatctctgttttggtaccagtaccatgctgttttggttactgtagccttgtagtatagtttgaagtcaggtagcgtgatgcttccagctttsttcttttggcttaggattgacttggtgatgcgggttcttttttggttccatatgaactttaaagtagttttttccaattctgtgaagaaagtcatcgata

SEQ ID NO: 50747 - DNA, 201 bp, Homo sapiens
tcctacttcacaaaattgttaggacttcaaaccgaataaatatatgaaaaacattttccctttttgttacacagaattattttttaaaatttgaattgcamattccaaaaagaactagttaaaatcaactaatatccagtatactgaaagatagcattttactccaaattttttcccactgacagatttttatctttgtaa

SEQ ID NO: 50748 - DNA, 201 bp, Homo sapiens
caaaaaaaaaaaaagaaaaaaaaaagaaaatgtggtacatatgcaccatggaatactatgcagacacaaaaatgcatgagaccaggacttttgcagaaacrtggatggagctggaggccattatccttagcaaactaacacagaaacagaaaaccaaatgtggcatgttctcacttataagtgggagctaaattatgagaa

SEQ ID NO: 50749 - DNA, 201 bp, Homo sapiens
ctcccgccatttgtgacaaccaaaaatatctgtctccagacattgccaaatgttgctcagaggagcaacatcaccctctgagaaccactgatttagaaccrccaggcactgtgctggattctgagcaaatagaaacgagaaagctgctggcctggcctggtggagctgactccagggcagctttgcgaacttcaatatgca

SEQ ID NO: 50750 - DNA, 201 bp, Homo sapiens
ctggaggccattatccttagcaaactaacacagaaacagaaaaccaaatgtggcatgttctcacttataagtgggagctaaattatgagaacacatggacwcaaagaggggaacaacacacactggggcctgtcagagggtggagggtgacagtagagagaagatcagaaaaaaataactattaggtaccaggcttagtac

SEQ ID NO: 50751 - DNA, 201 bp, Homo sapiens
attcttgcttctgacactcccgggtccctgcccctccactgtgctcaccccgcctgctccgctcaccccgcatgcccccgcgtcctcctttctcgactctyctcgccctcttctccagctctcttccctccctctctgcctccctttcatcctgcctccttgcaggccgtcgtcttaagtagggcctccttagccttttac

SEQ ID NO: 50752 - DNA, 201 bp, Homo sapiens
gccaagaggtggagacgacccacatatccatcaacagatgaatggatgaacaaaatatgctacaaacatgcaatggaggctgggcacagtggttcatgccyataatcccagcactttgggaggctgaggcaggctgatcacttgaggccaggagtttgagaccagcctggccaacatggcaaaatcccatctttactaaac

SEQ ID NO: 50753 - DNA, 201 bp, Homo sapiens
aaacctgacaccttctaaatagggcgaatgtgagttatgcgagttttgccgacaatgtggaatttggagcacaatcatgaaaaaaaaaaatcctttctatrgtaaagattttaggccgggcacggtaacagacctgtaatcccagcactttgggagggcaatgcggaaggatggcttgagcccaggagtttgagaccagcc

SEQ ID NO: 50754 - DNA, 201 bp, Homo sapiens
aaatcccatctttactaaacatataaaaattagccgggcatggtggcatgtgcctgtaatcccagctactcaggtggcggaggcatgagaatagtttgaayctgggaggtggaggctgcagtgagccaaggtcataccgctgcactccaggctgggcggcagagtgagactccatctcagaaaaaaaagtgcaatgggata

SEQ ID NO: 50755 - DNA, 201 bp, Homo sapiens
cttcaaggctggcagaaaaagcagccttggagtgggctcatcagtgagcaagcccctgagctgggaggtggaggttggatgcgtctgcattcccactcggygttgggaccctttccttatgctgaatttgccagaaggctgtgccgttctgggaggacttgcatcctggtctcctttttccttaaaaaaacaaaaattatc

SEQ ID NO: 50756 - DNA, 201 bp, Homo sapiens
attcagatctgactttggcaaaagcctttacgcagagtcaacagcttaactggtccagggccaggtggggaaatcatgagaacattatgatgaacaggacwccggggttttagttagttgacatttctatctgagttggcagtagaatgtaacgtctgcaaaagtcagttcattcatggtctgcatttatggaccttcagt

SEQ ID NO: 50757 - DNA, 201 bp, Homo sapiens
gtgtcctaagacacttagtgcctagtagctctagtaactgtttgttgaatgaatgaatgagtgaatggatgcatagtcactaaatcagaaatcgtggataytgtaatcatagaacattaggtcataaataccaaggatcctgaggaagaagaagaaagaatatctatgatttggacagccatttttccaattgtggaacat

SEQ ID NO: 50758 - DNA, 201 bp, Homo sapiens
atgttgttgcaagtagagattttctcctttttcagggctgatactcccctgtgtatatatagcacagtttctgtatccatttatccactgatggacacttrgagtccatatcttggctattgtgaatgaagctgcaatgagcaagcaagtgcagctgtctcctctacatactggttttatttccgttggtaatttacccac

SEQ ID NO: 50759 - DNA, 201 bp, Homo sapiens
atggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgtac

SEQ ID NO: 50760 - DNA, 201 bp, Homo sapiens
ggatggatgggtgtggatggttgaatggatggacaaatgatggatgaatgatgaatggatgaacagatggttgaatggatggatgaatggatggatgtggatggatggatggatggatggatggataaatgatggataaatgatggatgaatgatgagtagatgaacagatggttggatggatggatgaatggatgtacct

SEQ ID NO: 50761 - DNA, 201 bp, Homo sapiens
tcacgcctataatcccagcattttgagtctgaggcagaaggattgcttaatgtcaggagttcatgaccagccttggcaacatagtgagaccttgtctctamaaaaaattttaaaaattagccaggcatggcgatggcacacatgtggtcaagagtctgaggtgggaggactgcttgctcaagaggttgaggctgcagtgaa

SEQ ID NO: 50762 - DNA, 201 bp, Homo sapiens
ctttgttcttttggcttaggattgacttggtgatgcgggttcttttttggttccatatgaactttaaagtagttttttccaattctgtgaagaaagtcatygatagcttgatggggatggcattgaatctataaattaccttgggcagtatggccattttcacgatattgattcttcctacccatgagcatggaatgttct

SEQ ID NO: 50763 - DNA, 201 bp, Homo sapiens
ttgttcttttggcttaggattgacttggtgatgcgggttcttttttggttccatatgaactttaaagtagttttttccaattctgtgaagaaagtcatcgrtagcttgatggggatggcattgaatctataaattaccttgggcagtatggccattttcacgatattgattcttcctacccatgagcatggaatgttcttc

SEQ ID NO: 50764 - DNA, 201 bp, Homo sapiens
ttaaagtagttttttccaattctgtgaagaaagtcatcgatagcttgatggggatggcattgaatctataaattaccttgggcagtatggccattttcacsatattgattcttcctacccatgagcatggaatgttcttccattggtttgtatcctcttttatatcattgagcagtggtttgtagttctccttgaagaggt

SEQ ID NO: 50765 - DNA, 201 bp, Homo sapiens
aatgatgtgctctaagaagctaccatattatcagtagaatacaaaataagtaagaagtcaatcaatatattccataaaattagtaacaaaatgctaacacytgaagttagtcacctcaagtccttttaggaacaagaaaaggtgagaaaacacattgctaaagggttttgattccatgttacatgtggactttggccacag

SEQ ID NO: 50766 - DNA, 201 bp, Homo sapiens
ctatcatttttggacatttgggttggttccaagtctttgctattgtgaatagtgccacaacaaacagatgtgtgcatgtgtctttatagcagcatgatttmtagtcctttgggtatatacccagtaatgggatggctgggtcaaatggtatttctagttctagatccctgaggaatcgccacactgacttccacaatggtt

SEQ ID NO: 50767 - DNA, 201 bp, Homo sapiens
gttgtgtggtacacagatgagagattatccatcaggatgagggggaaggaggccgcttgtcatcaaagtgctagatcctctgaagctcggcttcctcagcygacaactgggatgatgaatttgtttctcttagaatttgtttgaaaatcactgaggcatctagcacagtgcctgcctctcaaagaacattggttggagtgg

SEQ ID NO: 50768 - DNA, 201 bp, Homo sapiens
aactgggatgatgaatttgtttctcttagaatttgtttgaaaatcactgaggcatctagcacagtgcctgcctctcaaagaacattggttggagtggatgwtgtatcagtcgtaagaatcatgagtgatgtgaatgatgtatgatagggtgatcaatcctgaatatgacttgaacagaagagagagagctccctgtcaggg

SEQ ID NO: 50769 - DNA, 201 bp, Homo sapiens
tcatttttggacatttgggttggttccaagtctttgctattgtgaatagtgccacaacaaacagatgtgtgcatgtgtctttatagcagcatgatttctartcctttgggtatatacccagtaatgggatggctgggtcaaatggtatttctagttctagatccctgaggaatcgccacactgacttccacaatggttgaa

SEQ ID NO: 50770 - DNA, 201 bp, Homo sapiens
taacaaaatgctaacacttgaagttagtcacctcaagtccttttaggaacaagaaaaggtgagaaaacacattgctaaagggttttgattccatgttacaygtggactttggccacagaagtgaaatttcccggtacgatgtgctgagacaggctgtcagggctgtgtatgtgaatcaaatccccctacttagaaaatcct

SEQ ID NO: 50771 - DNA, 201 bp, Homo sapiens
ttcttcctacccatgagcatggaatgttcttccattggtttgtatcctcttttatatcattgagcagtggtttgtagttctccttgaagaggtccttcacrtcccttgtaagttggattcctaggtattttattctctttgaagcaatcgtgaatgggagttcactcaagatttggctctctgtctgttattggtgtctaa

SEQ ID NO: 50772 - DNA, 201 bp, Homo sapiens
agaaagtttcacaaggaaaagggggtgaaagctgagccctgaaagataaggcagaatttaaagatgaggggagggaagcaggagtcgactaggggagggtrtctcatggcaagatggaaatgtcattagtgagggacagagacaggaaggcaggtggtgttttcggtgagcagaaatgtctggactggagagggtcctaat

SEQ ID NO: 50773 - DNA, 201 bp, Homo sapiens
cgctgctttcccgggtttccttgtgcattttgagctgtgcatctgattctttgggtcaaagcaaggactgaaaaagagcagaacacaagaagagatcacartgaggcaaggtcccggggctgagagagaaaggggccacccttgctggtgtttctccaccacagtctctttaaaaattgggcatgggccgggcatggtggc

SEQ ID NO: 50774 - DNA, 201 bp, Homo sapiens
gaatgttcttccattggtttgtatcctcttttatatcattgagcagtggtttgtagttctccttgaagaggtccttcacgtcccttgtaagttggattccyaggtattttattctctttgaagcaatcgtgaatgggagttcactcaagatttggctctctgtctgttattggtgtctaagaatgcttgtgatttttgtac

SEQ ID NO: 50775 - DNA, 201 bp, Homo sapiens
ttcctatttctccacatcctctccagcatctgttgtttcctgactttttaatgattgccattctaactggtgtgagatggtatctcattgtggttttgaawtgcatttctctgatggccagtgatgatgagcattttttcatgtgtcttttggctgcataaatgtcttcttttgagaagtgtctgttcatatccttcgccc

SEQ ID NO: 50776 - DNA, 201 bp, Homo sapiens
ccagcatctgttgtttcctgactttttaatgattgccattctaactggtgtgagatggtatctcattgtggttttgaattgcatttctctgatggccagtsatgatgagcattttttcatgtgtcttttggctgcataaatgtcttcttttgagaagtgtctgttcatatccttcgcccactttttgatggggttgttttt

SEQ ID NO: 50777 - DNA, 201 bp, Homo sapiens
tatcattgagcagtggtttgtagttctccttgaagaggtccttcacgtcccttgtaagttggattcctaggtattttattctctttgaagcaatcgtgaaygggagttcactcaagatttggctctctgtctgttattggtgtctaagaatgcttgtgatttttgtacattgattttgtatgctgagactttgctgaagtt

SEQ ID NO: 50778 - DNA, 201 bp, Homo sapiens
agcatggacatgtaaacttactgatggtaaattcacttcattttttcctaaattaattttactaccaagaagaagcaagtttaactttatacatttatggkgctttctgagtttcggcttaccatatataattcctccgtgtctaaattcaaacaaatacatcagagaaaacaatattatgaaataatcatagaaaacttg

SEQ ID NO: 50779 - DNA, 201 bp, Homo sapiens
tattctctttgaagcaatcgtgaatgggagttcactcaagatttggctctctgtctgttattggtgtctaagaatgcttgtgatttttgtacattgatttygtatgctgagactttgctgaagttgcttatcagcttaaggagattttgggctgagacaatggggttttctagatatacaatcatgtcatctgcaaacagg

SEQ ID NO: 50780 - DNA, 201 bp, Homo sapiens
caggttattgaggttgcagtgagcagtgatttcaccagtgcactgcagtgtggatgatacagtgaaagaaagaaaggaaagaaaggaaaggaaaggaaggragggagggaaggaaggaaggaagggagagagagagagggtgagagagaggaaggaaggaaggaaggggaagggaaggagaaagaaagaaagaagaaaaga

SEQ ID NO: 50781 - DNA, 201 bp, Homo sapiens
ttttgtacattgattttgtatgctgagactttgctgaagttgcttatcagcttaaggagattttgggctgagacaatggggttttctagatatacaatcaygtcatctgcaaacaggacaatttgacttcctcttttcctaattgaataccctttatttccttctcctgcctaattgccctggccagaacttccaacacta

SEQ ID NO: 50782 - DNA, 201 bp, Homo sapiens
attgaggttgcagtgagcagtgatttcaccagtgcactgcagtgtggatgatacagtgaaagaaagaaaggaaagaaaggaaaggaaaggaaggaagggarggaaggaaggaaggaagggagagagagagagggtgagagagaggaaggaaggaaggaaggggaagggaaggagaaagaaagaaagaagaaaagaaagaaa

SEQ ID NO: 50783 - DNA, 201 bp, Homo sapiens
ttttctagtttatttgtgtagaggtgtttgtagtattctctgatggtagtttgtatttctgtgggatcagtggtgatatcccctttatcattttttattgygtctatttgattcttctctctttttttctttattagtcttgctagcggtctatcaattttgttgatcctttcaaaaaaccagctcctggattcattaatt

SEQ ID NO: 50784 - DNA, 201 bp, Homo sapiens
agggaaggaaggaaggaagggagagagagagagggtgagagagaggaaggaaggaaggaaggggaagggaaggagaaagaaagaaagaagaaaagaaagaraaagaaagaaagaaaaggaaggaaggaaggaggagggagggagggaaggaaggaaggaaggagaaaaagggtccttcaaaagaaagaaagaaggaaggaa

SEQ ID NO: 50785 - DNA, 201 bp, Homo sapiens
aggaaggaaggaaggaaggggaagggaaggagaaagaaagaaagaagaaaagaaagaaaaagaaagaaagaaaaggaaggaaggaaggaggagggagggarggaaggaaggaaggaaggagaaaaagggtccttcaaaagaaagaaagaaggaaggaagaaaggaaggaaggaaagaaagaaagaaaggagaaaaagtgtc

SEQ ID NO: 50786 - DNA, 201 bp, Homo sapiens
aggggaagggaaggagaaagaaagaaagaagaaaagaaagaaaaagaaagaaagaaaaggaaggaaggaaggaggagggagggagggaaggaaggaaggarggagaaaaagggtccttcaaaagaaagaaagaaggaaggaagaaaggaaggaaggaaagaaagaaagaaaggagaaaaagtgtccttcatcagaatgcaa

SEQ ID NO: 50787 - DNA, 201 bp, Homo sapiens
ctggacgtggtgctataaaagatgattcaggagtggcacaggctgagggggactaggctggagaaggtggagggaagagggagcactccgtgccctcttcytgtccatgggaaatgaaccatctgtgcctggtgtccaagtccttgacgttccagttgccctttgagagcacacctcaagcctgctgaattcttttaagaa

SEQ ID NO: 50788 - DNA, 201 bp, Homo sapiens
attatttctgagggctctgttctgttccattgatctatatctctgttttggtaccagtaccatgctgttttggttactgtagccttgtagtatagtttgargtcaggtagcgtgatgcttccagctttgttcttttggcttaggattgacttggtgatgcgggttcttttttggttccatatgaactttaaagtagttttt

SEQ ID NO: 50789 - DNA, 201 bp, Homo sapiens
gtatagtttgaagtcaggtagcgtgatgcttccagctttgttcttttggcttaggattgacttggtgatgcgggttcttttttggttccatatgaactttraagtagttttttccaattctgtgaagaaagtcatcgatagcttgatggggatggcattgaatctataaattaccttgggcagtatggccattttcacgat

SEQ ID NO: 50790 - DNA, 201 bp, Homo sapiens
ttgtaaaatggcaggcttactgcggatgcttaatctcttttaaaagtgctgtgtctagcgggaagaagagtgacatttactaatatggttgcaaattactkttgaagtttatgcacagctgtttaaaatccctctgagatcagtgccattgtttgatgcaggtgcttaccgcagaaggctcttgttagtcccttcctcctg

SEQ ID NO: 50791 - DNA, 201 bp, Homo sapiens
attcttcctacccatgagcatggaatgttcttccattggtttgtatcctcttttatatcattgagcagtggtttgtagttctccttgaagaggtccttcaygtcccttgtaagttggattcctaggtattttattctctttgaagcaatcgtgaatgggagttcactcaagatttggctctctgtctgttattggtgtcta

SEQ ID NO: 50792 - DNA, 201 bp, Homo sapiens
ttgatcctttcaaaaaaccagctcctggattcattaattttttgaagggttttttgtgtctctatttccttcagttctgctctgattttagttatttcttkccttctgctagcttttgaatgtgtttgctcttgcttttctagttcttttaattgtgatgttagggtgtcagttttggatttttcctgctttctcttgtgg

SEQ ID NO: 50793 - DNA, 201 bp, Homo sapiens
gagtggtgagagagggcatccctgtcttgtgccagttttcaaagggaatgcttccagtttttgcccattccgtatgatattggctgtgggtttgtcatagmtagctcttatgattttgagatacatcccatcaatacttaatttattgagagtttttagcatgaagggttgttgaattttgtcaaaggccttttctgcatc

SEQ ID NO: 50794 - DNA, 201 bp, Homo sapiens
tttagcatgaagggttgttgaattttgtcaaaggccttttctgcatctattgagtaatcatgtggtttttgtctttggctctgtttatatgctggattacrtttattgatttgcatatattgaaccagccttgcatcccagggatgaagcccatttgatcatggtggataagctttttaatgtgctgctggattcggtttg

SEQ ID NO: 50795 - DNA, 201 bp, Homo sapiens
aatgtgtttgctcttgcttttctagttcttttaattgtgatgttagggtgtcagttttggatttttcctgctttctcttgtgggcatttagtgctataaayttccctctacacactgctttgaatgtgtcccagagattctggtatgttgtgtctttgttctcattgatttcaaagaacatctttatttctgccttcattt

SEQ ID NO: 50796 - DNA, 201 bp, Homo sapiens
ttggtaagctattgattattgccacaatttcagatcctgttattggtctattcagagattcaacttcttcctggtttagtcttgggagagtgtatatgtcraggaatttatccgtttcttctagattttctagtttatttgtgtagaggtgtttgtagtattctctgatggtagtttgtatttctgtgggatcagtggtga

SEQ ID NO: 50797 - DNA, 201 bp, Homo sapiens
ggggaagggaaggagaaagaaagaaagaagaaaagaaagaaaaagaaagaaagaaaaggaaggaaggaaggaggagggagggagggaaggaaggaaggaargagaaaaagggtccttcaaaagaaagaaagaaggaaggaagaaaggaaggaaggaaagaaagaaagaaaggagaaaaagtgtccttcatcagaatgcaag

SEQ ID NO: 50798 - DNA, 201 bp, Homo sapiens
atatgtcgaggaatttatccgtttcttctagattttctagtttatttgtgtagaggtgtttgtagtattctctgatggtagtttgtatttctgtgggatcrgtggtgatatcccctttatcattttttattgcgtctatttgattcttctctctttttttctttattagtcttgctagcggtctatcaattttgttgatcc

SEQ ID NO: 50799 - DNA, 201 bp, Homo sapiens
agaaaaggaaggaaggaaggaggagggagggagggaaggaaggaaggaaggagaaaaagggtccttcaaaagaaagaaagaaggaaggaagaaaggaaggraggaaagaaagaaagaaaggagaaaaagtgtccttcatcagaatgcaagtatttttggtaaatgattttaagatccctgctttgaaaaacaattccatgg

SEQ ID NO: 50800 - DNA, 201 bp, Homo sapiens
taatttctgttcttttacatttgctgaggagagctttacttccaactatgtggtcaattttggaataggtgtggtgctgaaaaaaatgtatattctgttgmtttggggtggagaattctgtagatgtctattaggtctgcttggtgcagagctgagttcaattcctgggtatccttgttaactttctgtctcattgatctg

SEQ ID NO: 50801 - DNA, 201 bp, Homo sapiens
ggaaggaaggaaggaggagggagggagggaaggaaggaaggaaggagaaaaagggtccttcaaaagaaagaaagaaggaaggaagaaaggaaggaaggaargaaagaaagaaaggagaaaaagtgtccttcatcagaatgcaagtatttttggtaaatgattttaagatccctgctttgaaaaacaattccatggatggtc

SEQ ID NO: 50802 - DNA, 201 bp, Homo sapiens
tgttgacagtggggtgttaaaagtctcccattattattgtgtgggagtctaagtctctttataggtcactcaggacttgctttatgaatctgggtgctccygtattggatgcatatatatttaggatagttagctcttcttgttgaattgatccctttaccattatgtaatggccttgtctcttttgatctttgttggttt

SEQ ID NO: 50803 - DNA, 201 bp, Homo sapiens
tagatgattgcttgggtgctttgagaacatgtagaagggaaccaagtcctgattcggaggttcaggaaaggctttcagaggacaaggtatcgcgggtgggratggaagatgtatgggaattagccaaaaggacaggggttcagaggtgagccaagtctgtcctgaaagtaagcagaaatgttgttgttcttgtcgttttga

SEQ ID NO: 50804 - DNA, 201 bp, Homo sapiens
gtagctcggagtagtttgatcatctgaagacttcttctctcaactcgtcaaagtcattctccatccagctttgttccgttgctggtgaggaactgcgttcstttggaggaggagaggcactctgctttttagagtttccagtttttctgctctgttttttccccatctttgtggttttatctacttttggtctttgatgat

SEQ ID NO: 50805 - DNA, 201 bp, Homo sapiens
tattgtgtgggagtctaagtctctttataggtcactcaggacttgctttatgaatctgggtgctcctgtattggatgcatatatatttaggatagttagctcttcttgttgaattgatccctttaccattatgtaatggccttgtctcttttgatctttgttggtttaaagtctgttttatcagagactaggattgcaacc

SEQ ID NO: 50806 - DNA, 201 bp, Homo sapiens
tgggattggagggagggagagcgttaggaaaagtagctaatgcatgtggggcttaatacctaggtgatgggatgatgggtgcagcaaaccaccatggcacatgtttacccatgtaacaaacctgcacgtcctgcacctgtatcccagaacttaaaataaaaataaaaattaaagaaaattacatacctatggcatttagtt

SEQ ID NO: 50807 - DNA, 201 bp, Homo sapiens
tggctcacgcctgtaatcccagcactttgggaggccgaggcaggtggatccgaggtcaggagaccgagaccatcctggctaacatggtggaaccccgtctytactaaaaatacaaaaaattagccgggtatggcagtgtgtgcctgtagtcccagctactcgggaggctgaggcaggagaatggcatgaacccgggaggcg

SEQ ID NO: 50808 - DNA, 201 bp, Homo sapiens
gcgtctcaaaagccccactgttccccctgtgttcctataataggagcaaagagaggctgatgtctctttggaggtgcaaactcattttgacaaagaatagsaaggcagttaaacagggaaatatcgtactttttttttttttttttgaggtggagtcttgctctgttgcccaggctggagtgcagtggcacaatcatggct

SEQ ID NO: 50809 - DNA, 201 bp, Homo sapiens
gggattggagggagggagagcgttaggaaaagtagctaatgcatgtggggcttaatacctaggtgatgggatgatgggtgcagcaaaccaccatggcacatgtttacccatgtaacaaacctgcacgtcctgcacctgtatcccagaacttaaaataaaaataaaaattaaagaaaattacatacctatggcatttagttt

SEQ ID NO: 50810 - DNA, 201 bp, Homo sapiens
aggaataaaataaaaggaacagtctaaaagaaaatactgttgcagagagatttcatggtagagtagatgaaatatctacagaatgcctgttaagtgtacayagttgaaatgctttataattctttaaaaattaggctgggagcaatggctaatgcctataatcccagcactttgggggccaaggcaggaggatcacttgaa

SEQ ID NO: 50811 - DNA, 201 bp, Homo sapiens
agtcttgctctgttgcccaggctggagtgcagtggcacaatcatggctcgctgcaacctccgcctcccaggttcaggcaattctcctgcctcagcctcccragtagctgggactacaggcgcgtgccaccatgcccggctaatttatgtatttttagtagagacagggtttcaccatgttggccaggatggtctcgatctc

SEQ ID NO: 50812 - DNA, 201 bp, Homo sapiens
catggtagagtagatgaaatatctacagaatgcctgttaagtgtacatagttgaaatgctttataattctttaaaaattaggctgggagcaatggctaatrcctataatcccagcactttgggggccaaggcaggaggatcacttgaatccaggagtttgagaccagcctgggcaatgtagagtgaccccatctctacaag

SEQ ID NO: 50813 - DNA, 201 bp, Homo sapiens
tccagacctgacttcccagcttctgaggctgaaggagaacagatgaggcttgctctggcgtcgttcggtgaaaccactgttcctctctcgctgctttcccrggtttccttgtgcattttgagctgtgcatctgattctttgggtcaaagcaaggactgaaaaagagcagaacacaagaagagatcacaatgaggcaaggtc

SEQ ID NO: 50814 - DNA, 201 bp, Homo sapiens
agggactgtgttcccaaagtttgttagttaggtggctgtttagggaaggaccacacctggttcctgtttgtttgtttcttggtttgtttgttggtttgttwgtttgtttgtttttgaggcagggtcttgttctgttgctcaggttggagtgctgtgactcaatctcggctcactgcaacatctgcctcccaggctcaagca

SEQ ID NO: 50815 - DNA, 201 bp, Homo sapiens
ccgtggtcccacagcatcctgtgaatacctctgttctgacacatcgattttctttccctctggactcttaactccttgcagaacagccactgtcaaaacaygtctcattaattcctttaactgtggtgccaagtttctggtgaggcatgcaggaagtacacaatgaatgcctgctgaactgttcagctggactcaccttgg

SEQ ID NO: 50816 - DNA, 201 bp, Homo sapiens
tgaaagggtcctcccaaaactacacaataagggattaagccagaagtagagcctgtgacgttttacatggccagaaaaactcttgtgctgctgttgatatygttcttctgtttgtttagcaagtctgccttagagagacttcacagcacccctgggcctcacttagcactgatctgtctcccaggagtgggccccggggtg

SEQ ID NO: 50817 - DNA, 201 bp, Homo sapiens
attgtgtgggagtctaagtctctttataggtcactcaggacttgctttatgaatctgggtgctcctgtattggatgcatatatatttaggatagttagctcttcttgttgaattgatccctttaccattatgtaatggccttgtctcttttgatctttgttggtttaaagtctgttttatcagagactaggattgcaaccc

SEQ ID NO: 50818 - DNA, 201 bp, Homo sapiens
ttgtgtgggagtctaagtctctttataggtcactcaggacttgctttatgaatctgggtgctcctgtattggatgcatatatatttaggatagttagctcttcttgttgaattgatccctttaccattatgtaatggccttgtctcttttgatctttgttggtttaaagtctgttttatcagagactaggattgcaacccc

SEQ ID NO: 50819 - DNA, 201 bp, Homo sapiens
acatgagatgggtttcctgaatacagcacactgatgggtcttgactctttatccaatttgccagtctgtgtcttttaattggagcatttagtccatttacrtttaaagttaatattgttatgtgtgaatttgatcctgtcattatgatgttagctggttattttgctcgttagttgatgcagtttcttcctagtctcgatg

SEQ ID NO: 50820 - DNA, 201 bp, Homo sapiens
gtctcccaggagtgggccccggggtggtggagggtcagggatggggttgccgtgcacatcagtctgctccatctaaaaaagctcaccgacatcaaaacatstggctttcctagaaaatactggaatgtctggaatttttttttttttttttttttttttttttttgacagagtcttgctctgtcacctaggctggagtgca

SEQ ID NO: 50821 - DNA, 201 bp, Homo sapiens
ttacgtttaaagttaatattgttatgtgtgaatttgatcctgtcattatgatgttagctggttattttgctcgttagttgatgcagtttcttcctagtctygatggtctttacattttggcatgattttgcagcagctggtaccagttgtgcctttccatgtttagtgcttccttcaggagctcttttagggcaggcctgg

SEQ ID NO: 50822 - DNA, 201 bp, Homo sapiens
tttttttttttttttttttttttttttgacagagtcttgctctgtcacctaggctggagtgcagaggcgcgatcttggctcactacagcctccacctcccrggttcaagcgattctcctgcctcagcctcccgagtagctgggattacaggcgtgcgccaccacacccagctaatttctgtgtttttagtagagacggggt

SEQ ID NO: 50823 - DNA, 201 bp, Homo sapiens
agcttagtttggctggatatgaaattgtgggttgaaaattcttttctttaagaatgttgaatattggtccccactgtcttctggcttgtagagtttctgcygagagatcagctgttagtctgacgggcttccctttgtgggtaacccgacctttctctctggctgcccttaacattttttccttcatttcaactttggtga

SEQ ID NO: 50824 - DNA, 201 bp, Homo sapiens
ctcaaatacagtgacttgaccactacacattctgtgtacgtaacaaaataccacatgtgccccataaatatgcaaaatatgatgtatcaataaaaacaaamacacacaaaactcaaagaacaataaaacaaagacggtgaagaggtaaagagaatttctagaacctggcctgtttttagattattaaatgtttcctttttt

SEQ ID NO: 50825 - DNA, 201 bp, Homo sapiens
ctttggaggccgaggtgggtggatcacttgaggtcaggagatcaagaccagcctgatcaacatgtgaaaccctgtctctaccaaaaatacaaaaattatcygggcatggtggtatgcacctgtaatcccagctactcgggaggctgaggcaggagaattacttgaacccaggaggcagaggttgcagtgagccgagattgt

SEQ ID NO: 50826 - DNA, 201 bp, Homo sapiens
gtttggctggatatgaaattgtgggttgaaaattcttttctttaagaatgttgaatattggtccccactgtcttctggcttgtagagtttctgccgagagwtcagctgttagtctgacgggcttccctttgtgggtaacccgacctttctctctggctgcccttaacattttttccttcatttcaactttggtgaatctga

SEQ ID NO: 50827 - DNA, 201 bp, Homo sapiens
cttctgttaatacttaaggtaccttatgtaagtggaatcattcagtatttgtctttccctgcctggcttacttcacttagcataatgttatcaaggttcaytcacgtagcatgtgacaggtttcccttcaccttgaaggctgaataatattcctctgtgtggaggtaccacattttcttcaacgccttccctatccctcct

SEQ ID NO: 50828 - DNA, 201 bp, Homo sapiens; identical to SEQ ID NO: 9400

SEQ ID NO: 50829 - DNA, 201 bp, Homo sapiens
cgggagaatttcttgagcctgggaggtggagattgcagtgagccaagatcatgccattgcactccagcctagcctggcagacagagtgagactctgtctcaaaaaaaaaaaaaaaaaaagatgaattttatgttatgtgctttttaccatgataagaaaagctacataattgcagtttttgtcattacttttaatggcaaa

SEQ ID NO: 50830 - DNA, 201 bp, Homo sapiens
gtgaacaaggtgcaaggtggagagtaagcatgtggcctactgagactctgtggtccgggaatctccccaacggagggaacattgaaactgacagctgaagrgtgacagagctggttaggtgaagagcaggaggaaggaagctccttacaggctggaagaccctgctgagggagagtccaacgtgttccaggaactgaaatg

SEQ ID NO: 50831 - DNA, 201 bp, Homo sapiens
gcttccctttgtgggtaacccgacctttctctctggctgcccttaacattttttccttcatttcaactttggtgaatctgacaattatgtgtcttggagtygctcttctcgaggagtatctttgtggcgttctctgtatttcctgaatctgaatgttggcctgccttgctagattggggaagttctcctggataatatcct

SEQ ID NO: 50832 - DNA, 201 bp, Homo sapiens
tgtgtctttatagcagcatgatttatagtcctttgggtatatacccagtaatgggatggctgggtcaaatggtatttctagttctagatccctgagaaatygccacactgacttccacaatggttgaactagttgacagtcccaccaacagtgtaaaagtgttcctatttctccacatcctctccagcacctgttgtttcc

SEQ ID NO: 50833 - DNA, 201 bp, Homo sapiens
gactttaaatcctcctccctaacagatagactcagaccccgctatcgagctgtaggtagctcttagagatctttcatttctagatttgagtgctttggggktttttttgtttttgagatggagtttctctcttgttgcccaagctggagtgcattggcatgatcttggctcactgcaaccactgcctcccaggttcaagcg

SEQ ID NO: 50834 - DNA, 201 bp, Homo sapiens
aaacttcccttctcacttcatttcattcatttcatcttccatcactgatactctttcttccagttgatcgcatcagctcctgaggcttctgcattcttcaygtagttctcgagccttggctttcagctccatcagctcctttaagcacttctctctattgcttattctagttatacattcgtctaaatttttttcaaagtt

SEQ ID NO: 50835 - DNA, 201 bp, Homo sapiens
tttagttgaattagatcccatttgtcaattttggcttttgttgccattgcttttggtgttttagacatgaagtccttgcccatgcctatgtcctgaatggyaatgcctaggttttcttctagggtttttatggttttaggtctaacgttgaagtctttaatccatcttgaattaatttttgtataaggtgtaaggaaggga

SEQ ID NO: 50836 - DNA, 201 bp, Homo sapiens
accagaggagatggaaggaatcctccaagcggggaggttggtggtttataccagtgagacgtcagcagaggtggagcaaaggggcaggttctcaggtgatwttgatgttagaaatgactggatttgccaaaagattagatgaaagaggtggatataaggatgatgccgcaggttctggcttctgcccgaggccgagcagtg

SEQ ID NO: 50837 - DNA, 201 bp, Homo sapiens
caccacgttggccaggctggtctcaaactcccgacctcaggtgatccactagcctcggcctcccaaagtgctggaattacaggagtgagccactgcacccrgcctagatttgagcactttgctatcctaggttctctttcctggcacaggacacaatttgattctgcatgtcagtgattagagttgtgccccctgaactga

SEQ ID NO: 50838 - DNA, 201 bp, Homo sapiens
ttcttccagttgatcgcatcagctcctgaggcttctgcattcttcacgtagttctcgagccttggctttcagctccatcagctcctttaagcacttctctstattgcttattctagttatacattcgtctaaatttttttcaaagttttcaacttctttgcctttggtttgaatttcctcctgtagctcggagtagtttga

SEQ ID NO: 50839 - DNA, 201 bp, Homo sapiens
acttaatacttagtcatgtcattttcaattattaaaaataaattcatcacgcctgtaatcccagtactttgggaggctgagatgggcagattgcctgagckcaggaattcaagaccagcctgggcaacatggtaaaaccccatctctactaaaatacaaaaaattagctgggcgtggtggggcgcacctgtagtcccagct

SEQ ID NO: 50840 - DNA, 201 bp, Homo sapiens
tggaggaaggaaaagagaaagcaacaagtgccttcgaggaaaaaggaagatctatgagataattatcttagagaaagcaaggtgactcgtgaaaagcagtmagactgtggagcagagctgaaagtccatttgaatttgacggagtcagcctgctcaggagtatgattttctccaacaaaggggcaggttcagagaaggcga

SEQ ID NO: 50841 - DNA, 201 bp, Homo sapiens
agcggatcacctgaggtcaggagtttgagaccagcctgaccaacatggagaaacacggtctctactgaaaatacaaaattagccaggcatagtggcacacrcctgtgatcccagctactcagaaggctgaggcaggagaaaatgggcatttatgttatatagagggtttttttttattttactcagtcttttgtttcccat

SEQ ID NO: 50842 - DNA, 201 bp, Homo sapiens
aaaaattccatgtcgatcactagcatccctctcccactcccctctccctaccccgataagccttcacatttattttgagacagaaaagagaatggctgggytctgattctgactgccaagcttatagatatcccagctctagagctgcgtgtcctgggcaagtttcttaccttctctgtgcttcatttcctcgtctgtcaa

SEQ ID NO: 50843 - DNA, 201 bp, Homo sapiens
ttgagaccagcctgaccaacatggagaaacacggtctctactgaaaatacaaaattagccaggcatagtggcacacgcctgtgatcccagctactcagaakgctgaggcaggagaaaatgggcatttatgttatatagagggtttttttttattttactcagtcttttgtttcccatagttttttattagaaatattcagt

SEQ ID NO: 50844 - DNA, 201 bp, Homo sapiens
agtatactgaaagatagcattttactccaaattttttcccactgacagatttttatctttgtaatgagtttatatatatatatatatatctatatatatakatagatatatgtttctatttaacttttaagtatattctgtaaatatctttgtttcaataagtaataagccactggttataaaatattccattatagttac

SEQ ID NO: 50845 - DNA, 201 bp, Homo sapiens
gaaaatggagctggggctaccgaagttgaaacctgacaccttctaaatagggcgaatgtgagttatgcgagttttgccgacaatgtggaatttggagcacwatcatgaaaaaaaaaaatcctttctatagtaaagattttaggccgggcacggtaacagacctgtaatcccagcactttgggagggcaatgcggaaggatg

SEQ ID NO: 50846 - DNA, 201 bp, Homo sapiens
agaaatattgttgacttcttcactctaacaaactctgagagtacaggctattaccatcttagcagcaatctccagaattcaccatcaaaacggaattcagygccctatccgtggtagcccaggatccatcgagaatacaggcacagtattacaggtggaaactgggctctgagaatcacaaggtgtgagccaggagctccc

SEQ ID NO: 50847 - DNA, 201 bp, Homo sapiens
cctgtctcaagaacaacaacacaacaacaaagattttaaatatgcagaaaagattttgcttcaggtgaatttttctggctatatctatgcctatatactcrgtctagtaatggttaatagttgaccgggcgcggtggctcacacctgtaatctcagcactttaggagaccgaggtgggcagatcacttgaggtcagaagtt

SEQ ID NO: 50848 - DNA, 201 bp, Homo sapiens
tgcaagctgccaccagcaccccgttctccacccacctgacaggtgctcgagtatttccctctcctctttctttttctttaacatcttatgtgacttataargatgacagaaaactttggttctttttcttcgagttacctttcataacaggttgtagatgtcaatttacgccatcagttcatgcgtgcaagaaatatcact

SEQ ID NO: 50849 - DNA, 201 bp, Homo sapiens
attctcctgcctcagcttcccgagtacctgggactacttgcgcacacaaccgcacccagctaattctttgtattttagtagagatggggcttcaccatgtygcccaggctggcctcaaatgcctgagctcaggcaatccgcccacctcggcctcccgaagttgtcagattacatgtgtgagccaccatacccggccaacgt

SEQ ID NO: 50850 - DNA, 201 bp, Homo sapiens
agtgcttgtgtattttgcatatatggtcttttactgattggaatttgtttcttaagttgaactatttcccagtctattgaagaaagagacatagtccacastccaaaatccaaatgccaggctcacagacagggggtgctgccctcacagacagatggaaaggtattaaagctgcctgaactgtaggaaaccctctaaaca

SEQ ID NO: 50851 - DNA, 201 bp, Homo sapiens
cagtacagtggcatcgcagaaggacaggtgggaggggaagggataggctgcatcagctgcctttgaaaacgccatcgagcaatagtattgcagccatttayaccataatatttcctacagaggacctcgtttagtttccgagattgagcctctagtctcgctcttcacaccgctgaagatgtgcggtagaggatcttgctg

SEQ ID NO: 50852 - DNA, 201 bp, Homo sapiens
cagttgatcgcatcagctcctgaggcttctgcattcttcacgtagttctcgagccttggctttcagctccatcagctcctttaagcacttctctctattgsttattctagttatacattcgtctaaatttttttcaaagttttcaacttctttgcctttggtttgaatttcctcctgtagctcggagtagtttgatcatct

SEQ ID NO: 50853 - DNA, 201 bp, Homo sapiens
attctgtcccatattgtctctgattgtttatgtgctacttttgtcttcccaacagaattctatatcccagagaacagagggagcaggtgctactgttgagytgaactgaattattttccaggcctggctgaaggaataatgagaccttacgtttctgttcctagagaacgggcagatgtatatccagaaaaagcctaccat

SEQ ID NO: 50854 - DNA, 201 bp, Homo sapiens
tctagttatacattcgtctaaatttttttcaaagttttcaacttctttgcctttggtttgaatttcctcctgtagctcggagtagtttgatcatctgaagmcttcttctctcaactcgtcaaagtcattctccatccagctttgttccgttgctggtgaggaactgcgttcctttggaggaggagaggcactctgcttttt

SEQ ID NO: 50855 - DNA, 201 bp, Homo sapiens
ttttaaaaatcttggttttggccaggtgcagtggctcacacctgtaatcccagcactttggtaggctgaggcgggtggatcatgaggtcaggagatcaagmccatagtggctaacacggtgaaaccccgtctctactaaaatataaaaaattagctgggtgtggtggcacgtacctgtaatcccagctgctcaggaggctg

SEQ ID NO: 50856 - DNA, 201 bp, Homo sapiens
cgggtcatgaggtcaggagatccagaccatcctggcttacacggtgaaaccccatctctactaaaaatacaaaaaaaattagccaggtgttgtggcgggcrcctgtggtcccagctacttgggaggctgaggcaggaaaatggtgtgaacccgggaggcggagcttgtagtgaaccgagatcacaccactgcactccagcc

SEQ ID NO: 50857 - DNA, 201 bp, Homo sapiens
tttagtagagacagggtttcaccatgttggccaggatggtctcgatctcttaacctcatgatccgcccgccttggcctcccaaagtgctgggattacaggygtgagccactgcgcccagccggaaacatcatactttctatggcacactagacactcagtaaatccagatgggattgcaatgcatggaagcagctccctgg

SEQ ID NO: 50858 - DNA, 201 bp, Homo sapiens
tcaggagaagagtgactgatctcagctggcccttcttctgtacctgggaagatgagcttgaaatcaacattgtcagttgagttcctaaaacagaactcagttttagaagttaagcttaggttgcagtcctagggttgcaatcggcataggcttgttttgtaggggaatgtggatcctgaaggatttaggggccagaaagga

SEQ ID NO: 50859 - DNA, 201 bp, Homo sapiens
aattagccaggtgttgtggcgggcgcctgtggtcccagctacttgggaggctgaggcaggaaaatggtgtgaacccgggaggcggagcttgtagtgaaccragatcacaccactgcactccagcctgggcgacagagcaagactccatctcaaaaaaataaaaaataaaaaaaataataagttagtgggatctggatataa

SEQ ID NO: 50860 - DNA, 201 bp, Homo sapiens
aagtaggagaatcgcttgaacttgggaggcggaggttgcagtgagctgagatcgcgccactgcactccagcctggccaacataagcgagactctgtctccaaaaaaaaaaaaaaaaaaaaaaaactgagcatagtgtgaccatgacagcttgaggtttaaaaccaagaggcacattatgctatggaaggaacatcacgtgg

SEQ ID NO: 50861 - DNA, 201 bp, Homo sapiens
acttcaataattttaaagtcattagttgttgggactctgaaaatgtaggaatcctgttatgcatgacagatttccacggtgggcaacagtcacctagcacrtgcctggtagttcagctgtaatgtgggctaaaagctgatggaaagcctaacccctttttaaacagtatttctatgactggctgaactccgtggtggatgg

SEQ ID NO: 50862 - DNA, 201 bp, Homo sapiens
aataagttagtgggatctggatataaagttttttattttatataaaggcaggttcaaacactattacaattgctacatttgtagcaataaatgtagcaatsgtaataatgaactcagtgtgaaatgtgtcagcttgggctccataacaagatatcacagactgagtgggttaaacaacagacatttctttctcacagtttt

SEQ ID NO: 50863 - DNA, 201 bp, Homo sapiens
agtaggagaatcgcttgaacttgggaggcggaggttgcagtgagctgagatcgcgccactgcactccagcctggccaacataagcgagactctgtctccaaaaaaaaaaaaaaaaaaaaaaaactgagcatagtgtgaccatgacagcttgaggtttaaaaccaagaggcacattatgctatggaaggaacatcacgtggt

SEQ ID NO: 50864 - DNA, 201 bp, Homo sapiens
acaaatgagatcacacttaaagctgaaaatagtgagcctctaagagtaaagatcctttgtaattttaaagtacataggggccgggcgcgatggctcactcytgtaatcccggcactttgggaggccaaggcggatggatcacctgaggtcaggagttcaagaccagcctagccagcatggtgaaacccagtctctactaaa

SEQ ID NO: 50865 - DNA, 201 bp, Homo sapiens
aatcgcttgaacccaggaggcaaaggttgcagtgagccaagatcgtgccattgcactccagcctgggcaacagggcgagactccgtctcaaaaaaataaataaataaataaataaataaataaataaataaataacataacataacatcacataacataacatagtacatatcatgatggtgttttgcagctggggtagca

SEQ ID NO: 50866 - DNA, 201 bp, Homo sapiens
ttgggctccataacaagatatcacagactgagtgggttaaacaacagacatttctttctcacagttttagaggcagaaagtccaagattaaggtccagcartgtcagttcctgatgaggactctcttcctggctggtagacagctgccttcttgttgtgtccttacagcagagagagagagagataaactctggtctctct

SEQ ID NO: 50867 - DNA, 201 bp, Homo sapiens
cctaacagatagactcagaccccgctatcgagctgtaggtagctcttagagatctttcatttctagatttgagtgctttggggttttttttgtttttgagwtggagtttctctcttgttgcccaagctggagtgcattggcatgatcttggctcactgcaaccactgcctcccaggttcaagcgattctcctgcctcagct

SEQ ID NO: 50868 - DNA, 201 bp, Homo sapiens
cttttcttttcttttctttttttaagacagagtcttgctctgttgcctaggctggagtgcaatgacatgatcttggctctctgcaacctctgcagggagcmaagcgattcccctgcctcagcctccagagtcgctgggattacaggtgccccccaccatgcctggctaattgctgtatttttgtagagagggggtttcacc

SEQ ID NO: 50869 - DNA, 201 bp, Homo sapiens
taaactctggtctctctttcatgtgagacttctagccctattggatcaagaccttaccccatgacctcatttaacccgaattatctccataaagcccttayctacagttacattgtgggttagggcatcaacatgtgtattttgagaggacgccattcagtccaaagcatgaggctgcactgcaaagcctgggccagcaaa

SEQ ID NO: 50870 - DNA, 201 bp, Homo sapiens
agtttctctcttgttgcccaagctggagtgcattggcatgatcttggctcactgcaaccactgcctcccaggttcaagcgattctcctgcctcagcttccrgagtagctaggattacaagcacccaccaccacacctggttaatttttgtagttttagtagagatagggtttcaccacgttggccaggctggtctcaaact

SEQ ID NO: 50871 - DNA, 201 bp, Homo sapiens
tgtataagaccttaccaataggaataacacttgataaataatattgtaatactctggtgatccagtctgatgcagtatccctaaatctgggaaaggttgtaaaaaaaaaaaaaaaaaaaaaaaaaaaaaaaaaagatgctatcttaaagatgcatttttttctggcatgtagaagttggaaacagactaaatatgtagcta

SEQ ID NO: 50872 - DNA, 201 bp, Homo sapiens
aattagccaggtgtggtggtgggcgcctgtagtcccagctactcgggaggctgaggcaagagaatggcatgaacgcgggaggcggagcttgcagtgagccragatcgcgccactgcactccagcctgggtgacagagcaagactccatctcaaaaaaaagaaaaaaaacactctttacttcctcatttatccatccaggat

SEQ ID NO: 50873 - DNA, 201 bp, Homo sapiens
agccaagcgggaagggggaagccccttatgaaactatactctcactatcataagaacagcatggggggaaaccgcccccatgattcaatcacctcccatcragtccctcccgtgacacatggggattataggattataattcaagatgagattctgggtggggacacaaagccaaaccatatcagccagtacagttgacct

SEQ ID NO: 50874 - DNA, 201 bp, Homo sapiens
gcctgtagtcccagctactcgggaggctgaggcaagagaatggcatgaacgcgggaggcggagcttgcagtgagccgagatcgcgccactgcactccagcstgggtgacagagcaagactccatctcaaaaaaaagaaaaaaaacactctttacttcctcatttatccatccaggatgtcctgtctatttgtttgaaaatg

SEQ ID NO: 50875 - DNA, 201 bp, Homo sapiens
aaacgtctgagtttttcaaagccgcctttgacttaatgggtctcctggatccagttctctttaccatctcaggtctccctgacatttgcttcctgagggcttttttttttttttttttgcatttggccttgcctttgaacttggtctaatgagccatgtggatcgagagtccttgtcagaaaagaaggaaactggttttcc

SEQ ID NO: 50876 - DNA, 201 bp, Homo sapiens
tctcggctcactgcaacctccacctcccaggttcaaatgattctcctgcctcagcctcccgcatagctggggttacaggcgtccaccaccacacccggctratttttgtatttttagtagagatggggtttcactatgttggctaggctggtctcaaactcctgacctcaggtgatccacccacctcagcctcccaaagtg

SEQ ID NO: 50877 - DNA, 201 bp, Homo sapiens
aacgtctgagtttttcaaagccgcctttgacttaatgggtctcctggatccagttctctttaccatctcaggtctccctgacatttgcttcctgagggcttttttttttttttttttgcatttggccttgcctttgaacttggtctaatgagccatgtggatcgagagtccttgtcagaaaagaaggaaactggttttcct

SEQ ID NO: 50878 - DNA, 201 bp, Homo sapiens
aatggtgcccggcctccagagcttacagtgtggtaggaaagaagacaaccttggaaaaaagatacaatgtgctaattctccagtggagcgaagatgttgtrtggtacacagatgagagattatccatcaggatgagggggaaggaggccgcttgtcatcaaagtgctagatcctctgaagctcggcttcctcagctgacaa

SEQ ID NO: 50879 - DNA, 201 bp, Homo sapiens
acctaaataatagtatcaatgatgtttaattccttgaataagagaaatacattcctcccattagtttaaatcatgacccaatgtaaattgaaaaagggtcytgtctgggcatggtggctcatgcctgtaattccagtactttgggaggccgaggtgggcagatcacttgagctcaggagttccagaccaggctaggcaaca

SEQ ID NO: 50880 - DNA, 201 bp, Homo sapiens
gttttcggtgagcagaaatgtctggactggagagggtcctaatgggaaatggaaggtcctgtgagtcagcgtcagactccagagagccttgaatgccagcygaggacccgaggatgtcagaactctccaagccctagagatcaccttgtctagcccttcctttacacacgaggaaactgagactcagaaaacttatccaag

SEQ ID NO: 50881 - DNA, 201 bp, Homo sapiens
gtttatttgtgtagaggtgtttgtagtattctctgatggtagtttgtatttctgtgggatcagtggtgatatcccctttatcattttttattgcgtctatwtgattcttctctctttttttctttattagtcttgctagcggtctatcaattttgttgatcctttcaaaaaaccagctcctggattcattaattttttgaa

SEQ ID NO: 50882 - DNA, 201 bp, Homo sapiens
ctccagccctgccttcctgcctttgacgcagggagctaagggtctgaatgaaccctgttggaggttgcaattaaatctttgtggacaaaggcacacacacrcacacatacacagaatcctcagataacaggaggcaataaatccaacagcacatccacgttcagagaacagtgtccctgctgtcttgctaacagctgccaa

SEQ ID NO: 50883 - DNA, 201 bp, Homo sapiens
tttttttttagcgttaaatcgaaagttccctagttaattcccacaattaggaggggcccaccagttccacaaataggaaatctctgcactgctcttgctcrtaaagtgtatttgctttttcataaattgcttatgttctttgagccaccaatggtttaatgtcagaataatatagatcattagagcctctcaagatcccac

SEQ ID NO: 50884 - DNA, 201 bp, Homo sapiens
gtgcctactgtgtgccaggcactcttctaagtgtttattgttcatttattttctcgaatcttcacaagaatgctctaagtcagcaaatggaagtactaagmaatcaggtagtgtgtctaaagtctcacagctaagtgaatggcagacccaggactgaaactgatcattcagatgcttcttttctgtgtcctagtatttcta

SEQ ID NO: 50885 - DNA, 201 bp, Homo sapiens
ccctgctgatcctctgctctccaacaacacacctccttctccctcgcgtttttcttttcttttcttttctttttaattatactttaagttctagggtacaygtgcacaacgtgcaggtttgttacgtatgtatacatgtgccatgttggagtactgcacccattaactcatcatttacattaggtatatctcctaatgcta

SEQ ID NO: 50886 - DNA, 201 bp, Homo sapiens
ggagccccccggcaaaggaagagaagcttgtaaggagcaccgactgttaaaagagaaattcacttctgtttctttccatcatctctctcattccctttcaycctgggctgttatttcctccctctattgctctgttgatactctctctgctttgccatgtttcccaatcccctttcatcttcatatttcttttgtgcactt

SEQ ID NO: 50887 - DNA, 201 bp, Homo sapiens
tgccagcaccatcccacctccagccactgaagccatctcagctcataaaaacaactgcttgcaaggcacaggtttcttggaggaagagactacccgggtcrgggttctgtttgcttcaaaggctgtgatgcaacttctggtcaacccattcgtgggccctctcaccaacaggtatctcactgggtgcagtgccccgcaggg

SEQ ID NO: 50888 - DNA, 201 bp, Homo sapiens
tgctataacaaatacttgaaaatatggaagcagctttggaactggaaaattggtagaggctgcaataatttggaggagcaggctagaaagagcctgtattkctgtggttaaggcattaagggtgattctggtgagggctcagaagaagaggagagctatagagaaagtctgaatctttttagacattggttaagaggttgt

SEQ ID NO: 50889 - DNA, 201 bp, Homo sapiens
catctgcttaccggattagttacgctcaccgatgtagcagtcctgcacctgttttcccgcctttcttgaccacaaagaaaggagtccaggctgctggattmtggtggtccattaccagcgtgcccaacattgcctttgcgatcaggggtgagttcttgagctgggctgcgcaacccagttgccccatcaagatgcattccc

SEQ ID NO: 50890 - DNA, 201 bp, Homo sapiens
atcatttctcaatgacttgtaacacctaatgcaatggaaatgctatataaatagttgttatactgtattattttcttttttgtattatttttatcttgtaytgttatttttattttttttcctcatatatttttgatctgcgattagttgaatccaaggatgtgaaacctgcaaatacaaagggccaagtataatttgttt

SEQ ID NO: 50891 - DNA, 201 bp, Homo sapiens
ttatttattcatcttatttcattcatcagctcatgggcatttgcgtcatgttcacctttcagctgttgtgaataatgctgctctaaacatttatgtataarttgttgtgtgggcatatgttctcatttctcctgggtatatacctaggagtaaaattgttcggtcctgtgataacttgatgttaaaactctgaggaactgc

SEQ ID NO: 50892 - DNA, 201 bp, Homo sapiens
ccgatgagcattagtcctagagtgtcctctatggtcctaatgcttattcctttccagggtgtgtaaccacccagggacatctgcttaccggattagttacrctcaccgatgtagcagtcctgcacctgttttcccgcctttcttgaccacaaagaaaggagtccaggctgctggattctggtggtccattaccagcgtgcc

SEQ ID NO: 50893 - DNA, 201 bp, Homo sapiens
cagtgttgagaagtggaacctttagtaggtgataaagtcctaggggcaccacctttatgaatagattaaagcaattatcataggagtgggttagtcacaaraggggggagtttggcccctttttcttttctctctcaaatgccctttctccatgtgatacccttcggctgtattatgacccaacaagaagtccctcaccag

SEQ ID NO: 50894 - DNA, 201 bp, Homo sapiens
tctgttagtggcttctgactcagaggaccttcgtcccctgggacagtgggccttccagtgattctcttgacataaggggcatagatgagggggtggcttayttctattcggacaatcttttttaaagcgtccttgtagactgcactagaagcaagccctattaggcatttgatttgcccaggctttccatattccagagcc

SEQ ID NO: 50895 - DNA, 201 bp, Homo sapiens
ctggctggaatgcctggggtttatatcccgatcattgtccctccctctgtgctctcaggtgatagattatttgattatttctttacctcctgcttttagcstaattggtattttagtgagctctctttactatgtgattggtcaggtgtgagctgagttactagccccttgtttaaaggtgggtgtggtcaccttccccag

SEQ ID NO: 50896 - DNA, 201 bp, Homo sapiens
aagatacagagattgaaatgtatagcctaaagtgcagcgggaggtacatccaacagttagtaggattttggccaaggttccatcgagcctagtgagggtgrtattaaataggcttaccaggcaagtatgggtacagagggtcttcaaaggcatacaagaattgagagtcaggatgtacagggatgtagaaaaaggcatcct

SEQ ID NO: 50897 - DNA, 201 bp, Homo sapiens
aggtcaagcatacccagggctctgtgagggtgatgacatgggctggcacttgccctgggcaccctcagtcctgctgctggatcatctgttagtggcttctsactcagaggaccttcgtcccctgggacagtgggccttccagtgattctcttgacataaggggcatagatgagggggtggcttacttctattcggacaatc

SEQ ID NO: 50898 - DNA, 201 bp, Homo sapiens
gctatgtcctccaaaatttgtgtgttggaaacttaatccccaatgcaacagtgttgagaagtggaacctttagtaggtgataaagtcctaggggcaccacmtttatgaatagattaaagcaattatcataggagtgggttagtcacaaaaggggggagtttggcccctttttcttttctctctcaaatgccctttctccat

SEQ ID NO: 50899 - DNA, 201 bp, Homo sapiens
gggctctgtgagggtgatgacatgggctggcacttgccctgggcaccctcagtcctgctgctggatcatctgttagtggcttctgactcagaggaccttcrtcccctgggacagtgggccttccagtgattctcttgacataaggggcatagatgagggggtggcttacttctattcggacaatcttttttaaagcgtcct

SEQ ID NO: 50900 - DNA, 201 bp, Homo sapiens
gccatccttgttatacagttacaaaaaacttggcagacttgtatccataacctaggacttcatggaatgaagaacttagaggcaataaactaggatatctrgcagaagaaatatctaagcagcaaagcttcaggctgctttgtggctgttttaactgcatatatagtgacatgtgaaagcaaagaaatgatttaaaggtga

SEQ ID NO: 50901 - DNA, 201 bp, Homo sapiens
aacaaccagctcttgtgtgaacttacagagcaagaagtcactcattaccgtgaggatggggacagcaccacgccattcacgagggattcattcccatgacycaaacacctcccactcagccccacctttaccactggagatgaagttataacgtgaaatttcaagaggacaaatatcaagcaatatcaccttgatgtcagt

SEQ ID NO: 50902 - DNA, 201 bp, Homo sapiens
tcggataagttatttaacctctttgacctctgatatggtgtgaatgtgtcccccaaaatttatatgttgcaaattgaatccccagtgcaacagtcttgagmagtgggacctttgagagatgatgagatcatgggagcaccctcatgaatggattaaggccattatcatgggagtgagtttgtcataataaaaggggagttc

SEQ ID NO: 50903 - DNA, 201 bp, Homo sapiens
agcatgcaataaaaagcactaaatctaattttgggggggcaattctaagcaagactcccagctgcactcctagtgccaaattgaatttttatgggttgcargtgcttttgaccatgacgattaattgagttagtcggtattcagtgcagataattcatcgcctgccctaaggctctgaccactcagggtctcgatactagt

SEQ ID NO: 50904 - DNA, 201 bp, Homo sapiens
aaaaattagcctggcgtggtgatgggcgcctgtagttccagctactctggaggctgaggcaggagaacggcatgaacccgggaggcggagcttgcagtggsccgagattgcgccactgcactccagcctgggcaacagagcgagactccgtctcaaaaaaaaaaaaatgataataatgtgcagtggcttctcttcttgcct

SEQ ID NO: 50905 - DNA, 201 bp, Homo sapiens
cttctgcaataaaagacatcctctgtgaatatccctaactgtcattctgtcacagttaataaatatcagagttggtacttgtttgactctaagccaaaaayggctctggaaaatccatatcccaccacgaaggaaaaaaagtaagaaagtgcatcaagtgtaaaaatgtttgatctaaaggccttgactttgcattccaca

SEQ ID NO: 50906 - DNA, 201 bp, Homo sapiens
ctgccaatacctcactgagtgcctcacaccaacatgggctccaaggtaagatttttctctctccggacaaatttaatctttccttgtgatttgtgtctctrtcagaggattttgactgttaagtaaagtttactattgatttgttggcaaattcctggttttgtttgtttttgttttgggatttgggtgtgtgtgtttctc

SEQ ID NO: 50907 - DNA, 201 bp, Homo sapiens
tggagaggaggatctagcccttcccaggaaccctgaggaaagaggacagggaaggctacgtgcaaattgctccatcactgcagggaggagaggcttacggrgccagaggggaagctgataagaacatgatatagttcagcatgcaataaaaagcactaaatctaattttgggggggcaattctaagcaagactcccagctg

SEQ ID NO: 50908 - DNA, 201 bp, Homo sapiens
tggtttcagctcctttgattttctgtgaaaacttgtgcagatgccttaaaccctctgagcatcacttttctcattgctaaaatgagcatcaaaatactatstagttcaagagaaattggatgaataaatgacatatgaggtgaaaatgctttgtaccctgtacaatattaatgtgcaccattaccatccacattctcctcc

SEQ ID NO: 50909 - DNA, 201 bp, Homo sapiens
cagaccatgtgctcccccaagtggcagctgggtaagtgacctcagcacccccgctcagggcctggcaggaggaggtgggtgccatgagtcctttcgttcartgtcacacagggacaacatgcttcctttgtagaatgacctcccacgtccacacccatgaatcaagcccaagagggtgtgtggtccctcagagaagcagtc

SEQ ID NO: 50910 - DNA, 201 bp, Homo sapiens
agagggtccagctgccgtacagcactagcccacactttcttccaggtctgcagtgctttcctgctcttccctgggcacccctgttaaatagaatggtctcwgtgtgcctagattttcctttccctgatctgctctgtaacccctcattttgggaaatgtgctaggaaatgataaaatgttatgaaacatggtataatcaga

SEQ ID NO: 50911 - DNA, 201 bp, Homo sapiens
ttatagttataaatagtgctgtaatttgcatgactgcatgtttataatgttgtcattaatctttagagtcaattcctagaagtgggactgttgggtcaaasggtttattgtacttttaaatgtatattttaatgatttacatcagtttctttacttcgaataataattgggtaagcgaatgatctctttagttttaggatc

SEQ ID NO: 50912 - DNA, 201 bp, Homo sapiens
ccgcagtctcctgagatgctctgctctttacagactggctttaggagtaggatgtctgggtcctggagagggaagtcataaccaccacccatccaggactyctcagggcaaggagcaccaaataccctctgcacaggctcccaggcctggcatatgcttgggcccagcacccctccagccctggcccaggcgtagggacac

SEQ ID NO: 50913 - DNA, 201 bp, Homo sapiens
taaatatggataattctcactgcaaaggactcaccctcacctctggaatctgtgtctcctatgcctctccagtgggagctccctttggaagtgtaatgtaygagtttgttgggaagtctgcacccttcctcatcctggccttcctggcactactggatggaggtaagtcaccatcagagcctccagcaggtgacagcccag

SEQ ID NO: 50914 - DNA, 201 bp, Homo sapiens
gagattgttgatgcccgttactacccttaaaccctccaccccccaactaggagccatgcctaatgtaatcaagagtgaaatggtggcccatgtaaagggtycaaagtgaaaaaaataattgctttggtattcctaaatagaatgaccaactctcctggtttgcctagaattgaggggtgtcttagtccatttagcattgct

SEQ ID NO: 50915 - DNA, 201 bp, Homo sapiens
gcagcaaactatagcgatgaatacattctgctgatgtctttgtttcctatccctatttctcgctctaggtttacattttaaaactgtttccatctaggccrcgcgctgtggctcgcgtctgtaattccagcactttgagaggccaaggcaggaggatcacttgaggtcaggacttcgagaccagcctggccaacatggtga

SEQ ID NO: 50916 - DNA, 201 bp, Homo sapiens
aataaaagacatcctctgtgaatatccctaactgtcattctgtcacagttaataaatatcagagttggtacttgtttgactctaagccaaaaacggctctrgaaaatccatatcccaccacgaaggaaaaaaagtaagaaagtgcatcaagtgtaaaaatgtttgatctaaaggccttgactttgcattccacagcttgtc

SEQ ID NO: 50917 - DNA, 201 bp, Homo sapiens
tagcatggttacagtaaactgaaaaaatatatctatttgatctaatatgtattatccctataatatatgagtatgtattagaaacatgcccaaatagtacrtaatccataaatgatagctactgttattgttgctgttattcttattattgcccaacatgtgatgattcttagtctatacctgctttcccaggccctcaat

SEQ ID NO: 50918 - DNA, 201 bp, Homo sapiens
ttgcatgcaacattttactgtcaaactttcaccatgctttaattatttgtgtccctccctacacacacacacacatacatacacacacgcgcgcacacacrcacacacacaaacacacacacttcctccactagaaagtgggcttgatggggacagggatcatgtctccatctctgaattcccagagcctcaggtggagct

SEQ ID NO: 50919 - DNA, 201 bp, Homo sapiens
attttactgtcaaactttcaccatgctttaattatttgtgtccctccctacacacacacacacatacatacacacacgcgcgcacacacacacacacacamacacacacacttcctccactagaaagtgggcttgatggggacagggatcatgtctccatctctgaattcccagagcctcaggtggagcttagcccctagc

SEQ ID NO: 50920 - DNA, 201 bp, Homo sapiens
catgtatatctggagatctccatatatatatatatatgtgcacacacacatgtaattatagctaggagataatgacattggggactgagtatttggagctrtaacatcatctcagagatgaaggctgtgggggccacctagacaacatcttctgcaataaaagacatcctctgtgaatatccctaactgtcattctgtcac

SEQ ID NO: 50921 - DNA, 201 bp, Homo sapiens
tgcaggaacccaggcatgcctgccaaaccataagaagaaaagtgaagaggaatagggtcagcgaaagtgagaactgtgtttggattccaggatagggttaygtttcaggtagtgtgggggatagtgacgtatttggcttgatgttggacaaagatggtggaagaaccttgtgcataatcaaagaagccatagagaatctat

SEQ ID NO: 50922 - DNA, 201 bp, Homo sapiens
gatggctgaatgcaggaacccaggcatgcctgccaaaccataagaagaaaagtgaagaggaatagggtcagcgaaagtgagaactgtgtttggattccagkatagggttacgtttcaggtagtgtgggggatagtgacgtatttggcttgatgttggacaaagatggtggaagaaccttgtgcataatcaaagaagccata

SEQ ID NO: 50923 - DNA, 201 bp, Homo sapiens
ccttgagaggggtgctttcgatgtcatcaacattggagcatgggctagcaggccagtccaggggtctgtagtagatcttagtcacagactgcatctggggytccatttgaagaaccatttatagttttacagcttcaattctggaagagacaaacttaaccaggaggttaagatacagagattgaaatgtatagcctaaag

SEQ ID NO: 50924 - DNA, 201 bp, Homo sapiens
ggcatcagacaagtcactttctctccctgtactggggttcctggtctctgcagtaaaggagatactgtagatggtctctaagcccataattgtactttctmagattctgtgaaaataggagagatgtatgcactgtacaaatggacattttttgttatccatgttctcagagtgccaaggggactcccctctttatgcttc

SEQ ID NO: 50925 - DNA, 201 bp, Homo sapiens
atatttttctataccttgcatataaattaaacttaacaaggagccattgccaacgctaatatctcaagaatctgtggtggattttaaacgcgtcagctctscctgtgaaattctgcgcacacaatcaaggacagatggggttgagagctgaattgcaagtgaaagctggaatgtccttattcccattctgaagcaccaggg

SEQ ID NO: 50926 - DNA, 201 bp, Homo sapiens
agacttttaaaacaattcttgtcaagggttaacaccaggccgggcacagtggctcatgtctgtaatcccagcactttgggaggccaaggcaagagggtcaytcgagctcaggagttcaagaccagcccgggcagcatggcgaaactccttctctacaaaaaatttaaaaattagctaggcatggtggtacgttcctgtggt

SEQ ID NO: 50927 - DNA, 201 bp, Homo sapiens
cctgggcaatagactgagaccctgactcaaaaaataagaagtcaacaccaaacactgtaaagtaagtcaggacactttttaaaattatagatcagaggtakgttaaagatcatatatatagcgtatatatggaagagtataaaaagaagaattccacaaaaataggaaatggaattagtctttattagtggccttataaag

SEQ ID NO: 50928 - DNA, 201 bp, Homo sapiens
cgattattctgatattttcaagagatatacactccacctaggctatcatttctggaaatgagaattttggccctgatctatggtcatatctgcatgtttgkttgtttgctcatactcatccacatgccctatttcatctccacactacattcagaggcatgttttaccatacacccaaatagctgcatttctgctcccact

SEQ ID NO: 50929 - DNA, 201 bp, Homo sapiens
acactttttaaaattatagatcagaggtaggttaaagatcatatatatagcgtatatatggaagagtataaaaagaagaattccacaaaaataggaaatgraattagtctttattagtggccttataaagaaggccactaatataaagaagagaatgcacggtaaatttcccatattcacaggtcagatgaatttcttgta

SEQ ID NO: 50930 - DNA, 201 bp, Homo sapiens
tttaccatacacccaaatagctgcatttctgctcccacttacatttaaaaatgtagtccatgtatgtgagtgcctgttggaattgtatctttttttttttmaattcccttttaggattggatatcatatccccatgtttgctggctttgttatcatgtttctctccacagttagtaagtaatttgcttcctcttttcttcc

SEQ ID NO: 50931 - DNA, 201 bp, Homo sapiens
agaagaggaaactgatgagatgggtctcactatgttgcccaggctggcgttgatctcctgggctcaagagatcctcccatcttggcctcccaaagtaatgrgattacaggaatgatccactgccaccagccaaaatccattttttttggtaacagctttattgagatacaattcacatgccataccgttcatccatttaaa

SEQ ID NO: 50932 - DNA, 201 bp, Homo sapiens
gagtataagtctttggctgcatctctgaccttttttcttttgtaggatgggttccttgtagtagagttactaagtcaaagagtatacaatttttagggccygatagatttcatgatggtaatctattttaaaatttaaatgagtgatattgttgataccacaacagaagccacgtcaaagaaaatgaaattctccccagaa

SEQ ID NO: 50933 - DNA, 201 bp, Homo sapiens
ctcagaacgtgtagtttaggcaaaggcaataatgatggctgaggcactgctgggatgcttggaaagagggtggggcgaccaagtttagatgagagtgtgtyctgacgagagtgggtcctggatgtttaggctgtattttaaccctgcttcttctaccttagttcagtgtggctcaaaatgatcagaatgaagaattcagaa

SEQ ID NO: 50934 - DNA, 201 bp, Homo sapiens
ctaatcgggatgctggtagtaggtaccagcttgctctgtgtaagtataagaagacctgggggaggggaaggagagagagagcgagagacagacagacagasagagagagagagagagagagagagggagagagagagagagaaagacacagacatttaaagactaatttcctttaagatgagcagagatggcttggcaagg

SEQ ID NO: 50935 - DNA, 201 bp, Homo sapiens
cggtggctcacgcctgtaatcccagcactttaggaggctgaggcgggcgcatcacgaggtcaggagatcgagaccattctggctaacatggtgaaaccccrtctctgctaaaaatacaaaaaattagcctggcgtggtgatgggcgcctgtagttccagctactctggaggctgaggcaggagaacggcatgaacccggga

SEQ ID NO: 50936 - DNA, 201 bp, Homo sapiens
caccactttggagaagccctgtacaggccaccagatgttactggagggtctttgttcttagagctcccaagatggggcgggctgctcctaagatggcagcragccttttgttctctgacctggggttcttggcctcacagattccaaggaatggaaccttgggccatgtggtgagtgttatagctctattagaagccgtgg

SEQ ID NO: 50937 - DNA, 201 bp, Homo sapiens
ttggacaaagatggtggaagaaccttgtgcataatcaaagaagccatagagaatctatctatctatctatctatctatatattcgacacatatatggggtrtgtatatatatattcatgtatatctggagatctccatatatatatatatatgtgcacacacacatgtaattatagctaggagataatgacattggggact

SEQ ID NO: 50938 - DNA, 201 bp, Homo sapiens
ttctgcaataaaagacatcctctgtgaatatccctaactgtcattctgtcacagttaataaatatcagagttggtacttgtttgactctaagccaaaaacrgctctggaaaatccatatcccaccacgaaggaaaaaaagtaagaaagtgcatcaagtgtaaaaatgtttgatctaaaggccttgactttgcattccacag

SEQ ID NO: 50939 - DNA, 201 bp, Homo sapiens
caatttgtattcagacccaggcaagagttaaagagttcgatgatagataagcacagatgcaaaacagtacagtccagtgcctctttgcttaggctaatatstgccctctctttatcctctccagccctgccttcctgcctttgacgcagggagctaagggtctgaatgaaccctgttggaggttgcaattaaatctttgtg

SEQ ID NO: 50940 - DNA, 201 bp, Homo sapiens
aatgaggagattggtaaaaaaaagatgtgcggtggttggccgggcgcggtggctcacgcctgtaatcccagcactttaggaggctgaggcgggcgcatcaygaggtcaggagatcgagaccattctggctaacatggtgaaaccccgtctctgctaaaaatacaaaaaattagcctggcgtggtgatgggcgcctgtagtt

SEQ ID NO: 50941 - DNA, 201 bp, Homo sapiens
ttttgggatttgggtgtgtgtgtttctctctctttgtagtacttacttcactcactatgttttttaattttccatggcttgtcttttattcttatccatayatatcctaagtcaatttgtattcagaaatacctcctttatatagagaaatgaaggatcttaagtaattgcatgcatttactggttaaaacttaactgaga

SEQ ID NO: 50942 - DNA, 201 bp, Homo sapiens
ccattgtaaaggccatcggttttccctggctcatggtcatcactggggtcatcaacatcgtctatgctccactctgctactacctgcggagccccccggcraaggaagagaagcttgtaaggagcaccgactgttaaaagagaaattcacttctgtttctttccatcatctctctcattccctttcatcctgggctgttat

SEQ ID NO: 50943 - DNA, 201 bp, Homo sapiens
aacagccactcctggctccttgtcacttctgggttagaatctggcagcatcctccctcttgtgtactccctccttccaccacgatgctgcctgaacaatcytcctgagcccagagcaggtgatgtttctcacctgatgtttctccataggccgcaaggccaagtacatgactcatctgcatatacaaggttcctgcatatg

SEQ ID NO: 50944 - DNA, 201 bp, Homo sapiens
cgccacacctcggtgtatgggagtgtctacgccatcgctgatgtggctttttgcatgggctttgctataggtatgttggcaggacctggtgccccactttyccctgtctactctttaccagctggaagtgcagccaggaagctatcctcctagggttctggagatctttgacgctgagacatcctctgggtcacccactgc

SEQ ID NO: 50945 - DNA, 201 bp, Homo sapiens
cttccatctgctgtgtggtgactcggtttatacttctgtggtttctcagttttcttgccatttaaatagcaaaactgaggagtgggagattgaaaagacarctcaaaaaacagggaacagtcatcatgctttattaaaaacatatgcatcaagactcatatctgcagtatcacgggcatgttctctggcggctggggaagc

SEQ ID NO: 50946 - DNA, 201 bp, Homo sapiens
taaaaacacaaccaaagacatctgtaatgaatgggcaaagggattacaattcttctgattcagacacttcgaggagattattcttaccctaggagacattwttctggaattggaggtgagacatgtctggacttaactaccctgaccaccagcaccctctgatttagttttgtgttgcgggaagtcagggaccctgaatgg

SEQ ID NO: 50947 - DNA, 201 bp, Homo sapiens
gagggatccttccccataacccaaacaccttccactgggccccatctccaacaccggggatcaaatttcaacatgagatttggtggggacaaacaacccawgtccacactgtagtgaggggcttcccaggatgtaagacttcctgtttttgtggggtattttgagtttcagttttaaaaacaaggaagttctgggcagacc

SEQ ID NO: 50948 - DNA, 201 bp, Homo sapiens
aaaaaataattgctttggtattcctaaatagaatgaccaactctcctggtttgcctagaattgaggggtgtcttagtccatttagcattgctataaaggartacctgaggctgggtcatttatattagaaagaggtttgttggctcatggttctgcaggctctacaagaagcatgacaccagcatctgcttctggtgcggg

SEQ ID NO: 50949 - DNA, 201 bp, Homo sapiens
ggtggcccatgtaaagggtccaaagtgaaaaaaataattgctttggtattcctaaatagaatgaccaactctcctggtttgcctagaattgaggggtgtcytagtccatttagcattgctataaaggaatacctgaggctgggtcatttatattagaaagaggtttgttggctcatggttctgcaggctctacaagaagca

SEQ ID NO: 50950 - DNA, 201 bp, Homo sapiens
actttaagttctagggtacacgtgcacaacgtgcaggtttgttacgtatgtatacatgtgccatgttggagtactgcacccattaactcatcatttacatyaggtatatctcctaatgctatccctcccctctcccccgactccatgacaggccccggtgtgtgaagttccccttccggtgtccatgtgttctctgttcaa

SEQ ID NO: 50951 - DNA, 201 bp, Homo sapiens
caacacacctccttctccctcgcgtttttcttttcttttcttttctttttaattatactttaagttctagggtacacgtgcacaacgtgcaggtttgttaygtatgtatacatgtgccatgttggagtactgcacccattaactcatcatttacattaggtatatctcctaatgctatccctcccctctcccccgactcca

SEQ ID NO: 50952 - DNA, 201 bp, Homo sapiens
atatctaatgcaatcttatgaagttggcattttatgccattttacccatagctatgaaggccagagggtccagctgccgtacagcactagcccacactttyttccaggtctgcagtgctttcctgctcttccctgggcacccctgttaaatagaatggtctctgtgtgcctagattttcctttccctgatctgctctgtaa

SEQ ID NO: 50953 - DNA, 201 bp, Homo sapiens
ttcccttgttggcctcatcctatttcaactcctttagaaatatcactgagaaaaggttaaatttccttctccttaagaagctgggaaacacataaacgtcrgagaaaggtccggaagcccagcctgttggaggaagtgagcctccccgatttagaggccactgcttcgcctcggttcccatgcacacagcaccagagcatg

SEQ ID NO: 50954 - DNA, 201 bp, Homo sapiens
tcacttctcattattcatagttctgtagttatagttatgctctataaagtcgctgcaaacactgaattagtgaatactgaatcattgctcccagggaaacmacacacacacacacacacacacacacacacacacacaattataatcttaaatcttaaacatcgtggtacatcgtgttttctttataaaagagaaaaagaa

SEQ ID NO: 50955 - DNA, 201 bp, Homo sapiens
ggcgaaaacaccatccaacatcacacagctaggaaacgccacagccaggatacagactccgattttctgggcttggaaacccaagccccaaacgataaaaytaccctttctttgaggctcctccctcatacaacttaattgacaagctacatgctttcacttattacatgccaagcacagtgccagtactgtagggtggga

SEQ ID NO: 50956 - DNA, 201 bp, Homo sapiens
cacttctcattattcatagttctgtagttatagttatgctctataaagtcgctgcaaacactgaattagtgaatactgaatcattgctcccagggaaaccacacacacacacacacacacacacacacacacacacaattataatcttaaatcttaaacatcgtggtacatcgtgttttctttataaaagagaaaaagaag

SEQ ID NO: 50957 - DNA, 201 bp, Homo sapiens
aaaaaattagcctggcgtggtgatgggcgcctgtagttccagctactctggaggctgaggcaggagaacggcatgaacccgggaggcggagcttgcagtgrgccgagattgcgccactgcactccagcctgggcaacagagcgagactccgtctcaaaaaaaaaaaaatgataataatgtgcagtggcttctcttcttgcc

SEQ ID NO: 50958 - DNA, 201 bp, Homo sapiens
tcgcctctcagtggtgatgtccattttgatcactgggtcaaggtgttgtctgggtctcttgtgtagtaattacttcttcaccttgtaactaatacataacmtgtgggagatgttgtaaagtcatataaatctcctactcctccttaaatttcctttctgcctagatttgttatccattgatgattcttgactgacccaatc

SEQ ID NO: 50959 - DNA, 201 bp, Homo sapiens
ttggcaaagccctcgtggctgcctgaaattcctgagacattgactgtgctttcattgcatgcaacattttactgtcaaactttcaccatgctttaattatytgtgtccctccctacacacacacacacatacatacacacacgcgcgcacacacacacacacacaaacacacacacttcctccactagaaagtgggcttga

SEQ ID NO: 50960 - DNA, 201 bp, Homo sapiens
ctgctgtacatgaagagcatccctcaaaggtgttgggagccaaaggagtccatgcttttgaaagtaatgtgtagtctgcctctgagtgcttgctatgtggsccaccatatactaggtagcatcaccaaggggaggaaatagcccaggtccacctgggtttgaatgctgaccacgtcacttactgattgtgacctcggataa

SEQ ID NO: 50961 - DNA, 201 bp, Homo sapiens
acttcccactgggaggatgggcagtgagtgagtggtgagggtggtatggagaatggattgtcctgagctctgagctgattgttatagaagaggcagtggawacatgaggggcaccccttactttccatccatttgctgtccagttgaggagataaaataaccacaacagagaacagctatgaaaaatgcagtactttggga

SEQ ID NO: 50962 - DNA, 201 bp, Homo sapiens
aacagatgtttttcatgcaggggtcatgtatctataaatacatattctggagcacctattttgcacaaaatactgctaaaatgtaagctataatcaggtcytaaagaacgagcaacgtggattgagaaaaatctaattaaggaaattttacaccatttaaaatgatgtcaaggaggtgtatctaggaggctgtaggcttcc

SEQ ID NO: 50963 - DNA, 201 bp, Homo sapiens
attccaaaaagcctactgcttttcagttaagggctttaaaggttaagcttagaaaagtaaatttgctaaagaaacaagaaagagaaagacaaatactctayccaggatcagctaaatgtttctaataaaatggagatgggataaacacagtacatgagaaaagtaagtctggaaattgatgctgagaagtaaaggaagaag

SEQ ID NO: 50964 - DNA, 201 bp, Homo sapiens
cagtctagttggaattggtctattctgctatagaagaacagatattttattcacttcacttcagctggacataatgagagctgtttgaatatgtatgctayggggtgtgtgtgtgtgtgtgtgtgtgtgtgtgttatatgcatcagtaatcccttgagcaagtttaatacaaactttccatctatgagaagcaatgatatt

SEQ ID NO: 50965 - DNA, 201 bp, Homo sapiens
tcctgtttgctctggccacaggcatggtggattcttctatgatgcccatcatggggcacctggtggatctacgccacacctcggtgtatgggagtgtctaygccatcgctgatgtggctttttgcatgggctttgctataggtatgttggcaggacctggtgccccactttcccctgtctactctttaccagctggaagtg

SEQ ID NO: 50966 - DNA, 201 bp, Homo sapiens
ctccacactacattcagaggcatgttttaccatacacccaaatagctgcatttctgctcccacttacatttaaaaatgtagtccatgtatgtgagtgcctkttggaattgtatctttttttttttcaattcccttttaggattggatatcatatccccatgtttgctggctttgttatcatgtttctctccacagttagta

SEQ ID NO: 50967 - DNA, 201 bp, Homo sapiens
atatctgcatgtttgtttgtttgctcatactcatccacatgccctatttcatctccacactacattcagaggcatgttttaccatacacccaaatagctgyatttctgctcccacttacatttaaaaatgtagtccatgtatgtgagtgcctgttggaattgtatctttttttttttcaattcccttttaggattggatat

SEQ ID NO: 50968 - DNA, 201 bp, Homo sapiens
atgggacagtcctgttgtaatctagagcactggcttcccaggagttgtattgacgattattctgatattttcaagagatatacactccacctaggctatcmtttctggaaatgagaattttggccctgatctatggtcatatctgcatgtttgtttgtttgctcatactcatccacatgccctatttcatctccacactac

SEQ ID NO: 50969 - DNA, 201 bp, Homo sapiens; identical to SEQ ID NO: 9446

SEQ ID NO: 50970 - DNA, 201 bp, Homo sapiens
ctcggtgtatgggagtgtctacgccatcgctgatgtggctttttgcatgggctttgctataggtatgttggcaggacctggtgccccactttcccctgtcyactctttaccagctggaagtgcagccaggaagctatcctcctagggttctggagatctttgacgctgagacatcctctgggtcacccactgcccctagca

SEQ ID NO: 50971 - DNA, 201 bp, Homo sapiens
agggcagctggcagggttgtggagagatgagctcgtaattcccacctggaacaggtgttagtccgaggcagaagacagcagacaaagcaaatggactaaakggaggaggagaggcggggtggtactaactgtgggtggggctgactgtgtcctgtttgctctggccacaggcatggtggattcttctatgatgcccatcat

SEQ ID NO: 50972 - DNA, 201 bp, Homo sapiens
ccccatgcaggttcctctggctcacaatatttttggtctcattggccccaatgcagggcttggccttgccataggtaagaagtgccctcaaagaaaacaakaagcccctgcatgttggctttgggtctgatgcctttcctcccccttttctcatcagaggaggtaggtgcagaggcagaaggatcaggagggcagctggca

SEQ ID NO: 50973 - DNA, 201 bp, Homo sapiens
acttctcattattcatagttctgtagttatagttatgctctataaagtcgctgcaaacactgaattagtgaatactgaatcattgctcccagggaaaccacacacacacacacacacacacacacacacacacacaattataatcttaaatcttaaacatcgtggtacatcgtgttttctttataaaagagaaaaagaagt

SEQ ID NO: 50974 - DNA, 201 bp, Homo sapiens
agtgtcagtcttcactaagaatgggcggtttggacatgttttgatggatcaaggactgccccgttgtagaaaagaaagaagaaactcagggagttaaattkatgcataatagggtggtagcactacagctgttattggagcccccagctaatcagtagacacgctgaactgtctcaccttctttgtttcttagcactccag

SEQ ID NO: 50975 - DNA, 201 bp, Homo sapiens
cttctcattattcatagttctgtagttatagttatgctctataaagtcgctgcaaacactgaattagtgaatactgaatcattgctcccagggaaaccacmcacacacacacacacacacacacacacacacacaattataatcttaaatcttaaacatcgtggtacatcgtgttttctttataaaagagaaaaagaagtt

SEQ ID NO: 50976 - DNA, 201 bp, Homo sapiens
acgagtttgttgggaagtctgcacccttcctcatcctggccttcctggcactactggatggaggtaagtcaccatcagagcctccagcaggtgacagcccmggtcaggttgggaatgcattatgttgtagtgtcagtcttcactaagaatgggcggtttggacatgttttgatggatcaaggactgccccgttgtagaaaa

SEQ ID NO: 50977 - DNA, 201 bp, Homo sapiens
cagaggcatgttttaccatacacccaaatagctgcatttctgctcccacttacatttaaaaatgtagtccatgtatgtgagtgcctgttggaattgtatctttttttttttcaattcccttttaggattggatatcatatccccatgtttgctggctttgttatcatgtttctctccacagttagtaagtaatttgcttcc

SEQ ID NO: 50978 - DNA, 201 bp, Homo sapiens; identical to SEQ ID NO: 9438

SEQ ID NO: 50979 - DNA, 201 bp, Homo sapiens
ctttggaagtgtaatgtacgagtttgttgggaagtctgcacccttcctcatcctggccttcctggcactactggatggaggtaagtcaccatcagagcctmcagcaggtgacagcccaggtcaggttgggaatgcattatgttgtagtgtcagtcttcactaagaatgggcggtttggacatgttttgatggatcaaggac

SEQ ID NO: 50980 - DNA, 201 bp, Homo sapiens
ttaccatacacccaaatagctgcatttctgctcccacttacatttaaaaatgtagtccatgtatgtgagtgcctgttggaattgtatctttttttttttcaattcccttttaggattggatatcatatccccatgtttgctggctttgttatcatgtttctctccacagttagtaagtaatttgcttcctcttttcttccc

SEQ ID NO: 50981 - DNA, 201 bp, Homo sapiens
gtctagttggaattggtctattctgctatagaagaacagatattttattcacttcacttcagctggacataatgagagctgtttgaatatgtatgctacgkggtgtgtgtgtgtgtgtgtgtgtgtgtgtgttatatgcatcagtaatcccttgagcaagtttaatacaaactttccatctatgagaagcaatgatattat

SEQ ID NO: 50982 - DNA, 201 bp, Homo sapiens
tagttggaattggtctattctgctatagaagaacagatattttattcacttcacttcagctggacataatgagagctgtttgaatatgtatgctacggggtgtgtgtgtgtgtgtgtgtgtgtgtgtgttatatgcatcagtaatcccttgagcaagtttaatacaaactttccatctatgagaagcaatgatattatttt

SEQ ID NO: 50983 - DNA, 201 bp, Homo sapiens
gttggaattggtctattctgctatagaagaacagatattttattcacttcacttcagctggacataatgagagctgtttgaatatgtatgctacggggtgtgtgtgtgtgtgtgtgtgtgtgtgtgttatatgcatcagtaatcccttgagcaagtttaatacaaactttccatctatgagaagcaatgatattattttgt

SEQ ID NO: 50984 - DNA, 201 bp, Homo sapiens
ctctgtggcatcagacaagtcactttctctccctgtactggggttcctggtctctgcagtaaaggagatactgtagatggtctctaagcccataattgtaytttctcagattctgtgaaaataggagagatgtatgcactgtacaaatggacattttttgttatccatgttctcagagtgccaaggggactcccctcttta

SEQ ID NO: 50985 - DNA, 201 bp, Homo sapiens
ggcaggggaaggcagcctgtggatccagccttggttcccgatggccctgctgatcctctgctctccaacaacacacctccttctccctcgcgtttttcttytcttttcttttctttttaattatactttaagttctagggtacacgtgcacaacgtgcaggtttgttacgtatgtatacatgtgccatgttggagtactgc

SEQ ID NO: 50986 - DNA, 201 bp, Homo sapiens
tagaaagaggtttgttggctcatggttctgcaggctctacaagaagcatgacaccagcatctgcttctggtgcgggcctcagggagcttccactcatggtrgaaggtgaaggggagctggctgtgcagagatgagagaggaagaaagagagaggagagggaggtgccagcctttttttaaccagcagctcttgagagaact

SEQ ID NO: 50987 - DNA, 201 bp, Homo sapiens
atcaatactcttataatttcctatgcctgtctttactttaatctcttaatcccatggtcttcgtaaactgaggatgtatgtcgactcaggaccctgtgagkattgcgttaactgcacaaattgttcataaagcgtgtgtgtttgaacaatatgagatctcagaaccttgaaaaaagaataggataatggagatgttcaggg

SEQ ID NO: 50988 - DNA, 201 bp, Homo sapiens
tgactccaagtgcctctgaggcagcgagatcttctcacaggggtgcctttctggactctgctctataaaaacagcatattttatttggatatctgatttaktatcaagaccttgccttccttgtggttctttccctcagaatcctgctttttttagttgatactctcctaatcattacattaagttacacccttgtataaa

SEQ ID NO: 50989 - DNA, 201 bp, Homo sapiens
atcaatatctatgttggttttaaaaattttttgagagttaggggtcttgctatgtagtccaggctggactcaaactcctgggctcaagatatcctcccacytcagcctcccaagtaactgagactccaggcacatcccaccatacctggcagtatctcaatattttaaaagagtggatctagaggaaaaagatgaagtaaa

SEQ ID NO: 50990 - DNA, 201 bp, Homo sapiens
cgtcaaagaaaatgaaattctccccagaaactcttattacttgaagtttgacaaggtactgtgacttaatgctgactaatgatatgaaatcctgaatagasaactaatcatgaaagtcaatattttattttcacagatgaaggcatctttctgatcaggggtttgtagctcaaacaaaagaatgagcgtgcttctagaacc

SEQ ID NO: 50991 - DNA, 201 bp, Homo sapiens
gaagccacgtcaaagaaaatgaaattctccccagaaactcttattacttgaagtttgacaaggtactgtgacttaatgctgactaatgatatgaaatcctraatagagaactaatcatgaaagtcaatattttattttcacagatgaaggcatctttctgatcaggggtttgtagctcaaacaaaagaatgagcgtgcttc

SEQ ID NO: 50992 - DNA, 201 bp, Homo sapiens
gaggtagctctgtaatgcttgtacgagtcagtcctctgaggcttacttgaagaaagggcggtgcagcccttccacacaccttccctggatgtgtggttgaytcttggcaagctttgacaccccagggctgctgcgttacacaattcagttctgctgagctcacccctacaatttcgtgtatgggacaggagaactttctct

SEQ ID NO: 50993 - DNA, 201 bp, Homo sapiens
tcatatttccacagtcagtggatttcatatttccacagtcggtggatgaaggttccaatttctccacatccttgccaacatttgttattgtctgtcttttyaattatatccatcctagggggtgtgaaatggtcgcttgtggttttgatttgaatttttctgatgaccaataatgttgagcatcttttcatgtacttattg

SEQ ID NO: 50994 - DNA, 201 bp, Homo sapiens
agataactgaagtcattgattataaataactggcatttgagtatctctctactctctcaaaaatgtgcccatatatttatatttagacaattgagataaasttgaaaacacagtttaatttcccttttttacttaacattatagtaatagtattttctgtatcattaaaattatttgaaaatataatttttaagagccgct

SEQ ID NO: 50995 - DNA, 201 bp, Homo sapiens
cctgtgataacttgatgttaaaactctgaggaactgccagactgttttccaaagtagctttcatatttccacagtcagtggatttcatatttccacagtcrgtggatgaaggttccaatttctccacatccttgccaacatttgttattgtctgtctttttaattatatccatcctagggggtgtgaaatggtcgcttgtg

SEQ ID NO: 50996 - DNA, 201 bp, Homo sapiens
ttacttcactcactatgttttttaattttccatggcttgtcttttattcttatccatacatatcctaagtcaatttgtattcagaaatacctcctttatayagagaaatgaaggatcttaagtaattgcatgcatttactggttaaaacttaactgagaatttggttcacttaggaccttggtcacgttaatatgtagtag

SEQ ID NO: 50997 - DNA, 201 bp, Homo sapiens
gcagctggcagggttgtggagagatgagctcgtaattcccacctggaacaggtgttagtccgaggcagaagacagcagacaaagcaaatggactaaatggrggaggagaggcggggtggtactaactgtgggtggggctgactgtgtcctgtttgctctggccacaggcatggtggattcttctatgatgcccatcatggg

SEQ ID NO: 50998 - DNA, 201 bp, Homo sapiens
acttacttcactcactatgttttttaattttccatggcttgtcttttattcttatccatacatatcctaagtcaatttgtattcagaaatacctcctttayatagagaaatgaaggatcttaagtaattgcatgcatttactggttaaaacttaactgagaatttggttcacttaggaccttggtcacgttaatatgtagt

SEQ ID NO: 50999 - DNA, 201 bp, Homo sapiens
tttgtagtacttacttcactcactatgttttttaattttccatggcttgtcttttattcttatccatacatatcctaagtcaatttgtattcagaaatacmtcctttatatagagaaatgaaggatcttaagtaattgcatgcatttactggttaaaacttaactgagaatttggttcacttaggaccttggtcacgttaa

SEQ ID NO: 51000 - DNA, 201 bp, Homo sapiens
ttccaggtggctgtgttccctaatcgggatgctggtagtaggtaccagcttgctctgtgtaagtataagaagacctgggggaggggaaggagagagagagygagagacagacagacagagagagagagagagagagagagagagggagagagagagagagaaagacacagacatttaaagactaatttcctttaagatgag

SEQ ID NO: 51001 - DNA, 201 bp, Homo sapiens
agagagagagagagagagagagagagggagagagagagagagaaagacacagacatttaaagactaatttcctttaagatgagcagagatggcttggcaargactgtcagaaagactgtttctgaataggcaggaatttagcacgggggaagaggccaccagctgcagtggctttcctttgaggggaagtgggaaaggaga

SEQ ID NO: 51002 - DNA, 201 bp, Homo sapiens
ggtttggggatcttggaaggttacaggggtggacttcagtgtcttgtacgagacaaggcattttagagtaaattggacatgtcctaaggtaaggatctgtrtccttccacaggtctagctttcttgcctgccagtgtgtcctacctcattggcaccaacctctttggtgtgttggccaacaagatgggtcggtatgtagcc

SEQ ID NO: 51003 - DNA, 201 bp, Homo sapiens
tgcctcctgagtcagctgattcctcctgtaagggaaggaagagtgtgtcccacggcacctcctctgcctttctatagaaaaagggatggagccaggggagwcaaggaaagggcagggagagagctcatttgggtacaaactggtcatgtagggatgctgtcctcaggtcctaaggggttgctgggattagggctggtggga

SEQ ID NO: 51004 - DNA, 201 bp, Homo sapiens
aggctctacttttctcctcgcaaatattcatactctgctaacacccgctttcttctttttcttctccaactacacactcttttctgacacctctgtgttcttcacacaagcttcttcccctccagatactctacacttggcaaagccctcgtggctgcctgaaattcctgagacattgactgtgctttcattgcatgcaac

SEQ ID NO: 51005 - DNA, 201 bp, Homo sapiens
gctttcattgcatgcaacattttactgtcaaactttcaccatgctttaattatttgtgtccctccctacacacacacacacatacatacacacacgcgcgcacacacacacacacacaaacacacacacttcctccactagaaagtgggcttgatggggacagggatcatgtctccatctctgaattcccagagcctcagg

SEQ ID NO: 51006 - DNA, 201 bp, Homo sapiens
tggttccatcttggcttccaatttgtattcagacccaggcaagagttaaagagttcgatgatagataagcacagatgcaaaacagtacagtccagtgcctytttgcttaggctaatatctgccctctctttatcctctccagccctgccttcctgcctttgacgcagggagctaagggtctgaatgaaccctgttggaggt

SEQ ID NO: 51007 - DNA, 201 bp, Homo sapiens
ctttcattgcatgcaacattttactgtcaaactttcaccatgctttaattatttgtgtccctccctacacacacacacacatacatacacacacgcgcgcrcacacacacacacacaaacacacacacttcctccactagaaagtgggcttgatggggacagggatcatgtctccatctctgaattcccagagcctcaggt

SEQ ID NO: 51008 - DNA, 201 bp, Homo sapiens
cattttactgtcaaactttcaccatgctttaattatttgtgtccctccctacacacacacacacatacatacacacacgcgcgcacacacacacacacacaaacacacacacttcctccactagaaagtgggcttgatggggacagggatcatgtctccatctctgaattcccagagcctcaggtggagcttagcccctag

SEQ ID NO: 51009 - DNA, 201 bp, Homo sapiens
gtgggggatagtgacgtatttggcttgatgttggacaaagatggtggaagaaccttgtgcataatcaaagaagccatagagaatctatctatctatctatmtatctatatattcgacacatatatggggtgtgtatatatatattcatgtatatctggagatctccatatatatatatatatgtgcacacacacatgtaat

SEQ ID NO: 51010 - DNA, 201 bp, Homo sapiens; identical to SEQ ID NO: 9440

SEQ ID NO: 51011 - DNA, 201 bp, Homo sapiens
tgggggatagtgacgtatttggcttgatgttggacaaagatggtggaagaaccttgtgcataatcaaagaagccatagagaatctatctatctatctatctatctatatattcgacacatatatggggtgtgtatatatatattcatgtatatctggagatctccatatatatatatatatgtgcacacacacatgtaatt

SEQ ID NO: 51012 - DNA, 201 bp, Homo sapiens
tcttggaatgatgaacagcttccatacggttgaaagtttaggatgagtacacaccgataaaaacttcccactgggaggatgggcagtgagtgagtggtgarggtggtatggagaatggattgtcctgagctctgagctgattgttatagaagaggcagtggatacatgaggggcaccccttactttccatccatttgctgt

SEQ ID NO: 51013 - DNA, 201 bp, Homo sapiens
gggggatagtgacgtatttggcttgatgttggacaaagatggtggaagaaccttgtgcataatcaaagaagccatagagaatctatctatctatctatctatctatatattcgacacatatatggggtgtgtatatatatattcatgtatatctggagatctccatatatatatatatatgtgcacacacacatgtaatta

SEQ ID NO: 51014 - DNA, 201 bp, Homo sapiens
cactactggatggaggtaagtcaccatcagagcctccagcaggtgacagcccaggtcaggttgggaatgcattatgttgtagtgtcagtcttcactaagartgggcggtttggacatgttttgatggatcaaggactgccccgttgtagaaaagaaagaagaaactcagggagttaaatttatgcataatagggtggtagc

SEQ ID NO: 51015 - DNA, 201 bp, Homo sapiens
tcacggggtaaatatggataattctcactgcaaaggactcaccctcacctctggaatctgtgtctcctatgcctctccagtgggagctccctttggaagtrtaatgtacgagtttgttgggaagtctgcacccttcctcatcctggccttcctggcactactggatggaggtaagtcaccatcagagcctccagcaggtga

SEQ ID NO: 51016 - DNA, 201 bp, Homo sapiens
ggggatagtgacgtatttggcttgatgttggacaaagatggtggaagaaccttgtgcataatcaaagaagccatagagaatctatctatctatctatctatctatatattcgacacatatatggggtgtgtatatatatattcatgtatatctggagatctccatatatatatatatatgtgcacacacacatgtaattat

SEQ ID NO: 51017 - DNA, 201 bp, Homo sapiens
aaagaagccatagagaatctatctatctatctatctatctatatattcgacacatatatggggtgtgtatatatatattcatgtatatctggagatctccatatatatatatatatgtgcacacacacatgtaattatagctaggagataatgacattggggactgagtatttggagctgtaacatcatctcagagatgaa

SEQ ID NO: 51018 - DNA, 201 bp, Homo sapiens
aagaagccatagagaatctatctatctatctatctatctatatattcgacacatatatggggtgtgtatatatatattcatgtatatctggagatctccatatatatatatatatgtgcacacacacatgtaattatagctaggagataatgacattggggactgagtatttggagctgtaacatcatctcagagatgaag

SEQ ID NO: 51019 - DNA, 201 bp, Homo sapiens
cctcccaaagtaatgggattacaggaatgatccactgccaccagccaaaatccattttttttggtaacagctttattgagatacaattcacatgccatacygttcatccatttaaagtatactattcagtggctttaagtatattcacaggactgtgcagccatcaccaccataaattttatattttcatcagcccagaaa

SEQ ID NO: 51020 - DNA, 201 bp, Homo sapiens
gaaacaatgtgacagtgaaaactttgttatttgtaacgtgagaataacaatgacacagttgtaacaggagtgtaattaagatgaatgaggtaataagaagyagacaaagaacacactttatcaaccataaacccctatttaaggccagatgcagtggctcacatctgtaatcccagcactttgggaggctgaggagggcgg

SEQ ID NO: 51021 - DNA, 201 bp, Homo sapiens
accccagaaacacaaacgtcatttcaggtttcatttgttgctttcaagaaattattagaagcaaagtgtgttgtgatcccctcccctcctccttgccctcyttgttgtcctccttctccttatcttcttcctcctcctctcctcgctcctctcctcccctgctgtcccttctccccctcccccctcctcctcctccccctc

SEQ ID NO: 51022 - DNA, 201 bp, Homo sapiens
aagtagcctacacctttaaggaggcccatttgtgatggccacagtctcagaacaccactggaggaactctaaaatcactagagggctaactctagggtgartattaggaaatacttccccgctacccacccactgtgttcttatgtatggaattgatttttccaagataaagccttagctacataaaataatttttaaaaa

SEQ ID NO: 51023 - DNA, 201 bp, Homo sapiens
ggggagtcagctattcggaaagctcgttactcaaagaataacatgttactgatgaaatgttatgggatcagattttcttagtgatatattgagtattgagyaccaagaagagaaccatgaacagcagtgtgctgtgatgttctatcagtgacctggagcatggcttgaatgggaaaagggtatgaatgggacagtcctgtt

SEQ ID NO: 51024 - DNA, 201 bp, Homo sapiens
taaagtagcctacacctttaaggaggcccatttgtgatggccacagtctcagaacaccactggaggaactctaaaatcactagagggctaactctagggtraatattaggaaatacttccccgctacccacccactgtgttcttatgtatggaattgatttttccaagataaagccttagctacataaaataatttttaaa

SEQ ID NO: 51025 - DNA, 201 bp, Homo sapiens
gggcagtgtgccatgctccctgtagggagtggacagtggcaccccagagatgtccacctcctaatcctggaacctgtgagtatgttgccttggtagtcccstatggtaaaagggactttgcagatatgattaaggatcttgagatggggaggtgatcttggaatatctgggtgggcccagggtcatcccgtgagtccttac

SEQ ID NO: 51026 - DNA, 201 bp, Homo sapiens
tacagaaatgaacacatttaaaaaatgggaacaattttttgtcagagaaactgattcctggcttgccagctaacattgtttgaacaatatgcaaagatgtrgataaagggaagccagtggacacaatttgagacttttaaaacaattcttgtcaagggttaacaccaggccgggcacagtggctcatgtctgtaatcccag

SEQ ID NO: 51027 - DNA, 201 bp, Homo sapiens
aagaatggtatttccctagctactaacagtgtatgtgaatttccattccacagtactcacagtttttttttttattctatgattaaagggaggaagttgastgctcattcatttttaatggacaacaatttgattattaatagtgatgggcatttgtgaggagaccccagacttggccagcctgtgaatactagcatggtt

SEQ ID NO: 51028 - DNA, 201 bp, Homo sapiens
ggaaataatggcagagacagaggtaagaagcaggatggagagacccacacagacaggcttttgggatgcctgaatatcagattggggttttcagactttayctggaatgacaccagggtctgatttttgcactgctctgtaggagtctgaggctccaacacaaaccctgaatcaaagagcacattcaagctgaacctttca

SEQ ID NO: 51029 - DNA, 201 bp, Homo sapiens
ggaagcaatgagaaacaaaagcaccctccagctctgagtcacagggccgtctcctctgccaggccatgtcagccacagcccagggtacatgtaattgggtwatagatattatttggcccggagaaaaagctgtccgtctgaggatgttgtatgccaaccactttaactagaaagataacagagccactatcaaagagcctc

SEQ ID NO: 51030 - DNA, 201 bp, Homo sapiens
tagaagaaagacagaaaaaataactgattagacccaagatttcatgggaagaagttaaaagaaactgccttgaaatccctcctgattgtagatttcctaayaggaggggtgtaatgtgacattgttcatacttgctaataaatacattattgcctaattcagacctggtaaactagatgttgttttatagcacaagagagt

SEQ ID NO: 51031 - DNA, 201 bp, Homo sapiens
aaaattagcctggcgtggtgatgggcgcctgtagttccagctactctggaggctgaggcaggagaacggcatgaacccgggaggcggagcttgcagtgggscgagattgcgccactgcactccagcctgggcaacagagcgagactccgtctcaaaaaaaaaaaaatgataataatgtgcagtggcttctcttcttgcctc

SEQ ID NO: 51032 - DNA, 201 bp, Homo sapiens
ttccatttggcttcctgctgtaactttcactaccactgttaaattcagttaaaagcaaatgagatacttgtcctgacaagggttgatatactaggtacccsgggaggctggtgcatgtacatgcagagggtcctatgcatgtttcttgagtacttagcaatgccagccttggaagaactagtgggaggacggaatgaggag

SEQ ID NO: 51033 - DNA, 201 bp, Homo sapiens
cttccacaggtctagctttcttgcctgccagtgtgtcctacctcattggcaccaacctctttggtgtgttggccaacaagatgggtcggtatgtagcctcrggatctgggacgaacagtagaaatgtaagatggaagagcgcccgttcctgatcttggaatgatgaacagcttccatacggttgaaagtttaggatgagta

SEQ ID NO: 51034 - DNA, 201 bp, Homo sapiens
tataagtctttggctgcatctctgaccttttttcttttgtaggatgggttccttgtagtagagttactaagtcaaagagtatacaatttttagggcccgayagatttcatgatggtaatctattttaaaatttaaatgagtgatattgttgataccacaacagaagccacgtcaaagaaaatgaaattctccccagaaact

SEQ ID NO: 51035 - DNA, 201 bp, Homo sapiens
tttagagtaaattggacatgtcctaaggtaaggatctgtgtccttccacaggtctagctttcttgcctgccagtgtgtcctacctcattggcaccaacctytttggtgtgttggccaacaagatgggtcggtatgtagcctcgggatctgggacgaacagtagaaatgtaagatggaagagcgcccgttcctgatcttgga

SEQ ID NO: 51036 - DNA, 201 bp, Homo sapiens
tgcttctctatctgtgactattacagtgcctacctttcacacaggaggggtcctgcctccagcttcctctgtggcatcagacaagtcactttctctccctrtactggggttcctggtctctgcagtaaaggagatactgtagatggtctctaagcccataattgtactttctcagattctgtgaaaataggagagatgtat

SEQ ID NO: 51037 - DNA, 201 bp, Homo sapiens
agtaccagggagatctagtggaaaccaggagtccagacatctattgtccaaccctgaccttgctaccaatccactctgaccttgttgatggtcacgtgaasgcaggaaccatggctggaatatgttgcttctctatctgtgactattacagtgcctacctttcacacaggaggggtcctgcctccagcttcctctgtggca

SEQ ID NO: 51038 - DNA, 201 bp, Homo sapiens
aataattttatgtacatgtgattatgttcacaaaaaacttaaaaaacatttatttatctgatattatcagtgtagaatcatggagtcctatttttgtagttcatcactctatttacttgtttaatttttttttggagacagggcctctttctgtgactgaggctggagtgtagaggtgtgatcatggctcactgtagcctc

SEQ ID NO: 51039 - DNA, 201 bp, Homo sapiens
ataattttatgtacatgtgattatgttcacaaaaaacttaaaaaacatttatttatctgatattatcagtgtagaatcatggagtcctatttttgtagttcatcactctatttacttgtttaatttttttttggagacagggcctctttctgtgactgaggctggagtgtagaggtgtgatcatggctcactgtagcctcc

SEQ ID NO: 51040 - DNA, 201 bp, Homo sapiens
taattttatgtacatgtgattatgttcacaaaaaacttaaaaaacatttatttatctgatattatcagtgtagaatcatggagtcctatttttgtagttcatcactctatttacttgtttaatttttttttggagacagggcctctttctgtgactgaggctggagtgtagaggtgtgatcatggctcactgtagcctcca

SEQ ID NO: 51041 - DNA, 201 bp, Homo sapiens
gagggtccagctgccgtacagcactagcccacactttcttccaggtctgcagtgctttcctgctcttccctgggcacccctgttaaatagaatggtctctktgtgcctagattttcctttccctgatctgctctgtaacccctcattttgggaaatgtgctaggaaatgataaaatgttatgaaacatggtataatcagac

SEQ ID NO: 51042 - DNA, 201 bp, Homo sapiens
gtattcttttttttgcgttctcctttttttctcaataatatgtcctgaaaattactctactagttcacagaatctttccttattattttccacctggtggtatatatatatatatatatatatatatatatatatatatatatatatacacacacacacacccacacacaattttgtatgtgtacacaatagtgtgtgcgc

SEQ ID NO: 51043 - DNA, 201 bp, Homo sapiens
tattcttttttttgcgttctcctttttttctcaataatatgtcctgaaaattactctactagttcacagaatctttccttattattttccacctggtggtrtatatatatatatatatatatatatatatatatatatatatatatacacacacacacacccacacacaattttgtatgtgtacacaatagtgtgtgcgcc

SEQ ID NO: 51044 - DNA, 201 bp, Homo sapiens
tggtttgaatgcaaaatttggagctttgtgtggctccaaagcccatgtttcctgaacacttccctctactgtcacaaaaagccatgtgttcaggacttcartttacaaaatacttttgcatgcattacctaatttgctccacattgtaacccggtatgatataatcatagctttgctttttccagatgtggaaaccaaggc

SEQ ID NO: 51045 - DNA, 201 bp, Homo sapiens
tgtgtctctgtcagaggattttgactgttaagtaaagtttactattgatttgttggcaaattcctggttttgtttgtttttgttttgggatttgggtgtgygtgtttctctctctttgtagtacttacttcactcactatgttttttaattttccatggcttgtcttttattcttatccatacatatcctaagtcaatttg

SEQ ID NO: 51046 - DNA, 201 bp, Homo sapiens
ttgtgtctctgtcagaggattttgactgttaagtaaagtttactattgatttgttggcaaattcctggttttgtttgtttttgttttgggatttgggtgtktgtgtttctctctctttgtagtacttacttcactcactatgttttttaattttccatggcttgtcttttattcttatccatacatatcctaagtcaattt

SEQ ID NO: 51047 - DNA, 201 bp, Homo sapiens
attcttttttttgcgttctcctttttttctcaataatatgtcctgaaaattactctactagttcacagaatctttccttattattttccacctggtggtatatatatatatatatatatatatatatatatatatatatatatatacacacacacacacccacacacaattttgtatgtgtacacaatagtgtgtgcgcca

SEQ ID NO: 51048 - DNA, 201 bp, Homo sapiens
agatctgtaactctggatagagcaataaataaacacaacagcgctggtcaagttttcatatccttaaaatggaggtatagattcttttccatgagaaagtstgagagtgcaggaggatgatgtatgtggccaatagtgcactctgaataaatgcatttcatgtgaaaactctttgaaccttgctcccacctgacccatctg

SEQ ID NO: 51049 - DNA, 201 bp, Homo sapiens
ttcttttttttgcgttctcctttttttctcaataatatgtcctgaaaattactctactagttcacagaatctttccttattattttccacctggtggtatatatatatatatatatatatatatatatatatatatatatatatacacacacacacacccacacacaattttgtatgtgtacacaatagtgtgtgcgccat

SEQ ID NO: 51050 - DNA, 201 bp, Homo sapiens
ttttttctttaagaattacccaatctgtggtaatatgttacagcagcaaaaataaaacagactaagaccaacttcagttttttaatttgtaaaaaagtagrtatttttcagagtcattttcatctggaatcctaaatggattagcccagtgcgtggaatacaggatactatcagtaaataaaaaattatttgtacaatttt

SEQ ID NO: 51051 - DNA, 201 bp, Homo sapiens
aacacacacacttcctccactagaaagtgggcttgatggggacagggatcatgtctccatctctgaattcccagagcctcaggtggagcttagcccctagsaggccttctgcaaatgctcacggggtaaatatggataattctcactgcaaaggactcaccctcacctctggaatctgtgtctcctatgcctctccagtgg

SEQ ID NO: 51052 - DNA, 201 bp, Homo sapiens
tcctgaaaattactctactagttcacagaatctttccttattattttccacctggtggtatatatatatatatatatatatatatatatatatatatatakatatacacacacacacacccacacacaattttgtatgtgtacacaatagtgtgtgcgccatattttattccatctcctatgtttaggtagttttcagtat

SEQ ID NO: 51053 - DNA, 201 bp, Homo sapiens
tccactccagtgtgcccaggattttggacatggagtcaaaggcaattattctccagctttaagacataatattgttttctgttttgggctttggactttcrtgggacctgttacccctttcttcttccctgttgcttccttttgaaataagaatgcctgttctatctttgttccaccattatttttgaaagtaggtaaatt

SEQ ID NO: 51054 - DNA, 201 bp, Homo sapiens
cttgatggggacagggatcatgtctccatctctgaattcccagagcctcaggtggagcttagcccctagcaggccttctgcaaatgctcacggggtaaatrtggataattctcactgcaaaggactcaccctcacctctggaatctgtgtctcctatgcctctccagtgggagctccctttggaagtgtaatgtacgagtt

SEQ ID NO: 51055 - DNA, 201 bp, Homo sapiens
ctgaaaattactctactagttcacagaatctttccttattattttccacctggtggtatatatatatatatatatatatatatatatatatatatatatabatacacacacacacacccacacacaattttgtatgtgtacacaatagtgtgtgcgccatattttattccatctcctatgtttaggtagttttcagtattt

SEQ ID NO: 51056 - DNA, 201 bp, Homo sapiens
cattgcatgcaacattttactgtcaaactttcaccatgctttaattatttgtgtccctccctacacacacacacacatacatacacacacgcgcgcacacrcacacacacacaaacacacacacttcctccactagaaagtgggcttgatggggacagggatcatgtctccatctctgaattcccagagcctcaggtggag

SEQ ID NO: 51057 - DNA, 201 bp, Homo sapiens
gaaaattactctactagttcacagaatctttccttattattttccacctggtggtatatatatatatatatatatatatatatatatatatatatatatayacacacacacacacccacacacaattttgtatgtgtacacaatagtgtgtgcgccatattttattccatctcctatgtttaggtagttttcagtatttta

SEQ ID NO: 51058 - DNA, 201 bp, Homo sapiens
cattagagcctctcaagatcccacaaggaactgcactttctcctgtagttaaccatccagtcatccatgcaagaaatatttattggatgctaccatgtatsaggcactgagccagtattgagatgtgaagacacagtgcataatctaagcctttacagaggccacagatgttgggtttttatggcttgagaacaacataca

SEQ ID NO: 51059 - DNA, 201 bp, Homo sapiens
tggatgaataaatgacatatgaggtgaaaatgctttgtaccctgtacaatattaatgtgcaccattaccatccacattctcctcccttcagctcctcatcytcaagactaccctttggttatcttttttacctctaaaaaggggtgtatgtagcactcacttaggaaaagctatgggcccaggagagagggttccagcttc

SEQ ID NO: 51060 - DNA, 201 bp, Homo sapiens
gctgcgcattcagtataatttaatacctgctgattttgtctggttaaaagatcgttcaatataagatataaaaaaggatctgattgtatcacaagatattrttttctacccaattcctataatcctcgaagcacctacttactgtcactgtactccagatgatcctgtgggacccagcaatggtaaagaccagatctggat

SEQ ID NO: 51061 - DNA, 201 bp, Homo sapiens
aattcacttctgtttctttccatcatctctctcattccctttcatcctgggctgttatttcctccctctattgctctgttgatactctctctgctttgccrtgtttcccaatcccctttcatcttcatatttcttttgtgcacttccttaatttcccttctctaagtaaccacttccctctttctggggctatcaggaagg

SEQ ID NO: 51062 - DNA, 201 bp, Homo sapiens
catcagaggaggtaggtgcagaggcagaaggatcaggagggcagctggcagggttgtggagagatgagctcgtaattcccacctggaacaggtgttagtcygaggcagaagacagcagacaaagcaaatggactaaatggaggaggagaggcggggtggtactaactgtgggtggggctgactgtgtcctgtttgctctgg

SEQ ID NO: 51063 - DNA, 201 bp, Homo sapiens
gcagggcttggccttgccataggtaagaagtgccctcaaagaaaacaataagcccctgcatgttggctttgggtctgatgcctttcctcccccttttctcmtcagaggaggtaggtgcagaggcagaaggatcaggagggcagctggcagggttgtggagagatgagctcgtaattcccacctggaacaggtgttagtccg

SEQ ID NO: 51064 - DNA, 201 bp, Homo sapiens
ttccatagactccctggtcacccacaatgattttggggatggtagatatttttctataccttgcatataaattaaacttaacaaggagccattgccaacgstaatatctcaagaatctgtggtggattttaaacgcgtcagctctgcctgtgaaattctgcgcacacaatcaaggacagatggggttgagagctgaattgc

SEQ ID NO: 51065 - DNA, 201 bp, Homo sapiens
tgaaaactctttgaaccttgctcccacctgacccatctggagtcctgatgactcttcctccttccccatgcaggttcctctggctcacaatatttttggtstcattggccccaatgcagggcttggccttgccataggtaagaagtgccctcaaagaaaacaataagcccctgcatgttggctttgggtctgatgcctttc

SEQ ID NO: 51066 - DNA, 201 bp, Homo sapiens
gggtttttgttgggggattgggagggcaatgggaatgagtctcacaagcttcctgacaggggacccaagccacaccacctgccccctctagcttacagctractggttgttggggcctcttctctatcttctttttccaacagctaccaagttagaagtctaaatgaaacctttcagtgatgtccataatggaaaacagag

SEQ ID NO: 51067 - DNA, 201 bp, Homo sapiens
ttttaccatacacccaaatagctgcatttctgctcccacttacatttaaaaatgtagtccatgtatgtgagtgcctgttggaattgtatcttttttttttycaattcccttttaggattggatatcatatccccatgtttgctggctttgttatcatgtttctctccacagttagtaagtaatttgcttcctcttttcttc

SEQ ID NO: 51068 - DNA, 201 bp, Homo sapiens
agccaatactattgataatttataaacatttcttgaggcatgaaccctaaaaattgttatcagccagcagcatctaaacggtatgctaaacccttaagggktgagtgtcctggggtagcaggtttgaatggcaggtacccagagagggaggtaaggaacctgaaaaagagggaagaaggggtttttgttgggggattggga

SEQ ID NO: 51069 - DNA, 201 bp, Homo sapiens
agaagtaaaggaagaaggaatgaaaagggttagcgttagcaggttaaggcaggggaaggcagcctgtggatccagccttggttcccgatggccctgctgawcctctgctctccaacaacacacctccttctccctcgcgtttttcttttcttttcttttctttttaattatactttaagttctagggtacacgtgcacaac

SEQ ID NO: 51070 - DNA, 201 bp, Homo sapiens
gcccccatcacctgtcctccttgactttcagtagaattgacatctgtccttagccccttgagtttcagtggtaagatgacatcggtccttagcccccatcrcctgtcctctttgactttcagtgccaattgtgcccaccttcctatatgacatggagttcaaagaagtcaactcttctctgcacctcggccatgccggaag

SEQ ID NO: 51071 - DNA, 201 bp, Homo sapiens
ggttctgatggtgtccacagggttgtcaaggtaatccaaataaaccacagtgtctggcacatggtgagcccatagtgaatctcagccaatactattgatawtttataaacatttcttgaggcatgaaccctaaaaattgttatcagccagcagcatctaaacggtatgctaaacccttaaggggtgagtgtcctggggtag

SEQ ID NO: 51072 - DNA, 201 bp, Homo sapiens
ttccagctatcagaagtgtatatgatggttgcctggggagacatgagacacacactgagaagtaagacaatgcggtgtgctagtggatctgagacgttttrgcatgatatccttgcctgattctctgccaagaattcatgtgttaaaagctttacttttaaagtaaactgtatatgttaagtaattattgtttaacttata

SEQ ID NO: 51073 - DNA, 201 bp, Homo sapiens
cacaaacctcctaggcctgagggagagaagaacagggctacaaggcactgtaaactgtgctcaagaccagctggaggtcctgagcaggagcatgggatccrggttccatggcaggttttgccactttctatgcatgtgactttgagcaggttacttcatctccgtgtgctcagcatcctcatctatgtagagagggttctg

SEQ ID NO: 51074 - DNA, 201 bp, Homo sapiens
ttcattgcatgcaacattttactgtcaaactttcaccatgctttaattatttgtgtccctccctacacacacacacacatacatacacacacgcgcgcacrcacacacacacacaaacacacacacttcctccactagaaagtgggcttgatggggacagggatcatgtctccatctctgaattcccagagcctcaggtgg

SEQ ID NO: 51075 - DNA, 201 bp, Homo sapiens
ccagcttgctctgtgtaagtataagaagacctgggggaggggaaggagagagagagcgagagacagacagacagagagagagagagagagagagagagagrgagagagagagagagaaagacacagacatttaaagactaatttcctttaagatgagcagagatggcttggcaaggactgtcagaaagactgtttctgaat

SEQ ID NO: 51076 - DNA, 201 bp, Homo sapiens
ctgtcaaactttcaccatgctttaattatttgtgtccctccctacacacacacacacatacatacacacacgcgcgcacacacacacacacacaaacacamacacttcctccactagaaagtgggcttgatggggacagggatcatgtctccatctctgaattcccagagcctcaggtggagcttagcccctagcaggcct

SEQ ID NO: 51077 - DNA, 201 bp, Homo sapiens
tggaggtaagtcaccatcagagcctccagcaggtgacagcccaggtcaggttgggaatgcattatgttgtagtgtcagtcttcactaagaatgggcggttyggacatgttttgatggatcaaggactgccccgttgtagaaaagaaagaagaaactcagggagttaaatttatgcataatagggtggtagcactacagctg

SEQ ID NO: 51078 - DNA, 201 bp, Homo sapiens
ctttctcctgtagttaaccatccagtcatccatgcaagaaatatttattggatgctaccatgtatcaggcactgagccagtattgagatgtgaagacacastgcataatctaagcctttacagaggccacagatgttgggtttttatggcttgagaacaacatacattgtttctttccaggaagctaattggggtacatgg

SEQ ID NO: 51079 - DNA, 201 bp, Homo sapiens
gtctagctttcttgcctgccagtgtgtcctacctcattggcaccaacctctttggtgtgttggccaacaagatgggtcggtatgtagcctcgggatctggracgaacagtagaaatgtaagatggaagagcgcccgttcctgatcttggaatgatgaacagcttccatacggttgaaagtttaggatgagtacacaccgat

SEQ ID NO: 51080 - DNA, 201 bp, Homo sapiens
gggaataagcctgggacaccctccatgggctcactgcccaggaccaccttgggactctgctctctgcgtttcagtgcagtgcccctcaactgtgccagccrtggctcaagtgggcccagatgtggcctggcctcccactctggagggtgcaagtggtaagccttggtggtgtctatgtggtgcaaattttgcacgtgcgca

SEQ ID NO: 51081 - DNA, 201 bp, Homo sapiens
tgagtatctctctactctctcaaaaatgtgcccatatatttatatttagacaattgagataaacttgaaaacacagtttaatttcccttttttacttaacrttatagtaatagtattttctgtatcattaaaattatttgaaaatataatttttaagagccgcttaataatccaccattaacatgtttgacttttttcact

SEQ ID NO: 51082 - DNA, 201 bp, Homo sapiens
ttgatatgcactattttgtttaaacctcacaactggcctgtctggtagaaattatgattatccccatatttcagagatttcttttcttttctttttctttyttttttttttttggcagctgcaagatttaatagagtgaaaacagagctaccatataatgggaggcggcccaaagggaattgccactgctggctggaatgc

SEQ ID NO: 51083 - DNA, 201 bp, Homo sapiens
attgttttttgagtaatgttttacttttcgatacaaaaatatgtcctacgttcatcttgtactttccctgcctcagccctgaattcatttccccaaggagsccaggttcttgttagtagggaatggtgtttagaaaccaaactatggggccgggcacggtggttcacgcctgtaatcccagcagtttgggaggccgaggca

SEQ ID NO: 51084 - DNA, 201 bp, Homo sapiens
acattatagtaatagtattttctgtatcattaaaattatttgaaaatataatttttaagagccgcttaataatccaccattaacatgtttgacttttttcrctaagaaaaataattctgcaattgatcattttgagtataagtctttggctgcatctctgaccttttttcttttgtaggatgggttccttgtagtagagtt

SEQ ID NO: 51085 - DNA, 201 bp, Homo sapiens
ctgagtctggtcagaccttcgtatggtaattaagattaaaatcccctgttaggaaattggctgggttaagggaattttcagtggttaatgttaagtcatctttttttttttttaacagactagccccatactttaagatttttgagttagtaagctacttttttttttttttttgacttaggatagttctgaactggtgag

SEQ ID NO: 51086 - DNA, 201 bp, Homo sapiens
aaccaggaggttaagatacagagattgaaatgtatagcctaaagtgcagcgggaggtacatccaacagttagtaggattttggccaaggttccatcgagcmtagtgagggtggtattaaataggcttaccaggcaagtatgggtacagagggtcttcaaaggcatacaagaattgagagtcaggatgtacagggatgtaga

SEQ ID NO: 51087 - DNA, 201 bp, Homo sapiens
ggctgggttaagggaattttcagtggttaatgttaagtcatctttttttttttttaacagactagccccatactttaagatttttgagttagtaagctacttttttttttttttttgacttaggatagttctgaactggtgaggtgtgctcacaatgaggtttcctctaaaagttatttttctacttccttctgttagcaa

SEQ ID NO: 51088 - DNA, 201 bp, Homo sapiens
aggctcagtccttggatctctattctttatttgttctttcataggcaatcccatccatttgcatggctttaagtatctaactgcctgacagctctgcttgratatctaccagtcacttcaaacctctcacgttccccccatgctcttgcacttcaaccagtcttccctatctccagctacccaatcgattaagacaaaaac

SEQ ID NO: 51089 - DNA, 201 bp, Homo sapiens
ctgaaggaggggagagcgtcccggcagctggtgctggtggtggtattcgtcgctttgctcctggacaacatgctgtttactgtggtgggtacgtttgtggstctttgtgctgagggttaatttgctgtgggccccagcaggcagtgtacaccctgcttgagttcaacagtgaatccatctgagaattttcctttttatgct

SEQ ID NO: 51090 - DNA, 201 bp, Homo sapiens
tggcaggacagagccatatttctcttattgttttggatgacatattcctgttggatctcagtttcctgggtgtccatcttcaacagactgcctctcttcamggacaataactagatgttatttttattttgcatttgctacagagtctagcagagctgcgcattcagtataatttaatacctgctgattttgtctggttaa

SEQ ID NO: 51091 - DNA, 201 bp, Homo sapiens
agcggttgctgaaggaggggagagcgtcccggcagctggtgctggtggtggtattcgtcgctttgctcctggacaacatgctgtttactgtggtgggtacrtttgtgggtctttgtgctgagggttaatttgctgtgggccccagcaggcagtgtacaccctgcttgagttcaacagtgaatccatctgagaattttcctt

SEQ ID NO: 51092 - DNA, 201 bp, Homo sapiens
aatcaggagtggcaatgggtgccttgctggatcagaagtgcagtggacaccctgccagatctggaggggtggaagtcaatggtgggtctgtgatggcagcrctcagccgtggtggacggcgaatgaaagctcagctcgagccagaacaaacacggaccagaagagtgtacagttgcaagatttaatagagtgaaaacagag

SEQ ID NO: 51093 - DNA, 201 bp, Homo sapiens
tggaagtcaatggtgggtctgtgatggcagcgctcagccgtggtggacggcgaatgaaagctcagctcgagccagaacaaacacggaccagaagagtgtayagttgcaagatttaatagagtgaaaacagagctcccaaagggggttgccctcagagatttcttgatcttaccaaatttcccagtgctctttcaaatcctg

SEQ ID NO: 51094 - DNA, 201 bp, Homo sapiens
gtgggtctgtgatggcagcgctcagccgtggtggacggcgaatgaaagctcagctcgagccagaacaaacacggaccagaagagtgtacagttgcaagatytaatagagtgaaaacagagctcccaaagggggttgccctcagagatttcttgatcttaccaaatttcccagtgctctttcaaatcctggacttgtcatca

SEQ ID NO: 51095 - DNA, 201 bp, Homo sapiens
aatgacattggggactgagtatttggagctgtaacatcatctcagagatgaaggctgtgggggccacctagacaacatcttctgcaataaaagacatcctstgtgaatatccctaactgtcattctgtcacagttaataaatatcagagttggtacttgtttgactctaagccaaaaacggctctggaaaatccatatccc

SEQ ID NO: 51096 - DNA, 201 bp, Homo sapiens
ctgctcccacttacatttaaaaatgtagtccatgtatgtgagtgcctgttggaattgtatctttttttttttcaattcccttttaggattggatatcatayccccatgtttgctggctttgttatcatgtttctctccacagttagtaagtaatttgcttcctcttttcttcccttcactgattacctttgattttatcaa

SEQ ID NO: 51097 - DNA, 201 bp, Homo sapiens
tcccagcactttgggaggccaaggcaggcaggatttcatgaccagcctgggcaacatgacgagactccatctctacaaaacaaacaaacaaacaaacaaamaaaaaaaaaacaaaaaaaaacaactaggtgtggtggtgttcatctgtaatcccagccacttgggaggctgagctgggaggatcacttgatcccaggaggt

SEQ ID NO: 51098 - DNA, 201 bp, Homo sapiens
gactgtctgggagcctggcaggacagagccatatttctcttattgttttggatgacatattcctgttggatctcagtttcctgggtgtccatcttcaacasactgcctctcttcaaggacaataactagatgttatttttattttgcatttgctacagagtctagcagagctgcgcattcagtataatttaatacctgctg

SEQ ID NO: 51099 - DNA, 201 bp, Homo sapiens
cccagcactttgggaggccaaggcaggcaggatttcatgaccagcctgggcaacatgacgagactccatctctacaaaacaaacaaacaaacaaacaaacaaaaaaaaaacaaaaaaaaacaactaggtgtggtggtgttcatctgtaatcccagccacttgggaggctgagctgggaggatcacttgatcccaggaggtc

SEQ ID NO: 51100 - DNA, 201 bp, Homo sapiens
attacctttgattttatcaagtgaatgcggtgtagatagcagggtaacctagaatgtaattaggcatctgactaagcagactggaatattggtttaaatgytctgctgtttttggtatgtggactagaacagtagtgacaattcagtctagttggaattggtctattctgctatagaagaacagatattttattcacttca

SEQ ID NO: 51101 - DNA, 201 bp, Homo sapiens
gggtgcagtgccccgcagggtacacaggagtaggaggactagaaaagtatagaaagggggttggaagggaaaaagaagaaatactcacttgtatgattccycaggggagtcagctattcggaaagctcgttactcaaagaataacatgttactgatgaaatgttatgggatcagattttcttagtgatatattgagtattg

SEQ ID NO: 51102 - DNA, 201 bp, Homo sapiens
acctaggctatcatttctggaaatgagaattttggccctgatctatggtcatatctgcatgtttgtttgtttgctcatactcatccacatgccctatttcrtctccacactacattcagaggcatgttttaccatacacccaaatagctgcatttctgctcccacttacatttaaaaatgtagtccatgtatgtgagtgcc

SEQ ID NO: 51103 - DNA, 201 bp, Homo sapiens
actgccataggacatcagagaaggaaagaagtttggtactttctgtgttttttgagacagacctcaaggaccaaataaaataggacaggtaggaggcagtstgagctgggcaacagcatgagttaagtttgagggctacttctaaggaacaagtgcctcctgagtcagctgattcctcctgtaagggaaggaagagtgtgt

SEQ ID NO: 51104 - DNA, 201 bp, Homo sapiens
gcctccagcaggtgacagcccaggtcaggttgggaatgcattatgttgtagtgtcagtcttcactaagaatgggcggtttggacatgttttgatggatcarggactgccccgttgtagaaaagaaagaagaaactcagggagttaaatttatgcataatagggtggtagcactacagctgttattggagcccccagctaat

SEQ ID NO: 51105 - DNA, 201 bp, Homo sapiens
gcccaggtcaggttgggaatgcattatgttgtagtgtcagtcttcactaagaatgggcggtttggacatgttttgatggatcaaggactgccccgttgtaraaaagaaagaagaaactcagggagttaaatttatgcataatagggtggtagcactacagctgttattggagcccccagctaatcagtagacacgctgaac

SEQ ID NO: 51106 - DNA, 201 bp, Homo sapiens
ggacatgttttgatggatcaaggactgccccgttgtagaaaagaaagaagaaactcagggagttaaatttatgcataatagggtggtagcactacagctgytattggagcccccagctaatcagtagacacgctgaactgtctcaccttctttgtttcttagcactccagctttgcatcctacagccttccaaagtctctc

SEQ ID NO: 51107 - DNA, 201 bp, Homo sapiens
ggaggcccagctcttttaacaaccagctcttgtgtgaacttacagagcaagaagtcactcattaccgtgaggatggggacagcaccacgccattcacgagsgattcattcccatgacccaaacacctcccactcagccccacctttaccactggagatgaagttataacgtgaaatttcaagaggacaaatatcaagcaat

SEQ ID NO: 51108 - DNA, 201 bp, Homo sapiens
atgttttgatggatcaaggactgccccgttgtagaaaagaaagaagaaactcagggagttaaatttatgcataatagggtggtagcactacagctgttatkggagcccccagctaatcagtagacacgctgaactgtctcaccttctttgtttcttagcactccagctttgcatcctacagccttccaaagtctctcctga

SEQ ID NO: 51109 - DNA, 201 bp, Homo sapiens
cagcaagcatcctatgccctcatccttttctctgaacatgtctttcatcttcttgccctactgagacccagatgttttctgtgaacattgttttcctgcarcatctagatggaagttcatgttccacaccttgctctcctttgttgcttccgagtcatttcttctctattctccttcaaagatctcagctcctttgaatgt

SEQ ID NO: 51110 - DNA, 201 bp, Homo sapiens
tatgcataatagggtggtagcactacagctgttattggagcccccagctaatcagtagacacgctgaactgtctcaccttctttgtttcttagcactccarctttgcatcctacagccttccaaagtctctcctgaggtaagcagacacaaagctccatttctaacagttatacaggatggctgaatgcaggaacccaggc

SEQ ID NO: 51111 - DNA, 201 bp, Homo sapiens
cttagtgcgccatctatgctgcatcttacacattccatgaaataagtacaatttttagcctcactctacagataatgaaatcgagggtgaacagagaagcrtctgaaagaatttgaaactatgacataatcaatactttgagtgccaattcccccagagcaactaggagcctcccgcagtctcctgagatgctctgctctt

SEQ ID NO: 51112 - DNA, 201 bp, Homo sapiens
tgcccgtcgcctctcagtggtgatgtccattttgatcactgggtcaaggtgttgtctgggtctcttgtgtagtaattacttcttcaccttgtaactaatayataacatgtgggagatgttgtaaagtcatataaatctcctactcctccttaaatttcctttctgcctagatttgttatccattgatgattcttgactgac

SEQ ID NO: 51113 - DNA, 201 bp, Homo sapiens
gttctctgacctggggttcttggcctcacagattccaaggaatggaaccttgggccatgtggtgagtgttatagctctattagaagccgtgggtcacagawgagaaccgtggaatgcagtgactagtgttcagctggattaggatgaacctgggcacttaggtgtgcaggaacaatggcaagcttttagcccaatcaggag

SEQ ID NO: 51114 - DNA, 201 bp, Homo sapiens
gtaagactctgtctcaaaaaaaatactctaaaaaacaaaaaagcaatagccattcctttcttactctctttatatgtatatatttataaatatttataccraataggtatataataattttatgtacatgtgattatgttcacaaaaaacttaaaaaacatttatttatctgatattatcagtgtagaatcatggagtcct

SEQ ID NO: 51115 - DNA, 201 bp, Homo sapiens
taagatggcagcaagccttttgttctctgacctggggttcttggcctcacagattccaaggaatggaaccttgggccatgtggtgagtgttatagctctaktagaagccgtgggtcacagaagagaaccgtggaatgcagtgactagtgttcagctggattaggatgaacctgggcacttaggtgtgcaggaacaatggca

SEQ ID NO: 51116 - DNA, 201 bp, Homo sapiens
cattaccacctaaaagtcaaaattattccaaaaggtgtactcagaaagtgtcaatccctccagtctttctaaccctccccctctcccacccctaccactcrtaggtaaccaattttaatgccttctggtttgtctttcctgtgtcttagtgttttttcctcaaaataaatcgcttatgtgttttcttatttttcccttttc

SEQ ID NO: 51117 - DNA, 201 bp, Homo sapiens
agagctcccaagatggggcgggctgctcctaagatggcagcaagccttttgttctctgacctggggttcttggcctcacagattccaaggaatggaacctkgggccatgtggtgagtgttatagctctattagaagccgtgggtcacagaagagaaccgtggaatgcagtgactagtgttcagctggattaggatgaacct

SEQ ID NO: 51118 - DNA, 201 bp, Homo sapiens
cacacacacacccacacacaattttgtatgtgtacacaatagtgtgtgcgccatattttattccatctcctatgtttaggtagttttcagtattttatagwtataaatagtgctgtaatttgcatgactgcatgtttataatgttgtcattaatctttagagtcaattcctagaagtgggactgttgggtcaaagggttta

SEQ ID NO: 51119 - DNA, 201 bp, Homo sapiens
tggtagtaggtaccagcttgctctgtgtaagtataagaagacctgggggaggggaaggagagagagagcgagagacagacagacagagagagagagagagrgagagagagagggagagagagagagagaaagacacagacatttaaagactaatttcctttaagatgagcagagatggcttggcaaggactgtcagaaaga

SEQ ID NO: 51120 - DNA, 201 bp, Homo sapiens
atcacaagatattattttctacccaattcctataatcctcgaagcacctacttactgtcactgtactccagatgatcctgtgggacccagcaatggtaaaraccagatctggattttgcacatggacgatccaggagtatgatctaagaaccagtttccagcctaggacactgagcttcatggacatccctcatttcagtg

SEQ ID NO: 51121 - DNA, 201 bp, Homo sapiens
agttaccaagttaactccctcataagtgggcagaattccattggcacatccgttcatccactcattcactctagtgcaacattatccttaccaggtcacttttttttttttttttgatggagtttcactcttgttgcccagggtggagtgtaatagtgtgatctcggctcaccacaacctctgcctcccgggttcaagaga

SEQ ID NO: 51122 - DNA, 201 bp, Homo sapiens
tgtgatctcggctcaccacaacctctgcctcccgggttcaagagattctcctgccttggcatcccaagtagctgggattacaggcatgtaccaccatgtcyggctaattttttgtatttttagtagagatggggtttatccatgttggtcagcaggtcacgtttttaaaagtacaaaaaccccagggaagagatccatacc

SEQ ID NO: 51123 - DNA, 201 bp, Homo sapiens
ctatgtagtccaggctggactcaaactcctgggctcaagatatcctcccacctcagcctcccaagtaactgagactccaggcacatcccaccatacctggyagtatctcaatattttaaaagagtggatctagaggaaaaagatgaagtaaatgatagtacaggtagtccttagatatgacataaaccatcaaggtgatag

SEQ ID NO: 51124 - DNA, 201 bp, Homo sapiens
atgaatgacactgccagcaccatcccacctccagccactgaagccatctcagctcataaaaacaactgcttgcaaggcacaggtttcttggaggaagagaytacccgggtcggggttctgtttgcttcaaaggctgtgatgcaacttctggtcaacccattcgtgggccctctcaccaacaggtatctcactgggtgcagt

SEQ ID NO: 51125 - DNA, 201 bp, Homo sapiens
caaacttaaccaggaggttaagatacagagattgaaatgtatagcctaaagtgcagcgggaggtacatccaacagttagtaggattttggccaaggttccrtcgagcctagtgagggtggtattaaataggcttaccaggcaagtatgggtacagagggtcttcaaaggcatacaagaattgagagtcaggatgtacaggg

SEQ ID NO: 51126 - DNA, 201 bp, Homo sapiens
gatttataagaagtgaacagtgatacagacatggagatgtttccaaatatcatcctactacttgcaaccctttgcacttttcgttttaatagtgagtttcmttcgtctgggcagactccctcccctcttccataaaggctgcaggagacctgtagctgtcacaggaccttccctaagagcccgcaggggaagactgcccca

SEQ ID NO: 51127 - DNA, 201 bp, Homo sapiens
ttgtagctcaaacaaaagaatgagcgtgcttctagaaccacagagcaagggaacatggtagaggataagctggcaagttgaaaagcgtgggatttcatccmagtttgacactaactgtgcaaccccaaacaaatctcctaaccttcagaggctcggatttcttgtctatgagatgaaggttggtctacatcagtgtttctc

SEQ ID NO: 51128 - DNA, 201 bp, Homo sapiens
atttttctgatgaccaataatgttgagcatcttttcatgtacttattgaccatgtatacattttctttgtggaaatgtctattcagagcctttgtccattaaaaaaaaaaaaaatggttgtcttggccgggctcggtggctcacgcctgtaatcccagcactttgggaggccaaggcaggtggatcacgaggtcaggagtt

SEQ ID NO: 51129 - DNA, 201 bp, Homo sapiens
gcttcccaggagttgtattgacgattattctgatattttcaagagatatacactccacctaggctatcatttctggaaatgagaattttggccctgatctrtggtcatatctgcatgtttgtttgtttgctcatactcatccacatgccctatttcatctccacactacattcagaggcatgttttaccatacacccaaat

SEQ ID NO: 51130 - DNA, 201 bp, Homo sapiens
agctgccagagaaagtcttgaagaccagccaccctgagaaacctcacagcttttctgtcattcgaggtcctctgcacccgttctctaattctgttcactgattcagactttccagttaggtgccccagctcccctctccgcttctcgggtttgatctttctccacccattcacctgcttctgcaaaggggctaaagcccat

SEQ ID NO: 51131 - DNA, 201 bp, Homo sapiens
gaccagccaccctgagaaacctcacagcttttctgtcattcgaggtcctctgcacccgttctctaattctgttcactgattcagactttccagttaggtgycccagctcccctctccgcttctcgggtttgatctttctccacccattcacctgcttctgcaaaggggctaaagcccattctccttagagggcaggggtgt

SEQ ID NO: 51132 - DNA, 201 bp, Homo sapiens
atgcacccagtacagagccagttgttaggacaccaaaaagataaggcgtaggaccaaccttggggatctctagtcgagagccgccaagggtttttaaggcmagataccctggagggagctgaggcagtcctaagcctgaagggcctggcttaagctccctggcaaccatcgagcatcttccccttcccaccctgtccctca

SEQ ID NO: 51133 - DNA, 201 bp, Homo sapiens
gacctgtgcgccacatcctatctcctgtgacgctgcaggagcttccctggttttaagaggtgacatggtggagagaaagcacaggactgggggccacaggycctggcttctcatccaggctccgctgctccctgactgctgcctttctctgtgggcctcgtttcctccctgatcccaccaggtgaattgtaattctccaca

SEQ ID NO: 51134 - DNA, 201 bp, Homo sapiens
tccggctaatttttacatttttgtagagatggggtcttactatgttgaccaggctggtttcaaactcctgacctcaagtgacccttctgcctcagcttccyaaagccctgggattagagccatgagccactgtgcctctccctgtttcctctcatgctcctctctggccctgtctgctccagtgacttcccgaaaagcctt

SEQ ID NO: 51135 - DNA, 201 bp, Homo sapiens
ataaaaaggtaggatggggctgggcacgatggctcatgcctgtaatcccagcactttgggaggctgaggcaggtggatcacctgaggtcaggagttcgagmccagcgtagccaacatggtgaaaccctgtctctacaaaaaatattttaaaaattagccgggcgtgatggtccatgcctgtaattccagctactcgggagg

SEQ ID NO: 51136 - DNA, 201 bp, Homo sapiens
tgaggaataaaaaggtaggatggggctgggcacgatggctcatgcctgtaatcccagcactttgggaggctgaggcaggtggatcacctgaggtcaggagktcgagaccagcgtagccaacatggtgaaaccctgtctctacaaaaaatattttaaaaattagccgggcgtgatggtccatgcctgtaattccagctactc

SEQ ID NO: 51137 - DNA, 201 bp, Homo sapiens
ttctttgtgaggaataaaaaggtaggatggggctgggcacgatggctcatgcctgtaatcccagcactttgggaggctgaggcaggtggatcacctgaggycaggagttcgagaccagcgtagccaacatggtgaaaccctgtctctacaaaaaatattttaaaaattagccgggcgtgatggtccatgcctgtaattcca

SEQ ID NO: 51138 - DNA, 201 bp, Homo sapiens
aagtgacccttctgcctcagcttcctaaagccctgggattagagccatgagccactgtgcctctccctgtttcctctcatgctcctctctggccctgtctsctccagtgacttcccgaaaagccttccagaccagctggccccttcttccccacctcactgtcccctttcccattcacaccccttgctccaggccatctgc

SEQ ID NO: 51139 - DNA, 201 bp, Homo sapiens
aagatacctaattaatttattgtactttttcagattaataattggaaacatggccttaaattgagggaacctgaccaggcacagtggctcacgcctgtaawcccagcactttgggaggccaaagtgggtggccacaagcactttgggaggccacaaggtgggtggatcacttgaggccaggagttccagaccagcctggcc

SEQ ID NO: 51140 - DNA, 201 bp, Homo sapiens
atggaagatacctaattaatttattgtactttttcagattaataattggaaacatggccttaaattgagggaacctgaccaggcacagtggctcacgcctrtaatcccagcactttgggaggccaaagtgggtggccacaagcactttgggaggccacaaggtgggtggatcacttgaggccaggagttccagaccagcct

SEQ ID NO: 51141 - DNA, 201 bp, Homo sapiens
agaggagaaagtccacatcccaaagatcctcccctggcacgctgggacttattcctgtgtggcagaaaacattcttggtactggacagaggggcccgggarctgagctggatgtccagtgtgagtagccacggagcctctggttctagggagagaagatggacacagggaacggggaaggcagatggggtgcagggcattc

SEQ ID NO: 51142 - DNA, 201 bp, Homo sapiens
gtgggaggatcacttgagcccaggagtttgagaccagcctgggcaacatagcccacacctcatagcaagatctcatctctacaaaaaataccaaaaaaaawtttaaaaacgaacaaacaaaacaataacaacaacaaaaaagagtctgaaagcatatggaagatacctaattaatttattgtactttttcagattaataat

SEQ ID NO: 51143 - DNA, 201 bp, Homo sapiens
atgcctgtaatcccaacactttgagaggccatggtgggaggatcacttgagcccaggagtttgagaccagcctgggcaacatagcccacacctcatagcargatctcatctctacaaaaaataccaaaaaaaattttaaaaacgaacaaacaaaacaataacaacaacaaaaaagagtctgaaagcatatggaagatacct

SEQ ID NO: 51144 - DNA, 201 bp, Homo sapiens
gaaagtccacatcccaaagatcctcccctggcacgctgggacttattcctgtgtggcagaaaacattcttggtactggacagaggggcccgggagctgagytggatgtccagtgtgagtagccacggagcctctggttctagggagagaagatggacacagggaacggggaaggcagatggggtgcagggcattccggggt

SEQ ID NO: 51145 - DNA, 201 bp, Homo sapiens; identical to SEQ ID NO: 9506

SEQ ID NO: 51146 - DNA, 201 bp, Homo sapiens
gctaatttttggattttttttttttttttttttagtagagatggggttttaccatgttgcccaagctggtcttgaactcctgagctcaggcaatccacccrccttggccacccaaagcgctaggattacaggcatgagccaccatgcccagtcctacaagatatcttttctttttcttcctttctttctttctttcttttt

SEQ ID NO: 51147 - DNA, 201 bp, Homo sapiens; identical to SEQ ID NO: 9470

SEQ ID NO: 51148 - DNA, 201 bp, Homo sapiens
ttgcaaatattttctcttagtctgtaatttgtcttttcattctcttaactaggtcttttacagagcaaaaaaaaattaattttgatgaagttggattgatktttttagggatcatgcctttggtgtcatgtctaagaacacttcatcaagctctaagtctcacagattttctcctatgttatcttccagaggttttttgtt

SEQ ID NO: 51149 - DNA, 201 bp, Homo sapiens
tggattcttcctccattctgtccatttctcagttcccaacaacacactgaacagtaggaggccagttctccgctcacagcgggcgctgcaccccaggtgckgctctcgagaaaaaggcgagcatggaccaatttagtggctccgaggtatgaaaagcagtgagatggtgtctttgagggagttagtgataggctgagaccc

SEQ ID NO: 51150 - DNA, 201 bp, Homo sapiens
cctaaagactctccattcaataacacttcctacaagatatcttttttgtttttttgtttttttgagacaggatctggctctgtcacccaggctggagtgcmacagcgcgatctgctcactgcaacctcagcctctcgggcttaagtgattctcctgccttagcctcctgagtagctgggaccacaggcgcccgccaccaca

SEQ ID NO: 51151 - DNA, 201 bp, Homo sapiens
cccctgcccgccatgcagatgcacccaggaggctgcgtgtgtccatgagcccgggggaccaagtgatggaggggaagagtgcaaccctgacctgtgagagygacgccaaccctcccgtctcccactacacctggtttgactggaataaccaaagcctcccctaccacagccagaagctgagattggagccggtgaaggtcc

SEQ ID NO: 51152 - DNA, 201 bp, Homo sapiens
gggaggccaaggtgggcagatcacctgaggtcaggagttcaagaccagcctagccaacatggtaaaatcctgtctctaccaaaaatacaaaaattagctgrgcgtggtgattcacacctgtaatctcagctacttgggaggctgaggcaggagagtcgcttgaacctgggaggcggaggtagcggtgagccgagatcacgc

SEQ ID NO: 51153 - DNA, 201 bp, Homo sapiens
accagcatgcatagctaatttttaaaatttttagtagagacagggttttgctgtgttggccaggtctcgaactcctgacctcaggtgatctgcccacctcrgcctcccaaagtgctgaaattacaagcgtgagccaccatgcccggcctcaggaccccatttgacagacgtgtaaactgagacctgcagcccatgcccgtg

SEQ ID NO: 51154 - DNA, 201 bp, Homo sapiens
catgaaagtaacacaagtttgtcaaagctgaaaagtccgtgaactaaactgataaaattcacttagaggtggtgggaataggccgggcacggtggctcacrcctgtaatcccagaactttgggaggccgaggcaggcggatcacaaggtcaggagatcgagaccatcctgactaacacagtgaaaccctgtctctactaaa

SEQ ID NO: 51155 - DNA, 201 bp, Homo sapiens
ggtgccccagctcccctctccgcttctcgggtttgatctttctccacccattcacctgcttctgcaaaggggctaaagcccattctccttagagggcaggkgtgtaattatctgatcatcagggagattggctcctggcacgtggcaggtgtccccaaactgccaccttcctctcccaccttcctttccctcccatctctg

SEQ ID NO: 51156 - DNA, 201 bp, Homo sapiens
tatgtgctaacaggacaggggtgcccaaatcctgagcatctcagacagctggatgcgtgaccacagcagccacagtgatgtttgtggagtgtttgccacaygccacactctgctctaagggagtcatctcatttccttcttgaaacaattcccaggaggttaggaactctcaggactcaccccccacccaccccgcactgc

SEQ ID NO: 51157 - DNA, 201 bp, Homo sapiens
ttctggatgtcatcaaggaggtctgtgtgacctaaggatcattgttctttgaaagagagacaagttcatttatcttgcaggcagctgccagggagtcaggwtgtaagttaaacaattatgagtgaattaatggttacctgctactgaaatgaccaaatgtaactaatcatgcatggaggaaggaaaggacaaagagaaaag

SEQ ID NO: 51158 - DNA, 201 bp, Homo sapiens
tgcaccctgggagggaggcgggaggaaaagctctgtcccgcctgccctctttgtgccaggcccatgccaggcaccctgatacatgctctgcctcattcccrctcggcaacaagcctctgggtaagggccagtctccagaagtggacctgctccttcaagtcagcagcacacatgcccagtccgttcttatcacaaagatca

SEQ ID NO: 51159 - DNA, 201 bp, Homo sapiens
ggcacagagctcacaaaccgagcttcctgcagagctcaggcaggggacgccagcggatgacgatggcgatgcagcagcactagacagagctgcgggacctyggatgtcccatctgaccctcagttcctgcccctctgggacctggattccaaagttatcggatctcctgatctttccctctttctttctcaccatgtattt

SEQ ID NO: 51160 - DNA, 201 bp, Homo sapiens
tgactagccccacagagttttgctgtgttgttcaggttggtctcaaacttctggccttaagcaatcctcttgccttgctctcccaaagcgtattacaggcrtaagtcaccacacccagccctatcggtgcttttggaagaaggtgttcttccctctctctgtttccctccctatggccagctgcccatagagggcagtggt

SEQ ID NO: 51161 - DNA, 201 bp, Homo sapiens
aatgcctcatttctgcattggggtggcagtggatgtccaggctgcccacatggtttccaccaacaccacatcgggggagggtgatcccagtggggaggaakgtcccagctccaactctagcatcactctggctgagtatgggagtggcctagggttctttgttacagcctggtgaaggtgaatgtctaggttttccatccg

SEQ ID NO: 51162 - DNA, 201 bp, Homo sapiens
caatcctcttccaacaaattacacgtggtaccacaatgggaaagaaatgcagggaaggacagaggagaaagtccacatcccaaagatcctcccctggcacrctgggacttattcctgtgtggcagaaaacattcttggtactggacagaggggcccgggagctgagctggatgtccagtgtgagtagccacggagcctctg

SEQ ID NO: 51163 - DNA, 201 bp, Homo sapiens
gacctctcagcgcatccctcttcatctgtaggatgtgcatggcttccaatgctgtctgttctgctcctgagacactcgctggctacaggattataaaggtratgaggtttcagcctaaagactctccattcaataacacttcctacaagatatcttttttgtttttttgtttttttgagacaggatctggctctgtcaccc

SEQ ID NO: 51164 - DNA, 201 bp, Homo sapiens
caggctggtcttgaactcctgacctcaggtgatccactttgcttcccaaagtgctgggattacaggtgtgagccatcgtgcccagcctgatttttattttrtatatatatatatgtacacacacacacacaatatacatacacacacatatatgcacacatatgtgtgttaaagctgtatgtaaagctgttatatattaca

SEQ ID NO: 51165 - DNA, 201 bp, Homo sapiens
ccaccttccagaagtcctgagctcctactgggtccctgtctctctctctctgactactctgtctctctcagccctgacaggctccttgtttttatcttttwaaacgtaaatgattttttttttaaacggagtctcgatctgtcacccaggctggagtgcagtggcgtgatcacggctcactgcaagctctgcctcccgggt

SEQ ID NO: 51166 - DNA, 201 bp, Homo sapiens
aaaacattcttggtactggacagaggggcccgggagctgagctggatgtccagtgtgagtagccacggagcctctggttctagggagagaagatggacacrgggaacggggaaggcagatggggtgcagggcattccggggtcctggagtcaagagcaaggagcagccagggtctcctgttcacaactgctgtctcagctc

SEQ ID NO: 51167 - DNA, 201 bp, Homo sapiens
atggcaagttctcatgagctcttcaaggtcagatgacactgttgttgaaccccaaaggccaggtttgagctcccgatgcgtagtcagccaaacactgacayctcagtgcttagaagctgagataggattatttaatttagccaaagcaaggggacagaagagagaaactctcaaatctgacctgactttgagcgttagtgg

SEQ ID NO: 51168 - DNA, 201 bp, Homo sapiens
ttgccatgttggccaggctggtcttgaactcctgacctcaagtgatctgcctgccttggcatcccaaagtattgggattacaggtgtgagccactgcgccyggctcacccatactttgttactggttttagaattcctttttacctggtctttcaaaccaagttttgaccatgtctgtccctgagtataatccttgatgag

SEQ ID NO: 51169 - DNA, 201 bp, Homo sapiens
gtaggtgtgcaggaggtgacctcccgatcgtcaaagctgttgtgcccctcggctcatcaaatttctggatgtcatcaaggaggtctgtgtgacctaaggawcattgttctttgaaagagagacaagttcatttatcttgcaggcagctgccagggagtcaggatgtaagttaaacaattatgagtgaattaatggttacct

SEQ ID NO: 51170 - DNA, 201 bp, Homo sapiens
tctgtacatttttagtttattttttatctttttgagacagggtcttgccctgtcgcccaggctggagtgcagttgcatgatctcggctcattccaacttcyacttcccgggttcaagcaattctcctgcctcagcctcatgagtatctgggattacaggtgtacgccaccacgcctggctaattttttgcattttgagtaa

SEQ ID NO: 51171 - DNA, 201 bp, Homo sapiens
cctgagctcaggcaatccacccgccttggccacccaaagcgctaggattacaggcatgagccaccatgcccagtcctacaagatatcttttctttttcttyctttctttctttctttctttttttttttttgagacagagtctcactctgtcacccaggctggactgcagtggtgtgatctcttctcactgcagcctccgc

SEQ ID NO: 51172 - DNA, 201 bp, Homo sapiens
atactatcttttattttagctgttcttatagatgttagtagtgatatctcatcatggtcttaacctgtctaaaggctagtgatgttgaatatctttttagrtaattattttctatccatatatccccttgggtgaaatttctctttatatcttttgccagtcttctaattggatgatttgatttttttatgtagtgtttct

SEQ ID NO: 51173 - DNA, 201 bp, Homo sapiens
catccccaccagtcgtgtgtgaatgtttcaagttcacagcatcctcaccagtgtttggtgttgtcattattggttatttaattttagctgttctaaagcgktatcttgtcatgggtttcaatttgcatttcactaatggctggtgatgtgagacatcttttcatgtgcttatttgccttctatataccttcttcagggaaa

SEQ ID NO: 51174 - DNA, 201 bp, Homo sapiens
ctggtaggtatattttgtttagtttttcaggaaaccggcaaactgttttccagagtagctggaccactttgcatccccaccagtcgtgtgtgaatgtttcmagttcacagcatcctcaccagtgtttggtgttgtcattattggttatttaattttagctgttctaaagcggtatcttgtcatgggtttcaatttgcattt

SEQ ID NO: 51175 - DNA, 201 bp, Homo sapiens
ttacccggtatgaatggaaaccccatggcgcctgggaggagccatcgcttggggtgctgaagatccaaaacgttggctgggacaacacaaccatcgcctghgcagcttgtaatagttggtgctcgtgggcctcccctgtcgccctgaatgtccagtgtgagtccctgggctaggcagggggatctgggaggtggcccggct

SEQ ID NO: 51176 - DNA, 201 bp, Homo sapiens
ccatcccccaccacctcctctatcccttggcagaggcccgtgtccagttgctccatctcgaagcctccagcctgtggagtccctgaccctcacacatgtgyctttatttctcagttggaagaggacacagagccagcaggggcttcaggagaattccagcggccagagcttctttgtgaggaataaaaaggtaggatgggg

SEQ ID NO: 51177 - DNA, 201 bp, Homo sapiens
gctgcagagagaagtccaggatgccttccaggcaaaggctgccagggagagctggcccctcagttgattaaggtctctcctttctccacccagatagcccrgagaccatcggcaggcgagtggctgtgggactcgggtcctgcctcgccatcctcatcctggcaatctgtgggctcaagctccagcgacggtgagctcctg

SEQ ID NO: 51178 - DNA, 201 bp, Homo sapiens
tctcagagatgcagagtcctcagagatgcagagacctcccccggactgcgatgacacggtcacttattcagcattgcacaagcgccaagtggtaaggaggrtctccccaggtctccccagaggggctgtggaaggctggggacagggcctggcctcagtggtgggtcccacataggaaggagttgggtaggcatccgtggt

SEQ ID NO: 51179 - DNA, 201 bp, Homo sapiens
ctactgtaaggcctcttcctgctcttgttcttcttggtggtggtcagtccttccttccttccttccttccttccttccttccttccttccttccttccttyctttctctctttcttttcctcctcctcttcttcccctcctcctcctcttcctcctccttcttcttcttctgctttctccctctcctcctcctctttcttc

SEQ ID NO: 51180 - DNA, 201 bp, Homo sapiens
tgcctcagcctcccaagtagtttggaccacaggcatgggccaccatgcccagctacttttcattttttgcttttgttgactagccccacagagttttgctrtgttgttcaggttggtctcaaacttctggccttaagcaatcctcttgccttgctctcccaaagcgtattacaggcgtaagtcaccacacccagccctatc

SEQ ID NO: 51181 - DNA, 201 bp, Homo sapiens
tgtgtcacctgggtctggtctttgggttggaggctccaggaggctggctggaccacagcaacacctccctgggcatcaacacaccggtcaacggctctccsgtctgcctggaggcctgggacccggcctctgccggcccggcccgcttcagcctctctctcctgctcttttttctgcccttggccatcacagccttctgct

SEQ ID NO: 51182 - DNA, 201 bp, Homo sapiens
agcttcctgcagagctcaggcaggggacgccagcggatgacgatggcgatgcagcagcactagacagagctgcgggacctcggatgtcccatctgaccctsagttcctgcccctctgggacctggattccaaagttatcggatctcctgatctttccctctttctttctcaccatgtatttttcagcttttgtgacaaact

SEQ ID NO: 51183 - DNA, 201 bp, Homo sapiens; identical to SEQ ID NO: 9483

SEQ ID NO: 51184 - DNA, 201 bp, Homo sapiens
ccgctggtgaccggttacttgggaaggggtcctggcctgaagacagtgtgtgcggcaagaacgcaagggggcaagtcccagaagtaacgccactgctcggrggaaggagcatggggcaggagggcccggctgcttctccaggcccctgcggggggctgcttcggaggaactgcagggcagcctggcccggaggcctccctg

SEQ ID NO: 51185 - DNA, 201 bp, Homo sapiens
aagagagagaggctgcccccgcagggctctcagtttgaaggagaggtgcagcacactcagaaaaaactcccggccaggagtggtggctcacacctgtagtrccagcactttgggaggccaaggctggcagatcacctgagatcaggagttcaagaccagccaggccaacatggtgaaaccccatctctactgaaaatacaa

SEQ ID NO: 51186 - DNA, 201 bp, Homo sapiens
tcaacccttgggggcttcagtgtaggtggtcagattccccaccatttatgcctatgatgaaaagagtggaaatggtaataactggatggtgtcactaaacyacaaatactttcaggtaggcctgtgcctttttcagcgggctgcagttctcctgcttggcttgagtcattcgcatttcctgagagctgggtagagggggag

SEQ ID NO: 51187 - DNA, 201 bp, Homo sapiens
cgagaccatcctgactaacacagtgaaaccctgtctctactaaaaatgcaaaaagttagccaggcgtggtggcaggcgcctgtagtcccagctactcaggrggctgaggcaggagaatggcgtgaacccggaaggtggagcttgcagtgagctgagatcacgccactacactccagtccgggcgacagagcgagactctgt

SEQ ID NO: 51188 - DNA, 201 bp, Homo sapiens
agtgattcaaagtggagaaaagcaggactgcgttgggtgcagtggttcccgcctgtaaccccagcactttgggaggctgagatcggaggatcgtttgagcycaggagtttgagaccagcctgggtaacatggcaagaccctgtctctacaaaatgtttaaaaaactagctaggtgtggtggcacatgcctgtagtcccagt

SEQ ID NO: 51189 - DNA, 201 bp, Homo sapiens
cccaggttagaagggcccccctctctgaagacccccactccctgggatgctacaatccaatgatggaagatggcattagctacaccaccctgcgctttccmgagatgaacataccacgaactgggtactgagggtaccaggagggtgaccctgcaccctgggagggaggcgggaggaaaagctctgtcccgcctgccctct

SEQ ID NO: 51190 - DNA, 201 bp, Homo sapiens; identical to SEQ ID NO: 9474

SEQ ID NO: 51191 - DNA, 201 bp, Homo sapiens; identical to SEQ ID NO: 9496

SEQ ID NO: 51192 - DNA, 201 bp, Homo sapiens; identical to SEQ ID NO: 9498

SEQ ID NO: 51193 - DNA, 201 bp, Homo sapiens
aaaaatcagccaggcgtggtggcacctgcctttacccagctacttggggggctgaggccagagaaacgcttgagcctgggaagcagaggttgcagtgagcrgagatcacaccactgcactctagcctgggagacagagcaagactctgtctcaaaaaaaaagaaagaactccgtgagcatcccaaatgccacatccccata

SEQ ID NO: 51194 - DNA, 201 bp, Homo sapiens
gttgcatgatctcggctcattccaacttctacttcccgggttcaagcaattctcctgcctcagcctcatgagtatctgggattacaggtgtacgccaccaygcctggctaattttttgcattttgagtaaagatggggttttgccatgttggccaggctggtcttgaactcctgacctcaagtgatctgcctgccttggca

SEQ ID NO: 51195 - DNA, 201 bp, Homo sapiens
gtggctcctctcttcacctgactgttccccagacccccagaccccctgcccaggtggcccctgagaactgctaagctcaaccgtgacatggatggggcccrgctgacccttgggctctccctgggggacccccttttcctgtccctggccacaccctcaccttatccacacccttctcctccctgctgccccgccggcttt

SEQ ID NO: 51196 - DNA, 201 bp, Homo sapiens
tgtggctcctctcttcacctgactgttccccagacccccagaccccctgcccaggtggcccctgagaactgctaagctcaaccgtgacatggatggggccyagctgacccttgggctctccctgggggacccccttttcctgtccctggccacaccctcaccttatccacacccttctcctccctgctgccccgccggctt

SEQ ID NO: 51197 - DNA, 201 bp, Homo sapiens; identical to SEQ ID NO: 9502

SEQ ID NO: 51198 - DNA, 201 bp, Homo sapiens
agggggccaggactccagacgcaggccgccctccacaaccccagctctcacagtcctcccagggtccagacaatggatcgtgcatttaggttcccaaacasctgctgtgcaacgtgtagtagacaaagcagaccaaagcctttgccctcaggaggccggcattctagctcaggagccagccaagacgatgtcgcactgaag

SEQ ID NO: 51199 - DNA, 201 bp, Homo sapiens
gggaggaaaagctctgtcccgcctgccctctttgtgccaggcccatgccaggcaccctgatacatgctctgcctcattcccactcggcaacaagcctctgrgtaagggccagtctccagaagtggacctgctccttcaagtcagcagcacacatgcccagtccgttcttatcacaaagatcaagagctcgtgatacacacc

SEQ ID NO: 51200 - DNA, 201 bp, Homo sapiens; identical to SEQ ID NO: 9503

SEQ ID NO: 51201 - DNA, 201 bp, Homo sapiens
cccccagaaaaccaacctccatcctttatttgcatttttcgaagaatgtgaaaaggggaagccgattcaaaacagctcttcccaaaagtgacgctacccarttcttgcacaacccatagctgccagagaaagtcttgaagaccagccaccctgagaaacctcacagcttttctgtcattcgaggtcctctgcacccgttct

SEQ ID NO: 51202 - DNA, 201 bp, Homo sapiens
gtaatcccagcactttgggaggctgaggcaggtggatcacctgaggtcaggagttcgagaccagcgtagccaacatggtgaaaccctgtctctacaaaaartattttaaaaattagccgggcgtgatggtccatgcctgtaattccagctactcgggaggctgaggcaggagaatcgcttgaacctgggaggcagaggttg

SEQ ID NO: 51203 - DNA, 201 bp, Homo sapiens
tactcgggaggctgaggcaggagaatcgcttgaacctgggaggcagaggttgcagtgagccaagattgcgccattgcactccagcctgggtgacatactgwgactctgcctcaaaaaaaaaaaaaaaaaaaaaaaaagggtaggcatgaggcagactgtgaagctgagtggggaaacaaggtgaaggaaggggataaaatg

SEQ ID NO: 51204 - DNA, 201 bp, Homo sapiens; identical to SEQ ID NO: 9475

SEQ ID NO: 51205 - DNA, 201 bp, Homo sapiens
aggttcaagtgatcctcctgccttggcctcctgagtagctgggactacaggcacgcaccacccaactggctaattttttgcatttttatgtggttgctttygagaattttctctgcctcttgtttttagaagtttgactatgatgtgtcttggcatgaatttctttgggtttatcctgtttgtgatgcgctcagcttcttg

SEQ ID NO: 51206 - DNA, 201 bp, Homo sapiens; identical to SEQ ID NO: 9477

SEQ ID NO: 51207 - DNA, 201 bp, Homo sapiens
tctgccggcccggcccgcttcagcctctctctcctgctcttttttctgcccttggccatcacagccttctgctacgtgggctgcctccgggcactggcccrctccggcctgacgcacaggcggaagctgcgggccgcctgggtggccggcggggccctcctcacgctgctgctctgcgtaggaccctacaacgcctccaac

SEQ ID NO: 51208 - DNA, 201 bp, Homo sapiens
gcaggagaatcgcttgaacctgggaggcagaggttgcagtgagccaagattgcgccattgcactccagcctgggtgacatactgagactctgcctcaaaamaaaaaaaaaaaaaaaaaaaagggtaggcatgaggcagactgtgaagctgagtggggaaacaaggtgaaggaaggggataaaatgtcctctgaggagacct

SEQ ID NO: 51209 - DNA, 201 bp, Homo sapiens
ggctgtcagaggccagggaaggggacgagggttggggaacaggtggttagcacttcatcctcgtctccctcccaggttagaagggcccccctctctgaagrcccccactccctgggatgctacaatccaatgatggaagatggcattagctacaccaccctgcgctttcccgagatgaacataccacgaactgggtactga

SEQ ID NO: 51210 - DNA, 201 bp, Homo sapiens
ggcaacaagcctctgggtaagggccagtctccagaagtggacctgctccttcaagtcagcagcacacatgcccagtccgttcttatcacaaagatcaagasctcgtgatacacacccacgcctactccctccacgcacatttgcacgagctcctactgtgagctttgggcactggggaggccacaggttttacataagggg

SEQ ID NO: 51211 - DNA, 201 bp, Homo sapiens
acaagcctctgggtaagggccagtctccagaagtggacctgctccttcaagtcagcagcacacatgcccagtccgttcttatcacaaagatcaagagctcrtgatacacacccacgcctactccctccacgcacatttgcacgagctcctactgtgagctttgggcactggggaggccacaggttttacataaggggctga

SEQ ID NO: 51212 - DNA, 201 bp, Homo sapiens
ggccacagccagtttcctgacacgaggacacccgcctgggcttttggacccccgggtggaatgaaggagagaatgcggagaaaagcggcggtggaggctgrcgacagtggggccaggctaaccaccatgcggttttctcagggcgactatgagaacgtcattccagattttccagaagatgaggggattcattactcagag

SEQ ID NO: 51213 - DNA, 201 bp, Homo sapiens
gtgcctgtggtcccagctactggggaggctgaggagggagaatcacttgagcccaggaagtgaaggctgcagactgaactatgttcctgctactgcactcyagcctgggtgacagagcaagacctgggtctcaaaaagaaaaagaaaatgctgggactgggattataggtgtgagctgggcacagtggctcacacttgtaa

SEQ ID NO: 51214 - DNA, 201 bp, Homo sapiens
aacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggagg

SEQ ID NO: 51215 - DNA, 201 bp, Homo sapiens
gaggccgaggcaggcggatcacaaggtcaggagatcgagaccatcctgactaacacagtgaaaccctgtctctactaaaaatgcaaaaagttagccaggcrtggtggcaggcgcctgtagtcccagctactcaggaggctgaggcaggagaatggcgtgaacccggaaggtggagcttgcagtgagctgagatcacgccac

SEQ ID NO: 51216 - DNA, 201 bp, Homo sapiens
actttttaatttgttgtagaaatgggtcttgctatgttgccaggctggtcttgaactcctggcctcaagcaatcctcctgcttcaacctctcaaagcattrggattacaggcatgagtcaccgcacccggcctgatcttctgatttttcaagagacgatggaaatctagattttccagtgaaatctcccagcatgttaatg

SEQ ID NO: 51217 - DNA, 201 bp, Homo sapiens
tactacatatataacagctttgctgagatataattcacataccataaaacacacccatgtaaaatgtccaattgaatggttttgggtctattcactgaatkatgcaaccatcaccacaaccagttttagaacatttcatcaccccaaaataatctcacatccattagcagtcactcttcatttcctcttacctttcccacc

SEQ ID NO: 51218 - DNA, 201 bp, Homo sapiens
ccttccttccttccttccttccttccttccttccttccttccttcctttctctctttcttttcctcctcctcttcttcccctcctcctcctcttcctcctycttcttcttcttctgctttctccctctcctcctcctctttcttctccttctccttccttcttcttcttcttatagagacaaggtcttactctgtcaccca

SEQ ID NO: 51219 - DNA, 201 bp, Homo sapiens
taggaatccatgacaactccctggctgggagtgggagggatgcttcattactgctccctatgtggctttcactgacactgtgtgtggcagagagagggggrtgcttgttaccactgagtggtggcgaaagtcccaactctccaccaggccccctttgacactactccaatggggccgggtggaatgcctcatttctgcatt

SEQ ID NO: 51220 - DNA, 201 bp, Homo sapiens
ccgtctggcttcagcgctgtgccctgaacccctgcaccaaaccacagccaggccagagagccagggcagggtttctgttctcacacagatgcaggaaggaygcacaagcccccctttgattaatttaggacctgtgcagatgcccgggacaggtagcgggagaagaggaagcaggagggaaggggtactgtggacagctgg

SEQ ID NO: 51221 - DNA, 201 bp, Homo sapiens
gctgcagtgagcctgtgatcatgccgctgcactccagcctgggtgactgagtgagaccttgtctcaaaaaaaagaatggattggccaggcatggtggcttrcgcctgtaatcccagcactttgggaggccaaggtgggcagatcacctgaggtcaggagttcgagaccagcctggccaacatggcgaaaccctgtctctac

SEQ ID NO: 51222 - DNA, 201 bp, Homo sapiens
cctcccaaagtgctgaaattacaagcgtgagccaccatgcccggcctcaggaccccatttgacagacgtgtaaactgagacctgcagcccatgcccgtgcrcctctcagcagccgtctggcttcagcgctgtgccctgaacccctgcaccaaaccacagccaggccagagagccagggcagggtttctgttctcacacaga

SEQ ID NO: 51223 - DNA, 201 bp, Homo sapiens
attccggggtcctggagtcaagagcaaggagcagccagggtctcctgttcacaactgctgtctcagctcctagcatagggcctggctcatggagggtgctyggtagatgcttgtttttttgtgttttagttttttttgagatggagtctccctctgtctcccaggctggagtgcagtggcacaatctcggctcactgcaag

SEQ ID NO: 51224 - DNA, 201 bp, Homo sapiens
atctttctctcccctctgcacgtcctcacctgcctgtcttccgtgggccgcgagcagaggccttgtacttacgggaaggaggaggcagtctgtttctgacycacaggaactgccactccggtgatgcacttgaggacagctactctgaaatcagttcccaggagagaacatttgatttccgagtaggagaggaggcaggag

SEQ ID NO: 51225 - DNA, 201 bp, Homo sapiens; identical to SEQ ID NO: 9490

SEQ ID NO: 51226 - DNA, 201 bp, Homo sapiens
tcagaaagcagacatccggcaatgagcatgaaagaaaagtagatcacagttcccaaggaggcttagtgtggtcaaggcctttcagaggggatttcgggtgwgcaaaagtgattcaaagtggagaaaagcaggactgcgttgggtgcagtggttcccgcctgtaaccccagcactttgggaggctgagatcggaggatcgtt

SEQ ID NO: 51227 - DNA, 201 bp, Homo sapiens
ttcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgt

SEQ ID NO: 51228 - DNA, 201 bp, Homo sapiens
agtagatcacagttcccaaggaggcttagtgtggtcaaggcctttcagaggggatttcgggtgagcaaaagtgattcaaagtggagaaaagcaggactgcrttgggtgcagtggttcccgcctgtaaccccagcactttgggaggctgagatcggaggatcgtttgagcccaggagtttgagaccagcctgggtaacatgg

SEQ ID NO: 51229 - DNA, 201 bp, Homo sapiens
ctgatacatgctctgcctcattcccactcggcaacaagcctctgggtaagggccagtctccagaagtggacctgctccttcaagtcagcagcacacatgcscagtccgttcttatcacaaagatcaagagctcgtgatacacacccacgcctactccctccacgcacatttgcacgagctcctactgtgagctttgggcac

SEQ ID NO: 51230 - DNA, 201 bp, Homo sapiens
cgggtcacaggctctgggcgtgccacgtctgtgggaaaagcagctcctcaggagaattagtgccttattcctaaagggaggcccagagcaagcaggggccrttgtcaccctcttcctctgcacccctgcacgcatgcaggggagaaggacgagtctggctgcagagagaagtccaggatgccttccaggcaaaggctgcca

SEQ ID NO: 51231 - DNA, 201 bp, Homo sapiens
cagctcctcaggagaattagtgccttattcctaaagggaggcccagagcaagcaggggccattgtcaccctcttcctctgcacccctgcacgcatgcaggrgagaaggacgagtctggctgcagagagaagtccaggatgccttccaggcaaaggctgccagggagagctggcccctcagttgattaaggtctctcctttc

SEQ ID NO: 51232 - DNA, 201 bp, Homo sapiens
cctcccatctctgctcagtacccggacggtaactctaggaattatggttcagggaggccttgatcgccccatcaatccactttgtccctggtttgattctygtgagcaccattaacttttctggaggaaggtgaggctttaagaactgtttaaagcccaggcgtggtggatcacgcctgtaatcacagcactctgggaggc

SEQ ID NO: 51233 - DNA, 201 bp, Homo sapiens
ttagtgtccttcttaacagactcaaaccacatggaccacgaatattctttctgtccagaagggctactttccacatatagagctccagggactgtcttttytgtattcgctgttcaataaacattgagtgagcacctccccagatggagcatgctggtcctgggccatgactcaaaccaggtctgtcctcgccactcagtc

SEQ ID NO: 51234 - DNA, 201 bp, Homo sapiens
gcaacggcaccagggaaagcactcagaccaacagcgcttttaacagcaccccagggcccatggcgtcaggtggagccccaggactcctcttgttggccagrttggctgcgactggtccagcttcgtgctgcccttgcatcctgtctactgcccgggctcaggcacctcccctggctgaaggcaaggagcctgctcttccct

SEQ ID NO: 51235 - DNA, 201 bp, Homo sapiens
atagattggtctctggaacaggttcgagacccaaaaacggagatctaaatgctgtgtggtagtgatcttcacactggaggtatggatccttggggaaacasgaagatatttcaagtgatgccggcagagagtgttctggaaatccatttacagaccttttatttccaagtgtcctctttgctaaaactgggagagagcccc

SEQ ID NO: 51236 - DNA, 201 bp, Homo sapiens
tgggagagagcccctgaaggcaagggggaacctctttcctctcattcaatctgaacctgaacccatgggtataaaaacaatagggacagcaaacaaaaagmcaaaacggtaataaatcgttcatatctggcattctcaattcctcaaggaaactgaattgaagaggagaggacttcatggggatatcaactgatgaggtct

SEQ ID NO: 51237 - DNA, 201 bp, Homo sapiens
caaagtgctgggattacaggcatgagccaccgcgcccagctccagaataaatttttataatattcacagatgtatgggtcacaggtagtaaaaacatttawttttttttttttttttttttttttttttagacagagtctcgctttgtcgcccaggctggagtgcagtggcacgatcttggctactgcaacctctgcctcc

SEQ ID NO: 51238 - DNA, 201 bp, Homo sapiens
cgcgcccagctccagaataaatttttataatattcacagatgtatgggtcacaggtagtaaaaacatttaattttttttttttttttttttttttttttaracagagtctcgctttgtcgcccaggctggagtgcagtggcacgatcttggctactgcaacctctgcctcccaggttcaagcaattcttctgcctcagcct

SEQ ID NO: 51239 - DNA, 201 bp, Homo sapiens
ttttgtgaagtcttgcgggaacgcagtcctacccattaatgttcacagtctctgtggctgtctctgagccgcaggggcagagttgagtagttgtggcagaraccatatagacggcaaagcctgaaatatttactacctgtccccataaggaaaaacagtgcttgcccttggaatagataggtttgttttttgttgttgttg

SEQ ID NO: 51240 - DNA, 201 bp, Homo sapiens
cttgcgggaacgcagtcctacccattaatgttcacagtctctgtggctgtctctgagccgcaggggcagagttgagtagttgtggcagagaccatatagayggcaaagcctgaaatatttactacctgtccccataaggaaaaacagtgcttgcccttggaatagataggtttgttttttgttgttgttgtttttgagacg

SEQ ID NO: 51241 - DNA, 201 bp, Homo sapiens
gcctggatcccggcacctggccctggcgcgagcctatggcccacttacacatcagctgaattcacacctgaccactgcagtttgttctcttgaatttcttsgaatttccttatggaggctagttcacttttgtaaacagaaaaagttgtatttttgccataggtataaagtaatatttaataaatgcagtggcaacaaagc

SEQ ID NO: 51242 - DNA, 201 bp, Homo sapiens
atgaacccagtaattccactgctaagagaattgaaaacatgtacacacagaaacttgtacatgaatattcctaacaacattatatataattgccaaaatgkggaaacaacccagatgtctgtcaactgacagataaaatatgatacatccatacaaagaaacatccagcctaagaaggaagtgctgacacacactacacca

SEQ ID NO: 51243 - DNA, 201 bp, Homo sapiens
ggctgccatttagttgaagcatgtgccaagctctcagcaataacatcttaacttgatggagtacttctaggtgctgtaccaaccctcaatacgcactatcycctctagacccgaactggccctaggagatgagtatccttattacctcatttgacaggtgaggaaacgggggctccaagtggttaagtaatgtgcccaagg

SEQ ID NO: 51244 - DNA, 201 bp, Homo sapiens; identical to SEQ ID NO: 9546

SEQ ID NO: 51245 - DNA, 201 bp, Homo sapiens; identical to SEQ ID NO: 9547

SEQ ID NO: 51246 - DNA, 201 bp, Homo sapiens
cagagtgagactccgtctcaaaagaaaaaaagaactgaaaggagttctctcacggagactaaatgtgattacatcaccaccttacatgcctccctggtccrctgtggggaacattgctctaaagcgctcaaagaggcgttgttggatgggactgtcattgcttttatccttcccatatgatcacctctttttgaattttgt

SEQ ID NO: 51247 - DNA, 201 bp, Homo sapiens
aggcaagggggaacctctttcctctcattcaatctgaacctgaacccatgggtataaaaacaatagggacagcaaacaaaaagacaaaacggtaataaatygttcatatctggcattctcaattcctcaaggaaactgaattgaagaggagaggacttcatggggatatcaactgatgaggtcttaaaaataatgttgagt

SEQ ID NO: 51248 - DNA, 201 bp, Homo sapiens
gttgggtatggagaaaaaaatgggatcccttactggatcgtgaaaaactcttggggtccccagtggggaatgaacgggtaagcagctcccaggtcccactkctgggagggggatgttgctcaggcctggaggccctgggggcatcacttccacctcagagttacggcttccacagacgagctggtcagccaagccctaggc

SEQ ID NO: 51249 - DNA, 201 bp, Homo sapiens
ggagaagtgggatatggatcattcatttggcagctaaggagagggaagaatgaattcttcacaaagtcaggtccgtgatttgccggtgatcaaataagccraatgctactgttttatgaataaatttagagggtctcacccctgaagtcagctcttggtgagcagcaaaacattctagaaaggcctgtggtggggagaccg

SEQ ID NO: 51250 - DNA, 201 bp, Homo sapiens
atgggaggtgcaaggcggggacaggcagggacataggggtgtgaggtggggaaatgcaggaagatggggggatgtgaggtggggactggcagggatatggrggtgtgaggtggggacaggcagagacatgggggtgtgaggtggggacaggcagggacataggggtatggtggggataggcagggagatggggggtgcgag

SEQ ID NO: 51251 - DNA, 201 bp, Homo sapiens
aatgtatgttcccttaggataaaattctgccaggtggggatggagataggtgttcaacaagaaaaagaaactctgtataatatctgactcttttttgtttkgttttctttatttgagatggagtttcgctcttgtcacccaggctggggtgcagtggcacaatctcggctcacagcagcctccgcctctcaggttcaagcg

SEQ ID NO: 51252 - DNA, 201 bp, Homo sapiens
ggctgagatagaattgcttgaaccagggaggtggaggttgcagtgagctgatatcgtgccactgccctccagcctgggcaacagagccagactccttctcaaaaaaaaaaaaaaaaaagaaggaaagaaagggagggagggagggctgagtgatagagcaccatgggattggatgcacagaaaggagtgcgaagaattaag

SEQ ID NO: 51253 - DNA, 201 bp, Homo sapiens
aaaaaaaaaaaaagaaggaaagaaagggagggagggagggctgagtgatagagcaccatgggattggatgcacagaaaggagtgcgaagaattaagtggcrttgctcttaaaaactgcctccattcccagctgcttatttgagcagggtttcccagccctttgacctataagaaacaaaaataagaccagaattaatgctg

SEQ ID NO: 51254 - DNA, 201 bp, Homo sapiens
aagaattaagtggcattgctcttaaaaactgcctccattcccagctgcttatttgagcagggtttcccagccctttgacctataagaaacaaaaataagascagaattaatgctgaaccttttctcaaccaaacaatattcactcatgaaaatataaatccattgcgggggatgggcagtagagtactgtttatcacatta

SEQ ID NO: 51255 - DNA, 201 bp, Homo sapiens; identical to SEQ ID NO: 9535

SEQ ID NO: 51256 - DNA, 201 bp, Homo sapiens
gaatagggaagtgtggtcttaccctgcttctcccagagagaactggaacgtgaatgaacgccttcgtgactgcagtgtgcatgcatgcaagtgtgggaggrtgtgtgaggagtggaggaatatcgcttaggttgtgtgtgcgcccacgaatgtatgtacagttcacaaacgtgatgtctgtgtaatgacagcggctgccat

SEQ ID NO: 51257 - DNA, 201 bp, Homo sapiens
caaatagtggtcccaagtgattaacttggctgacagccttccaagccctgggattcatttctgtattttgttttcaaagcacattgtggagaatgtaaatkagtacaaccattgtaaaaaaacagtatggaggttccatcaaaaactcaaaacaaaactaccatatgacccagcaagcctactactgagtatatatccaaa

SEQ ID NO: 51258 - DNA, 201 bp, Homo sapiens
ctcttaggaaaacaaaaaggtctccctctagggagctgcagcctgtttccatgacttgctactggcgtgttttgttttagcaccgtaagacctacagtacrgaggagtaccaccacaggctgcagacgtttgccagcaactggaggaagataaacgcccacaacaatgggaaccacacatttaaaagtacgtggaacgcct

SEQ ID NO: 51259 - DNA, 201 bp, Homo sapiens
ctcccagttgacgctctgggccgccacctccgcggaccctgagcgcaagagccaagccgccagcgctgcgatgtgggccacgctgccgctgctctgcgccrgggcctggctcctgggagtccccgtctgcggtgccgccgaactgtgcgtgaactccttaggtacgcagagggcgcgccgcccgagagggtgctagcaggc

SEQ ID NO: 51260 - DNA, 201 bp, Homo sapiens; identical to SEQ ID NO: 9550

SEQ ID NO: 51261 - DNA, 201 bp, Homo sapiens
taagtggcattgctcttaaaaactgcctccattcccagctgcttatttgagcagggtttcccagccctttgacctataagaaacaaaaataagaccagaawtaatgctgaaccttttctcaaccaaacaatattcactcatgaaaatataaatccattgcgggggatgggcagtagagtactgtttatcacattaagagat

SEQ ID NO: 51262 - DNA, 201 bp, Homo sapiens
ttttttgttttgttttctttatttgagatggagtttcgctcttgtcacccaggctggggtgcagtggcacaatctcggctcacagcagcctccgcctctcrggttcaagcgatcctcctgcctcagcctcctgagtagctgggattacaggcgcctgccaccatgcccagctaatttttgtatttttagtggagctggggt

SEQ ID NO: 51263 - DNA, 201 bp, Homo sapiens; identical to SEQ ID NO: 9534

SEQ ID NO: 51264 - DNA, 201 bp, Homo sapiens
taatacatttgaaatgttttaatcagttgggacactaataataattatgattactcaatccagaataaattttttttttttttttttgagacggagtctcrctctgtcgcccaggctggagtgcagtggcgtgatctcggctcactgcaagccccgcctcccgggttcacgccattctcctgcctcagcctcctgagtagc

SEQ ID NO: 51265 - DNA, 201 bp, Homo sapiens
ggagctgcttctggccatccatgctgctctgggcctctagcccctagcttgaggcaaaaggctgtactgtgaaaggagtggggaggtgacaggccatgtgwttctgtctcggtcctgtttccacagtatgacgaggaagcgatggtggaggctgtggccctctacaaccctgtgagctttgcctttgaggtgactcaggac

SEQ ID NO: 51266 - DNA, 201 bp, Homo sapiens
gagagaggccgcaggggagctgcttctggccatccatgctgctctgggcctctagcccctagcttgaggcaaaaggctgtactgtgaaaggagtggggagrtgacaggccatgtgtttctgtctcggtcctgtttccacagtatgacgaggaagcgatggtggaggctgtggccctctacaaccctgtgagctttgccttt

SEQ ID NO: 51267 - DNA, 201 bp, Homo sapiens
gtaggggttgctcatgggctcagagcagcccctgggagcatctgccttcactccggattaatttcactagaaactcacataggccgggcgcggtggctcaygcctgtaattccagcactttgggaggccgagatgggtggatcacctgaggtcgggagttcaagaccagcctaaccaacatggagaaaccccatctctact

SEQ ID NO: 51268 - DNA, 201 bp, Homo sapiens
cacatgcatccaaacacatagccaggcacccaaccactgagccaatcccctaccgacctaccatataaaatcagcctgtggatgtggaaggagtcccaccycttaccagcaggcctacttaacttctccaagtctcaatctcttcatctgaaaattgagtatgtgtatgctcataagggccttcacagggttgttatgagc

SEQ ID NO: 51269 - DNA, 201 bp, Homo sapiens
ccggattaatttcactagaaactcacataggccgggcgcggtggctcacgcctgtaattccagcactttgggaggccgagatgggtggatcacctgaggtygggagttcaagaccagcctaaccaacatggagaaaccccatctctactaaaaatacaaaattagccgggcttggtggcgcatgtctgtaatcccagctat

SEQ ID NO: 51270 - DNA, 201 bp, Homo sapiens; identical to SEQ ID NO: 9553

SEQ ID NO: 51271 - DNA, 201 bp, Homo sapiens; identical to SEQ ID NO: 9554

SEQ ID NO: 51272 - DNA, 201 bp, Homo sapiens
accttttctcaaccaaacaatattcactcatgaaaatataaatccattgcgggggatgggcagtagagtactgtttatcacattaagagatgcatttctgrtacaattttacttttgatgtttaacaattacttttcataatgtataatacatttgaaatgttttaatcagttgggacactaataataattatgattactc

SEQ ID NO: 51273 - DNA, 201 bp, Homo sapiens
gcctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattg

SEQ ID NO: 51274 - DNA, 201 bp, Homo sapiens
cctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattgg

SEQ ID NO: 51275 - DNA, 201 bp, Homo sapiens
agagctgctggcccaggagaggacctcagggaatggatgtgaatgactgaatgagtaggtccacgctgtaccccgtggtccctatctcagagggtgcaggrtttcctaggagcagagttggggagaggaacgagagatggccagacagacccagccagagacaggaagggagagaggccgcaggggagctgcttctggcca

SEQ ID NO: 51276 - DNA, 201 bp, Homo sapiens
agtttgttcatgttactgatggtggatatcaaatcatcatggtatttagattccactggctagctttaaaagaatgatataacaatcttatttttagagatttttttttttttttgagacaaggtctcactcctgtcacccaggcaggaatgcagtggcgctatcatagctcattgcagcctcaacctcccaggctcaagt

SEQ ID NO: 51277 - DNA, 201 bp, Homo sapiens
ctcaagtgattctcccgtctaattttttttatttttttgtagagacgaggtctcactttgttgcccagactggtcccaaactcctaggctcaagggattcrcctgtgtcagcctcccaaagtactgagattataggcttgggccacactgccaggtgttatttttaaatctcaatatttataagttggaatatgtctttgg

SEQ ID NO: 51278 - DNA, 201 bp, Homo sapiens
gcaccctcatgtttattgcagaactagtcacaatagccaagatatggaatcaacctaagtgcctatcaatgggtaaagcaaatgtggtgtatgtacacaayggaatattattcagccataacaaagaatgaaattctgtcatttgcagcaacatggatggaactggaggtcattatgtttagtgaaataagccaagcatag

SEQ ID NO: 51279 - DNA, 201 bp, Homo sapiens
ctctctgtgtaatgtgggatcgtaaatttgggacaaagccggtacccctctgggtggttgtgaagtttacaagagactctgtagaagcccctgccccattsctgccatctgagggtccagcctggaagccaaggtctgtctttggattgttgcggggggtaggggttgctcatgggctcagagcagcccctgggagcatct

SEQ ID NO: 51280 - DNA, 201 bp, Homo sapiens
aatatttataagttggaatatgtctttggaggtattcaaatttaaaatgaaatgtttagataagaacatacatggggaaatacggcaggaatccaaaaacaaatggctggcctgcttttgtaaaatattttgtcttgtttgttttattatgtttttgataatatctgtacatatttgggggtacatgtgaggtttcgtttt

SEQ ID NO: 51281 - DNA, 201 bp, Homo sapiens
gaaaaagaaactctgtataatatctgactcttttttgttttgttttctttatttgagatggagtttcgctcttgtcacccaggctggggtgcagtggcacratctcggctcacagcagcctccgcctctcaggttcaagcgatcctcctgcctcagcctcctgagtagctgggattacaggcgcctgccaccatgcccagc

SEQ ID NO: 51282 - DNA, 201 bp, Homo sapiens
gtaatgtgcccaaggccacagagctaggaaatagatgctggatttgaactaagaatgtgtcattccagaaccagggctcattgccttgacaacatacagcrcaaatcctgtactcaggatgtcaccctcttcagaatgttgctgctgtcactcaagctggctgctctgggccatgatatcccaaggacaggtgaatttggg

SEQ ID NO: 51283 - DNA, 201 bp, Homo sapiens
ccacctcctgggggctctgtcgccctcccactgtcagagccctcaggccactgtagagaagcagcctctttgccaacctgctccctgccaaacagggcttycaagggacagttatgcatgctgcctggatcccggcacctggccctggcgcgagcctatggcccacttacacatcagctgaattcacacctgaccactgca

SEQ ID NO: 51284 - DNA, 201 bp, Homo sapiens
ctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattgga

SEQ ID NO: 51285 - DNA, 201 bp, Homo sapiens
gtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattggaat

SEQ ID NO: 51286 - DNA, 201 bp, Homo sapiens
attatggcacttttaaagtcctgactagattggaatggatctattttagggtaaggcacggttcaccagcagattattctggccccagaataatctctccrgaggcaaactggtagtcaattgtcctaaactcaaaccctgcctccaactcttgtcctgagttgaggtctgtcttcctctaaagccctcagctgcagcagg

SEQ ID NO: 51287 - DNA, 201 bp, Homo sapiens
aataaatcgttcatatctggcattctcaattcctcaaggaaactgaattgaagaggagaggacttcatggggatatcaactgatgaggtcttaaaaataaygttgagtgaggccaggcgtgggggctcacgcctgtgatcccagcactttggtaggccaaggtgggtggatcacctgaggtcagaagtttcagaccagatt

SEQ ID NO: 51288 - DNA, 201 bp, Homo sapiens
gtccccttacttttggtctgtttccactccacagcttagaaacccaacccataacaagagtctgacatttgggcactctggggtcccaccgtttttatttttttttatttatttatttatttatttatttattttttctttttttgagatggagtctcgctctgttgcccaggctggagtgcagtggcgcgatctcagctc

SEQ ID NO: 51289 - DNA, 201 bp, Homo sapiens
tccccttacttttggtctgtttccactccacagcttagaaacccaacccataacaagagtctgacatttgggcactctggggtcccaccgtttttatttttttttatttatttatttatttatttatttattttttctttttttgagatggagtctcgctctgttgcccaggctggagtgcagtggcgcgatctcagctca

SEQ ID NO: 51290 - DNA, 201 bp, Homo sapiens
ccccttacttttggtctgtttccactccacagcttagaaacccaacccataacaagagtctgacatttgggcactctggggtcccaccgtttttatttttttttatttatttatttatttatttatttattttttctttttttgagatggagtctcgctctgttgcccaggctggagtgcagtggcgcgatctcagctcac

SEQ ID NO: 51291 - DNA, 201 bp, Homo sapiens
ggtggctcacacctgcaatcccagcactttgggaggccgaggtgggtggatcacctgaggtcaggagctcgagaccaacctagccaacatgatgaaacccygtctctacccaaaatacaaaaattagctgggtgtggtggtgcacgcctgtaatcaggctactcgggagtctgaggcaggagaatcgtttgaaccctggag

SEQ ID NO: 51292 - DNA, 201 bp, Homo sapiens
agcaatactgtctcaaaaaaaagaaaagaaaagaaagaaaaaaaaaaaggccaggcaaggtggctcacgcctgtaatcccagcactttgggaggccgaggygggtggatcacaaggtcaggagatcgagaccatcctaacacggtgaaaccccatctctactaaaaaatacaaaaaaattagccgggcacggtggcaggcg

SEQ ID NO: 51293 - DNA, 201 bp, Homo sapiens
aaagtttatttgtgtgaggcacttggagcagggtccaacacatccccacaagaggtcatgactctgaccatggataggcctgttctttgcccttggcctcycagcccccatatgcaccagaccttcagaccaatgaggcacctgccagtttgggtgtttcatctggtgtattggtttcttcctattgttgtgttctaatta

SEQ ID NO: 51294 - DNA, 201 bp, Homo sapiens
agagaccaaattaggcagcaggtgggaaggcccctggcaccagtggagtggttctttacctagctatccatcagactcacgaggggagtatctaaaaaagyaagtgcccaggccccaccccagaccaactgcattagcatctctggagtacggcccggacatctataccattgaaaaagctccccaggtattttggcagca

SEQ ID NO: 51295 - DNA, 201 bp, Homo sapiens
ctacttgggaggctgagatagaattgcttgaaccagggaggtggaggttgcagtgagctgatatcgtgccactgccctccagcctgggcaacagagccagmctccttctcaaaaaaaaaaaaaaaaaagaaggaaagaaagggagggagggagggctgagtgatagagcaccatgggattggatgcacagaaaggagtgcg

SEQ ID NO: 51296 - DNA, 201 bp, Homo sapiens
ctcctccacgctcgtgccgcccccccccgcgctcccagttgacgctctgggccgccacctccgcggaccctgagcgcaagagccaagccgccagcgctgckatgtgggccacgctgccgctgctctgcgccggggcctggctcctgggagtccccgtctgcggtgccgccgaactgtgcgtgaactccttaggtacgcaga

SEQ ID NO: 51297 - DNA, 201 bp, Homo sapiens
aagagccaagccgccagcgctgcgatgtgggccacgctgccgctgctctgcgccggggcctggctcctgggagtccccgtctgcggtgccgccgaactgtscgtgaactccttaggtacgcagagggcgcgccgcccgagagggtgctagcaggccctagagtggacgctgggagaacttggccaggggcgcactgggctc

SEQ ID NO: 51298 - DNA, 201 bp, Homo sapiens
atactttttcacattaatttggggtacaaaaccaggaagagtcggagtttctttttgcattctgcattatataacaccatttttggtgttttaaatttagyccagttttcgaaaatgcaaatcagttctaaagtgccctactttgctatagactcaacattactgtgatgcgcccagacctaattttttttttctttttac

SEQ ID NO: 51299 - DNA, 201 bp, Homo sapiens
tgggagtccccgtctgcggtgccgccgaactgtgcgtgaactccttaggtacgcagagggcgcgccgcccgagagggtgctagcaggccctagagtggackctgggagaacttggccaggggcgcactgggctccggaggaacggggcagagctttccccggtgagaggccaggaactctgcgtgctggcacggggagggg

SEQ ID NO: 51300 - DNA, 201 bp, Homo sapiens
tggtgttttaaatttagtccagttttcgaaaatgcaaatcagttctaaagtgccctactttgctatagactcaacattactgtgatgcgcccagacctaattttttttttctttttacagagaagtttcacttcaagtcatggatgtctaaggtcagtgcccaacttcttctttttgaagtttttcatttcacaaagtttc

SEQ ID NO: 51301 - DNA, 201 bp, Homo sapiens
cagcctctttgcctcagccagtgacagcatccaccacacagggtcgacacgaggggtcagggagtcatgcctgggaagcacctgcccaggggctcggctgyggcgatgacagtgctctgggctgatgctgttgaccatggtgtggggctgtgcactcctgacagagcggctggccttaaggggtctctatcccactgaggc

SEQ ID NO: 51302 - DNA, 201 bp, Homo sapiens
ctcccttgaattttctgtgtgaccttggcggtagtgggggtgttagttaccctctctgagcctccatttcattgtctacaaattgatataatcatattttmttcgtgatttttaaaagttttttaatttttgtagagatggggtttcactatgttgcccaggctggtctcaagctcctggactcaagcgatcataccgcct

SEQ ID NO: 51303 - DNA, 201 bp, Homo sapiens
agtccagttttcgaaaatgcaaatcagttctaaagtgccctactttgctatagactcaacattactgtgatgcgcccagacctaattttttttttcttttyacagagaagtttcacttcaagtcatggatgtctaaggtcagtgcccaacttcttctttttgaagtttttcatttcacaaagtttcctgttatcaaaccaa

SEQ ID NO: 51304 - DNA, 201 bp, Homo sapiens
tactttgctatagactcaacattactgtgatgcgcccagacctaattttttttttctttttacagagaagtttcacttcaagtcatggatgtctaaggtcrgtgcccaacttcttctttttgaagtttttcatttcacaaagtttcctgttatcaaaccaaactgtcccagatttgagacaatgaaaaagggaatttccaa

SEQ ID NO: 51305 - DNA, 201 bp, Homo sapiens
agtgattaacttggctgacagccttccaagccctgggattcatttctgtattttgttttcaaagcacattgtggagaatgtaaattagtacaaccattgtaaaaaaacagtatggaggttccatcaaaaactcaaaacaaaactaccatatgacccagcaagcctactactgagtatatatccaaaagaaaggaaattagt

SEQ ID NO: 51306 - DNA, 201 bp, Homo sapiens
ctggactttctccaccactggggccctggagtctgcgatcgccatcgcaaccggaaagatgctgtccttggtaagaaatcagccacaggcgaccccctgcrgaggacaccccatcctgatgtgggccaggcctgggcctttggtttccctggagcattggctaagggtgctgtttcaggtggacccagatgccccagcctt

SEQ ID NO: 51307 - DNA, 201 bp, Homo sapiens
cggttggcctcacccgccaccaaggcctctgggagtgtggccaaaagaatttaatagagtgagcaacacaccattacacatcatcctccaaacccgagatscacacacagatacagggttggcctttagatgaactcactaaagtcccagcctcccaagctcattgcgccctgtgagggtgaggtggctgtgtgtaagggc

SEQ ID NO: 51308 - DNA, 201 bp, Homo sapiens
tttgctgagtcttatcccaaggctgggcctctcagagaccccctctgccactgggacatgcccaaccaagtccccagcctgccaggccagatatctcgccrcgccagtccccgagggccccgcctctatcaggacagccccaggtgggctcacctgtgtgtacttcttgcaggggtctccccagccaggctttcgagtata

SEQ ID NO: 51309 - DNA, 201 bp, Homo sapiens
cgccaaagccttgacggcttctcagctggcaggtcactgggttgtgtccttcttccaggcggaacagcagctggtggactgcgcccaggacttcaataatyacggctgccaagggtacgtctctgaccagaaggggcccaaaacttcctcatttcccactgaccgcttcgacaggatccagtgtgtgctgggtctgccaca

SEQ ID NO: 51310 - DNA, 201 bp, Homo sapiens
gaggagtaccaccacaggctgcagacgtttgccagcaactggaggaagataaacgcccacaacaatgggaaccacacatttaaaagtacgtggaacgcctyccttccttcctggaaggatgtcagttagtgacccagcccatgaaagggcccgctgggggctggtgggtggagggagcagaagcccaggctctgaagctgt

SEQ ID NO: 51311 - DNA, 201 bp, Homo sapiens
tccttccgggagaaaaggctggcatggggcggcctgggtgtatatgctgctgtgcctttgtcctgtcctcccagattccatgtccttgtctgaaaaggagmgctttcctgttccctcgggctcctggtgataaaatagctgtgtgagggcccggccagggctaagagggggccctcggtaaattttcgggagaagtgggat

SEQ ID NO: 51312 - DNA, 201 bp, Homo sapiens
gcaggccctagagtggacgctgggagaacttggccaggggcgcactgggctccggaggaacggggcagagctttccccggtgagaggccaggaactctgcrtgctggcacggggaggggtaaactgcattataggcgggggttctcggagggtgggcggcttgtaggaccagaggagcagatgggctgagtgtccagggtc

SEQ ID NO: 51313 - DNA, 201 bp, Homo sapiens; identical to SEQ ID NO: 9541

SEQ ID NO: 51314 - DNA, 201 bp, Homo sapiens
ccctgagcgcaagagccaagccgccagcgctgcgatgtgggccacgctgccgctgctctgcgccggggcctggctcctgggagtccccgtctgcggtgccrccgaactgtgcgtgaactccttaggtacgcagagggcgcgccgcccgagagggtgctagcaggccctagagtggacgctgggagaacttggccaggggcg

SEQ ID NO: 51315 - DNA, 201 bp, Homo sapiens
agtggatctgatgaagaaagacagtagaatggtgactagcagaagctaggaagggcagggaagcagggatgaagataaactgattcctgagtacaaaatatttttttttttttgagacagagtctcactttgtcacccaggctgaagtgcagtggcacactctcggctcactgcaacctccaccttctgggttcaagcgat

SEQ ID NO: 51316 - DNA, 201 bp, Homo sapiens
ttggtctccaattaaccaggtcagtgccctccacatctcagcacccaggggccctggcctgctggaacgatccacaaaggagggtcaccagggacctagcscaggaggcagctctggggcctgaggtctagcatgcagagctttcaattctgacatcctccaagtggctgggatgggcagaggggtgaagcattccaggta

SEQ ID NO: 51317 - DNA, 201 bp, Homo sapiens
tggcacgatcttggctactgcaacctctgcctcccaggttcaagcaattcttctgcctcagcctcccaagtagctgggactacaggtgcatgccaccacgyctggcttatttttgtatttttagtagagatgaggtttcaccatgttggccaggctggtctcaaactcctgacctcatgatccacctgcctcagcctccca

SEQ ID NO: 51318 - DNA, 201 bp, Homo sapiens
cagaccaaatccggcaatatataaaaagaattatataccatctctactaaaaatacaaaagttatttaccatctctactaaaaatacaaaaattagctagmcgtggtggtgtgcacctgtaatcccagctgctccagaggctgaggcaggagaactgcttgaacccgggaggtggaggctgcagtgagccaagattgtgcc

SEQ ID NO: 51319 - DNA, 201 bp, Homo sapiens
aggagcctgctcttccctactgcctccctcctttcctactgtccctggtcccagcctcagcccacaggctctgaacttaaagaccacctgcccccttcacmgagaaaagtagccaagaaacaacccaaggagccaagaacctagggagggggggtgccctgagctctggaggaacgggacagggctttcccccagctagag

SEQ ID NO: 51320 - DNA, 201 bp, Homo sapiens
atgctcataagggccttcacagggttgttatgagcagtaaataacaaaacccatgtgaatggtggctattatattaccatggtaagaaaatgaatgtggcraaaggcccagcttgtctgctacaatgttggctctaacaggtgatctggaaaaccagtcaaacctgtagttaacagttgtggggggtgggggaggggggtg

SEQ ID NO: 51321 - DNA, 201 bp, Homo sapiens
cagggcaaggtaactccaacagcctccactctgtcttcttggcgtacagcatgcctagcttcactccctccccagccttggaagacatcccttctcccccsacctccctcccgccggaattctcacaattgtctgttctctccaaattcttccttcccctcctccacccacctgagcccactgctctcaccagtccagggg

SEQ ID NO: 51322 - DNA, 201 bp, Homo sapiens
tttgcctttgaggtgactcaggacttcatgatgtatagaacgggcatctactccaggtgagtcagggtcccaggagccaggagggacagtggggaggggcytggtgggcctcctcacaccccactcgtgggacttgggctcgtggcccagactcctgtgtgtcagacccttcatgacacctgccaggtgctgggcgttttg

SEQ ID NO: 51323 - DNA, 201 bp, Homo sapiens
ggctcctctccctcctgccacgagcgccatcctctcgcctctgtccatgcagttggcctcttgtgccaaggaccctttgggggcccacccccacccctacsctatcaaggctgctgggcctcccaccatcacctccgcccagcctggccacagccaagtgccttgtctttccccaagacctgttgctcctcctttatttcc

SEQ ID NO: 51324 - DNA, 201 bp, Homo sapiens; identical to SEQ ID NO: 9536

SEQ ID NO: 51325 - DNA, 201 bp, Homo sapiens
ctgagactgtccccactcccctgcctcacaggctctgactcggcctccacttctcagtgagtttcctcaggccgggtgaggcccctcctcaggctcccacsacacaccatgtgtgcccacctctgccaaagccagcacaggaccatctgctaccagaccctaagctccttgaggacaaggatgctttaattctctctgaaa

SEQ ID NO: 51326 - DNA, 201 bp, Homo sapiens
gtgccttagtgtccttcttaacagactcaaaccacatggaccacgaatattctttctgtccagaagggctactttccacatatagagctccagggactgtyttttctgtattcgctgttcaataaacattgagtgagcacctccccagatggagcatgctggtcctgggccatgactcaaaccaggtctgtcctcgccact

SEQ ID NO: 51327 - DNA, 201 bp, Homo sapiens
tcatgatgtatagaacgggcatctactccaggtgagtcagggtcccaggagccaggagggacagtggggaggggcttggtgggcctcctcacaccccactygtgggacttgggctcgtggcccagactcctgtgtgtcagacccttcatgacacctgccaggtgctgggcgttttgcacatccctcagttaatcctcacac

SEQ ID NO: 51328 - DNA, 201 bp, Homo sapiens; identical to SEQ ID NO: 9542

SEQ ID NO: 51329 - DNA, 201 bp, Homo sapiens
tgctgtgcctttgtcctgtcctcccagattccatgtccttgtctgaaaaggagagctttcctgttccctcgggctcctggtgataaaatagctgtgtgagsgcccggccagggctaagagggggccctcggtaaattttcgggagaagtgggatatggatcattcatttggcagctaaggagagggaagaatgaattcttc

SEQ ID NO: 51330 - DNA, 201 bp, Homo sapiens
cattgtccttggaccccctaaccccccacacactgttccagcttccactgggagctgtctgccttctgaaacactcctcttgccaacgccaacctttgaayacaccagtgtccctgctttcccagggtcctaccctgagggggaccctcatgatctggtcctccctctttttccacactcatctgccatcaaacccgtccc

SEQ ID NO: 51331 - DNA, 201 bp, Homo sapiens
ggagaaaaaaatgggatcccttactggatcgtgaaaaactcttggggtccccagtggggaatgaacgggtaagcagctcccaggtcccacttctgggaggsggatgttgctcaggcctggaggccctgggggcatcacttccacctcagagttacggcttccacagacgagctggtcagccaagccctaggccaggccagg

SEQ ID NO: 51332 - DNA, 201 bp, Homo sapiens
ctgaaggaactatcctagcccctgcctctgtggagaaaggagggacagtgcacagccggcctggtgatgccatgaggaccctgggttgtggacaggtgggrgtagggtctctggctgggcctgtttcccccatcctatacaccgctgtgggaccccacactctgcatcgtatgggcacacctacggggcaggggtttggac

SEQ ID NO: 51333 - DNA, 201 bp, Homo sapiens
gcctctgtttcctctcggcatctctccagccctcttcctttgaggggccagggaggtcagcacttctctaggctgctctggaggatgcaaaagttcctctktattgggctaaagtttactcccttccttccccacgccccagattttcccattggtcccaggtctctcctacagagccatccaaaacgttatgttccctgt

SEQ ID NO: 51334 - DNA, 201 bp, Homo sapiens
gtccctccctcccccagctgagagagatatgtgaagggaagagattgggtgaggccagtgtcaacctagggtgatgacctgggaggcaggtaggggacttaagagacatttcagaagtagaagctggaagactgaaccagcaaggtgaggaaacagagatgaacctgagagaaatccttacagcagccaccagcattgtgc

SEQ ID NO: 51335 - DNA, 201 bp, Homo sapiens
accagaaggggcccaaaacttcctcatttcccactgaccgcttcgacaggatccagtgtgtgctgggtctgccacagatataacccaccactgccctgggygatggcaaaatggtctctgttgtacaggggtggtcacctcacatggccaggtctcatagccaggacagggcagagctggaatctgagtccaggcctctgt

SEQ ID NO: 51336 - DNA, 201 bp, Homo sapiens
ccagcttctggacttttctgcaggtctccacacttttcttggctgtgggtgcagcatctccagggtttggccaaaggggtggtgttctccatgttctctgrctttccaggggacaaacagtgccttctcattcagtcaatggacatttttcaggctggaattctctgacccacagccaagggaagtaatcaaggtggctag

SEQ ID NO: 51337 - DNA, 201 bp, Homo sapiens
agcctgggcaacagagccagactccttctcaaaaaaaaaaaaaaaaaagaaggaaagaaagggagggagggagggctgagtgatagagcaccatgggattrgatgcacagaaaggagtgcgaagaattaagtggcattgctcttaaaaactgcctccattcccagctgcttatttgagcagggtttcccagccctttgacc

SEQ ID NO: 51338 - DNA, 201 bp, Homo sapiens
cacacccagagaggggcatccagacagagatggagtcacaacctaaggaagatctgctttatctgaaaaaaggtgcctgctggagctcaccctggttccayggagattccatgtccacatgccacactggccacaggagaggagagagactgtgggggaggctctttaaatgcagatttctgagccctacccagacccagt

SEQ ID NO: 51339 - DNA, 201 bp, Homo sapiens
catgctcagtgtccccttacttttggtctgtttccactccacagcttagaaacccaacccataacaagagtctgacatttgggcactctggggtcccaccrtttttatttttttttatttatttatttatttatttatttattttttctttttttgagatggagtctcgctctgttgcccaggctggagtgcagtggcgcg

SEQ ID NO: 51340 - DNA, 201 bp, Homo sapiens
ggaccagaggagcagatgggctgagtgtccagggtcccacctagccaggtggctctccagcctagaataccaaaggagcccgcagctccttccgccttccycaactggggacacagagtgtcacacagaggactctgatctgtccctgccagaggtgagcaaggacgtcccagccttctctagcagcttcccccgggactt

SEQ ID NO: 51341 - DNA, 201 bp, Homo sapiens
tctaccgcctcggcctcccaaagtgctgtgattacaggcgtgagccaccgtgcccggccaactctcccttcttaacctcacgcccaggcccagccacatgytggttcctaaatgccaggtcctaccctccctctagttctgtcccttgtcctgctgccttctctcctgccttgaaagggctgcgcttccctccttgtgacc

SEQ ID NO: 51342 - DNA, 201 bp, Homo sapiens
agaataaatggatgtggggcaggtaacaatgactagaacattcatgcaggaggcattctgcatgcaggcagtgactgcagattccaggacctgtggttagyggactcctattgatgtttctgggaactctagacctggaagttcaggtaggtaggcaagcctcaggactcatcgtcatcacttgttcccatggggcaaatg

SEQ ID NO: 51343 - DNA, 201 bp, Homo sapiens
tggctttggccctcttcaaagccagcagtggcagatagagtccttctcatgattcagcgctctctgaccccacctgcctcatcccccctctgacttctccracctctccttctgccccctctctccgactcttctcctatgctcttctgcttctaaaggcccacatgattccacagggcccctcggataacccaggataat

SEQ ID NO: 51344 - DNA, 201 bp, Homo sapiens
aactggaacgtgaatgaacgccttcgtgactgcagtgtgcatgcatgcaagtgtgggagggtgtgtgaggagtggaggaatatcgcttaggttgtgtgtgygcccacgaatgtatgtacagttcacaaacgtgatgtctgtgtaatgacagcggctgccatttagttgaagcatgtgccaagctctcagcaataacatctt

SEQ ID NO: 51345 - DNA, 201 bp, Homo sapiens
tgcttgagtgaataggaagctttcgagttctgcctaccagccctgtccagccaagactgtgccagcagctgcagtcctcagcctcatttctgtagaggtgyagaggactggaaccacggagaagccctccagccagctggagccagagggtcagacaaactcaccatgaaaagtgtgtgcaggtagcaaaggataaaaagc

SEQ ID NO: 51346 - DNA, 201 bp, Homo sapiens
ctgcttctcccagagagaactggaacgtgaatgaacgccttcgtgactgcagtgtgcatgcatgcaagtgtgggagggtgtgtgaggagtggaggaatatmgcttaggttgtgtgtgcgcccacgaatgtatgtacagttcacaaacgtgatgtctgtgtaatgacagcggctgccatttagttgaagcatgtgccaagct

SEQ ID NO: 51347 - DNA, 201 bp, Homo sapiens
gaacatcaggggatgaaacaccagtcggagggaggccacgagagagctcagatctggctctactcacaggttggaaagatgcatttttaaaaagagagggmagggcacagaggctcacatctctaatcctagcactctgggaggctgaggcaggaggatcacttgagcccaggagtttgagaccccatctctactaaaaat

SEQ ID NO: 51348 - DNA, 201 bp, Homo sapiens
gggacatgagggggtgtgaggtggggacaggcaggaagatgggaggtgcaaggcggggacaggcagggacataggggtgtgaggtggggaaatgcaggaakatggggggatgtgaggtggggactggcagggatatgggggtgtgaggtggggacaggcagagacatgggggtgtgaggtggggacaggcagggacatagg

SEQ ID NO: 51349 - DNA, 201 bp, Homo sapiens
agacaggcagggacatggggagtctgaggtggggacaggcagggagatggggggtgtgagttggggacaggcagggagatgggggggtgcgaggtggggayaagcagggacatgggggtgcgaggtggggacaggcagggacatgggggtgggaggtggggacaggcagggacatagggggtgggaggtgggcacattcag

SEQ ID NO: 51350 - DNA, 201 bp, Homo sapiens
acaggcagggacatggggagtctgaggtggggacaggcagggagatggggggtgtgagttggggacaggcagggagatgggggggtgcgaggtggggatargcagggacatgggggtgcgaggtggggacaggcagggacatgggggtgggaggtggggacaggcagggacatagggggtgggaggtgggcacattcaggg

SEQ ID NO: 51351 - DNA, 201 bp, Homo sapiens
agtctgaggtggggacaggcagggagatggggggtgtgagttggggacaggcagggagatgggggggtgcgaggtggggataagcagggacatgggggtgsgaggtggggacaggcagggacatgggggtgggaggtggggacaggcagggacatagggggtgggaggtgggcacattcagggagatgggggtgtgaggtg

SEQ ID NO: 51352 - DNA, 201 bp, Homo sapiens
caggaagggacatgaggggtgcgagttggggataggcagggagatgggggggtgcgaggtggggacacgcagggagatgggggacgtggggatggcgacasgctgggagagggagaggccaggctgagacctccccgcgcggtgccagccagtccaggcagatccaggactcagccaggcctgatacccagataagccctt

SEQ ID NO: 51353 - DNA, 201 bp, Homo sapiens
ggggaatgaacgggtaagcagctcccaggtcccacttctgggagggggatgttgctcaggcctggaggccctgggggcatcacttccacctcagagttackgcttccacagacgagctggtcagccaagccctaggccaggccagggggaaagggagcatgagaatgtagcctccacatttccaagcccccatttgcagcc

SEQ ID NO: 51354 - DNA, 201 bp, Homo sapiens
tgtcacacagaggactctgatctgtccctgccagaggtgagcaaggacgtcccagccttctctagcagcttcccccgggacttggcacacaggggatcccygtagtgtcttgggagtcccatctgtagagtaggttggacgggctgtttggaacagtgaatccctgtgcaacggcaccagggaaagcactcagaccaacag

SEQ ID NO: 51355 - DNA, 201 bp, Homo sapiens
acgggtaagcagctcccaggtcccacttctgggagggggatgttgctcaggcctggaggccctgggggcatcacttccacctcagagttacggcttccacrgacgagctggtcagccaagccctaggccaggccagggggaaagggagcatgagaatgtagcctccacatttccaagcccccatttgcagccctcacaggg

SEQ ID NO: 51356 - DNA, 201 bp, Homo sapiens
agccctaggccaggccagggggaaagggagcatgagaatgtagcctccacatttccaagcccccatttgcagccctcacagggccccaggtctttaggacrctgcagggagagcaggaggccagctggctcagaaggactgctaggaaaacagctcagaacttggaactctgctggcacgaaatcagtgtctgggagggtc

SEQ ID NO: 51357 - DNA, 201 bp, Homo sapiens
tgcgcccaggacttcaataatcacggctgccaagggtacgtctctgaccagaaggggcccaaaacttcctcatttcccactgaccgcttcgacaggatccmgtgtgtgctgggtctgccacagatataacccaccactgccctgggtgatggcaaaatggtctctgttgtacaggggtggtcacctcacatggccaggtct

SEQ ID NO: 51358 - DNA, 201 bp, Homo sapiens
ctgcgcccaggacttcaataatcacggctgccaagggtacgtctctgaccagaaggggcccaaaacttcctcatttcccactgaccgcttcgacaggatcyagtgtgtgctgggtctgccacagatataacccaccactgccctgggtgatggcaaaatggtctctgttgtacaggggtggtcacctcacatggccaggtc

SEQ ID NO: 51359 - DNA, 201 bp, Homo sapiens
tgtctgtaatcccagctatttgggaggctgaggcaggagaatcacttgatcccgggaggtggaggttgcggtgagccgagatagtgccattgcactccagsctgggcaacaagagtgaaactccatctcaaaaaaaaaaagaaactcacacgcacgtccagcgtattttctgaggactctgagaaatattggtagttgact

SEQ ID NO: 51360 - DNA, 201 bp, Homo sapiens
gggcctcagatgtggctcagccagggaggcttagcgcctcacgccaaagccttgacggcttctcagctggcaggtcactgggttgtgtccttcttccaggsggaacagcagctggtggactgcgcccaggacttcaataatcacggctgccaagggtacgtctctgaccagaaggggcccaaaacttcctcatttcccact

SEQ ID NO: 51361 - DNA, 201 bp, Homo sapiens
cggcgtccccatcactgatgtcctctgctctcccctggcctttccagggtgcctgcggcagttgctggactttctccaccactggggccctggagtctgcratcgccatcgcaaccggaaagatgctgtccttggtaagaaatcagccacaggcgaccccctgcggaggacaccccatcctgatgtgggccaggcctgggc

SEQ ID NO: 51362 - DNA, 201 bp, Homo sapiens
atgacagcggctgccatttagttgaagcatgtgccaagctctcagcaataacatcttaacttgatggagtacttctaggtgctgtaccaaccctcaatacrcactatcccctctagacccgaactggccctaggagatgagtatccttattacctcatttgacaggtgaggaaacgggggctccaagtggttaagtaatgt

SEQ ID NO: 51363 - DNA, 201 bp, Homo sapiens
ttccacagtatgacgaggaagcgatggtggaggctgtggccctctacaaccctgtgagctttgcctttgaggtgactcaggacttcatgatgtatagaacsggcatctactccaggtgagtcagggtcccaggagccaggagggacagtggggaggggcttggtgggcctcctcacaccccactcgtgggacttgggctcg

SEQ ID NO: 51364 - DNA, 201 bp, Homo sapiens
atggtccccaggagagcctcattggtgacacctgcagggccctgacgaccaggccagaactagcattcagccctcttgggcaggcccatggggtggaaatrgtgccacctgcagaagtcatcgcccctgtgctgggctggcctctgtgccctccatgtctcagatatgccctgacctgttgggctcacaaggccttgtcca

SEQ ID NO: 51365 - DNA, 201 bp, Homo sapiens
ggtgcagggtttcctaggagcagagttggggagaggaacgagagatggccagacagacccagccagagacaggaagggagagaggccgcaggggagctgcytctggccatccatgctgctctgggcctctagcccctagcttgaggcaaaaggctgtactgtgaaaggagtggggaggtgacaggccatgtgtttctgtct

SEQ ID NO: 51366 - DNA, 201 bp, Homo sapiens; identical to SEQ ID NO: 9552

SEQ ID NO: 51367 - DNA, 201 bp, Homo sapiens
aatacatttgaaatgttttaatcagttgggacactaataataattatgattactcaatccagaataaattttttttttttttttttgagacggagtctcgytctgtcgcccaggctggagtgcagtggcgtgatctcggctcactgcaagccccgcctcccgggttcacgccattctcctgcctcagcctcctgagtagct

SEQ ID NO: 51368 - DNA, 201 bp, Homo sapiens; identical to SEQ ID NO: 9572

SEQ ID NO: 51369 - DNA, 201 bp, Homo sapiens
acagaaactgtgaggatgctggtactgggaaaaaggatctgcacagcctctagaggcctcccagcaaatgcggggagccatgcccccagggtctacacacwctcgttcatcaacatcacaactggaattcgggatttgtgaagtttagagctgaacagactgttacagattatgagtcaacacgtatattttctctttcaa

SEQ ID NO: 51370 - DNA, 201 bp, Homo sapiens
aaatgtcatcatttgacagagctactatgaggaaaaatatttttatttttaaaaaagttttattgatcgattgatttgagatggggtcttgctctgtcacytaggctggagtgcagtggcttgatcatggctcactgcagcctcgaactcccgggctcaatggatcctccaggttcagtcgatcctccgggctcaattgat

SEQ ID NO: 51371 - DNA, 201 bp, Homo sapiens
caattgtggaggcagcagtggggcaggggggatggttcgttgttgggcagagaaaccttcagtggagtcaggaaagaggtaaagagtagggtaaatgcctytgtgcataactgtctacattttggtcatggtgaggcctcagggatgaggacaccagtggtgtccaccagccctggggagtgtggtggtgggagaaccttt

SEQ ID NO: 51372 - DNA, 201 bp, Homo sapiens
cgagagtgggatcaagtgccaggcacagtgcaggctgtgtgagtactcagtgaatggttccctgtgtgctaatggggcacacacctgtgagggtgtggtcrggcctctgttggtacagggatgacagtgtggtttgacaaaaaacaaacagtagaaagggtgaaaaatcaattattgtcttagccaaaaaattcttgttgt

SEQ ID NO: 51373 - DNA, 201 bp, Homo sapiens
gctgtctgtgaggcagcctttgtgctggggctgtgctgtcgccgctgcttcctgggccaggggacaagcctcccatcatgttccttatcaggggaacccargccgtcctgctggtgcttttgtgggagggcagtttgcacactgcccaggcccttctgtcctttgacttctggctttcggtggctttgctggccctgccaa

SEQ ID NO: 51374 - DNA, 201 bp, Homo sapiens
agccaccgcgcctggcatagtttttagtatttaaattaaaatgtcggggccgggcgcagtggctcatgcctgtaatcccaacactttgggaggccgaggcrggcggatcacgaggtcaagagattgagaccatcctggccaacatggtgaaaccccgtctctactaaaaacacataaattagctgggcttggtggcatgtg

SEQ ID NO: 51375 - DNA, 201 bp, Homo sapiens
tctgggagggggttgcagggggtcctgaaccacagatccctggagactcagtgggagcagctgtaccaggaatcaggcaccactccgctgctgtaagtctkcgtgagagccactggccagcttcctctgacttccctgtcccctcacccaaatcgatgacatcaggagctaatggcccaggctgccctcctgctgcagtgc

SEQ ID NO: 51376 - DNA, 201 bp, Homo sapiens
catagtggttcatgccagtaatcccaacactttgggaggccaaggcagggagatcacttgagcccagaagttcaagaccagccctgggcaacacagggagwcctgtctctacaaaaaatttaaaaattggctacatgtagtagcattcgcctgtatttgggaggctgaggtgggaggattgcttgatcctggaagtcaagg

SEQ ID NO: 51377 - DNA, 201 bp, Homo sapiens
aatggggtttcaccatgttggccaggctggtttcgaactcctgacctcaggtgatccacctgccttggcctcccaaagtgctgggattacaggcattagcyactgtgcccagcctggaggcttccttttgtattgtggactttctaagctggcctccacttttcctttctctcctgtttctgtctttttatgcttttatcc

SEQ ID NO: 51378 - DNA, 201 bp, Homo sapiens
gatcgccaagagaaattgattgacaggaaaggcagaggaagagattatgggctcccttgctggaattcctctggttcgctctatttagaggacatctccaraacaaacccaccaaaggcagtaatcagatacgatgctgttgatagagttgtccataaaagatccacgatgtcaaaacacccttggttcgtcctaacgatc

SEQ ID NO: 51379 - DNA, 201 bp, Homo sapiens
ttagttactgaggtgccagagggacctagtgagattctggtgtgcgaagaaaccccgcaaataactatctgtttgcctatgtgggtgggccctgggggtgscctctagggttgggtgtgctgctgtgtgcagggagtgtgggaacaggcacagcacaagttggccgaggtctggtggggaagcagtggcacggaggcagct

SEQ ID NO: 51380 - DNA, 201 bp, Homo sapiens
tggggcttgtttcatgtttctttcaagaaggctgggtgctgagttggaatgaatatagtatctatctcctagacacagtcaaccaggtaagtgaagggackccaccatatcttctgtgtctataggcaagagaatgtatctctataaactgttctactcagggacctcagaatgctaccaggagcagtattgacttacact

SEQ ID NO: 51381 - DNA, 201 bp, Homo sapiens
ggatggactaggacagatccgatgacttagtgtccaagttcaattgcaaatgcagcctcatttctttctttgaagtagaaaatcaaagttcatagattagrtgaaagaatagtcattgtacaaaagtaattatagtgtgtgtacttttctttatctacaggagctgtaaaattgacaagcttggcatgtggaaatcagcac

SEQ ID NO: 51382 - DNA, 201 bp, Homo sapiens
ggcttgtttcatgtttctttcaagaaggctgggtgctgagttggaatgaatatagtatctatctcctagacacagtcaaccaggtaagtgaagggacgccrccatatcttctgtgtctataggcaagagaatgtatctctataaactgttctactcagggacctcagaatgctaccaggagcagtattgacttacacttta

SEQ ID NO: 51383 - DNA, 201 bp, Homo sapiens
cttgttgaccactgtgtcagctgctgtggaccaaaatacacaggatgctgtgtgagtttagacacacttttgtccaggtgaagggtcagggaagacatcckgaaggcatgggttccaggttgagagatcattcctcctttgaccagtgatgtggaggaagggcatcgagaagtccaccagccataccagccgtgtgggaaa

SEQ ID NO: 51384 - DNA, 201 bp, Homo sapiens
gcactaggggcaggacgtggcctctctgcctcctgcggggcccacactggctgctgcatgctgccactaacatgtccccagttccggaagtctcctgtcckttctcttgtcacccaactcctgccttccctgaaagtcccttcccgcttccagcccgccggggtcagcttggtcagcgtccattccagccccaacgaccag

SEQ ID NO: 51385 - DNA, 201 bp, Homo sapiens
ggcctccacgaccctggactgggtgtggctctgcctggcagtattcagagggagatgaatgttaggctgtgattgctcatgtcgctttatttagggacacyctagaattatctggagaaagggtttgaaggccagctgtcgtccagaactaagatctgaagtggttttgtctatgctttctttctttaacacattcttcct

SEQ ID NO: 51386 - DNA, 201 bp, Homo sapiens
ggtgacagagcaagacttcatttgaaaaaaagaaaagaaagggttttcttctttggtgtgtgtcagcagaacatgaagttcatcttctcctcattgaagtyttatgaattattatcagccgtacctggtaacactggtttggcagaaagaaaactggcccggggtggggggcagaactagactcgactcttctagcctggt

SEQ ID NO: 51387 - DNA, 201 bp, Homo sapiens
accgcgcctggcatagtttttagtatttaaattaaaatgtcggggccgggcgcagtggctcatgcctgtaatcccaacactttgggaggccgaggcaggcrgatcacgaggtcaagagattgagaccatcctggccaacatggtgaaaccccgtctctactaaaaacacataaattagctgggcttggtggcatgtgcctg

SEQ ID NO: 51388 - DNA, 201 bp, Homo sapiens
tggtcctttcacaagcgcacacgtgcacatttgtgtttggatggtcatcttgttactagaaatgcagaggtgtggacctgagctagaaccttccctcaagrcagagagtctacacttgtaactgctctgacagcagggcttttgcttgtctcctccttccaggtgagcatcacggactatgtggtgtttgaccagtgcagc

SEQ ID NO: 51389 - DNA, 201 bp, Homo sapiens
gttatggtgtgtgcagggactgtgatggaaagctgatggatgcacaaacaaaacgtggcctgtctacacaatggaaggctgttcagcaataaaaaggaacraagtactgatttgtgctacaacatggaggaaccttgagaacattaggctaagtgaaagcaaccagacacaaaataccacatattatatgattcaatttta

SEQ ID NO: 51390 - DNA, 201 bp, Homo sapiens
aagaggtttattcttcattcaccaaatatcctttatttaaaattttttttcttgagccaaaaatatgtgtgcaagttagtctcttactaatcatatagaaycgtgccttattttgaatgttcttattctgaattagaaggtggaagcaggagcacctgtcacagctccctggaatcgacaccctgctccgaatttcctggg

SEQ ID NO: 51391 - DNA, 201 bp, Homo sapiens
agaataacaaaacccagtaaacttgaaaaggggaggatctgattttctgaattaccacagtattagattcaaatgttcagttttcaacaaaacaaatcacraggcacacaaagaaacaggaaagtatgctcttccaaggaaaaaaaaaacaactgaaactgtgagaccacatagtagacctactagaaaaagattttaaaa

SEQ ID NO: 51392 - DNA, 201 bp, Homo sapiens
gcagaactagactcgactcttctagcctggttctgcctttaaccaagagtctcttatcggccggagcctggtttgttttcctgtaaaatggggtgggggtrgaagaagcatcgacttaggggaatcaccaaggtgccttgagtttgttcattttataagggatattctgaaaggtatttttgcaccctttcctcagttaca

SEQ ID NO: 51393 - DNA, 201 bp, Homo sapiens
gctctctgtgggttttgaaggtgactagacagatggaactttgtgcagggttctgcttggaaaacgagattgggaaaaccagctcttccctaactaggagygattgtataccttttccatgtagccccagctcacagcatttatcctttttttttcttgtgtatatttttatcccttgttcatagcttcggagatttgatg

SEQ ID NO: 51394 - DNA, 201 bp, Homo sapiens
agtgatgggattacaggcatgagccaccgcgcccagcctaaattttgttcaattttgatcaatttgaatttcaatacttacaagtagctggtggctgcctrttggacagggagctctaggcaagatctgccattaagttatgtaatcttcagcaagtcgcttcacagcagagtcctcccctccagtctccagtgtacactt

SEQ ID NO: 51395 - DNA, 201 bp, Homo sapiens
agagaggatggcgaatggatcaaagtgggctgtggtcttgtgttgagggtactgtagctggaactgctctggccttgtgccctgtggtgtcgtgttgcagraaagatgagtccactgcagtgggaagctcactggcccttgggcttggggacaggagacaggtactcacatgcctgttctcactctgcggtctactggcct

SEQ ID NO: 51396 - DNA, 201 bp, Homo sapiens
tctcttaagagtgttcccggccatcctgggtcatcagtgtgtctttcaaaagctgccacccacttgaaccatatctcttgcacagtaatttaactcagacycaaacttccttccctggcacctgctgatccgctccagggccacgtctcttctcccagccacgcctgccgggagaccctggatgtccgcagtccagacaca

SEQ ID NO: 51397 - DNA, 201 bp, Homo sapiens
ggacccccggcgcccgccaccatgcccggctaattttttgtatttttagtagagacggggtttcactgtgttagccaggatggtcttgatctcctgacctygtgatccgcccgccttggcctcccaaagtgctgggattacaggcgtgagtcaccgtgcccatcctagttttgctggtttctatgaatttagaatcattca

SEQ ID NO: 51398 - DNA, 201 bp, Homo sapiens
ggcgcccgccaccatgcccggctaattttttgtatttttagtagagacggggtttcactgtgttagccaggatggtcttgatctcctgaccttgtgatccrcccgccttggcctcccaaagtgctgggattacaggcgtgagtcaccgtgcccatcctagttttgctggtttctatgaatttagaatcattcagttcttta

SEQ ID NO: 51399 - DNA, 201 bp, Homo sapiens
cacataggaaaaggtctgaaggaattttcacatgattacttaactctaggtagggattaagattgggatgggctgagggaggaagagtgaaagggaattaygtatttttttaactttactgaggaattactagaaatttttggtacatattacacgcataaacacagcaacacaaagatttgttttgagctttggctgcca

SEQ ID NO: 51400 - DNA, 201 bp, Homo sapiens
ccatgcccggctaattttttgtatttttagtagagacggggtttcactgtgttagccaggatggtcttgatctcctgaccttgtgatccgcccgccttggsctcccaaagtgctgggattacaggcgtgagtcaccgtgcccatcctagttttgctggtttctatgaatttagaatcattcagttctttagctggctggtg

SEQ ID NO: 51401 - DNA, 201 bp, Homo sapiens
tcataaaacaccattttatagctagaatttgttagccagaacacactccttacatatcaacgtggtctataaagggaattaaaatttttttaggtaatcartgaggtttttggaaatcatctctaccgaaattaagaaattatattaatttgtttatgattttagaatcctgcaatacttagaccttaaaagttggagctt

SEQ ID NO: 51402 - DNA, 201 bp, Homo sapiens
tttcaaatgtttttaacagtgactcttagggaaaaaaaatacattttattagatgtccattctccctaaatttacctgagttcaactgaattccaataggkttttttttagtgttaatttaaaaaaacaagctggccaggtgtgatggctcatgcctgtaatcccagcactttgggaggccaaggtgggcggatcacttaa

SEQ ID NO: 51403 - DNA, 201 bp, Homo sapiens
agtggtaaaaccagactcttctttcttagtgagagatggtctggagatgtctggatgctcagagcgtgtccacgtgcagcaagcggagaagctgccagggrccacagtttctgagacgaggctcagaggctcttccatggccagctccgtggccagcgagccaaggagcaggagcagctcgctcaactccaccgacagcgg

SEQ ID NO: 51404 - DNA, 201 bp, Homo sapiens
acgatcattgtttcaaagctgaatttgatatataatatcctccttggaccctatccaaagggatttagttactgaggtgccagagggacctagtgagattytggtgtgcgaagaaaccccgcaaataactatctgtttgcctatgtgggtgggccctgggggtggcctctagggttgggtgtgctgctgtgtgcagggagt

SEQ ID NO: 51405 - DNA, 201 bp, Homo sapiens
attctcctgcctcagcctcccacgtagctgggattacaggcacccgccaccacgcccggctaattttgtatttttggtagaaatggggtttcaccatgttkgccaggctggtttcgaactcctgacctcaggtgatccacctgccttggcctcccaaagtgctgggattacaggcattagccactgtgcccagcctggagg

SEQ ID NO: 51406 - DNA, 201 bp, Homo sapiens; identical to SEQ ID NO: 9565

SEQ ID NO: 51407 - DNA, 201 bp, Homo sapiens
tggacaaataaatgtggaaactacaaagtctgaatgaatgtgaaagttcctggaagaagacaatatagaatatttttaacattttaaaattcaccagatakagctgaatcctcttccagcttaatggctccacaaagtttttaccttaagccctttgttttccaaagattggaaataaggtaaagttgtgactgtctgcta

SEQ ID NO: 51408 - DNA, 201 bp, Homo sapiens; identical to SEQ ID NO: 9555

SEQ ID NO: 51409 - DNA, 201 bp, Homo sapiens
tgtttcaaaactgtgtcttgccctgtctcctactaactgtcgatgtgaggtatgaattatggctgcgcacttacagccacgtgtgctttccacagtctacrctggcttctgtcagtgctagcagtgtgacgctttgtcagtgctcaccatgtgcaggtatcccacaaagcactttagaggtttaactcttttacttctcta

SEQ ID NO: 51410 - DNA, 201 bp, Homo sapiens; identical to SEQ ID NO: 9575

SEQ ID NO: 51411 - DNA, 201 bp, Homo sapiens
tttgagacaaaacgccataagtctggcttttttttcttctttctttcttttttttttttttttctgagacagggtctcactctgtcacccaggatggagcrcagtggcgcaatcatggctcattgctgcctcgacctccccaagctcaagtgatccacctgcctcagcttcctgagtcactgggactacaggcatgtgcca

SEQ ID NO: 51412 - DNA, 201 bp, Homo sapiens
ctctcttaagagtgttcccggccatcctgggtcatcagtgtgtctttcaaaagctgccacccacttgaaccatatctcttgcacagtaatttaactcagasccaaacttccttccctggcacctgctgatccgctccagggccacgtctcttctcccagccacgcctgccgggagaccctggatgtccgcagtccagacac

SEQ ID NO: 51413 - DNA, 201 bp, Homo sapiens
aaaaaagtgaggaaatgataaaggcaaaatgcagtccagtggttccatctggggcacaagggggcaggaagtgttaggagcacaggagaacattggttggrtgactgatgatttctttcctaagtttggggatgggttcccaggtgtacctttccttgctaggcttcataactgcatggatatatgtacatatacacagtg

SEQ ID NO: 51414 - DNA, 201 bp, Homo sapiens
tagtggacacggggtttcactgtggtagccaggatggtcttgatctcctgacctcatgatccgcccgcctcagcctcccaaaatgctgggattacaggtgmgagccactacgcccggctttgcttgttttttcttaaggttgtgttggccacgtcggcacctacgccagtggggacacttttgccttgaagcagcctggtt

SEQ ID NO: 51415 - DNA, 201 bp, Homo sapiens; identical to SEQ ID NO: 9557

SEQ ID NO: 51416 - DNA, 201 bp, Homo sapiens
ccggcagcgtgtcgtgtttcacaggcaggtgcccggggccagtgggcttaaggccccttggggttcccagggctcctgtggacgatgtcggggggctctcraagaagccgaccccactgggctccaatctctcaaagcaagaactgagggcaaagccaggagtgtgtcccagggagggaaggggctggacacctgggctct

SEQ ID NO: 51417 - DNA, 201 bp, Homo sapiens
tggacctctcccagctaggtacggccacctcgtgagtacacctgccggtgccctgactgccctaaaccggcatcacaacgtgatgtcggacaaaactgccyggcctgtgtccaacctgtgagagttctgagggggtgtttataagctgctgaatttcaggagctcagttggccactctttcagactagacaggctctgggt

SEQ ID NO: 51418 - DNA, 201 bp, Homo sapiens
tgttttgctacactccgtgggctgtcatctgataccagtgacaactgtgcaagggtggtacctcccgattctgcacccagtgtggggcgtcctccacctgyccctctccagcagcaccaccagctaatggagctgcacaccttttattccccggttgaaagtcaaaataacccatcaaaattaaaaacttctcatccaaaa

SEQ ID NO: 51419 - DNA, 201 bp, Homo sapiens
cagaacccgcagacacggctgtgggtgtggagcacaggatctccattggggaaactggcggtttctttaaaaatgaaacaggccgggcgcagtggctcacrcctgtaatcccagcactttgggaggccgagacggatcacctgaggtcaggagttcaagaccagcttggccaacatggcaaaaccctgtctctactaaaaa

SEQ ID NO: 51420 - DNA, 201 bp, Homo sapiens
atcatggtaggaaataatttctgcttaaaccaagatgataacagattatcatcagagacagatttagaaactttaaacaaagctgtttagtttcagtttcyccttgtcttaagagcagagcttttgctctttttaaaataaactccctgccttaccctcccgactcctcacccccagactctagaccaggccctgtcctgt

SEQ ID NO: 51421 - DNA, 201 bp, Homo sapiens
ttacccagtaggtataattaacttcattttataggtagagaaatggagacaggggaccgtctgggacagatgtcacagtcaccctcagagactggaccacycagtggcagcatgactggcagctttcggaaacaaatgttatgtttgcagcagtccatcagttatttaaaattagccaaaaacatagactctccttctaca

SEQ ID NO: 51422 - DNA, 201 bp, Homo sapiens
atttggactctcacacatgcatttttatgctttgagctgttaccgttgtttagttttgtgttttttgttttttttttttttttttttttgacaggccacarttgctggtttggaaggatccggtgatattgtgtctgtttcgtgcacagaaaatgaaatatttttcttgaaaggagataggaacattataagaatttcaag

SEQ ID NO: 51423 - DNA, 201 bp, Homo sapiens
gaacaaagaaagacaaataggtggtgcccaggggggaaccatgtggcctggtgggagttttgggagaggggccgtgtggcagcacattggtgtgtgacgcrggtgcctgtggagggaacacagtgctggtggggacagagtgcaggcggtggcctcagttgggccctctcatgggcagcagtgtagggttgaccagaaacc

SEQ ID NO: 51424 - DNA, 201 bp, Homo sapiens
agtggtgcaggtctctaaggtgtgtatttgggcttcactgggaggtttctctcggggagaaacctggcttgagtgggattgagtctcaagagtgtgagggmaacaggaacaagtccatcctgagtccaagatggccttgggccatctggtgttcagcagatactcattgaggggttgggtgtgtgaacagagggatggcct

SEQ ID NO: 51425 - DNA, 201 bp, Homo sapiens
tcagtgcatgtaaagttaagcacggtgcctgccgctgtacatttcagtaaaggggagcccctgctgtcatctgtgctagcctgcgttctcgccctctagtyccttctgatatgtctctgacttctcatgactttagtttctccttctctacctccatttctcttccctgcacttttttcttcctctcttattgggattcag

SEQ ID NO: 51426 - DNA, 201 bp, Homo sapiens
ggagaatcacttgaacccgggaggcggagattgcagtgagccaagactgcaccactgcactccagcctgggtgatggagcaagacaccacctcaaaaaaawatatatatatatatatgtgtgtgtgtgtgtatatatatatacacatatatatgtatatgtatgtgtgtgtatatatatatatctatatctcacatggtca

SEQ ID NO: 51427 - DNA, 201 bp, Homo sapiens
tggtggcccacacctgtaatcccagcactttgggaggccaaggcgggcagatcacgaggtcaggagatcgagaccatcctgcctaacacggtgaaaccccrtctctactaaaaatacaaaaaaagcggggcgtggtggcgggcgcctgtggtcccagctactcagtaggctgaggcaggagaatcgcttgaacccaggagg

SEQ ID NO: 51428 - DNA, 201 bp, Homo sapiens
agttcttacagggcacatgtgggggaatagggaagagtggaaagggactttgttctgcagagacatacaggttatggtgtgtgcagggactgtgatggaargctgatggatgcacaaacaaaacgtggcctgtctacacaatggaaggctgttcagcaataaaaaggaacgaagtactgatttgtgctacaacatggagga

SEQ ID NO: 51429 - DNA, 201 bp, Homo sapiens
ccaccatgcccagataattttttaaattttggtagagacaaggtcttgctgttgcccaggctcgtctcaaactccttggctcaagcagtcctccctccttrgtcttccaaagtgctggcattacaggtatgagacaccgtgcccagccctttcctcttttcacacccttctggcagcttcccacgtcactcagaatgaaat

SEQ ID NO: 51430 - DNA, 201 bp, Homo sapiens
gaagtactgatttgtgctacaacatggaggaaccttgagaacattaggctaagtgaaagcaaccagacacaaaataccacatattatatgattcaattttratgaaatctccagaataggcgaactgtagacagagaggagatcagtggttgcccagggctgagagaagaagcgtgtagaggggtgattgctaaagggtag

SEQ ID NO: 51431 - DNA, 201 bp, Homo sapiens
tgtttcttagactttgcccattgtaaaattgtcttttgttgttgttttgagatgaagtcttgctgtgttgatcaggctggtctcaaattcctgggttcaakcgatcttcccaccccagcctcccaagtagctgagactatagccacgtgccactgcacccagcttttaaaattgtctttttattattgagttataagagct

SEQ ID NO: 51432 - DNA, 201 bp, Homo sapiens
ccatgaagtggaggtaacattcatgtctaatgtttggggattgcaggaaaaaaaaatggaagtaactatgatgcctacttcatgtttgttttttttttctytctttttggtgaggatttaatgggtttgtgtgctaagaacagtttgtattaagtacagacggttttcaacttacagagtttcaacttactattttttgac

SEQ ID NO: 51433 - DNA, 201 bp, Homo sapiens
acatgggactctattctgtctgtggttagggggcttttatggaccaagatacagcttttgtatctaagagaaatgtttacaaatacttgtgttttaatcartattcaatatattaaagttttcatttaaaacgtaactaatttaagcctctgtgctcattttaaaataatcaaaatggttcatacacatacagccctttct

SEQ ID NO: 51434 - DNA, 201 bp, Homo sapiens
ttattgactcacagttacgcatggctgcggaggcctcaggaaacttacagtcatggtggaaggcacctcttcacagggctcactgtcacaagaacaggagkggggaaaccatgcccatgattcagttatctctacctggtccctcctacgacatgtggggattatgggaactacaattcaagatgaaatttgggtgaggac

SEQ ID NO: 51435 - DNA, 201 bp, Homo sapiens
caggctggtctcgaactcccgaccccaggtgatccacctgcctcggcctcccaaagtgctgggattacgggtgtgagccactgcatccggccggaagttgyttttatttttttactatttttaatttttttaaagaggtttatttggcccacaattctgtagctggaaagtccaagattgggcagctgcatctggtgggga

SEQ ID NO: 51436 - DNA, 201 bp, Homo sapiens
gtaacaaaacttatagagctttagtaattaagggagtgtggtattagcacaagaaaagatacatagatcactggaacagattagagaagtcagaagaccarcatgtatatggatacttgagtaattgcaaaggtgatacgacaaagtctttttcagtaaatgatgtgggacagctggatatgaatgggaagaaaaatgaaa

SEQ ID NO: 51437 - DNA, 201 bp, Homo sapiens
ctaaaactatggtttttaaagatatacacgcatgtggtaaagctatgaatcaaagcaagagaatatttcatctcaatgttaggagagtggttttggtgggrtggggtatgtagtcaggcagaggcacacaagagcttcaaaggtgctgttaatggtccctttcccaagctagatggggattccatgggtgctcatttttta

SEQ ID NO: 51438 - DNA, 201 bp, Homo sapiens
acaggagaattgcttgaacctgggagatggaggttgcagtgagccaagatcacaccactgcactccagcctgggtgacagagtgagactccatcttaaaaraaagaaagaaagaaaaaaagagaacattttagtatttaaaacttactacaacactttgaaagcagatatttttttcctaagtgtttacaggagcaggcac

SEQ ID NO: 51439 - DNA, 201 bp, Homo sapiens
aggagtagagagatggaggcgctcaggggccttggattccttttgtgcctactcgcttttttcttaggttattttctctcttaagagtgttcccggccatyctgggtcatcagtgtgtctttcaaaagctgccacccacttgaaccatatctcttgcacagtaatttaactcagacccaaacttccttccctggcacctgc

SEQ ID NO: 51440 - DNA, 201 bp, Homo sapiens
acctgggagatggaggttgcagtgagccaagatcacaccactgcactccagcctgggtgacagagtgagactccatcttaaaaaaaagaaagaaagaaaaraagagaacattttagtatttaaaacttactacaacactttgaaagcagatatttttttcctaagtgtttacaggagcaggcacatgcctgtttttcaaag

SEQ ID NO: 51441 - DNA, 201 bp, Homo sapiens; identical to SEQ ID NO: 9570

SEQ ID NO: 51442 - DNA, 201 bp, Homo sapiens
acctgaggtcaggagttcaagaccagcttggccaacatggcaaaaccctgtctctactaaaaatacaaaaattagctggacgtggtggcaggtgcctgtartcccagctacttgggaggctgaggcaggagaatggcgtgaacccgggaggcggagcttgcagtgagccgagatcccgccactgcactccagcctgggcga

SEQ ID NO: 51443 - DNA, 201 bp, Homo sapiens
gagttcaagaccagcttggccaacatggcaaaaccctgtctctactaaaaatacaaaaattagctggacgtggtggcaggtgcctgtaatcccagctactygggaggctgaggcaggagaatggcgtgaacccgggaggcggagcttgcagtgagccgagatcccgccactgcactccagcctgggcgacagagcgagact

SEQ ID NO: 51444 - DNA, 201 bp, Homo sapiens
tgggagacttagttttgtttttttttgtttttttgagatggggcctcgctctgttgcccaggctggagtgcagtggcaccatcacaggtcactgcaacctygacttcctgggcccaaccgatctcagcctcccgagtagctgggactacaggtgtgtgccaccacacccaactaatttctgtgtattttgtagagacagga

SEQ ID NO: 51445 - DNA, 201 bp, Homo sapiens
ttgagatggggcctcgctctgttgcccaggctggagtgcagtggcaccatcacaggtcactgcaacctcgacttcctgggcccaaccgatctcagcctccygagtagctgggactacaggtgtgtgccaccacacccaactaatttctgtgtattttgtagagacaggatctcactatgctgcccaaactggtcttgaact

SEQ ID NO: 51446 - DNA, 201 bp, Homo sapiens
gcagctgagagatgaattttacattttgtttaatttttattttattttattttattttttgagacagagtcttgctctgtatcccaggctagagtgcagtrgtgcagtctctggtcactgcaacctccacctcctgggttcaaacgattctcctgccttagcctcccgaatagctgggattacaggtgtgcaccaccacac

SEQ ID NO: 51447 - DNA, 201 bp, Homo sapiens
tacatattacacgcataaacacagcaacacaaagatttgttttgagctttggctgccagttattagtggtttaaccccagagatgaattaaatatttatgytgttgttgttgtcattttcatcatgagagctggctgggtcttagaatcatttggtacaatccccactttttatagataaagaaattctaagattcctgct

SEQ ID NO: 51448 - DNA, 201 bp, Homo sapiens
gtggctcatgcctataatcccagcactttgggaggccaaagtgggaggatcacttgaacccaggagttcaaaatcagcctaggcagcgtagtgagaccccrtctctacaggtaattttttaaattagccaggtgtgttggcgtgcacctgtggtcccagctactccagctactcaggaggctgaggtgggaggatcacttg

SEQ ID NO: 51449 - DNA, 201 bp, Homo sapiens
tgtagagttgttttaaatattaaagtgtacaaaaaaaaaatttaaatgggccgggtgtggtggctcatgcctataatcccagcactttgggaggtcgaggsgggtagattgcttgagctcaggagttcaagaccagcctgggtattattgtgaaatcccatctctatgaaaaatacaaaagttagccaggtgtggtggcat

SEQ ID NO: 51450 - DNA, 201 bp, Homo sapiens
cgatcaatctctgctcactgcaacctccaactcctgggtccaagtgattcttctgcctcagcctcccgagtagctgggcttaacaggcgtgtgccaccacrcccagctaattttttgtatttttaatagagacagggtttcaccacattggccagcctggtctcaaactcctgacctcaggtgagccacctgccttggcct

SEQ ID NO: 51451 - DNA, 201 bp, Homo sapiens
ggatttaatgggtttgtgtgctaagaacagtttgtattaagtacagacggttttcaacttacagagtttcaacttactattttttgactttaagattgagygaaaacgataccattcagtagaaactgtatttccagtaaccatacaaccattctgtttttcactttcaatatggtattaaataaattacatgagatatgc

SEQ ID NO: 51452 - DNA, 201 bp, Homo sapiens
aggtgacagggatcctggccctttgagcccctgactctctaacttcctcccttcctcatcccactccaggtagctgggaagccaagaaattttatggtgtrtttttatttggaggttcggtgtggaagtaagacttgccatggtgagcagggctggattgagaagagttgggcaccattttctttgaagtagttaacttct

SEQ ID NO: 51453 - DNA, 201 bp, Homo sapiens
aaattttagatcacctactactttttttttgtttttttagtagagattaggtctcgagctactgggctcaggcaattctcctgcctcagtgtctcatagarctgggattataggtgtaagccactgtgctcggcctttttttttttttaattgaatttttttttatttttttgatacgtagtttcactctttttgcccagg

SEQ ID NO: 51454 - DNA, 201 bp, Homo sapiens
gctctaagcgttacatttgcaaaggtgttagaacaggagaaaatgtcatccagggactccagggagtctttgtagggagacagcagcacgcgtctcagaasgtttgtagtagaggggtgtccacagatagcaggggttgggagaagggttgacttggcgtcttgctgacccgttttaccgtctcgtgttaatgatatcctc

SEQ ID NO: 51455 - DNA, 201 bp, Homo sapiens
cttcctctttaggaattctgttttaatgagctctctgctgtgggtgaacagtctactccctgactctaaaaggaaagtccattcattctttcatgctgctsttaggccattgttagtgaactggagctggtgtttcctgaacgatgttctcctgagctggaagacctcccatatctgcatggaatcatttgcttgcttttt

SEQ ID NO: 51456 - DNA, 201 bp, Homo sapiens
tgaactcctgacctcaggtgatctgcccaccttggcctcccaaaatgctgggattacaggcataagccactgcacccggcccatcttttaataagagctcrgcatattcatacttgattgatcagcattttcgtcattagaaatgaggtggggtttttttgtttttgtttttttgtgttttcatttcaaagattaaaaacc

SEQ ID NO: 51457 - DNA, 201 bp, Homo sapiens
gaagagggagcaccagtcatctgtctccacacctagacatcaattgtactggcaggatctgtctgatctaactattttggaactcggaagtctactgaggyttacacattcttgctgggatggcaaactgtggttaattttggtcagtttcaactcttagcacagtagcagctatgcactccccaaccccagttctgtgga

SEQ ID NO: 51458 - DNA, 201 bp, Homo sapiens
ctaaaaaaacaaacttcagagaggagagaaatgcctcctcatatacaagggacccccaataagattataagcagatttctcatcaaaaactttggaggggycaggtgcagtggctcacatccataatcccagcactttgggaggctgaggcaggtggatctcttgaggccaggagtttgagaccagcctggccaacatggc

SEQ ID NO: 51459 - DNA, 201 bp, Homo sapiens
gataaaccaactagatttaacagacatttatagaacactctacccaataacaatagcatacattttctcaaatgtagatgggatgttttccaggatagacyatatgttaagccacaaattagtgtcaatagattttaaaagatatacaaagtatgttcttattgcaaccacaacaggataaagttagaaatcagtaacaga

SEQ ID NO: 51460 - DNA, 201 bp, Homo sapiens
tgtcattttcatcatgagagctggctgggtcttagaatcatttggtacaatccccactttttatagataaagaaattctaagattcctgcttcaaggcacrtatctctgattgcctaaccattgtgcttacttcttgtgagaggaggtaggccctctgtgcagtctgtggatttcaaggatatggaatacagatgcgtggt

SEQ ID NO: 51461 - DNA, 201 bp, Homo sapiens
aaagtatctctgtttgcagatgacatgatcttgtatgtagaaaccctaaagattccacaaaaaattgtttgaactaatacatgaaactgacatagtagcarcatacaaagtcaatgcacaaaaatcagttgcatttctaaacaccaacaatgaataatatgaaaaagaaattaagaggaaaattccacttaaaatggcatt

SEQ ID NO: 51462 - DNA, 201 bp, Homo sapiens
cctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaat

SEQ ID NO: 51463 - DNA, 201 bp, Homo sapiens
ctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatt

SEQ ID NO: 51464 - DNA, 201 bp, Homo sapiens
tttaaaatgctgtagggaatgaaaggacatgattttgaggcaagggtgggaagagaagcacttccagcttcctaagccttctccagcagctgccccacccyccggccccatccccagaaggtccgggagagcaccatggcgccatccttcctaggaactgccaaccctccctccctccagggcaccgagttgatagtcttc

SEQ ID NO: 51465 - DNA, 201 bp, Homo sapiens
gaattttggaaaacgtttagcctttatctctgaagataccacttttcattaccctctcttttcatttcctgctgaaacccctttttttgtttgttttttgytttgttttgttttgttttagacagagtttcactcttgttgcccaggctggagtgcaatggtgtgatcttggctcaccgcaacctctgcctcccacattca

SEQ ID NO: 51466 - DNA, 201 bp, Homo sapiens
tgaggcaagagaatcgcttgaacctgggaggcagaggttgcagtgagccgagattgtgccattgcactccagcctgggtaacagagtgagactccttctcwaaataaataaataaataagatgtggaaaaaggtaaaacagcgtatgaaggctgggtgtggtggcttacgcctgtaatcccagcattttgagaggcagatc

SEQ ID NO: 51467 - DNA, 201 bp, Homo sapiens
gaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttggg

SEQ ID NO: 51468 - DNA, 201 bp, Homo sapiens
gtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactag

SEQ ID NO: 51469 - DNA, 201 bp, Homo sapiens
tcataaagacggaaagtagaatggtagttgccaggggctggggggagggatgaatggggaattattgtttaatagagtttcagttttacaagattaaataktcgtggagatggataatggtgatgattgaagagcattatgaatgtattgaataccactgaaatgtatactttaaaaagggatactggtaattttacgtta

SEQ ID NO: 51470 - DNA, 201 bp, Homo sapiens
ttaccatgttggtcaggctggtcttgaactcctgaccttagatgatctgcctgcctcggccttccaaagtgctgggattacaggcgtgagccaccacgccyagccaagaattcagcaattattagctgcatgactttcagtccctctgatccaagactgacctagtacaaatattctctagtagtagttctcaagctttgt

SEQ ID NO: 51471 - DNA, 201 bp, Homo sapiens
tttcactatttcatctgcctccctgtctagatcataagctacttgggagtaagaactgttttgttttttgtattctttccactcctccatggcattcactrcaacataaatcatagaggtcagaacatactgaagtgcattttgagttaaaatgctcaaaagtgatcttagtgacacgtgtttactttccctgtttattta

SEQ ID NO: 51472 - DNA, 201 bp, Homo sapiens
gcagtgctcagggagactgcagcatcctggagccctgccagccaggagggactgttcccattgcgggcagaatctgttacttgcaatcagaagaacttcarctaatacttgttttttgcctgtagattcaattgaccttgggaatgttgcttaaactcgcctttcactttcattttcctatcagtaaagtgaagggtcata

SEQ ID NO: 51473 - DNA, 201 bp, Homo sapiens
gacctctccctctgggctgcactcatccagaaggtgcttccccgagcctgtctgtagagtcagccacagagcagggcgatgagctatcagagaccagggtrtgtgccactgggtccagcttctgctcttcttgtctcacagcaatatttgagtcctggtgctagccatggcgcagtcgttgggctggtatcagtgacaagg

SEQ ID NO: 51474 - DNA, 201 bp, Homo sapiens
ttttgaactcctgggctccagcaatcctgccaccttggcctcccaaagtgctggattccaggcatgagcaactgcacctggcacccctcctgttttctgtytgctctggctgaaggcctccttttccttttcttttttttttttttttttgagttggtgtttttgcccttgttgcccaggctggagtgcagtggcgcaatc

SEQ ID NO: 51475 - DNA, 201 bp, Homo sapiens
aatgaggttggtgagttcaaaaaacagaaaacaaaacaaaacaaacaagcaaacaaaaaaaccagtgtgctggaatgaaatagacagaaaaggactagtgygtgagtaggtgatcagacaactagaacctaataggccaagataagaagttggaccgagggcagtggctcacgcctgtaatcccagcacttcaggaggcca

SEQ ID NO: 51476 - DNA, 201 bp, Homo sapiens
gagtgcagtggcgcaatctgggctcactacagcctccgccccccgggttcaagcgattctcctgcctcagcctcccacgtagctgggattacaggcacccrccaccacgcccggctaattttgtatttttggtagaaatggggtttcaccatgttggccaggctggtttcgaactcctgacctcaggtgatccacctgcct

SEQ ID NO: 51477 - DNA, 201 bp, Homo sapiens
tctcctgcctcagcctcccacgtagctgggattacaggcacccgccaccacgcccggctaattttgtatttttggtagaaatggggtttcaccatgttggycaggctggtttcgaactcctgacctcaggtgatccacctgccttggcctcccaaagtgctgggattacaggcattagccactgtgcccagcctggaggct

SEQ ID NO: 51478 - DNA, 201 bp, Homo sapiens
atcatataatatgtggccttttttatctgacatctttcactttgtatcatgtttcggagttcatccacgttgtaggtgtatcagttcttaattcctttttrtgactacatcacagctctgttgtatggataggccacattggtttatcatttcaccagtggatggacatttggattgtttctgcttattggctactgtgaa

SEQ ID NO: 51479 - DNA, 201 bp, Homo sapiens
aggctttcttcagatgttggcagtcccctggttggaagagtgaggcccagcaaggctgactggaagccctgagcacatgcatggagcctgtgggccccgcrggtctctgacagcaatctggctgggctgctgggtggggagtcgttgcttttagccttccagggcccgctgagtccttgccatgcatcccccactttccag

SEQ ID NO: 51480 - DNA, 201 bp, Homo sapiens
ctttatatttttccttttaagttacaacccgcataacataaaatttcagccttctacagtgtgcagctcagtggctttagcatcagttagcagcagttagyaccatccaattccagagggttcccatcactccaaaacagagagaacacccttacccattagcagtcacttcctgttctcacagaaccagcccctccgccc

SEQ ID NO: 51481 - DNA, 201 bp, Homo sapiens
ccagggagaaataaacaggtgagtactcatgatcttaacacgtgttaacttcttggcacattcctcatggatttttaaaattagaaatcctcatctgcttrgaaagtttatgctcagagaaagccgggcacgactttctctgcccaggctcatgcctgtaatcccagtactttggaaggccaaggcgggctgatcacgagg

SEQ ID NO: 51482 - DNA, 201 bp, Homo sapiens
tgcagtggctcatgcctataatcccagcactttgggaggccaaagtgggaggatcacttgaacccaggagttcaaaatcagcctaggcagcgtagtgagaycccgtctctacaggtaattttttaaattagccaggtgtgttggcgtgcacctgtggtcccagctactccagctactcaggaggctgaggtgggaggatca

SEQ ID NO: 51483 - DNA, 201 bp, Homo sapiens
atagacttatgttttataagcttccacttctatgactaaggagttggcctactggaacattcacttttttcattccactgttgtgtattacttttacttgraaaagaagctattatcattcctacttccttgaaaggttagtaggagtgatgccaagcacttctgaatcctaactgtggacaagtcagtgatttcaatgga

SEQ ID NO: 51484 - DNA, 201 bp, Homo sapiens
cgcctgccgggagaccctggatgtccgcagtccagacacactgggcactctgcctatgggtgctgacccccctgttctcctccttattttcagcgaaaggmaagctttagaacccgtctgcataacgctcggggatcagcagactctctgggccctggacatccatgggaacctgtggttcagaactggcattatttccaa

SEQ ID NO: 51485 - DNA, 201 bp, Homo sapiens
attacagcatttcaaataaaaatggtgttttgtgaaaaaagcagctggctcagctcatagctgcaacagttgcacaagtggtttccttgagagaaccactragtgtatttcagtgtgcagcagaagggagaatacaaaagtacctatcctctggccaggtgtggtggctcacacccgtaatcccagcactttgggaggcca

SEQ ID NO: 51486 - DNA, 201 bp, Homo sapiens
tttttttttgagacatggtcttactcctctcacccaggctggtgcacagtggtgcaatcacggctcactgcagctttgacttcccaggttcaggtgattcycccaccttggcctcccgagtagctgggactatgggtgcacaccaccatgcccagctgatttttttgtatttttatagagacagggcttcgccatgttgca

SEQ ID NO: 51487 - DNA, 201 bp, Homo sapiens
gcagtatttctgaaataattgatgaaacttttcatatatatattggatttcatatatatgaaatatacatatatttcatatatatataatgtatatatatwtatattttttgagacagagtctcactgtgttgcccaggctggagtgcagtggtgcgatcttggctcactgcaacccttgcctctgggttcaagtgattct

SEQ ID NO: 51488 - DNA, 201 bp, Homo sapiens
agtatttctgaaataattgatgaaacttttcatatatatattggatttcatatatatgaaatatacatatatttcatatatatataatgtatatatatatwtattttttgagacagagtctcactgtgttgcccaggctggagtgcagtggtgcgatcttggctcactgcaacccttgcctctgggttcaagtgattctcc

SEQ ID NO: 51489 - DNA, 201 bp, Homo sapiens
tatttctgaaataattgatgaaacttttcatatatatattggatttcatatatatgaaatatacatatatttcatatatatataatgtatatatatatatwttttttgagacagagtctcactgtgttgcccaggctggagtgcagtggtgcgatcttggctcactgcaacccttgcctctgggttcaagtgattctcctg

SEQ ID NO: 51490 - DNA, 201 bp, Homo sapiens; identical to SEQ ID NO: 9568

SEQ ID NO: 51491 - DNA, 201 bp, Homo sapiens
ctgtaacctgaactcctgggctcaaatgatccttctgtctcagcctcccaagtagcggggaccataggcacgtgccaacatgcctggctaataaaaaaaawttttttgtagagacatgatctcacaatgttgcccaggctggtcttgtaaagtatcattttatgttaatagcattttatatatttaatatcatttaatttc

SEQ ID NO: 51492 - DNA, 201 bp, Homo sapiens
gcgccaccatgcctggctaatttttgtatttttagtagaggcatggtttcaccatgttggccaggctagtctcaaactcttgacctcagatgatctgccgycttggcctcccaaagtgctgagattgcaggcatgatgcatccagcctgaatacaatgttatgtgatgcgtgactgtatctgccactcatggttgttgtaa

SEQ ID NO: 51493 - DNA, 201 bp, Homo sapiens
ttgaaaaaaaaaatttggttttgacatttaggtccaattttctgccgagaaatgatgtatgttttttgtatgtaaacacaaaattaaacttgttctttttkttgttgttgttgttgttgttgttgttgagaaagagtctcgctctgtcacccaggctggagtgcagtggcatgatctcggcttactgcaacctccacctcc

SEQ ID NO: 51494 - DNA, 201 bp, Homo sapiens
tgaagtataactaagctgttttgttatacacaggcatctctcatttgtaaataatttgtaaattgaagcgagaaatgctgtattcttagtatttttttactttttttttttttttttttgagacaggtttcactctgtcgtgcaggctggagtgcagtggcatgatctcagctcactgcaacctccacctcccaggctcaa

SEQ ID NO: 51495 - DNA, 201 bp, Homo sapiens
cccaggctcaaatgattctcccacctcagcctcccaagtagctgggactatgggcgtgcaccaccacaccctgctaaattttgagactccgtctcaaaaawaaataaataaataaatataaaaagaaagctatggcaaattattttactgattttaatatatgagcttcttgaagaacaaaaactatttcttagagtcttt

SEQ ID NO: 51496 - DNA, 201 bp, Homo sapiens
ctcccaagtagctgggacccccggcgcccgccaccatgcccggctaattttttgtatttttagtagagacggggtttcactgtgttagccaggatggtctygatctcctgaccttgtgatccgcccgccttggcctcccaaagtgctgggattacaggcgtgagtcaccgtgcccatcctagttttgctggtttctatgaa

SEQ ID NO: 51497 - DNA, 201 bp, Homo sapiens
atattaatatactaactcttcataaaaataatacgtgtttctctttctcattgttgctttaaagcaaccgaactaacgaagacgggcctatggatatgttrgatatattccaattatttggcttcctctttaggaattctgttttaatgagctctctgctgtgggtgaacagtctactccctgactctaaaaggaaagtcc

SEQ ID NO: 51498 - DNA, 201 bp, Homo sapiens
taatgagctctctgctgtgggtgaacagtctactccctgactctaaaaggaaagtccattcattctttcatgctgctgttaggccattgttagtgaactgsagctggtgtttcctgaacgatgttctcctgagctggaagacctcccatatctgcatggaatcatttgcttgctttttctttctttctttctttttttttt

SEQ ID NO: 51499 - DNA, 201 bp, Homo sapiens
agcctccgccccccgggttcaagcgattctcctgcctcagcctcccacgtagctgggattacaggcacccgccaccacgcccggctaattttgtatttttrgtagaaatggggtttcaccatgttggccaggctggtttcgaactcctgacctcaggtgatccacctgccttggcctcccaaagtgctgggattacaggca

SEQ ID NO: 51500 - DNA, 201 bp, Homo sapiens
ccgcccgcctcagcctcccaaaatgctggcattataggcgtgagccaccggcctcaggagcatgttttaatcactgctgtgagtcgtcagctggggatgartcttcaggttgaagctcttgcacagctggctctctcctagctgtgtaagaacctctggcctgggtgcacagccatgctggcttcataggccatatgctgg

SEQ ID NO: 51501 - DNA, 201 bp, Homo sapiens
gaggctgaggcgagcagattgcctgagcccaggagttcaagaccagcctaagcaacatggcaaaaccccgtctgtacaaaaaatacaaaaattagctgggkgcctgtagtcccagctgctcaagaagctgaggtgggaggatcccttgagcccaggaggcagaggctgcagtgagccatgatggctgccacctcactccag

SEQ ID NO: 51502 - DNA, 201 bp, Homo sapiens
ggattacaggcatgcaccgccacacccagctaatttttgtatttttagtagagatggggtttcactatgttgaataggatggttttgatctcctgacctcrtgatccacctgcctcggcctcccaaagtgctgggattacagacgtgagtcactgtgcccagcctaattttatatttttagtagagatagggtttcactat

SEQ ID NO: 51503 - DNA, 201 bp, Homo sapiens
tggcaggcgttgatgaggccctgcggctggtggtgccgttggggacaggccgtcctggagagtcgggtgaggcggagccagcccctgtggtcgtagtcacygcccgttattctgtgttctgggctttgcggcaacacacaagtttattctcttttctgcatggcagccctccggctgttaaaagacgctctcaaacctccc

SEQ ID NO: 51504 - DNA, 201 bp, Homo sapiens
aaagcaagaagagggctgggcacagtggctaatgcctataatcccagcactttgggaggccaaggagggcggatcacctgaggtcaggagttcaagaccarcctggccaacatggtgaaaccccgtctttactaaaaatacaaaaattacctgggtgtggtggcacatgcctgtaatcccagctacttggttgggaggctg

SEQ ID NO: 51505 - DNA, 201 bp, Homo sapiens
cctcctgtttgcaaacccacagcgcctctaagcctggggttcctggtggggccctgtgcctgcttaggatttctcctcccagaggcagacaagaagagtgkgttcttcttgtcgcagagctgtaggagcctgcacacacagccactctgcctctcagggtgccacagtcagcgcagagaagcctcaggggtggcctggtct

SEQ ID NO: 51506 - DNA, 201 bp, Homo sapiens
agcgaaaatgaactactggcagctcttgaaaagctgaggtgcctgcaggcctttacacgtgttctctctgcaggaaagctccttccttcctcaggctcacratgcccatcctccaagatgcacccggatcccactgcctgtaggaagcaacccccagaccaccaagagccaactcaggttgtttgttctccccgaaccctc

SEQ ID NO: 51507 - DNA, 201 bp, Homo sapiens
cacagtcagcgcagagaagcctcaggggtggcctggtctatctgttccttgtggagccacctcctccacacagccctggtgaggggtcagggttgtggggstcactcgttattcagcacgtgtttaccatgcacccctgtgcactgtggcaggctcagcagtgacatggtaaacacggcagatctgagccctccgttgtgg

SEQ ID NO: 51508 - DNA, 201 bp, Homo sapiens
atgaggtaaatggaggaatagctcttaccacctgttctataattgtctaagggttttccccccaacaggagattctgagggcaggatcacatctgattcayggtcagcctgactcatacggggcacatatttaggaaccaaaaacataactgacttcaagaaactcaagggctggtaaagacagaccagtcatcagcgtca

SEQ ID NO: 51509 - DNA, 201 bp, Homo sapiens
tttagggaacattgattgaaagcgtgctctgctccccaggaacgttttaggatgcagaaacaaataaatgtgtccccttctcagaaggagagagattttaytgagccttggggaaatgagggctaacagaataagaggaaatgtttttaacatctgtgtcttaaagacttgctttctgctgtagactattgtgtgcgtcta

SEQ ID NO: 51510 - DNA, 201 bp, Homo sapiens
ggctgtgggtctgagacctgggggttgggtgaggtggaacatggagttgggtgaacattgggtaaggaggaggagcagaaagtcttagcagaaatgtttgytgtgtctgcattgtttttcccaaacctagcgcaggacagtgagacagcggctctatgccttttcctcagcccgtcctagacactgtttctgccaggagga

SEQ ID NO: 51511 - DNA, 201 bp, Homo sapiens
gctggcagatttgctgccacgttggttctgaggtgtgagagggatgagttggagatgattcctaggtctgtggtctatgcagctgggtgagtggacatgcygtggattgacgcagagaatcctggaggcacggggagaaggaggagatggaacagcctgctgtggccccgccatgtcctctccctgcagtggagagctggc

SEQ ID NO: 51512 - DNA, 201 bp, Homo sapiens
gcgggtgtacctctcggggagctgtgcgctggcagccactggcatgcagacaggagctcgcctagggagatttgggcaggcttgtgttctgaagaggaaasggcatcaggagagaacaggagttggggggtcagaggagtcggaggccatatggagggacatagcagctgctgcgagaccgggggctgaggcagcttcgac

SEQ ID NO: 51513 - DNA, 201 bp, Homo sapiens
agaggagtcggaggccatatggagggacatagcagctgctgcgagaccgggggctgaggcagcttcgacgggcctgagtctgtagcatggaggctgtgcasagccctcctcatcagcagggccaagggattggaagggctgaaagaggagttgacggcgagtatggagagcttttaggaggagtgtttttgtagaagagaa

SEQ ID NO: 51514 - DNA, 201 bp, Homo sapiens
tttagtagagacggggtttcactgtgttagccaggatggtcttgatctcctgaccttgtgatccgcccgccttggcctcccaaagtgctgggattacaggygtgagtcaccgtgcccatcctagttttgctggtttctatgaatttagaatcattcagttctttagctggctggtgcctctgtgacaactggtatttaggg

SEQ ID NO: 51515 - DNA, 201 bp, Homo sapiens
ctcctgggctcaagcagtcctccctccttggcctccaaaagtgctgggattacaggtgtgagccaccatgcccagctattcagcagttttagaggcagccmctcccaggaccttgctcagcagggctcctttcccttcctccagggtaagagtccacctggtgttcaggacctcgccttctcatgcccactcagatgcacc

SEQ ID NO: 51516 - DNA, 201 bp, Homo sapiens
tcactgagtgagcaatgctccatacatccaaaagcagagaacacatacatttcttccccaaaggagttttactgcaaaatacttcacattaacggaaaatmcacacacacacacacacacacactgtaaggtctaaatgatgacagaacacctgtgtgtactcaccaccctgcttaaagggtctcagttttgtacttttca

SEQ ID NO: 51517 - DNA, 201 bp, Homo sapiens
ttatttatttattttttgcgacagagtttcgctcgtcgcccaggctggagtgcaatggcacgatctcggctcactgcaacctcacctcctgagttcaagcrattctcctgcctcagcctcccgagtatgcatgcccagcgaattttgtatttttagtagatacagggtttctccatgttggtcaggctggtcttgaactcc

SEQ ID NO: 51518 - DNA, 201 bp, Homo sapiens
ttcttttttttttttttttgagacagagtcttgctgtgttgcccaggctggagtgcagtggtacaatctcagctcactgcgagctccacctcccaggttcrcactattctcctgcctcagcctccccagtagctgggactacaggcacccgccaccacgcccagctaatttttttgtatttttttagtggacacggggttt

SEQ ID NO: 51519 - DNA, 201 bp, Homo sapiens
catcaccacgcccagccaatttttttgtatttttagtagagatggagtttcactatgtcggccaggctggtcttgaacttctgacctcaagtgatctgccygcctcagcctcccaaagtgctgggattacaggtgtgagccaccacaccaggccataatttgctctaaatagcagttcaggccaggtgtggtggctcatgc

SEQ ID NO: 51520 - DNA, 201 bp, Homo sapiens
gaaatcccgtctctattaaaaatacaaaaattaaccgggcatctcaggaggctgaggcaggagaatcacttgaacctgggaggcggaagttgcagagagcygagatcgcaccattgcactccagcctgggtgacagagcaagactccatctcaaaaaacagacagacaaaaaaaagcaacaacaacaaaaagccagaatgg

SEQ ID NO: 51521 - DNA, 201 bp, Homo sapiens
tgtgatacctttttagatgcatattatgtttctaagtaccgtatactgttgtccattggaaatacctgatttaaaagcaaaattaaagctgggcatagtgkttcatgccagtaatcccaacactttgggaggccaaggcagggagatcacttgagcccagaagttcaagaccagccctgggcaacacagggagacctgtct

SEQ ID NO: 51522 - DNA, 201 bp, Homo sapiens
tacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacactctagaattatctggagaaagggtttgaaggcca

SEQ ID NO: 51523 - DNA, 201 bp, Homo sapiens
gagtagaatagtgcacttgctctgcaaatgcacttttgaggcaaatctcttgactcccttctagctagactgcagtctcaaagcccttcttgtgtagagcytgcgagctgtcagtggatagcatcaaatcaagcggatggattcttgaaagctaaatgtcatcatttgacagagctactatgaggaaaaatatttttattt

SEQ ID NO: 51524 - DNA, 201 bp, Homo sapiens
atgtgatgtatggaaagggggttccatagccaaacaagttaagctaagttcagagggaaggtggtgaatagaaatcccaaacatctgatcccagcacagcyagcggtggggacttgccttgagtgcgctccaggtggtccctggggactcggtcctggcacccctgccctcctggattgcatcccacagccctgctggccg

SEQ ID NO: 51525 - DNA, 201 bp, Homo sapiens
gcgcctgacccaagagaccttttaataattacttatttaagtgaaaattttgaatgcaggtgtgctgtctgcccaggagcccgtgtatgactgtgcatggyggctgtcatcaggtggcatgcattgaatggggattattgactgtaaaggagagtcatcaagctgacatggctgctgcctgtgttacttatctggaattaa

SEQ ID NO: 51526 - DNA, 201 bp, Homo sapiens; identical to SEQ ID NO: 9574

SEQ ID NO: 51527 - DNA, 201 bp, Homo sapiens
cactctctgttcacctgggccatccctgcccttcttggcctcctgctggagtccatgctggtatctgctgggctgtccctcagtctggcccacctgacatyctggagacaagtgaccatctcccccgtgagactggcactaggggcaggacgtggcctctctgcctcctgcggggcccacactggctgctgcatgctgcca

SEQ ID NO: 51528 - DNA, 201 bp, Homo sapiens
tctttctttgaagtagaaaatcaaagttcatagattagatgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcc

SEQ ID NO: 51529 - DNA, 201 bp, Homo sapiens
cagatgtgcgccactatgcccacctaatttttgtgtttttggtagagacagggtttcaccatgttggccaggctggtcttgaactcccaacctcaggtgakccacctgcgttggcctcccaaagtgctgggattacagatgtgagccaccgtgcctggccttactgggcatttgtgtgtcttctttggagaaatgtttctt

SEQ ID NO: 51530 - DNA, 201 bp, Homo sapiens; identical to SEQ ID NO: 9576

SEQ ID NO: 51531 - DNA, 201 bp, Homo sapiens
aggggtgacacactgaggtgtgtgggagatgtactgaatggagaatcggggacatggagaggagaggaggagggatcagggatgatgctccttttctggcytggtcagcatggcccaggcaactggtagaagatacaagataggtaagtgtctttgacattgttcatttactctgtgtttatagctaggatgtaagtttta

SEQ ID NO: 51532 - DNA, 201 bp, Homo sapiens; identical to SEQ ID NO: 9578

SEQ ID NO: 51533 - DNA, 201 bp, Homo sapiens
gcccagacctgcgcccaagctcccagctccatctgtgcccaagctcccagctccatctgtgcccaccccacaggctgtgtgattgacaagtatgtgattgrctcttgtccctgcagtgactgcgtcagatgagctgtgggctgtgggcccgcccggctacctcctccaacggctgacaaagacgttcagccactcgcacgg

SEQ ID NO: 51534 - DNA, 201 bp, Homo sapiens
tctcctgaagtgctggggtttacaggtgtgagacaccgcgcccagccttctttgtgcttttctatattaacaaatttttgaggccgggcatggtggttcayacctgtaatcccagcaagtctgggcgtggtagctcaagcctgtaatcctagcactttgggaggccaaggtgggtggatcacctgagatcaggagttcaag

SEQ ID NO: 51535 - DNA, 201 bp, Homo sapiens
cctagtcacactgctaaagatcgctgtcttaaaatccatgcacagaggcgtcctagtcacactgctaaagatcacagtcttaaaatccatgcacagaggcrtcctagtcacactgctgaagatcaccatcttaaaatccatgcacagaggcgtcctggtcacactgctaaagatcaccatcttaaaatccatgcacagagg

SEQ ID NO: 51536 - DNA, 201 bp, Homo sapiens
agtcacactgctaaagatcgctgtcttaaaatccatgcacagaggcgtcctagtcacactgctaaagatcacagtcttaaaatccatgcacagaggcatcytagtcacactgctgaagatcaccatcttaaaatccatgcacagaggcgtcctggtcacactgctaaagatcaccatcttaaaatccatgcacagaggcgt

SEQ ID NO: 51537 - DNA, 201 bp, Homo sapiens
agatcgctgtcttaaaatccatgcacagaggcgtcctagtcacactgctaaagatcacagtcttaaaatccatgcacagaggcatcctagtcacactgctraagatcaccatcttaaaatccatgcacagaggcgtcctggtcacactgctaaagatcaccatcttaaaatccatgcacagaggcgtcctagtcacactgc

SEQ ID NO: 51538 - DNA, 201 bp, Homo sapiens
attacaggcatgaatcaccccgactagcctgacttaatattgttaagctgtccataccacccaaagtaatttataagttaattcaatacaatttctatcamactcccaaggccattttttggcttgggagttttagaatataaaaatttattctaaaattcatatgggatctcaggagaacctgaaaagccccaacaaacc

SEQ ID NO: 51539 - DNA, 201 bp, Homo sapiens
cctcagcctcccaagtagctgggacccccggcgcccgccaccatgcccggctaattttttgtatttttagtagagacggggtttcactgtgttagccaggmtggtcttgatctcctgaccttgtgatccgcccgccttggcctcccaaagtgctgggattacaggcgtgagtcaccgtgcccatcctagttttgctggttt

SEQ ID NO: 51540 - DNA, 201 bp, Homo sapiens
cggagcaagtctcaaaaaaaaaagcaactttttgatagtgagcatttataactgttataaaaagaaacctttatttttaaaaagttaaataaattatggcrcatcaatgtgtgtatgagtatgtatgtatgcactctttaaggaaacaaagccttttactatttctgtgccttggaaagaagaataagaagtttctgcatc

SEQ ID NO: 51541 - DNA, 201 bp, Homo sapiens
tggacggaacagccaatgcaagggccctggggtgagaacgagctggattaatttgatcagaagagggactggaagttggtcagtccactatgtagaaatasaaaacctacagttcaaagagaccataaatccatgatgcaagaagtttctgtgagaggagcttggaagtctccatagaacctgtagagctaaaatatccct

SEQ ID NO: 51542 - DNA, 201 bp, Homo sapiens
actccgtctcaaaaataaataaataaataaatataaaaagaaagctatggcaaattattttactgattttaatatatgagcttcttgaagaacaaaaactrtttcttagagtcttttgtatgattcttttagttttggtggattttttttttttttttttttgagacggagtctcactgtgttgcccaggctggagtgcag

SEQ ID NO: 51543 - DNA, 201 bp, Homo sapiens
gattaatttgatcagaagagggactggaagttggtcagtccactatgtagaaatagaaaacctacagttcaaagagaccataaatccatgatgcaagaagkttctgtgagaggagcttggaagtctccatagaacctgtagagctaaaatatccctccaggtgtaatcaggtacagagcatctacctggactgttacagcc

SEQ ID NO: 51544 - DNA, 201 bp, Homo sapiens
ttccattctgagctcagcgggcctctgacaggcacccctttcttttataagcagagcctcactgtagaaaataaacagttttcagccaggcgcagtggctyatgcctgtaatcccagcactttgggcactttggaaggccgaggtaggtggataacctgaggtcaggagttcaaggccagcctggccaacatggtgaaact

SEQ ID NO: 51545 - DNA, 201 bp, Homo sapiens
agcagaacatgaagttcatcttctcctcattgaagtcttatgaattattatcagccgtacctggtaacactggtttggcagaaagaaaactggcccggggkggggggcagaactagactcgactcttctagcctggttctgcctttaaccaagagtctcttatcggccggagcctggtttgttttcctgtaaaatggggtg

SEQ ID NO: 51546 - DNA, 201 bp, Homo sapiens
caggcctaaggtcaaggaatacagggttgtaggcgacagttggtctgtctgctcccctgggaatagcctttgagctcatttagacatactttattgacagracacaaggaggcaaggggagagccctggacagggagccagggaccctgagctttggcctgccactgccttgcagtttgacagacctcagatttcatctgg

SEQ ID NO: 51547 - DNA, 201 bp, Homo sapiens
gtgcccacctcccaccacggctaccagagctgtcttcctcaaacccagctcagatggtgttgccctccacgttacatggctccacgctgccactagaatayagctccagtctttggtgtggcacccagggtctcgcagccagacccggcctgctgttccgaggcctcgtgcgttggggactccagccactcctggcctttg

SEQ ID NO: 51548 - DNA, 201 bp, Homo sapiens
gggtcctgcctaactctaagggaatgtgagggagccatggagtgcttggggagggctgtggtctctgccaccgcgttcaccacatcctgaccacttcttcmatggaacaggttcacaaacctcattcatccaggcggcctgggtgacactctggggtaaaagtctgcaggaaagccctcagttcaactttgtcatctttca

SEQ ID NO: 51549 - DNA, 201 bp, Homo sapiens
ttattactctcttgagttacggtgttctcaagcccagctgagtccacacagccgatgtggatggactaggacagatccgatgacttagtgtccaagttcarttgcaaatgcagcctcatttctttctttgaagtagaaaatcaaagttcatagattagatgaaagaatagtcattgtacaaaagtaattatagtgtgtgta

SEQ ID NO: 51550 - DNA, 201 bp, Homo sapiens
aaccactggcgcctgtgcttccagagctgtgggcagagtgccatggagccagctggagagggaagtgctgtcagggccttggagtggtcagaggatctcayaagaggtggcactggtacaagaaaggcaagtaggagtgtagcaggcaggcaggacagagggtgttctaagcagaggggacatgaagtataggcactgagc

SEQ ID NO: 51551 - DNA, 201 bp, Homo sapiens
gtacaatctcagctcactgcgagctccacctcccaggttcgcactattctcctgcctcagcctccccagtagctgggactacaggcacccgccaccacgcycagctaatttttttgtatttttttagtggacacggggtttcactgtggtagccaggatggtcttgatctcctgacctcatgatccgcccgcctcagcctc

SEQ ID NO: 51552 - DNA, 201 bp, Homo sapiens
gcaaactggacgttgagtcagagctcgctttttaaaaatgctgccgccctctgcgcagccctgagcatcacagcgtcatgagtctgtcatgacggtctctrttcagaattgcccaccgtcaggtagttctggtttagtgtctgtgacggcttaggtccaaatatttttctttattttcatgctaatcgaagttgatctctg

SEQ ID NO: 51553 - DNA, 201 bp, Homo sapiens
ctctgctcactgcaatctctgcctcctgggttcaagcgattctcttgcctcagcctgctgagtagctgggattacagacatgtgcctccacgcctggctatttttttttttccatatttttttagtagaggcagggtttcaccatgttggccaggctggtctcaaactcctggcctcaggtgatccgcccacctcggcctc

SEQ ID NO: 51554 - DNA, 201 bp, Homo sapiens
ctcactccgctccagtttcatcaccagtggaatggagatgagaatagtttctacctctggcttggtaagaggattaaatgggtcagtgcatgtaaagttargcacggtgcctgccgctgtacatttcagtaaaggggagcccctgctgtcatctgtgctagcctgcgttctcgccctctagtcccttctgatatgtctctg

SEQ ID NO: 51555 - DNA, 201 bp, Homo sapiens
atacaagagaatatgagtaagccttaaaaaggaaggagttctgatatgtgctataacacggatgaaccttgaagatactgtgttaaggagataagccagtyagaaaaaaggcaaatactgtatggttccatttgtatgaggtatttagagtattcaaaatcacggtaaaaggaatctgaggagattaaaaaaaaaagagta

SEQ ID NO: 51556 - DNA, 201 bp, Homo sapiens
tgtttgtctggatttggtatcaaggtaatgctgctggcctcatagaatgcactgggaagtgttttcttcttttctactttttggaagagtttttgaaagawtggttttattttttacaccccatttgttagaattcgtcatcccatccatgaattcatgtagccatgtaggcctgaactttttttgtgggaagtttttttg

SEQ ID NO: 51557 - DNA, 201 bp, Homo sapiens
atccatgaattcatgtagccatgtaggcctgaactttttttgtgggaagtttttttgactactggttcaatctctttattcattataggtctattcagaattttttttttttttttctgacatggagtctcgctctgtcacccaggctagaggatgttggcgcgatctcggcccactgcaacctccgtctcctgggttctt

SEQ ID NO: 51558 - DNA, 201 bp, Homo sapiens
cctccacctcccaggttcaagcaattctcctgcctcagcctcccaagtaactggggttacaggcgtgcaccaccatgcccggctaattttgtttcttgtgttttttttttttttttgagacggagtctcgctctgtcgcccaggctggagtgcagtggcacgatctcagctcactgcagcctccgcctcctgggttcaagc

SEQ ID NO: 51559 - DNA, 201 bp, Homo sapiens
ttgagggtctttctccattgtctctcggcttccaggattgctactgagaagccagaagcctttcttttttttttttttttttttttttgagacggagtctygctctgtcgcccaggctggagtgcagtggcatgatctcggctcactgcaagctctgcctcccaggttcacgccattctcctgcctcagcctcccgagtag

SEQ ID NO: 51560 - DNA, 201 bp, Homo sapiens
tctagattcagtaatgcacagagagatcagtaaaattagaagggagtagttgatggctttgcgaattgctaaggtagaagggagctgttactcaagatgcrtgttcaatttaaaatgaatgtattctttggacctggacataagagttctattgactttttgccactattttatatttagggctgtcatacttgggtgaat

SEQ ID NO: 51561 - DNA, 201 bp, Homo sapiens
tggggatgatattgtctatgacaacactttgtgaatgatacggcactgtcaaacatgaggttgtacataatgaattataacacatgctctgttttccctcygcacacggtgacgtactcatagtggcacagagggagagtccaccctgcagagaggagccttcctcactgccatgtttagcactgctggggcacagtgatt

SEQ ID NO: 51562 - DNA, 201 bp, Homo sapiens
tttagtagagattaggtctcgagctactgggctcaggcaattctcctgcctcagtgtctcatagaactgggattataggtgtaagccactgtgctcggcctttttttttttttaattgaatttttttttatttttttgatacgtagtttcactctttttgcccaggctggagtgcaatggcgcaatcttgactcaccgcaa

SEQ ID NO: 51563 - DNA, 201 bp, Homo sapiens
tcacactgctgaagatcaccatcttaaaatccatgcacagaggcgtcctggtcacactgctaaagatcaccatcttaaaatccatgcacagaggcgtcctrgtcacactgctgaagatcacagtcttaaaatccatgcacagaggcgtcctagtcacactgctgaagatcaccatcttaaaatccatgcacagaggcaccc

SEQ ID NO: 51564 - DNA, 201 bp, Homo sapiens
acaaaggaccggagatgctgagcatggacagaggctgcccaaggaccagggcagggcggcagtcttgtgccgcggcctggtcaacgcagatgttgcctgcscggcagcacattcgggaggacagctgtgcctagaggagaggggcctcagctgagccaggatggtgagggcagcacaggcaggtggcaggggctcctgggc

SEQ ID NO: 51565 - DNA, 201 bp, Homo sapiens
cttaaaatccatgcacagaggcgtcctggtcacactgctaaagatcaccatcttaaaatccatgcacagaggcgtcctagtcacactgctgaagatcacartcttaaaatccatgcacagaggcgtcctagtcacactgctgaagatcaccatcttaaaatccatgcacagaggcaccctagtcacactgctgaagatcac

SEQ ID NO: 51566 - DNA, 201 bp, Homo sapiens
cagaataggtagtaagtgttaaaggatggggtgtcctggagtcagagccgggcaggtcccagcggccccttcctagctctgtgctggggcaagtgccctayctcactccgctccagtttcatcaccagtggaatggagatgagaatagtttctacctctggcttggtaagaggattaaatgggtcagtgcatgtaaagtta

SEQ ID NO: 51567 - DNA, 201 bp, Homo sapiens
cctggtcacactgctaaagatcaccatcttaaaatccatgcacagaggcgtcctagtcacactgctgaagatcacagtcttaaaatccatgcacagaggcrtcctagtcacactgctgaagatcaccatcttaaaatccatgcacagaggcaccctagtcacactgctgaagatcaccatcttaaaatccatgcacagagg

SEQ ID NO: 51568 - DNA, 201 bp, Homo sapiens
tagggaagagtggaaagggactttgttctgcagagacatacaggttatggtgtgtgcagggactgtgatggaaagctgatggatgcacaaacaaaacgtgrcctgtctacacaatggaaggctgttcagcaataaaaaggaacgaagtactgatttgtgctacaacatggaggaaccttgagaacattaggctaagtgaaa

SEQ ID NO: 51569 - DNA, 201 bp, Homo sapiens
gatctgttgaataccaacagattggataacctagatgaaatggacaaacccctagaaacacaaaacctactgagactaaaccgtgaaaaaatagaataccygagtagatctataattagtaagaggatagaatcaataatcaaatatctccttgtaaagaaaagccctagacacgaagccttcaccagtgaatttaaccaa

SEQ ID NO: 51570 - DNA, 201 bp, Homo sapiens
ctggtcacactgctaaagatcaccatcttaaaatccatgcacagaggcgtcctagtcacactgctgaagatcacagtcttaaaatccatgcacagaggcgycctagtcacactgctgaagatcaccatcttaaaatccatgcacagaggcaccctagtcacactgctgaagatcaccatcttaaaatccatgcacagaggc

SEQ ID NO: 51571 - DNA, 201 bp, Homo sapiens
ctctctagctaagatgactgcaacactgaaggaaatgttattagatttctaagcattttaataattataaggaattggtttgtgacccaggtgaacatctyagtttgtcccctggtttttcttagctgccctcaaacccatggatttgttcagtacttgcatgcatagaaagcatctctttgttgggattatttgtactta

SEQ ID NO: 51572 - DNA, 201 bp, Homo sapiens
cttaaaatccatgcacagaggcgtcctagtcacactgctgaagatcacagtcttaaaatccatgcacagaggcgtcctagtcacactgctgaagatcaccvtcttaaaatccatgcacagaggcaccctagtcacactgctgaagatcaccatcttaaaatccatgcacagaggcgtcctagtcacactgctgaagatcac

SEQ ID NO: 51573 - DNA, 201 bp, Homo sapiens
catttttaaagtggctgagaggccgggcatggtggctcacacctgtaattccagaactttgggaggctgaggcaggtggatcacttgaggtcgggaattcragaccaatctggccaacatggcgagagccccatctctactaaaaatacaaaaattagccgggaatagtggctcatgcctgtaatcccagctactgagaaa

SEQ ID NO: 51574 - DNA, 201 bp, Homo sapiens
gagaccaatctggccaacatggcgagagccccatctctactaaaaatacaaaaattagccgggaatagtggctcatgcctgtaatcccagctactgagaargctgaggcatgagaatcgcttgaatctgggaggcagaggctgcagtaagctaagatcgtgccagtgcactccagcctaggcgacagagtgagactccatc

SEQ ID NO: 51575 - DNA, 201 bp, Homo sapiens
tttgggaggccgaggcaggaggatcacgaggtcaggagatcgagaccatcctggctaacatggtgaaaccctgtctctactaaaaatacaaaaaaaaggcygggtgcggtgcctcacacctgtaatcccagcactttgggaggctgaggcgggcggatcacgagatcaggagatggaggccattgggctaacatggtgaaa

SEQ ID NO: 51576 - DNA, 201 bp, Homo sapiens
cgggctggtgttaaactccgacctcagttgatctgcccgccttggcctcccaaagtgctgggattataggcgtgagccaccgtgcccagcccacattttgktttctacataatttaaaataatttttttggtaaaataatttctaaagcatttaaaataattatttactttatggtttggggcacacagtttataaaggta

SEQ ID NO: 51577 - DNA, 201 bp, Homo sapiens
aaaacaccattttatagctagaatttgttagccagaacacactccttacatatcaacgtggtctataaagggaattaaaatttttttaggtaatcaatgasgtttttggaaatcatctctaccgaaattaagaaattatattaatttgtttatgattttagaatcctgcaatacttagaccttaaaagttggagcttcagt

SEQ ID NO: 51578 - DNA, 201 bp, Homo sapiens
tagcggtggggacttgccttgagtgcgctccaggtggtccctggggactcggtcctggcacccctgccctcctggattgcatcccacagccctgctggccrccccgccccagcctccctgctgtgacaggggcaggggctgcggtgaccctgcagcacaggcgcggctccctcggatcccttggatctcaccggtgcatct

SEQ ID NO: 51579 - DNA, 201 bp, Homo sapiens
caggacgataacgatgacaggggcaacaccatggtcctcgctgcccttcctggggcaggagggcccagaagactgataagctaaacccagggcctccctcrgctgcttatctgcccagcacctttcctctaggtcctctcctcccaccagtacaggggtctgggagggggttgcagggggtcctgaaccacagatccctgg

SEQ ID NO: 51580 - DNA, 201 bp, Homo sapiens
cggccaggtgcagtggctcaagcctgtaatcccagcagtttgggaggccgaggccagcagatgacaaggtcaggagatcgagaccatcctggttaatatgrtggaaccctgtctctactgaaaagtggaaccctgtctctattaaaaaatacaaaaaaattagccatgcttggtggtgggtgcctgtagtcccagctactc

SEQ ID NO: 51581 - DNA, 201 bp, Homo sapiens
acataccaaaatttatgggacagtgaaaacagtgctaaaggagaaatttatagctttaaatatatacattaaaaaataagaaaaatctcaaatcaacaacytaaactttaccatttaaggaactagaaaaggaagaaaaactaaactcaaaactagcagaaggaaggaaataataagattagaacagaggtaaaggaaata

SEQ ID NO: 51582 - DNA, 201 bp, Homo sapiens
aatttttttttttttttgagacagactgtcactctgttgcccaggctgcagtgcaatggcgtgatctcggctcactgcaacctccacctcctaggttcaartgatgctcctgcctcagcctcccgagtagctgggactacaggcgtgtggcaccacacctggctaatttgtgtatttttagtagagacaggatttcgtgtt

SEQ ID NO: 51583 - DNA, 201 bp, Homo sapiens
ctcactgcaacctccacctcctaggttcaaatgatgctcctgcctcagcctcccgagtagctgggactacaggcgtgtggcaccacacctggctaatttgygtatttttagtagagacaggatttcgtgttagccaggctggtctggaactcttgacctcaagtgattcgcctgcatcagcctcccaaagtgctgggatta

SEQ ID NO: 51584 - DNA, 201 bp, Homo sapiens
gatgctcctgcctcagcctcccgagtagctgggactacaggcgtgtggcaccacacctggctaatttgtgtatttttagtagagacaggatttcgtgttakccaggctggtctggaactcttgacctcaagtgattcgcctgcatcagcctcccaaagtgctgggattacaggtgtgagccaccgtacctggcccagtcaa

SEQ ID NO: 51585 - DNA, 201 bp, Homo sapiens
cgtggtggcgggcgcctgtggtcccagctactcagtaggctgaggcaggagaatcgcttgaacccaggaggtggaggttgcagtgagccaaggtggcgccwctgcactccagcctggtgatagagtgagattccatctcaaaaaaaaattaaaattggggcatgagggcagggtgcagtggctcacatctgtaatcccagc

SEQ ID NO: 51586 - DNA, 201 bp, Homo sapiens
aatgctacagggtacagcccatttgagctcctgtatggatactcctttttgttaggccccagtctcattccggacactagaccaacttagactgtgccccscctcaaaaaaaaaaaacttgtcatccctactatcttctgtctagtcatattcctattcaccattctcaactaactcatacatgccctgctctggtttaca

SEQ ID NO: 51587 - DNA, 201 bp, Homo sapiens
ttgcaacattttcatgtaatggaaatttctttatcttgattttggtgttggttacatgactataaatttgtcaaaattcatagaattgtatacccaaaaarggacgaaatttactgtaagttttaccaacaaatctgatcactgccccctacttccctcacaaaatgtcagtgatgttacagcagtatttctgaaataatt

SEQ ID NO: 51588 - DNA, 201 bp, Homo sapiens
tgagtgctttagttacataagatgaaccagtcaaaatggaaatgacaagagatttttcagaggtcctacaaatagaaggaaaacatttaaaaattggatcrccaagagaaattgattgacaggaaaggcagaggaagagattatgggctcccttgctggaattcctctggttcgctctatttagaggacatctccaaaaca

SEQ ID NO: 51589 - DNA, 201 bp, Homo sapiens
ccattctgagctcagcgggcctctgacaggcacccctttcttttataagcagagcctcactgtagaaaataaacagttttcagccaggcgcagtggcttaygcctgtaatcccagcactttgggcactttggaaggccgaggtaggtggataacctgaggtcaggagttcaaggccagcctggccaacatggtgaaactcc

SEQ ID NO: 51590 - DNA, 201 bp, Homo sapiens
ttttgccatgactaggcattgaaaggattgtaatgctttgttctgtagcccccaggtttccctagatgacaaataaacattccttttcctgcgtgaagatmgtctgtggaaaccttggccatggcatcgatatcagagcctgttacattcagagagttctgcccgttgtactatctcctcaatgccattccgacaaagatc

SEQ ID NO: 51591 - DNA, 201 bp, Homo sapiens
gctgtaattttcacactggctttataggcagcctcactttaaagccaacatttaaagaaaagctttaagatctcaacttgaaaagataatttagtgccagyggtatgaagtgtctagtggaggcactctatgctttgtgatcagtttctctcctttttaaaaaatctgtcattcctaaaactcgtatccctgtgtctggat

SEQ ID NO: 51592 - DNA, 201 bp, Homo sapiens
gacgctttgtcagtgctcaccatgtgcaggtatcccacaaagcactttagaggtttaactcttttacttctctaaacacgaactataaaataggcactctycttgtccccattttacagaggagaaaatggaagcacagaacagctagacagcttgcacaaggtcacatagcaaatgaagggcgggccccaggaccccctc

SEQ ID NO: 51593 - DNA, 201 bp, Homo sapiens
cccattttacagaggagaaaatggaagcacagaacagctagacagcttgcacaaggtcacatagcaaatgaagggcgggccccaggaccccctcactcacyctctgtgctgtcatgcctcagaagtgaaacatgctgcttacttgttttgagacaaaacgccataagtctggcttttttttcttctttctttctttttttt

SEQ ID NO: 51594 - DNA, 201 bp, Homo sapiens
cgggtgtggtggcagatgcctgtaatcccaagtactcaggagcctgaggcaggagaattgcgacttgcttgaacccaggaggcggaggttgcagtgagcckagattgtgcccctgtactccagcctgggcgacagagcgagtctctgtctcaaaaaggaaaaaaaaaagaaaatatggtggaaaaaagaaagacagtggta

SEQ ID NO: 51595 - DNA, 201 bp, Homo sapiens
gattagactacaaaaaattgacttgcatccaaatgttgaagaacctggctctttgtgtaaggtgaggtatgcctgcagaataatagcagctccttcgtaaygtgatgtgatgctctaagcgttacatttgcaaaggtgttagaacaggagaaaatgtcatccagggactccagggagtctttgtagggagacagcagcacg

SEQ ID NO: 51596 - DNA, 201 bp, Homo sapiens
agctggatgggctactcgggtcccggctatggcatcctcagcttggtggtctccgagaagtatatctggtgcctggactacaaaggcggcctgttctgcarcgcgttgccgggcgccgggctgcgctggcagaagtttgaagatgctgtccagcaggtggcagtctcgccctcaggttcgcctccccgctccctgctcccg

SEQ ID NO: 51597 - DNA, 201 bp, Homo sapiens
tttttagtagagatggagtttcactatgtcggccaggctggtcttgaacttctgacctcaagtgatctgcccgcctcagcctcccaaagtgctgggattayaggtgtgagccaccacaccaggccataatttgctctaaatagcagttcaggccaggtgtggtggctcatgcctgtaatcccaacactttgggaggcctag

SEQ ID NO: 51598 - DNA, 201 bp, Homo sapiens
tagtagagatggagtttcactatgtcggccaggctggtcttgaacttctgacctcaagtgatctgcccgcctcagcctcccaaagtgctgggattacaggygtgagccaccacaccaggccataatttgctctaaatagcagttcaggccaggtgtggtggctcatgcctgtaatcccaacactttgggaggcctagacga

SEQ ID NO: 51599 - DNA, 201 bp, Homo sapiens
agcctcccgagtagctgggactacaggcacatgccaccatgtccagctcacttttgtatttttagtagaggcagggtttcactatgttggccagtctggtyttgaactcctgaccttgtgatccgcccgcctcagcctcccaaaatgctggcattataggcgtgagccaccggcctcaggagcatgttttaatcactgctg

SEQ ID NO: 51600 - DNA, 201 bp, Homo sapiens
atcactcgagtccaggagttcaaagccagcctgggcaacatggtgaaaccctgtctctaccaaaaatacaaaaattagttggacatggtggcacacgccgktggtcccaactactcggaaggctgaggtgggagaatagtttgagcccaggagacaaaggtttcagccaagatcacaccaccacactccaacctgggcaac

SEQ ID NO: 51601 - DNA, 201 bp, Homo sapiens
cttaggaacttcctggctgcaaggcttcccagtttttttaacttagaaccagcatttggttatgtggtagacttgaattgtataagcatttaatgtttgaraactcaatcacatgtactcaccaaaaaaaaaaaaaaaaaaaggatggggagaaagaaagcaagaagagggctgggcacagtggctaatgcctataatccc

SEQ ID NO: 51602 - DNA, 201 bp, Homo sapiens; identical to SEQ ID NO: 9584

SEQ ID NO: 51603 - DNA, 201 bp, Homo sapiens; identical to SEQ ID NO: 9566

SEQ ID NO: 51604 - DNA, 201 bp, Homo sapiens
aattttttttttttttgagacagtctcgctcttgtcgcccaggctggagtgcagtggcccaatctcggcttgtgacaacctccatatcccgggttcaagcrattctgccacctcagcctcgcaagtagctgggattacagggacctgccatcatgcccgactaatttttgtatttttgtagagacggagttttaccatgtt

SEQ ID NO: 51605 - DNA, 201 bp, Homo sapiens
atggtttataattgcatttttgtgttctacatgatttaagagactaaaatgcttttttaaaattagtctaaaagctagtagtattgtaatgttggtttgtraatccacattttcttttcttttcttttttttttttttttagatggtgtcttgctctgtcacccaggctggagtacagtggtgtgatatgggctcactgca

SEQ ID NO: 51606 - DNA, 201 bp, Homo sapiens
actcttaactcttgaagtaaataaataatctttgctggcaggactgtgctgaatctccttaggcactctctaatcagatatcctgagtcgtcccaattctyagaccttttatacctgtttttctccttctgttattccatttagtttctcaattcatccaaaaccatatccaggccatcatcaatcattctatatgacaaa

SEQ ID NO: 51607 - DNA, 201 bp, Homo sapiens
agctacttgggagcctgaggcacaagaatcacttgaacctgggaggcagagcttgcagtgagctgagatcgcgccactgcactctccagcctggtgacagrgcgagactccgtctcaaaacaaaacaaaacaaaaatagcagttcagcaagtcacaggaagctgccctcagggaagtttttagctgatggaagggcacagt

SEQ ID NO: 51608 - DNA, 201 bp, Homo sapiens
acaggcatttggggtgcagagatgctgacgcctgaataaggttgggattcggggcccttgggaacactgggcacctggtgggtgggtggaggggcaggacsggctgcagccatgtttcccttagaaacagactgctggaattaacgaactaaacaaatgaaccaaggtgcttcaccccccaaaaaagtgagttttgttctg

SEQ ID NO: 51609 - DNA, 201 bp, Homo sapiens
gtgcagtggcatgatctcggctcactgcaagctctgcctcccaggttcacgccattctcctgcctcagcctcccgagtagctgggactacaggcgcccgcyaccacgcctggctaattttttttttttttgtatttttagtagagatggggtttcaccgtgttagccaggatggtctcgatctcctgaccttatgatctgc

SEQ ID NO: 51610 - DNA, 201 bp, Homo sapiens
acatctcaaataaataaataaatacataaataaataaattacttttaagaatcaccaatagaaatctgtctttccatcttttttttttttttttttgagayggagtcttgctctgtcgcccaggctggagtgcaatggcgcaatcttggctcactgcaacctccgcctcctgggttcaagcaattctcctgcctcagcctc

SEQ ID NO: 51611 - DNA, 201 bp, Homo sapiens
cacgcccagctaatttttttgtatttttttagtggacacggggtttcactgtggtagccaggatggtcttgatctcctgacctcatgatccgcccgcctcrgcctcccaaaatgctgggattacaggtgagagccactacgcccggctttgcttgttttttcttaaggttgtgttggccacgtcggcacctacgccagtgg

SEQ ID NO: 51612 - DNA, 201 bp, Homo sapiens
aagcccctggctgcattgcagtctgtatgctaccagctgatgagagcctcttgccattccgtaaagcaagcatcgtcctaggctgcctggcagtggttggygtgctcagccccgggggctcctacagggtgctgagtagacatcacccattcttttgcctgaaaaggcccctgaacactaactcagctgaagaagcaagtt

SEQ ID NO: 51613 - DNA, 201 bp, Homo sapiens
aagcaattctccctgtctcaacctcccgagtagctgagattacaggcacccaccaccacacctggctaattttttgtatttttagtagagacagggtttcrccatgttggccagtctggtcctgaactcctgacctcaggtggtccgcctgcctccgcctcccaaagtgctgggattacaggcgtgagccaccacgtacag

SEQ ID NO: 51614 - DNA, 201 bp, Homo sapiens
tatttttagtagagatggggcttcaccgtgttagccaggatggtctcgatctcctgatcttgtgatccacccgcctcagcctcccaaagtgctgggattayaggtgtgagccactgcgcccagcctcaattttttttttttaaatacagcttccctcttctttctacccctatacaaattaccagagcaattactgctata

SEQ ID NO: 51615 - DNA, 201 bp, Homo sapiens
tcgatctcctgatcttgtgatccacccgcctcagcctcccaaagtgctgggattataggtgtgagccactgcgcccagcctcaattttttttttttaaatrcagcttccctcttctttctacccctatacaaattaccagagcaattactgctataggattaaattaaaggaattcttaaattaaatggttggctgctgaa

SEQ ID NO: 51616 - DNA, 201 bp, Homo sapiens
gcggagcttgcagtgagccgagatcccgccactgcactccagcctgggcgacagagcgagactccgtctcaaaaaaaaaaaaaaaaaaaaaaagaaaaaamcaaaaaaacaggaggcagaggttgcagtgagccaagatcacgccactgcactccagcctgggcaacagaacgagattctgtctcaaaaaaaataaaaaag

SEQ ID NO: 51617 - DNA, 201 bp, Homo sapiens
gaacaaccccctttgactgtaattttccattaccttcccaaatcctataaaacggccccacccctatctccctctgctgactctcttttcggactcagccygcctgcacccaggtgaaataaacagccatgttgctcaaaaaaaaaaaaaaaaaaaaaaaaaaaaaaaaaaaaaagaagatggctggattctgcattcaat

SEQ ID NO: 51618 - DNA, 201 bp, Homo sapiens
taaagtctcagaggtcagaggttgctgatgcagaggacccaggctgacccaggtccaaaccttagatcctcctttgcctcctggcctggccacctcctgcygtgtggccctcagcagatctctttctggctgagtcccgacggtctcatgggtgaagtgggatgatactaatcgtgtatcattgttgtgggtttgagatga

SEQ ID NO: 51619 - DNA, 201 bp, Homo sapiens
ctcccaaagtgctgggattacagacgtgagtcactgtgcccagcctaattttatatttttagtagagatagggtttcactatgttggccaggctggtctcraactcctgacctcaagtgatcttcccacctcggcctcccaaagtgctgggattacaggtgtgagccactgcaccctgcctctctttcttcttgagtcaat

SEQ ID NO: 51620 - DNA, 201 bp, Homo sapiens
tcataccattctcctgcctcagcctcccaagtagctgggactacaggcgcccgccaccatgcccggcaaattttttttttttttttgtattttatgttgakacagggttttaccacgttagccaggacatacaaaaaattagccaggcgtggtggcgggcgcctgtagtcccagctactcaggaggccgaggcaggagaat

SEQ ID NO: 51621 - DNA, 201 bp, Homo sapiens
ttggtctccttgatccaacctcactgagccagcgtcgcttgtatgcatgatactgcaagacttccttcccagctggcctgcacgcaggtgccttggagagrcattgggcagatggcatgtggccatttccagcagtggggcgcagtgctcagggagactgcagcatcctggagccctgccagccaggagggactgttccca

SEQ ID NO: 51622 - DNA, 201 bp, Homo sapiens
acacacaaattgaattttcaggactgccttggaaaaccagtggtggggaagatggaatgaggataaccctcttctgaaggagtgactaggaagtagctttkgttaggcatcagctatattatacccacgtgtctttttcaatagaagactggcatctactggatttttttttccaattttttcttaaagaagttacactta

SEQ ID NO: 51623 - DNA, 201 bp, Homo sapiens; identical to SEQ ID NO: 9592

SEQ ID NO: 51624 - DNA, 201 bp, Homo sapiens
agaggagcttattaaaaatgtccaggcctcggccctccctggagatatgaattcagcaggtctggggtgaggcccaggcatcttggttggttttttttttwttattttttattgatttatttgagacggagtcttgctctgtcgcccaggctggagtgcagtggcatgatctcggctcactgcaagctccacctcccgggt

SEQ ID NO: 51625 - DNA, 201 bp, Homo sapiens
ggagcttattaaaaatgtccaggcctcggccctccctggagatatgaattcagcaggtctggggtgaggcccaggcatcttggttggtttttttttttttwttttttattgatttatttgagacggagtcttgctctgtcgcccaggctggagtgcagtggcatgatctcggctcactgcaagctccacctcccgggttca

SEQ ID NO: 51626 - DNA, 201 bp, Homo sapiens
ttttgttttgttttgttttgtttttgagacagggtctctcactctgtcacccaggctggagcacaatggcgcaatcacagctcattgtagctttaaacttstgggctcaagcaatcctcccaccacagcctcccaagtagctgggaccacaggcatatgcaccatgttcagctaatttttttattattttttgtagagatg

SEQ ID NO: 51627 - DNA, 201 bp, Homo sapiens
ccttttccttttcttttttttttttttttttgagttggtgtttttgcccttgttgcccaggctggagtgcagtggcgcaatctgggctcactacagcctcygccccccgggttcaagcgattctcctgcctcagcctcccacgtagctgggattacaggcacccgccaccacgcccggctaattttgtatttttggtagaa

SEQ ID NO: 51628 - DNA, 201 bp, Homo sapiens
cccaggctggagtgcagtggcgcaatctgggctcactacagcctccgccccccgggttcaagcgattctcctgcctcagcctcccacgtagctgggattayaggcacccgccaccacgcccggctaattttgtatttttggtagaaatggggtttcaccatgttggccaggctggtttcgaactcctgacctcaggtgatc

SEQ ID NO: 51629 - DNA, 201 bp, Homo sapiens
ggagtgcagtggcgcaatctgggctcactacagcctccgccccccgggttcaagcgattctcctgcctcagcctcccacgtagctgggattacaggcaccygccaccacgcccggctaattttgtatttttggtagaaatggggtttcaccatgttggccaggctggtttcgaactcctgacctcaggtgatccacctgcc

SEQ ID NO: 51630 - DNA, 201 bp, Homo sapiens
gtggcgcaatctgggctcactacagcctccgccccccgggttcaagcgattctcctgcctcagcctcccacgtagctgggattacaggcacccgccaccaygcccggctaattttgtatttttggtagaaatggggtttcaccatgttggccaggctggtttcgaactcctgacctcaggtgatccacctgccttggcctc

SEQ ID NO: 51631 - DNA, 201 bp, Homo sapiens
cagcctccgccccccgggttcaagcgattctcctgcctcagcctcccacgtagctgggattacaggcacccgccaccacgcccggctaattttgtattttyggtagaaatggggtttcaccatgttggccaggctggtttcgaactcctgacctcaggtgatccacctgccttggcctcccaaagtgctgggattacaggc

SEQ ID NO: 51632 - DNA, 201 bp, Homo sapiens
cactccaggcagagtcagggtgtccctctggcccttctctctgttacgcagtatggcattggtttgtccgggttgtgccccaccctccccagtaggatggyagttctgggtgggcagaaacaagtgttttgtttgcagttgaggtttccccaaaacccagcatgtgtgggtgctcatttgtcgaacaaatgatcacatgcc

SEQ ID NO: 51633 - DNA, 201 bp, Homo sapiens
gtgggcagaaacaagtgttttgtttgcagttgaggtttccccaaaacccagcatgtgtgggtgctcatttgtcgaacaaatgatcacatgcctccaattaraggtgtccaggagacagctggtgtgaggccttgggccacatgagccctgccagtggtaggggtggtatggtgtaccatggaacccagtctgggaaatact

SEQ ID NO: 51634 - DNA, 201 bp, Homo sapiens
ggagaattaagaagtgactgtgcatgcctaggaaaaggtataggcacagtaaagacctgagaagaccctgagtttatacccaagactgatctttggcacasacggcctacagtaaacaaaaagaatcacacacacatccacacacagaataacaaaacccagtaaacttgaaaaggggaggatctgattttctgaattacc

SEQ ID NO: 51635 - DNA, 201 bp, Homo sapiens
gagggcgtgagcagcttctgtccggaaggcgagcagtggaagtgtgacattgtcaggtactggcgggccagagactcctttcacatcgtgcttgtcctacycttcgttcttgtccacttgacaccacaaggcaccatgaggccgttcctgggaggcagcacctgcagcctccatggctataggctaagcttgaatctctgc

SEQ ID NO: 51636 - DNA, 201 bp, Homo sapiens
agtttgagatcagcctgggcaacgtagaaaggccccgtctatatttttaattaattaattaattaaagtttttttttaaagcactcatcataaaagaatayagcaaaataccaaaaaaggaaaaataagccaataaccaagtcaaaatgaggtgtggagttctgactgtgtgtctttggggcttcttcccatcttcctggc

SEQ ID NO: 51637 - DNA, 201 bp, Homo sapiens
tgtaggggctgaggtgggaggatcacttgagcctgagaggtcaaggctgcagtgagccatgatcgggccactgcactcagcctgggtgacagagcgagacyctgtctcaaaacaaaccaaaaaacaaattagttaacctgtctggagctcagtcccatatttgtaaaatgtggctaactacagcaccttcccttatagaaa

SEQ ID NO: 51638 - DNA, 201 bp, Homo sapiens
caattttttttttttttttttttttgagccagagtttcgctcttattgcctagtctggagtgcaatggcgccatcttggctcactacaacctccgcctacygggttcaagcaattatcctgcctcagcctcctgagtagctgagattacaggcatgcaccaccatgcccaggtgatttttgtatttttaggagagacgggg

SEQ ID NO: 51639 - DNA, 201 bp, Homo sapiens
cttccctccactattgtcccatgaccctgccaaatccccctctgtgagaaacacccaagaattatcaataaaaaaataaattaaaaaaaaaaataaaaaawaaaaaataaaaaaataaaaacacacctcaccaagctcagccaccaacttaaaaaggactggacaatacttttaccactttcccttctcagaattcaggcc

SEQ ID NO: 51640 - DNA, 201 bp, Homo sapiens
tgtccagaatgacttgctcttcctcttttaaagagcatttactggtgtccccatgtgcttttcgtcagactgtgctctcccaccctctgagacctggcctscatccctaccccttcctgaagccctcctgggctgtctgcaggctggcctctcacctagagtgagggccctgccagggagtgccagtcctcctttcggaga

SEQ ID NO: 51641 - DNA, 201 bp, Homo sapiens
ctcgatgacaaacatgacccctttctgcaggaagcttcctgtggctgtgccagagcagcaaggacctgtgcagcgtcagcgcccagagcgcacagtcgcgrccctccacggtgcagctgcctcccgaagccgagatgcgcgcctatgccgcctgccaggatgcgctgtgggcgctggacagcctcggccaggtgttcatca

SEQ ID NO: 51642 - DNA, 201 bp, Homo sapiens
tctagcggcttctagtaaaggctgttaatgggcggaggctcacattaggaggcagagcccggaagcgagagagccaagggagacagggaagttttatgttmcagagacgttgcgaggtgatggagagaagaggaaagggatgcggggtagccatcctctgcccgctcacgagcacttctccgcctgccaccgtgctgcttc

SEQ ID NO: 51643 - DNA, 201 bp, Homo sapiens
ttgcagacaggtaaccgcgggccacgcttagaggcctgccagctctgccgtcactgcctctgctgcaccctgctttgctagtaacatgcttaccacaatcrctatgattaagaggctaaatccattcgaattaagacacttctgggaagagagtatttgccatttggcatgtattagcagtttcctgcattgacacaaact

SEQ ID NO: 51644 - DNA, 201 bp, Homo sapiens
taatctcagctactcgggaggctgaggcaggagaattgcttgaacctgggaggcggaggttgcggtgagccaagatcacaccattgcactccagcctgggwaacaagagcgaaactccgtctcaaaaaaaaaaaaaaaaaactaaactagctcattcacctcactggcaggctgagacctgcagtcactccagcggcaccc

SEQ ID NO: 51645 - DNA, 201 bp, Homo sapiens
gttttttgttctttctttctttcttctaattttagtactgggaaatttggtgcttgttttataccaggactctgtaagcaaagtgatctaaccttgtatgygtcacggcccgggctccggctatggaaggctgatgtccacgggactgttcaagccacgtttatcttaaaagatgcttttgccgggggagtcaagcctttt

SEQ ID NO: 51646 - DNA, 201 bp, Homo sapiens
ttgcttgaacctgggaggcggaggttgcggtgagccaagatcacaccattgcactccagcctgggtaacaagagcgaaactccgtctcaaaaaaaaaaaamaaaaactaaactagctcattcacctcactggcaggctgagacctgcagtcactccagcggcaccctgagtgagctcacacaagagagaactttggccagg

SEQ ID NO: 51647 - DNA, 201 bp, Homo sapiens
gagtgagctcacacaagagagaactttggccaggcacggtggctcacgcctgtaatctcagcactttgggaggccaaggggaatggctcacttgaacccasgagttcaagaccagcctgggcaacatggtgaaacccagtgtctacaacaaaatacaaaaattagcctggtgtggtggtgtgcacctgtagtcccagattc

SEQ ID NO: 51648 - DNA, 201 bp, Homo sapiens
gtcaggtgcagtggctcacatccataatcccagcactttgggaggctgaggcaggtggatctcttgaggccaggagtttgagaccagcctggccaacatgrcgaaactctgtctctaaaaatacaaaaattagccagggatggtggcgtatgtgcctgtaatcccagccatctgggtgcctgaggcacaagaatcgcttga

SEQ ID NO: 51649 - DNA, 201 bp, Homo sapiens
ggtgctgttgacatccacttacagctgagggtacgaagttcacatggagatggtggcttgtccagtgtcccccacctagaatgtggcaagcccagacctgygcccaagctcccagctccatctgtgcccaagctcccagctccatctgtgcccaccccacaggctgtgtgattgacaagtatgtgattggctcttgtccct

SEQ ID NO: 51650 - DNA, 201 bp, Homo sapiens; identical to SEQ ID NO: 9589

SEQ ID NO: 51651 - DNA, 201 bp, Homo sapiens; identical to SEQ ID NO: 9590

SEQ ID NO: 51652 - DNA, 201 bp, Homo sapiens; identical to SEQ ID NO: 9591

SEQ ID NO: 51653 - DNA, 201 bp, Homo sapiens
catggatggacacccattagcacagatggccctaaacaggagtgtggagcatgcagcactgagggaaccatggactccatgcagagatcaggaaggcagcrtgcagagtggaccaacagctaagccttgaagctgacgaggacttccccatatggaaggagggggagggcgtctccagcaaagagggcagtgtctgcctag

SEQ ID NO: 51654 - DNA, 201 bp, Homo sapiens
tgggagcctgaggcacaagaatcacttgaacctgggaggcagagcttgcagtgagctgagatcgcgccactgcactctccagcctggtgacagggcgagaytccgtctcaaaacaaaacaaaacaaaaatagcagttcagcaagtcacaggaagctgccctcagggaagtttttagctgatggaagggcacagtgggactt

SEQ ID NO: 51655 - DNA, 201 bp, Homo sapiens
ccaaaaaaggaaaaataagccaataaccaagtcaaaatgaggtgtggagttctgactgtgtgtctttggggcttcttcccatcttcctggcaggtctgagygtggatcgcccttgtgccagagccgtaaaggtggactgtccctacccgctgtcccagatcacagcccggaacaatgtggtgtgggcgctgacagagcaga

SEQ ID NO: 51656 - DNA, 201 bp, Homo sapiens
tctgttacttgcaatcagaagaacttcaactaatacttgttttttgcctgtagattcaattgaccttgggaatgttgcttaaactcgcctttcactttcaytttcctatcagtaaagtgaagggtcatatccacattagagccatcagaggagcttattaaaaatgtccaggcctcggccctccctggagatatgaattca

SEQ ID NO: 51657 - DNA, 201 bp, Homo sapiens
actgcaacctccgcctcctgggttcaagcaattctcctgcctcagcctcctgagtagctgggagtacaggtgcctgccaccacgcctggctaatttttttwtttttagtagagacggggtttcatcatgttggtcaggctggtctcgaactcctgacctcatgatccacccaccttggcctcccaaagtgctgggattaca

SEQ ID NO: 51658 - DNA, 201 bp, Homo sapiens
gccctcctgcccacgttggtgcgggttgaatttgacggcccagcagaattcccaggcagggcagcctggctatcctccctggtgtctcggctctgagagcrgagacccagcctcccagcctggagttgtggtgaattcgcaaacaagtctccatctccagaaccttcctgaagaaaacagctctccaggctggggcaagaa

SEQ ID NO: 51659 - DNA, 201 bp, Homo sapiens
tgggctcaagtgatcctcttacctcatcctcctgagtacctgggactacaggtgtgtgtacaaaatacaaaaaacactcccagctgtccagccttaaatamaatcttgtacataagccagatgtgttcaacaagtaacagcaaaactggtcccatgaaactgccccttccacaggggccctgaggcacctctgcaaggcca

SEQ ID NO: 51660 - DNA, 201 bp, Homo sapiens
agccagatgtgttcaacaagtaacagcaaaactggtcccatgaaactgccccttccacaggggccctgaggcacctctgcaaggccagggccccacaggcrctgctggaaaactgctggtcttcgggccagtgaggacagagagagagctcagcacagcaggccccgggcagccatacccacctcgtaccacggtcagagt

SEQ ID NO: 51661 - DNA, 201 bp, Homo sapiens
aaatacagcaaaggtgtgttgagaccgccagtgaatcaggtcactgtgatgaaagccgcacagcaggtctgtgtgttaaccccacgcggcaccttccttgstcactgtgagcaaacagtggaattccctgctcccaagatcctgtgctgcttcccactggcaccactctcagaccgtaagaaatcggtttgctccagagga

SEQ ID NO: 51662 - DNA, 201 bp, Homo sapiens
ccgtgtgggaatgggcaggtgagtgagctggcatctgtggccaggtggctagcgtctgctgaaaggcaaaggctgccttgtgcatttagggcaggcggctyggtgcagacaacacctcgatgacaaacatgacccctttctgcaggaagcttcctgtggctgtgccagagcagcaaggacctgtgcagcgtcagcgcccag

SEQ ID NO: 51663 - DNA, 201 bp, Homo sapiens
tcctctaggtcctctcctcccaccagtacaggggtctgggagggggttgcagggggtcctgaaccacagatccctggagactcagtgggagcagctgtacyaggaatcaggcaccactccgctgctgtaagtctgcgtgagagccactggccagcttcctctgacttccctgtcccctcacccaaatcgatgacatcagga

SEQ ID NO: 51664 - DNA, 201 bp, Homo sapiens; identical to SEQ ID NO: 9567

SEQ ID NO: 51665 - DNA, 201 bp, Homo sapiens; identical to SEQ ID NO: 9593

SEQ ID NO: 51666 - DNA, 201 bp, Homo sapiens
tgtgtggcccagcaccctggactcctccatgcccaggtgtgctccccccaggcacgctgggggcagggtgggcagcaggtgccccccaccaggatagtggytcttcctcctgcagaccttcagccctctgctcctggcaggacactgtggccctcctgcccacgttggtgcgggttgaatttgacggcccagcagaattcc

SEQ ID NO: 51667 - DNA, 201 bp, Homo sapiens
ttgaaaggattgtaatgctttgttctgtagcccccaggtttccctagatgacaaataaacattccttttcctgcgtgaagatagtctgtggaaaccttggycatggcatcgatatcagagcctgttacattcagagagttctgcccgttgtactatctcctcaatgccattccgacaaagatccagaagggtttccgctct

SEQ ID NO: 51668 - DNA, 201 bp, Homo sapiens; identical to SEQ ID NO: 9595

SEQ ID NO: 51669 - DNA, 201 bp, Homo sapiens; identical to SEQ ID NO: 9598

SEQ ID NO: 51670 - DNA, 201 bp, Homo sapiens; identical to SEQ ID NO: 9600

SEQ ID NO: 51671 - DNA, 201 bp, Homo sapiens
ggaagaaccttcttctgaataggatttgaggtaacttaggaaactgctctcaatacggaattttaaagttggtgaggaagtcgacagaaggggaagtcacrgtaggaaaatcaaggtactatcaggatgaagtcagcacgcagagcaaggccagcgaggcccaggcgccaggccttggtccctgcccacctcacccaggcc

SEQ ID NO: 51672 - DNA, 201 bp, Homo sapiens
cccgccccagcctccctgctgtgacaggggcaggggctgcggtgaccctgcagcacaggcgcggctccctcggatcccttggatctcaccggtgcatctgrggttctgcgtggaaagtggctcgggcttccaatgccgctctgctttaagctgggaccgctgtccagggtggtgcccagccttctggcatctgccatccaa

SEQ ID NO: 51673 - DNA, 201 bp, Homo sapiens
agagatgggggtgttctctcactgctggcttttgatgagcccaggagggctcagccttcactatcctccctaacaggcatttggggtgcagagatgctgaygcctgaataaggttgggattcggggcccttgggaacactgggcacctggtgggtgggtggaggggcaggacgggctgcagccatgtttcccttagaaaca

SEQ ID NO: 51674 - DNA, 201 bp, Homo sapiens
tccatctctactaaaaatacaaaaattagctgggcgtggtggcacgcgcctgtaatcccagctactcaggaggctgaggcacgagaatcacttgaacccasgaggcagaggttgcagtgagccaagattgcacccctgtacaccagcctggatgacagagcaagactccatctcaaaaacaaacagaacaaaaaacaaaaa

SEQ ID NO: 51675 - DNA, 201 bp, Homo sapiens
cgcaggacctcaccgcgccagcgtgaagttcccgggcatggtcatgaaagcgtggttctgtaagaaatcagagggagaaagggagagaagggggagggagrcaacccaaacgttggagggtatttgttgtaaacttcaaacttttggcaggtttgaaatttttcataactccggggaggagcaagaggggtgaaaagaaac

SEQ ID NO: 51676 - DNA, 201 bp, Homo sapiens
caccagtacaggggtctgggagggggttgcagggggtcctgaaccacagatccctggagactcagtgggagcagctgtaccaggaatcaggcaccactccrctgctgtaagtctgcgtgagagccactggccagcttcctctgacttccctgtcccctcacccaaatcgatgacatcaggagctaatggcccaggctgccc

SEQ ID NO: 51677 - DNA, 201 bp, Homo sapiens
aggggaaggagtagagagatggaggcgctcaggggccttggattccttttgtgcctactcgcttttttcttaggttattttctctcttaagagtgttcccrgccatcctgggtcatcagtgtgtctttcaaaagctgccacccacttgaaccatatctcttgcacagtaatttaactcagacccaaacttccttccctggc

SEQ ID NO: 51678 - DNA, 201 bp, Homo sapiens
gcaatgagccaagatcacaccactgcactccagcctgggtgacagagcaagacttcatttgaaaaaaagaaaagaaagggttttcttctttggtgtgtgtyagcagaacatgaagttcatcttctcctcattgaagtcttatgaattattatcagccgtacctggtaacactggtttggcagaaagaaaactggcccgggg

SEQ ID NO: 51679 - DNA, 201 bp, Homo sapiens
gacattggatgaatccacgcagggaatgtctgttcattcagcgctggagctttgcgccaagcctctgccctgctccagtactcctcatcgggggatatctrtgaacaaggcagaacagatctctaatctcagggagctgtgtgcagagtagtgaacagataaacatgtcagagggtgcagagccagagagggaggagcagg

SEQ ID NO: 51680 - DNA, 201 bp, Homo sapiens
aacgtggcctgtctacacaatggaaggctgttcagcaataaaaaggaacgaagtactgatttgtgctacaacatggaggaaccttgagaacattaggctargtgaaagcaaccagacacaaaataccacatattatatgattcaattttaatgaaatctccagaataggcgaactgtagacagagaggagatcagtggttg

SEQ ID NO: 51681 - DNA, 201 bp, Homo sapiens
agctataatgtttacctgcctaaaagttccatgttgccagtattaaacatacttctttttgccatgactaggcattgaaaggattgtaatgctttgttctrtagcccccaggtttccctagatgacaaataaacattccttttcctgcgtgaagatagtctgtggaaaccttggccatggcatcgatatcagagcctgtta

SEQ ID NO: 51682 - DNA, 201 bp, Homo sapiens
aaaattcccggcagcgtgtcgtgtttcacaggcaggtgcccggggccagtgggcttaaggccccttggggttcccagggctcctgtggacgatgtcggggkgctctcgaagaagccgaccccactgggctccaatctctcaaagcaagaactgagggcaaagccaggagtgtgtcccagggagggaaggggctggacacct

SEQ ID NO: 51683 - DNA, 201 bp, Homo sapiens
atctttggggctgtgtccttcaaggacatgtccccagactgctgtgcagtgtcattttttgtgtttggtttggtggtggcttcttcccccttgctaggctrtcaacctcttatcaccacttgttggtgtcagaactaactgcttctggtctggagagggactgaccgatgcctttgggtagagagaattatgaaagaaatt

SEQ ID NO: 51684 - DNA, 201 bp, Homo sapiens
ctgttccctccccacgcactctgggcctgagctgacagagatggaccatcgaaaagccagggtcctcccagctgggcactactgcccctcgctaggaataygggcctcgcaggtcggcagcgtgaggtcctctgtgccaccttccatcaggtagctgtcaccgaggagcatgttgcagtgccgggtgggggctgccttgca

SEQ ID NO: 51685 - DNA, 201 bp, Homo sapiens
aggaagcactccctgaaaggcagctgctgttactatcctgagttgacacctttctcccagggctgctggagttaacattatgttctgatctaaggcccacrggccctggagcagaaagacctgagtttaaggaccagctctactgtttactgtcagagtagccaacgtgctcaacttccctgaacccactttcctcacgtg

SEQ ID NO: 51686 - DNA, 201 bp, Homo sapiens
gccagcagtggcagtgagagctccaaagatagttcgagatgttccaccccgggcctggaccccgagcggcatgagagactccgggagaagatgaggcggcrattggaatctggtgacaagtggttctccctggaattcttccctcctcgaactgctgagggagctgtcaatctcatctcaaggtaaactcatgcaaggtta

SEQ ID NO: 51687 - DNA, 201 bp, Homo sapiens
actactacctcttctacctgaagagcaagtcccccaaggaggagctgctgaagatgtggggggaggagctgaccagtgaagaaagtgtctttgaagtcttygttctttacctctcgggagaaccaaaccggaatggtcacaaagtgagtgatgctggagtggggaccctggttcatcccctgcccctggcctgaccccagc

SEQ ID NO: 51688 - DNA, 201 bp, Homo sapiens
acaagtactcgtgcacatccaggcttttttttgagtctcgtttcggaacttggccttggtctgcataactgtaagctgctgcacagggcttggggggtggyatgaaagaaagtgagtctgctgaccctctttctaactgttcctacagcgaggctgtgcttgccacagttaggattcccctaactctcaatcatgatgtct

SEQ ID NO: 51689 - DNA, 201 bp, Homo sapiens
caaaaaatacaaaaatgaccgaggcatggtggtgtacacctgtagtcccaggtacttagggggctggggtgagaggatcgcttgagtccgagaggttgagsctccagtaagccatatttgtgcctctgcactccagcctggcccacaaagtgagaccctgtctcaaaaaaaaaaaaaaaagattggctgggcttggtggct

SEQ ID NO: 51690 - DNA, 201 bp, Homo sapiens
tctgggcctccagaccaaagagttacatctaccgtacccaggagtgggacgagttccctaacggccgctggtgagggcctgcagaccttccttgcaaatayatctttgttcttgggagcgggagggcagaagaagtttgcatgcttgtggttgacctgggaggagtcaggggcagaatttacaggaatggcctcctgggca

SEQ ID NO: 51691 - DNA, 201 bp, Homo sapiens
ctcaggggtgctcccctgcttccggctccctctagccaatcccttgtctcaattctctgtccccatcctcacccaggcgtcccctaccctgggctctcagygcccaccccaagcgccgagaggaagatgtacgtcccatcttctgggcctccagaccaaagagttacatctaccgtacccaggagtgggacgagttcccta

SEQ ID NO: 51692 - DNA, 201 bp, Homo sapiens
ggccaaggtgggaggattgcttgagcccagaagttccagacaaacctggacaagatagcaagaccccatctctaaaaaataaataattaattaaaaaaaawttttttaattagccagatgtggtggcttgcatctgtagtccaagctactcaggagactgaagtgggagatcacttgtgcccgggagttcaaggctacagt

SEQ ID NO: 51693 - DNA, 201 bp, Homo sapiens
ctcagagggcatcagatggaagaactcagcctcaggggtgctcccctgcttccggctccctctagccaatcccttgtctcaattctctgtccccatcctcrcccaggcgtcccctaccctgggctctcagcgcccaccccaagcgccgagaggaagatgtacgtcccatcttctgggcctccagaccaaagagttacatct

SEQ ID NO: 51694 - DNA, 201 bp, Homo sapiens
agagatccccagaggagggtccaagagcagccccggctgcagtgctggctccccacggtggtacagatggatgtctgtgccatggctagctgggcacatcraaggctccagtctcagagggcatcagatggaagaactcagcctcaggggtgctcccctgcttccggctccctctagccaatcccttgtctcaattctctg

SEQ ID NO: 51695 - DNA, 201 bp, Homo sapiens
ctgctgaccctctttctaactgttcctacagcgaggctgtgcttgccacagttaggattcccctaactctcaatcatgatgtcttaactcacctgagatartaaacaggcaagcgctgtgaaaagtctgaagtgctgctctcacacaaaatgatagcgctgttgttgtgtcttacctctgtaatagtgattataacggcac

SEQ ID NO: 51696 - DNA, 201 bp, Homo sapiens
tgactgtcatccctattggcaggttaccccaaaggccaccccgaagcagggagctttgaggctgacctgaagcacttgaaggagaaggtgtctgcgggagycgatttcatcatcacgcagcttttctttgaggctgacacattcttccgctttgtgaaggcatgcaccgacatgggcatcacttgccccatcgtccccggg

SEQ ID NO: 51697 - DNA, 201 bp, Homo sapiens
tgcccagtccctgtggtctcttcatccctcgccttgaacaggtggaggccagcctctcctgactgtcatccctattggcaggttaccccaaaggccacccygaagcagggagctttgaggctgacctgaagcacttgaaggagaaggtgtctgcgggagccgatttcatcatcacgcagcttttctttgaggctgacacat

SEQ ID NO: 51698 - DNA, 201 bp, Homo sapiens
tgctcttaaggagctcccagcctagagtgagggaggcagatcaatgtgtgaccaccagccagtgtaagtgggaaaatcaagttcaggagaggatgctgtcrggtccagaggagggatatctcacctgggaggccagggaaggcttctcagagggtcatctgtgggaatcactgaggacaaagaggagttggccaacaggag

SEQ ID NO: 51699 - DNA, 201 bp, Homo sapiens
ttggcaggttaccccaaaggccaccccgaagcagggagctttgaggctgacctgaagcacttgaaggagaaggtgtctgcgggagccgatttcatcatcaygcagcttttctttgaggctgacacattcttccgctttgtgaaggcatgcaccgacatgggcatcacttgccccatcgtccccgggatctttcccatccag

SEQ ID NO: 51700 - DNA, 201 bp, Homo sapiens
ctgagcccaggccgttccccttggcttcctccgtccacccaggctgcactgcagtgatggcgcgggaggcaccagctctgtggcctgtgtccagcagctgygggtctgaaggaatagccagagaggagcacctgaaccccatgggcttggacttcctggggccccgctgggatttcttcgctgctctagctggcaggacac

SEQ ID NO: 51701 - DNA, 201 bp, Homo sapiens
ttcaaggacatgtccccagactgctgtgcagtgtcattttttgtgtttggtttggtggtggcttcttcccccttgctaggctatcaacctcttatcaccayttgttggtgtcagaactaactgcttctggtctggagagggactgaccgatgcctttgggtagagagaattatgaaagaaattttggtatttttctacttt

SEQ ID NO: 51702 - DNA, 201 bp, Homo sapiens
ctcttcctttgtcgcagctccgcccagttgaacacacccgctggggaaggtgcctctgttccctccccacgcactctgggcctgagctgacagagatggamcatcgaaaagccagggtcctcccagctgggcactactgcccctcgctaggaatatgggcctcgcaggtcggcagcgtgaggtcctctgtgccaccttcca

SEQ ID NO: 51703 - DNA, 201 bp, Homo sapiens
gctgcccgcagcttctccagcgggcaagggaggcctgggccacacgctgctcctgtgccccggctgccacttcctgggcttcccgccatgtggcaaacacrgcccccagtgctcttctcctcaggccatcctgaaaggcttgatgctgggcccggagcacccccgtgtctcttacaacctcacaccaggcctggaagtagc

SEQ ID NO: 51704 - DNA, 201 bp, Homo sapiens
tttagaaggtttttagatatctagaataggcaaatagacagaaaggagatcactggttgcctggagtcaggggcaaggagaacaggcagtggctgctaatsagtgcagggtttcctctcaggtgatgaaaatattctaaaattgactgtaggaattagctgggcgcagtggctcacgtctgtaatctcagcactttgggag

SEQ ID NO: 51705 - DNA, 201 bp, Homo sapiens
accacacacccattcactactgtgtgtttgcccattgctgtgcaagtgttttgtttgtttttaagtgtttgtcttattttcttaaccagactgccagatgrccctatgccctctgttggcctgtctgtgccctggtggctctgattacttgtttctgttttttgtttttgttttttttttttgagatggagttttgctttt

SEQ ID NO: 51706 - DNA, 201 bp, Homo sapiens
tagccctcagacctgtccagactgagaaactcacgtccccactcccctcaccctttgcttatggacgtgccaacgccacagttcattattccgcccacatkgctgccagtagtcctgataccttaggtgtctgcgaaagggcgtctggcagggctggggttggtgacaggcacctgtctctcccacaggcctacttagagt

SEQ ID NO: 51707 - DNA, 201 bp, Homo sapiens
tgcccctgaactgcagccgaatgctgtcacttggggcatcttccctgggcgagagatcatccagcccaccgtagtggatcccgtcagcttcatgttctggwaggtaaaggagccgggggcaagcttgccccgcccacctggaaaaccgtggggagggattgggaccaagtcccaagcgtgtgctgaaggccacactggacc

SEQ ID NO: 51708 - DNA, 201 bp, Homo sapiens
ggaaccagcagtatgggttcaagtcccacatcagccatgccctgcctcccatcacatgcccaggtggttggtgagggagaggaacaccatctctcactcastgagaagccaagaaaaaaaaccatctacggccaggcacagtggctcacacctgtaatcccagcattttgggaggcagaggcgggcggatcacctgaggtc

SEQ ID NO: 51709 - DNA, 201 bp, Homo sapiens
accccctcccagccaggatctgcgcctcacgtgactggccccgggacggtcacgtggccctctcgagctctgggactgagaccaggagtggctgcagacgrgtggggcgaggactcgcgtcacatgacgataaaggcacggcctccaacgagacctgtgggcacggccatgttgggggcggggcttccggtcacccgcgcc

SEQ ID NO: 51710 - DNA, 201 bp, Homo sapiens
cctcacccaggcgtcccctaccctgggctctcagcgcccaccccaagcgccgagaggaagatgtacgtcccatcttctgggcctccagaccaaagagttasatctaccgtacccaggagtgggacgagttccctaacggccgctggtgagggcctgcagaccttccttgcaaatatatctttgttcttgggagcgggaggg

SEQ ID NO: 51711 - DNA, 201 bp, Homo sapiens
ctcgtgctccctaccacaagaccccttcacttgagatgagtagaaaattctcccaggaggcaggagccccaaggccgtgggatgggagagggtggcaggcrtgcccaggtagaagtagggaagggctctccaatcctccaggcacggtgagaagcagcggtggtctcctattctccaccgccagcacagggtcagcatgca

SEQ ID NO: 51712 - DNA, 201 bp, Homo sapiens
attcagagttgcttgtcagaggctgactgagaactggggagaggtggtgcatacgaggttgctgggcccctggggaggcatccagccatgctgccaccacsggctgaatcaagctgattctaaggccggtggtccgagggtcatttttggacctcccgccctgcctaggctcccttcacctgtttccaaggggctggggcg

SEQ ID NO: 51713 - DNA, 201 bp, Homo sapiens
ttcaccatgttagccaagatggtctcgatctcctgacctcgtgatccgccagtccgggcctcccaaattgctgggattacaggcgtgagccactgcgcccrgcccaaaaatctaattttcaatttttctgtaaaaactagaagttctggaaacactggctcagtgttcctgccggggaatgattgggctgcataagcagct

SEQ ID NO: 51714 - DNA, 201 bp, Homo sapiens
agaattcaggtaaaaatctaattttctatttttttttttttttgagacggagtcttactccgtcgcccaggctggagtgcagtggcccgatctcagctcaytgcaacctctgcctcctggattcatgccattctcctgcctcagcctcccgagtagctgggactacaggcgcacactaccacgcctggctaattttgtgta

SEQ ID NO: 51715 - DNA, 201 bp, Homo sapiens
ctttgggaggccaaggcgggtggatcatgagatcaggagtttgagaccatcctgtccaacatagtgaaaccccgtctctactaaaaatacaaaaattagcygggcatggtggcgcgtgcctgtagtcccagctacttggtaggctgaggcaggagaatcgcttgaacccaggaggcggagcttgcagtgagccgagatcgc

SEQ ID NO: 51716 - DNA, 201 bp, Homo sapiens
gtggactgaggaccccaggtgagggcagtggcccagagatccccagaggagggtccaagagcagccccggctgcagtgctggctccccacggtggtacagrtggatgtctgtgccatggctagctgggcacatcgaaggctccagtctcagagggcatcagatggaagaactcagcctcaggggtgctcccctgcttccgg

SEQ ID NO: 51717 - DNA, 201 bp, Homo sapiens
gtgtgctcctagaatatgatcggactttcgtgggtccctctgcctgacactgtggttggcatggatgatggaagggggagaagtatttagggtgggagacrggctggccagcagccgccacagcccctcatgtcttggacagggctaccactcccttcggcagcttgtgaagctgtccaagctggaggtgccacaggagat

SEQ ID NO: 51718 - DNA, 201 bp, Homo sapiens
ccctggcggctgagaccagcctgctgaaggaggagctgctgcgggtgaaccgccagggcatcctcaccatcaactcacagcccaacatcaacgggaagccrtcctccgaccccatcgtgggctggggccccagcgggggctatgtcttccagaaggtgtggtagggaggcacggggtgcccccctctcttgaccggcaccc

SEQ ID NO: 51719 - DNA, 201 bp, Homo sapiens
tgctgccatccgcaactatggcatcgagctggccgtgagcctgtgccaggagcttctggccagtggcttggtgccaggcctccacttctacaccctcaacygcgagatggctaccacagaggtgctgaagcgcctggggatgtggactgaggaccccaggtgagggcagtggcccagagatccccagaggagggtccaaga

SEQ ID NO: 51720 - DNA, 201 bp, Homo sapiens
tttccctcctgctgtcttaccaagtgctagaaagagacgaaccaaacctaaataatatgaagtttctgccttccagggactcgcagtcctgggtgtcgggrctaggtagagggaacagaaagggtctctggaggttgggtgagacccagtgactatgacctccaccaaccctgcagacccaataggtgaccagtgggaaga

SEQ ID NO: 51721 - DNA, 201 bp, Homo sapiens
ttttttccctcctgctgtcttaccaagtgctagaaagagacgaaccaaacctaaataatatgaagtttctgccttccagggactcgcagtcctgggtgtcrgggctaggtagagggaacagaaagggtctctggaggttgggtgagacccagtgactatgacctccaccaaccctgcagacccaataggtgaccagtggga

SEQ ID NO: 51722 - DNA, 201 bp, Homo sapiens
gccaggcatggtggtgtatgcatgtagtcccagctacttgggaggctgaggtaggagaacagcttgaactcagaggcgggggtggaggtcgcagtgatccragaccgtaccactgcattccagcctgggcgacagagtgagactctgtctcaaacaatgacaagaacaacaaaaatttacatgaatatgcatatcagctga

SEQ ID NO: 51723 - DNA, 201 bp, Homo sapiens
caagttcaggagaggatgctgtcgggtccagaggagggatatctcacctgggaggccagggaaggcttctcagagggtcatctgtgggaatcactgaggasaaagaggagttggccaacaggagagaagggtattcctgggacagggcagaggacaggcagaggcagtgagctgcaccatctggggaaaccgggaacatga

SEQ ID NO: 51724 - DNA, 201 bp, Homo sapiens
actggtgggctgcttttttccctcctgctgtcttaccaagtgctagaaagagacgaaccaaacctaaataatatgaagtttctgccttccagggactcgcrgtcctgggtgtcggggctaggtagagggaacagaaagggtctctggaggttgggtgagacccagtgactatgacctccaccaaccctgcagacccaatag

SEQ ID NO: 51725 - DNA, 201 bp, Homo sapiens
tttgagtgaggcggcccggacagccatagctgaggagcatggagccactgggagggggcagtgtcaccttttttggccttcttcctgtgtggaaatacagygcctccggcttgaacctgccactcaggtgtcttgatgtgtcgggggtgtggctgcctgccccctgatgctccctgccccaccctgtgcagtaggaaccca

SEQ ID NO: 51726 - DNA, 201 bp, Homo sapiens
agacctcctccatgatgatcgccagcaccgccgtgaactactgtggcctggagaccatcctgcacatgacctgctgccgtcagcgcctggaggagatcacrggccatctgcacaaagctaagcagctgggcctgaagaacatcatggcgctgcggggaggtgtggagccagcactcccctacactctgggttctggctttc

SEQ ID NO: 51727 - DNA, 201 bp, Homo sapiens
gctactcaggagactgaagtgggagatcacttgtgcccgggagttcaaggctacagtgagccatgattgtaccactgcactctagcctgggtgacagagcragaccctgtctctgaaacaaaacaaaacaaactcacctatggtggatcctttttccccaggacagacctttggacatttgaaaggagtttctgtattctt

SEQ ID NO: 51728 - DNA, 201 bp, Homo sapiens; identical to SEQ ID NO: 9701

SEQ ID NO: 51729 - DNA, 201 bp, Homo sapiens
ggtatagtggctcatacctgtaatcccagcactctgggagaccgaagcagtatcacctgaggtcaggagttcgagaccagcctggccaacatggtgaaacyctatctctactaaaaatacaaaaattagccgggcatggtggtgggcgcctgtaatcccatctactcgggaggctggggcagaagaaccgcttgaacctag

SEQ ID NO: 51730 - DNA, 201 bp, Homo sapiens
ccgggcctggaccccgagcggcatgagagactccgggagaagatgaggcggcgattggaatctggtgacaagtggttctccctggaattcttccctcctcraactgctgagggagctgtcaatctcatctcaaggtaaactcatgcaaggttaaggtgggaggcgggagtggtggtgcctggggagcaaactgtcagccct

SEQ ID NO: 51731 - DNA, 201 bp, Homo sapiens
aggccaaggtgggaggattgcttgagcccagaagttccagacaaacctggacaagatagcaagaccccatctctaaaaaataaataattaattaaaaaaawattttttaattagccagatgtggtggcttgcatctgtagtccaagctactcaggagactgaagtgggagatcacttgtgcccgggagttcaaggctacag

SEQ ID NO: 51732 - DNA, 201 bp, Homo sapiens
tgtttgttaattttgccacagtattttcaaatctggagaattcaggtaaaaatctaattttctatttttttttttttttgagacggagtcttactccgtcrcccaggctggagtgcagtggcccgatctcagctcactgcaacctctgcctcctggattcatgccattctcctgcctcagcctcccgagtagctgggacta

SEQ ID NO: 51733 - DNA, 201 bp, Homo sapiens
agatgtggtggcttgcatctgtagtccaagctactcaggagactgaagtgggagatcacttgtgcccgggagttcaaggctacagtgagccatgattgtaycactgcactctagcctgggtgacagagcgagaccctgtctctgaaacaaaacaaaacaaactcacctatggtggatcctttttccccaggacagaccttt

SEQ ID NO: 51734 - DNA, 201 bp, Homo sapiens
tggggagggattgggaccaagtcccaagcgtgtgctgaaggccacactggacccagccttcagggcacacccagctctgactcacccatgtcactgctgaygcagggtgtttatttctgggcaggggtgggaagtgatactggcagtgggccttgttctattccgggaaatgtcctgttgagcagagcccttggagagccc

SEQ ID NO: 51735 - DNA, 201 bp, Homo sapiens
cacaagtactcgtgcacatccaggcttttttttgagtctcgtttcggaacttggccttggtctgcataactgtaagctgctgcacagggcttggggggtgrcatgaaagaaagtgagtctgctgaccctctttctaactgttcctacagcgaggctgtgcttgccacagttaggattcccctaactctcaatcatgatgtc

SEQ ID NO: 51736 - DNA, 201 bp, Homo sapiens
tggctaatttttatatttttagtagagtcgggatttcaccatgttggccaggctggtctcaaactcctggcctcaggtgatccacccacctcggcctcccraagtgctgggattacaggtgtgttttttgtttttttaagagatggagtctcgctatgttgcccaggctggccttgaactcctgggctcaggcaatccttc

SEQ ID NO: 51737 - DNA, 201 bp, Homo sapiens
tttcaaatctggagaattcaggtaaaaatctaattttctatttttttttttttttgagacggagtcttactccgtcgcccaggctggagtgcagtggcccratctcagctcactgcaacctctgcctcctggattcatgccattctcctgcctcagcctcccgagtagctgggactacaggcgcacactaccacgcctggc

SEQ ID NO: 51738 - DNA, 201 bp, Homo sapiens
ttgaactcagaggcgggggtggaggtcgcagtgatccaagaccgtaccactgcattccagcctgggcgacagagtgagactctgtctcaaacaatgacaasaacaacaaaaatttacatgaatatgcatatcagctgaaggcaagcacattacaaatgtaagtacaatttagtagaaggggtgagggagcctgggtgtcaa

SEQ ID NO: 51739 - DNA, 201 bp, Homo sapiens
cagggttcagtgagggagtgcaaggtgacagaacaatatggagtatcttatactaattcctgcaaacttctcaactatgtacaagaaaacaaatacttacraaacagaagaaaatggccaggtatagtggctcatacctgtaatcccagcactctgggagaccgaagcagtatcacctgaggtcaggagttcgagaccagc

SEQ ID NO: 51740 - DNA, 201 bp, Homo sapiens
gtggcctggagaccatcctgcacatgacctgctgccgtcagcgcctggaggagatcacgggccatctgcacaaagctaagcagctgggcctgaagaacatsatggcgctgcggggaggtgtggagccagcactcccctacactctgggttctggctttcccggaggccacttggtagcctgaacttggttcctgaaatggt

SEQ ID NO: 51741 - DNA, 201 bp, Homo sapiens
cgcgtttatggcgcttgctgagtggctggctgtgctggtgactgcaaggcatgaccattagagacttccccaaggaggggacacacagcaagaggcggtgycaggatgtggcccaggactagatggccagggcggcctctccctgtcacccccaaccaccctcttgagcctttgccctgccacccagccatgaattacgct

SEQ ID NO: 51742 - DNA, 201 bp, Homo sapiens
tgatggattcagagttgcttgtcagaggctgactgagaactggggagaggtggtgcatacgaggttgctgggcccctggggaggcatccagccatgctgcyaccacgggctgaatcaagctgattctaaggccggtggtccgagggtcatttttggacctcccgccctgcctaggctcccttcacctgtttccaaggggct

SEQ ID NO: 51743 - DNA, 201 bp, Homo sapiens
tggggccagagagatgctgaagagccactgggtgctcaccccagcctctccccatgggcctctacgcagccagcccttcgccccctaccaggtgggaacasaggaggccaccctgactgtctgggttaaaaagcctctattatgggtgtcctgctggtgaccaggccagcccagctcatagagttgttgggtttgtttttg

SEQ ID NO: 51744 - DNA, 201 bp, Homo sapiens
gaaatgtcctgttgagcagagcccttggagagccctgttaatcttgcctctgtgtgtgtgtgcatgtgtgcgtgtgtgcgggggtatgtgtgtgtaggacraggcctttgccctgtggattgagcggtggggaaagctgtatgaggaggagtccccgtcccgcaccatcatccagtacatccacgacaactacttcctggt

SEQ ID NO: 51745 - DNA, 201 bp, Homo sapiens
tgcttccggctccctctagccaatcccttgtctcaattctctgtccccatcctcacccaggcgtcccctaccctgggctctcagcgcccaccccaagcgcygagaggaagatgtacgtcccatcttctgggcctccagaccaaagagttacatctaccgtacccaggagtgggacgagttccctaacggccgctggtgagg

SEQ ID NO: 51746 - DNA, 201 bp, Homo sapiens
tcactgaggacaaagaggagttggccaacaggagagaagggtattcctgggacagggcagaggacaggcagaggcagtgagctgcaccatctggggaaacsgggaacatgagcaggaggaggcgggagtgttaagcaggggccaggcccgcagagatcatggttgtcctgctggaatttgagttttccctcaatgcaaggg

SEQ ID NO: 51747 - DNA, 201 bp, Homo sapiens; identical to SEQ ID NO: 9676

SEQ ID NO: 51748 - DNA, 201 bp, Homo sapiens
cagatggggcagcttttgttctgagaaattcgtgcccttactgaacttgggtctggctatttttggaacatggccagcatcaagttctaacccacaacackgtctttttggagtagcatgaattcaggagaaatctggctgcatagtcaagccctcaccccttccatcctgtgcacgaactgtttcaagtaacagatgttc

SEQ ID NO: 51749 - DNA, 201 bp, Homo sapiens
acactaccacgcctggctaattttgtgtatttttagtagagacggggtttcaccatgttagccaagatggtctcgatctcctgacctcgtgatccgccagwccgggcctcccaaattgctgggattacaggcgtgagccactgcgcccggcccaaaaatctaattttcaatttttctgtaaaaactagaagttctggaaac

SEQ ID NO: 51750 - DNA, 201 bp, Homo sapiens
catcttgcaacctcagcctcagagggcaggggctgccctgcgagggggatgggaaccagcagtatgggttcaagtcccacatcagccatgccctgcctccyatcacatgcccaggtggttggtgagggagaggaacaccatctctcactcagtgagaagccaagaaaaaaaaccatctacggccaggcacagtggctcaca

SEQ ID NO: 51751 - DNA, 201 bp, Homo sapiens
aagcagggagctttgaggctgacctgaagcacttgaaggagaaggtgtctgcgggagccgatttcatcatcacgcagcttttctttgaggctgacacattyttccgctttgtgaaggcatgcaccgacatgggcatcacttgccccatcgtccccgggatctttcccatccaggtgaggggcccaggagagcccataagct

SEQ ID NO: 51752 - DNA, 201 bp, Homo sapiens
tagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggctgga

SEQ ID NO: 51753 - DNA, 201 bp, Homo sapiens
atagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggctgg

SEQ ID NO: 51754 - DNA, 201 bp, Homo sapiens
gatagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggctg

SEQ ID NO: 51755 - DNA, 201 bp, Homo sapiens
gcccaggtcttacccccaccccacatcccctcagggtgaaaacatcaccaatgcccctgaactgcagccgaatgctgtcacttggggcatcttccctgggygagagatcatccagcccaccgtagtggatcccgtcagcttcatgttctggaaggtaaaggagccgggggcaagcttgccccgcccacctggaaaaccgtg

SEQ ID NO: 51756 - DNA, 201 bp, Homo sapiens
tgatagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggct

SEQ ID NO: 51757 - DNA, 201 bp, Homo sapiens
atgatagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggc

SEQ ID NO: 51758 - DNA, 201 bp, Homo sapiens
gcccccatcggtgactcagtgacctggtgactggattctcggccacctgggcgccgagacggcttccggctcctgccttttaaacctgcctccccggcgakcacctggagaagagcgctgggcccggggcactgcggtccctggcgcccactgcgtcccgctgcgcacgggggtccgccgggacctttctgggagtcgtag

SEQ ID NO: 51759 - DNA, 201 bp, Homo sapiens
aaggagctcccagcctagagtgagggaggcagatcaatgtgtgaccaccagccagtgtaagtgggaaaatcaagttcaggagaggatgctgtcgggtccaraggagggatatctcacctgggaggccagggaaggcttctcagagggtcatctgtgggaatcactgaggacaaagaggagttggccaacaggagagaaggg

SEQ ID NO: 51760 - DNA, 201 bp, Homo sapiens
accatcctgcacatgacctgctgccgtcagcgcctggaggagatcacgggccatctgcacaaagctaagcagctgggcctgaagaacatcatggcgctgcrgggaggtgtggagccagcactcccctacactctgggttctggctttcccggaggccacttggtagcctgaacttggttcctgaaatggtcctttacttct

SEQ ID NO: 51761 - DNA, 201 bp, Homo sapiens
acattcctcagggcttctagcacactgcaccctcagccagcctctgcaaatccagtccttcccactgccctattttgctgaccccttcccacgcctcaacytctctcgccactgctctgcccgctgagccctcctcacctcctcctgggaccctccctgactaactctgctggcccctaagggcaccatgactctgcccac

SEQ ID NO: 51762 - DNA, 201 bp, Homo sapiens
tataatgagaatggatgtcaaaatgggattctaacattttgtaagaccctaaatttatcaaataaagagtcaaatatgtgcaatgaactcttcctgagacrggaagaaggggcactttttagaaagatattcaacagaagggttttctagttgactgactatcaaggtagagaaaaccctataactccattcattaaaata

SEQ ID NO: 51763 - DNA, 201 bp, Homo sapiens
atgcaacagctctttttgcccagaggccaagacccagagagcaagcctgccttgggaccatccctcctcccttcactggccacattcctcagggcttctarcacactgcaccctcagccagcctctgcaaatccagtccttcccactgccctattttgctgaccccttcccacgcctcaacttctctcgccactgctctgc

SEQ ID NO: 51764 - DNA, 201 bp, Homo sapiens
gtggtggcttcttcccccttgctaggctatcaacctcttatcaccacttgttggtgtcagaactaactgcttctggtctggagagggactgaccgatgccyttgggtagagagaattatgaaagaaattttggtatttttctactttatattttctgaggtttctgtaataagcatatttcacttttccaataagaaaaaa

SEQ ID NO: 51765 - DNA, 201 bp, Homo sapiens
gcggaagcacttctgcaagtgctgaagaagtacgagctccgggttaattaccaccttgtcaatgtgaaggtaggccaggccccagggttcccacagagtaycaggcccttcgttgagcaaacacccagcacctagcctgggctaggcattgtgcaagacagagagatacaggcagaactggggccctgctcttaaggagct

SEQ ID NO: 51766 - DNA, 201 bp, Homo sapiens
tttctttaaaacgaaagaggggtctgggcgcggtggctcacacctgtaaccccaacactttgggaggccgaggcaggcagatcacctgaggtcaggagttygagacctgcctggccaacatagcgaaaccccgtctctactaaaaatacaaaaattagccaggtgtggtggtgcacggctgtagtcccagctactcaggag

SEQ ID NO: 51767 - DNA, 201 bp, Homo sapiens
tacaggtgtgttttttgtttttttaagagatggagtctcgctatgttgcccaggctggccttgaactcctgggctcaggcaatccttctgcctcagccttyccagtagctgggtcactgtgatgatttgaattgaattctgtgatgtgtaagaagagcagcctgcaaggcaagcacagatggggcagcttttgttctgaga

SEQ ID NO: 51768 - DNA, 201 bp, Homo sapiens
ccaatgctttgggaggccaaggcaggtagatcgcttgagcccaggagtttgagacaagccctggcaacatagtgagatcccatttctacaaaaaaaaaaaaaaaattagccgggtgtggtggcacacgcctgtagtctcagctactcaggtggctgaggtgggaggatcgtttgagccctggaggttgaggctgcagtgag

SEQ ID NO: 51769 - DNA, 201 bp, Homo sapiens; identical to SEQ ID NO: 9696

SEQ ID NO: 51770 - DNA, 201 bp, Homo sapiens
cccaatgctttgggaggccaaggcaggtagatcgcttgagcccaggagtttgagacaagccctggcaacatagtgagatcccatttctacaaaaaaaaaaaaaaaattagccgggtgtggtggcacacgcctgtagtctcagctactcaggtggctgaggtgggaggatcgtttgagccctggaggttgaggctgcagtga

SEQ ID NO: 51771 - DNA, 201 bp, Homo sapiens
ctccgaccccatcgtgggctggggccccagcgggggctatgtcttccagaaggtgtggtagggaggcacggggtgcccccctctcttgaccggcacccgtkggttccccagagcttagggcagagcagcctgcctctcctgggctcttaaattttgaatgagcatggattggagcggatgggagctcatgctttaagtcag

SEQ ID NO: 51772 - DNA, 201 bp, Homo sapiens
agacgtcagccattctgtagccaacagttcactgccccacggggacactgaacattcgcaaatttgtactgaactgtgggaggagccattctgtgtcctcygcttggttttacaatatgcattcatgaactgtatacatgttccaccagaacatctttacttaaatgaagatttcactctcttctcttagcgacagtgtac

SEQ ID NO: 51773 - DNA, 201 bp, Homo sapiens
agaaaattacatgttgtgagtaactttggccttgtccctaacccccgatggacatgtccattctgtcaacaggggtgtttaggtgctaagtctgggaagcrctgattaggagtcagagaacagacatttccaactgttaaattgtcatcgcttgtatcagccattatatagtcagttactgggggaatatgcacccgtgat

SEQ ID NO: 51774 - DNA, 201 bp, Homo sapiens
tgctgggcctcatggtgcatgcccggggccactggccatgctgggaaggcctgtggggcccgggccttcttctgctgcccatcttcctggccttgctgccygcagcttctccagcgggcaagggaggcctgggccacacgctgctcctgtgccccggctgccacttcctgggcttcccgccatgtggcaaacacagccccc

SEQ ID NO: 51775 - DNA, 201 bp, Homo sapiens
gccaggggcaattcctcttcccctgcctttggggagctgaaggactactacctcttctacctgaagagcaagtcccccaaggaggagctgctgaagatgtrgggggaggagctgaccagtgaagaaagtgtctttgaagtctttgttctttacctctcgggagaaccaaaccggaatggtcacaaagtgagtgatgctgga

SEQ ID NO: 51776 - DNA, 201 bp, Homo sapiens
tcagtgaatgttggctatcaccgtgtgccaaactctggggataccccaggcaggacaccggtcctgtctcagggaactggggaaagagaaaggagacaggycttttcacccacagttacaacccagggtgctatgggagtccagctgataacggataaatcgtgggagttggcttacaaatatggcacatgcgtggcatat

SEQ ID NO: 51777 - DNA, 201 bp, Homo sapiens
tctgggcaggggtgggaagtgatactggcagtgggccttgttctattccgggaaatgtcctgttgagcagagcccttggagagccctgttaatcttgcctstgtgtgtgtgtgcatgtgtgcgtgtgtgcgggggtatgtgtgtgtaggacgaggcctttgccctgtggattgagcggtggggaaagctgtatgaggagga

SEQ ID NO: 51778 - DNA, 201 bp, Homo sapiens
ggctggagtgctatggcacaatcttggttcactgcaacctctgccttccgggttcaagcgattctcctgcctcagcctccagagtagctgggattacaggygcccgccaccaaacctggctaatttttatatttttagtagagtcgggatttcaccatgttggccaggctggtctcaaactcctggcctcaggtgatccac

SEQ ID NO: 51779 - DNA, 201 bp, Homo sapiens; identical to SEQ ID NO: 9705

SEQ ID NO: 51780 - DNA, 201 bp, Homo sapiens
gcactctggcctgggcgacagagtgagacactgtctgagaacaaaaaacgactgaaaaaaaaaatcaccttagctttttctcttagaatcttctctaaaaygtattctttgtggcattctgaaataggattcatgatgatgcctgttgatcttagggacactacctcacctgccagtatctttggggctgtgtccttcaag

SEQ ID NO: 51781 - DNA, 201 bp, Homo sapiens
tttaaataaattagttgagtttggccctttgtaaatatgtaccaatggaatatatgagctattattaaaaccagatactgttacttctcctttgctatgaytaactttttatttctgcagtatatgttgctctttggtttaggggactaacaactttttaaaaaaataaaatgttatctgtgtcttgcagggctgttacag

SEQ ID NO: 51782 - DNA, 201 bp, Homo sapiens
gaggagctgaccagtgaagaaagtgtctttgaagtctttgttctttacctctcgggagaaccaaaccggaatggtcacaaagtgagtgatgctggagtggrgaccctggttcatcccctgcccctggcctgaccccagctgcaggccaggctgcggggctgtgacttccccatcctgtgccctcccctccatgctgtggac

SEQ ID NO: 51783 - DNA, 201 bp, Homo sapiens
gagtggaaggaggcagaagtatttactgaaatcagtggctagcttctaaatcatctggagccattatcaaataggaaccagccctcaaaaaaaacctttcrggggtgagggaccatgtgggtgaggatctacagccatcagctgagctcttcatttccactgatagtctccaaataaccaccctcctcttcaggacacctc

SEQ ID NO: 51784 - DNA, 201 bp, Homo sapiens
cctcccaaagtgctgggattacaggtgtgttttttgtttttttaagagatggagtctcgctatgttgcccaggctggccttgaactcctgggctcaggcawtccttctgcctcagccttcccagtagctgggtcactgtgatgatttgaattgaattctgtgatgtgtaagaagagcagcctgcaaggcaagcacagatgg

SEQ ID NO: 51785 - DNA, 201 bp, Homo sapiens
acgtgattgagccaatcaaagacaacgatgctgccatccgcaactatggcatcgagctggccgtgagcctgtgccaggagcttctggccagtggcttggtrccaggcctccacttctacaccctcaaccgcgagatggctaccacagaggtgctgaagcgcctggggatgtggactgaggaccccaggtgagggcagtggc

SEQ ID NO: 51786 - DNA, 201 bp, Homo sapiens
caccccaagcgccgagaggaagatgtacgtcccatcttctgggcctccagaccaaagagttacatctaccgtacccaggagtgggacgagttccctaacgrccgctggtgagggcctgcagaccttccttgcaaatatatctttgttcttgggagcgggagggcagaagaagtttgcatgcttgtggttgacctgggagga

SEQ ID NO: 51787 - DNA, 201 bp, Homo sapiens
cagagcaaagcagcttggccttccgcctggctcagagtcctgccctgggcttgggctgatgaaaccagcactccatgtagtttcatgaaggcctatggtcrtcctgcttgcctgaccgagcaaggcggctagtaagtttagtcattgaggaaaggggtcagagagttcacagagccagtaaggagcctatgggacatctga

SEQ ID NO: 51788 - DNA, 201 bp, Homo sapiens
gcctttggggagctgaaggactactacctcttctacctgaagagcaagtcccccaaggaggagctgctgaagatgtggggggaggagctgaccagtgaagmaagtgtctttgaagtctttgttctttacctctcgggagaaccaaaccggaatggtcacaaagtgagtgatgctggagtggggaccctggttcatcccctg

SEQ ID NO: 51789 - DNA, 201 bp, Homo sapiens
gcaattcctcttcccctgcctttggggagctgaaggactactacctcttctacctgaagagcaagtcccccaaggaggagctgctgaagatgtggggggakgagctgaccagtgaagaaagtgtctttgaagtctttgttctttacctctcgggagaaccaaaccggaatggtcacaaagtgagtgatgctggagtgggga

SEQ ID NO: 51790 - DNA, 201 bp, Homo sapiens; identical to SEQ ID NO: 9670

SEQ ID NO: 51791 - DNA, 201 bp, Homo sapiens
atggtggatcctttttccccaggacagacctttggacatttgaaaggagtttctgtattcttttcattcttttttttttttttttttgagacggagtttcrctctcgttgcccaggctagagtgcaatggtacgatctcggctcactgcaacctctgtctcgtgggttcaagcaattttcctgactcagcctcctgagtag

SEQ ID NO: 51792 - DNA, 201 bp, Homo sapiens
ccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggagggggct

SEQ ID NO: 51793 - DNA, 201 bp, Homo sapiens
gccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggagggggc

SEQ ID NO: 51794 - DNA, 201 bp, Homo sapiens
agccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggaggggg

SEQ ID NO: 51795 - DNA, 201 bp, Homo sapiens
ctattggcaggttaccccaaaggccaccccgaagcagggagctttgaggctgacctgaagcacttgaaggagaaggtgtctgcgggagccgatttcatcaycacgcagcttttctttgaggctgacacattcttccgctttgtgaaggcatgcaccgacatgggcatcacttgccccatcgtccccgggatctttcccatc

SEQ ID NO: 51796 - DNA, 201 bp, Homo sapiens
ggttcaggcttgtgtggggagagatatcattcacagatgcaggcagaggaggccaggagcggaggcacagggagaggggagtggaggcgcagggagagtgkaggccgggagtggaggcgcaggcagagggtattgagcccagacagcctcattgagtcaaggctgtccaggcagtgggactccagttgttcttggcccagg

SEQ ID NO: 51797 - DNA, 201 bp, Homo sapiens
tggagagccctgttaatcttgcctctgtgtgtgtgtgcatgtgtgcgtgtgtgcgggggtatgtgtgtgtaggacgaggcctttgccctgtggattgagcrgtggggaaagctgtatgaggaggagtccccgtcccgcaccatcatccagtacatccacgacaactacttcctggtcaacctggtggacaatgacttccca

SEQ ID NO: 51798 - DNA, 201 bp, Homo sapiens
cgagagatcatccagcccaccgtagtggatcccgtcagcttcatgttctggaaggtaaaggagccgggggcaagcttgccccgcccacctggaaaaccgtsgggagggattgggaccaagtcccaagcgtgtgctgaaggccacactggacccagccttcagggcacacccagctctgactcacccatgtcactgctgacg

SEQ ID NO: 51799 - DNA, 201 bp, Homo sapiens
tggcccaggtcttacccccaccccacatcccctcagggtgaaaacatcaccaatgcccctgaactgcagccgaatgctgtcacttggggcatcttccctgrgcgagagatcatccagcccaccgtagtggatcccgtcagcttcatgttctggaaggtaaaggagccgggggcaagcttgccccgcccacctggaaaaccg

SEQ ID NO: 51800 - DNA, 201 bp, Homo sapiens
tggccagcatcaagttctaacccacaacacggtctttttggagtagcatgaattcaggagaaatctggctgcatagtcaagccctcaccccttccatcctrtgcacgaactgtttcaagtaacagatgttccaggcagagccagccagagtgagctgttccttctctggagggtgatctggtatccctgaacgcctgttgg

SEQ ID NO: 51801 - DNA, 201 bp, Homo sapiens
gattctcctgcctcagcctccagagtagctgggattacaggcgcccgccaccaaacctggctaatttttatatttttagtagagtcgggatttcaccatgytggccaggctggtctcaaactcctggcctcaggtgatccacccacctcggcctcccaaagtgctgggattacaggtgtgttttttgtttttttaagagat

SEQ ID NO: 51802 - DNA, 201 bp, Homo sapiens
tttagttgcccaagcagtatcaaaggagctcacctcatagtctttccttggaagaatctcatcctcctcctcctgtgtttctccaaggatggtctagaaamacagatccgcagagggagccttttttagtggttaggagtggaaggaggcagaagtatttactgaaatcagtggctagcttctaaatcatctggagccatt

SEQ ID NO: 51803 - DNA, 201 bp, Homo sapiens
ttaaccagactgccagatgaccctatgccctctgttggcctgtctgtgccctggtggctctgattacttgtttctgttttttgtttttgttttttttttttgagatggagttttgcttttgtcgcccaggctggagtgctatggcacaatcttggttcactgcaacctctgccttccgggttcaagcgattctcctgcctc

SEQ ID NO: 51804 - DNA, 201 bp, Homo sapiens
aggtggctgtcatcagaaccacttgataagctttttcaaaaagtggatctccaggtcccacccctggaggttctcactcagtaaatctgagggaggtcctyggaatgtgtgttttacttcttgagcttggcaggtgattcggatgatcagtgcagcatgggaacagctgggttagatgacaccatgttaccaacagacaca

SEQ ID NO: 51805 - DNA, 201 bp, Homo sapiens
gatgctgccatccgcaactatggcatcgagctggccgtgagcctgtgccaggagcttctggccagtggcttggtgccaggcctccacttctacaccctcarccgcgagatggctaccacagaggtgctgaagcgcctggggatgtggactgaggaccccaggtgagggcagtggcccagagatccccagaggagggtccaa

SEQ ID NO: 51806 - DNA, 201 bp, Homo sapiens
aggagttgagtacagtgaggagggtggaggaaggtgctgagcttagccttgtgccctgcccccatctccccaggcctccagcctctcccggctgcctgccrcccaaagagaaatcacaggggcggggcaggaatgcaaagtgttttctcagaacagctgaaacattccgaagagggaatggatggggagaatggtcaatac

SEQ ID NO: 51807 - DNA, 201 bp, Homo sapiens
aaggctagttcctttcaattccatttaaaaaacaaaaaccagcaggtgtggtggctcatggcgtaatgggcctgcccaatgctttgggaggccaaggcagrtagatcgcttgagcccaggagtttgagacaagccctggcaacatagtgagatcccatttctacaaaaaaaaaaaaaaaattagccgggtgtggtggcaca

SEQ ID NO: 51808 - DNA, 201 bp, Homo sapiens
tgcccagagagcctgtcggtgttcggttcaggacacagtgatcaggggcactcatgggtccatgctggatgaaggacatgcagaggtgaactgcaccgtgyccttgctccttttgtatcacccactcccctcctgggcctgccaccatcgacccctagctttttgttcctctgcctggctgtgcccttagcctgcttggcc

SEQ ID NO: 51809 - DNA, 201 bp, Homo sapiens
agtgccagcagtggcagtgagagctccaaagatagttcgagatgttccaccccgggcctggaccccgagcggcatgagagactccgggagaagatgaggcsgcgattggaatctggtgacaagtggttctccctggaattcttccctcctcgaactgctgagggagctgtcaatctcatctcaaggtaaactcatgcaagg

SEQ ID NO: 51810 - DNA, 201 bp, Homo sapiens
aacgatgctgccatccgcaactatggcatcgagctggccgtgagcctgtgccaggagcttctggccagtggcttggtgccaggcctccacttctacacccycaaccgcgagatggctaccacagaggtgctgaagcgcctggggatgtggactgaggaccccaggtgagggcagtggcccagagatccccagaggagggtc

SEQ ID NO: 51811 - DNA, 201 bp, Homo sapiens
tgtaggaacaaagtctcactttattgcccaggatggtcttgaactcctggctttaagcgatcctcctgccttggcctcccaaagtgctgagcatataggcrtgagccactgtgccacgcttcttttttttttaaataaattagttgagtttggccctttgtaaatatgtaccaatggaatatatgagctattattaaaacc

SEQ ID NO: 51812 - DNA, 201 bp, Homo sapiens
tgtgaaggtaggccaggccccagggttcccacagagtaccaggcccttcgttgagcaaacacccagcacctagcctgggctaggcattgtgcaagacagasagatacaggcagaactggggccctgctcttaaggagctcccagcctagagtgagggaggcagatcaatgtgtgaccaccagccagtgtaagtgggaaaat

SEQ ID NO: 51813 - DNA, 201 bp, Homo sapiens; identical to SEQ ID NO: 9699

SEQ ID NO: 51814 - DNA, 201 bp, Homo sapiens
cagactgccagatgaccctatgccctctgttggcctgtctgtgccctggtggctctgattacttgtttctgttttttgtttttgttttttttttttgagayggagttttgcttttgtcgcccaggctggagtgctatggcacaatcttggttcactgcaacctctgccttccgggttcaagcgattctcctgcctcagcct

SEQ ID NO: 51815 - DNA, 201 bp, Homo sapiens
ctcctcaggccatcctgaaaggcttgatgctgggcccggagcacccccgtgtctcttacaacctcacaccaggcctggaagtagctgcaaaacagacacawtgggccaggtgtggtggctcatgcttgtaatcccagcactttgggaagccaaggtgagtggatcacctgaagtcagtttgagaccagcctgaccaacgtg

SEQ ID NO: 51816 - DNA, 201 bp, Homo sapiens
gtcttattttcttaaccagactgccagatgaccctatgccctctgttggcctgtctgtgccctggtggctctgattacttgtttctgttttttgtttttgktttttttttttgagatggagttttgcttttgtcgcccaggctggagtgctatggcacaatcttggttcactgcaacctctgccttccgggttcaagcgat

SEQ ID NO: 51817 - DNA, 201 bp, Homo sapiens
aagtgtttgtcttattttcttaaccagactgccagatgaccctatgccctctgttggcctgtctgtgccctggtggctctgattacttgtttctgtttttkgtttttgttttttttttttgagatggagttttgcttttgtcgcccaggctggagtgctatggcacaatcttggttcactgcaacctctgccttccgggtt

SEQ ID NO: 51818 - DNA, 201 bp, Homo sapiens
cgcagggagagtggaggccgggagtggaggcgcaggcagagggtattgagcccagacagcctcattgagtcaaggctgtccaggcagtgggactccagttrttcttggcccaggtcttacccccaccccacatcccctcagggtgaaaacatcaccaatgcccctgaactgcagccgaatgctgtcacttggggcatcttc

SEQ ID NO: 51819 - DNA, 201 bp, Homo sapiens
agatgcccagagagcctgtcggtgttcggttcaggacacagtgatcaggggcactcatgggtccatgctggatgaaggacatgcagaggtgaactgcaccrtgtccttgctccttttgtatcacccactcccctcctgggcctgccaccatcgacccctagctttttgttcctctgcctggctgtgcccttagcctgcttg

SEQ ID NO: 51820 - DNA, 201 bp, Homo sapiens
cgtcagcttcatgttctggaaggtaaaggagccgggggcaagcttgccccgcccacctggaaaaccgtggggagggattgggaccaagtcccaagcgtgtrctgaaggccacactggacccagccttcagggcacacccagctctgactcacccatgtcactgctgacgcagggtgtttatttctgggcaggggtgggaag

SEQ ID NO: 51821 - DNA, 201 bp, Homo sapiens
gtgtcaaggagttcgagaacagcctgggcaacatagggagactgtctttactttaaaacacacacacacacacacacacacacacacacacacacacacamacacacacacacatacaataaaaaataataatatgagaaaggagaagtggataacgaaagcacagacaaaagaagactgggcttgagctaaatcactgtg

SEQ ID NO: 51822 - DNA, 201 bp, Homo sapiens
gctggtgtcaaggagttcgagaacagcctgggcaacatagggagactgtctttactttaaaacacacacacacacacacacacacacacacacacacacamacaaacacacacacacatacaataaaaaataataatatgagaaaggagaagtggataacgaaagcacagacaaaagaagactgggcttgagctaaatcac

SEQ ID NO: 51823 - DNA, 201 bp, Homo sapiens
ggcacatctcacagaaagttaccatttttcaaaccacctataatgagaatggatgtcaaaatgggattctaacattttgtaagaccctaaatttatcaaayaaagagtcaaatatgtgcaatgaactcttcctgagacaggaagaaggggcactttttagaaagatattcaacagaagggttttctagttgactgactatc

SEQ ID NO: 51824 - DNA, 201 bp, Homo sapiens
tgaacctagggtggggtggaggttgcagtgagctgagatcgagccattgcactccaacctgggcactaagagtgagactccatctcaaatttaaaaaaaaraaaaaaaaagaaatagaacaaaacacagcagtggatacagtgctttttggttcattcaaagcagtcccatcagagtagcatattaaactatacaaacggc

SEQ ID NO: 51825 - DNA, 201 bp, Homo sapiens
cagtggctgctaatgagtgcagggtttcctctcaggtgatgaaaatattctaaaattgactgtaggaattagctgggcgcagtggctcacgtctgtaatcycagcactttgggaggccaaggcgggcggatcacccgaggccaggagttcaagaccagcctgaccaacatggagaagcctcgtctctactaaaaatacaaa

SEQ ID NO: 51826 - DNA, 201 bp, Homo sapiens
ttagtgcccgcctaggagttgagtacagtgaggagggtggaggaaggtgctgagcttagccttgtgccctgcccccatctccccaggcctccagcctctcmcggctgcctgccacccaaagagaaatcacaggggcggggcaggaatgcaaagtgttttctcagaacagctgaaacattccgaagagggaatggatgggga

SEQ ID NO: 51827 - DNA, 201 bp, Homo sapiens
accttccttgcaaatatatctttgttcttgggagcgggagggcagaagaagtttgcatgcttgtggttgacctgggaggagtcaggggcagaatttacagkaatggcctcctgggcatgtggtggcactgccctctgtcaggagtgtgccctgacctctgggcacccctctgccaggggcaattcctcttcccctgccttt

SEQ ID NO: 51828 - DNA, 201 bp, Homo sapiens
tctccactaaaaatacaaaaattagccaggtgtggtggcaggcgcctgtaatcccagctacgaggggagctgaggcaggagaattgcttgaacccaggggrtggaggttgcagtgagctaagatcgcaccactgcatgcctgggcaacacagcgagatcgtctcaaaaaaaaaaaaaaaaaaaaaaaaagactggttgggc

SEQ ID NO: 51829 - DNA, 201 bp, Homo sapiens
acgcttcgagagccctggctgcggtccccaggccccacccgctgccacctgcgggcccagattggcccggccccacccccggcaacgcctctctcagtccyttagcaaccgccccctccccaggccgactccgccggcttcttaccagctcctcgggggtgcgggtctcacgctcaccgcagcagcagcaccacctgcagc

SEQ ID NO: 51830 - DNA, 201 bp, Homo sapiens
atacaggctgggtttactaatttgcttttaacagacagaatttggcagaagcaatgggatgtcacttctgatatcaggttataaaaagactggttggggcygggtgcggtggctcacgcttgtaatcccagcactttggaaggccgaggcgggttgatcacttgaggtcaggagttcgagaccagcctggccaacatggtg

SEQ ID NO: 51831 - DNA, 201 bp, Homo sapiens
tctaggaccctgcgggagaggaaggagtctgcagccagggccatcaaggccaggactctctgcagggagcccccccagtgccctgcgggagggggccttcygggcccagccccaggctggggcccacccacctcccacactcccttttctggagggagaatctgggtaaacaggatggagagcgacctggaaggagaaaat

SEQ ID NO: 51832 - DNA, 201 bp, Homo sapiens
gctgggtgaggatggctcgctggacaccgccgcgcaccgccgactgcaccgaggcctctaggaccctgcgggagaggaaggagtctgcagccagggccatmaaggccaggactctctgcagggagcccccccagtgccctgcgggagggggccttctgggcccagccccaggctggggcccacccacctcccacactccct

SEQ ID NO: 51833 - DNA, 201 bp, Homo sapiens
aatgccccgccttgaatacaggctgggtttactaatttgcttttaacagacagaatttggcagaagcaatgggatgtcacttctgatatcaggttataaaragactggttggggctgggtgcggtggctcacgcttgtaatcccagcactttggaaggccgaggcgggttgatcacttgaggtcaggagttcgagaccagc

SEQ ID NO: 51834 - DNA, 201 bp, Homo sapiens
tcctgccggggaatgattgggctgcataagcagctgtctccagcggacaggacatgactttctagaaccaccacagccctgcctgccagctcattaatgcratatgtcggtgtagtgggcagcctccaagacagcatcctgtgttcgtgtcctgggcaatgccccgccttgaatacaggctgggtttactaatttgctttt

SEQ ID NO: 51835 - DNA, 201 bp, Homo sapiens
ttgaacctagggtggggtggaggttgcagtgagctgagatcgagccattgcactccaacctgggcactaagagtgagactccatctcaaatttaaaaaaargaaaaaaaaagaaatagaacaaaacacagcagtggatacagtgctttttggttcattcaaagcagtcccatcagagtagcatattaaactatacaaacgg

SEQ ID NO: 51836 - DNA, 201 bp, Homo sapiens
acttaatcaagaacatgtcagagagaagctgcttgagcaagaaaatatctgaaaagcaagctctcctagaagagaagcaaggcctccttaacagtttatargcacacacctgttaggggcacatactgcctgccagtgcctttcactctaagtctctctgtaagctgtaaaagcaaacagtttaatggcaaatacatactc

SEQ ID NO: 51837 - DNA, 201 bp, Homo sapiens
gttccccttggcttcctccgtccacccaggctgcactgcagtgatggcgcgggaggcaccagctctgtggcctgtgtccagcagctgcgggtctgaaggartagccagagaggagcacctgaaccccatgggcttggacttcctggggccccgctgggatttcttcgctgctctagctggcaggacacatcccggcctctt

SEQ ID NO: 51838 - DNA, 201 bp, Homo sapiens
caggagaatctcttggacccaagaggcggaggttgcagtgagccgagatggtgccgctgcagtccagcctcagtggcagagcaagactccatctcaaaaamaaaaaaaaaacaacaccccacaaaagagggatatttactaacaggattccagagggcagggaacccaagatcaggagatggcctcagacctcacaaggca

SEQ ID NO: 51839 - DNA, 201 bp, Homo sapiens
gagaagatgaggcggcgattggaatctggtgacaagtggttctccctggaattcttccctcctcgaactgctgagggagctgtcaatctcatctcaaggtraactcatgcaaggttaaggtgggaggcgggagtggtggtgcctggggagcaaactgtcagccctgaggctgggctgccctttaacccggcagaaaaaagc

SEQ ID NO: 51840 - DNA, 201 bp, Homo sapiens
ggggaggtgtggagccagcactcccctacactctgggttctggctttcccggaggccacttggtagcctgaacttggttcctgaaatggtcctttacttcytcctgggccccacgctgaggatccgcaggatcccatccccgccagtagtgtcagtaggcattgtgggtagtgagtcatcctgggcaccacacacaggcag

SEQ ID NO: 51841 - DNA, 201 bp, Homo sapiens
tccactgcccctgtgttttcagactccaggagctcattgttttgtgagtggcttatagtactctagccagctctctgaaccggatgctggttctgccattrgaaacaacacagaatatgactaataaagaacttcactagggggctgggtacagtggctcatgcctgtaatctcagcactttgggaggccaaggtgggagg

SEQ ID NO: 51842 - DNA, 201 bp, Homo sapiens
gggctgcttttttccctcctgctgtcttaccaagtgctagaaagagacgaaccaaacctaaataatatgaagtttctgccttccagggactcgcagtcctsggtgtcggggctaggtagagggaacagaaagggtctctggaggttgggtgagacccagtgactatgacctccaccaaccctgcagacccaataggtgacc

SEQ ID NO: 51843 - DNA, 201 bp, Homo sapiens
gaagcacttctgcaagtgctgaagaagtacgagctccgggttaattaccaccttgtcaatgtgaaggtaggccaggccccagggttcccacagagtaccargcccttcgttgagcaaacacccagcacctagcctgggctaggcattgtgcaagacagagagatacaggcagaactggggccctgctcttaaggagctccc

SEQ ID NO: 51844 - DNA, 201 bp, Homo sapiens
tgtggggcatggttccttccctgggaaggctaagttcagttctgttttttattctatgagaacaagtcacagctgcagctgggccccatgctctgccccargcccccaaccccgcggtgctccggcggcttcctgtccactctcggggcccttggggcctggcttgctccagggtcttgggctactggcagctcctctcct

SEQ ID NO: 51845 - DNA, 201 bp, Homo sapiens
gggaaggctaagttcagttctgttttttattctatgagaacaagtcacagctgcagctgggccccatgctctgccccaagcccccaaccccgcggtgctcyggcggcttcctgtccactctcggggcccttggggcctggcttgctccagggtcttgggctactggcagctcctctccttgggctcctggctgccaggcgt

SEQ ID NO: 51846 - DNA, 201 bp, Homo sapiens
caagcccctcagcccttgcccccatccctcggacccaccaaactgcacacacagctcctcttaccgtagcctccgtttatgggccttgctttgggctttgsaggctctgggctcagggctggagtgcgctcttggtccctggtccctcgtccacaggggcaggcctgggacccagctactctgtccaggccactgtggcca

SEQ ID NO: 51847 - DNA, 201 bp, Homo sapiens
gggacccagctactctgtccaggccactgtggccagagctggaaggcagggcagagggaatgttccctgcaccctggaaaggggagttgagtcacaagagkttaaggtgggtccaggaaggcagctgctcttagtgcccgcctaggagttgagtacagtgaggagggtggaggaaggtgctgagcttagccttgtgccctg

SEQ ID NO: 51848 - DNA, 201 bp, Homo sapiens
gaaggcagggcagagggaatgttccctgcaccctggaaaggggagttgagtcacaagaggttaaggtgggtccaggaaggcagctgctcttagtgcccgcytaggagttgagtacagtgaggagggtggaggaaggtgctgagcttagccttgtgccctgcccccatctccccaggcctccagcctctcccggctgcctgc

SEQ ID NO: 51849 - DNA, 201 bp, Homo sapiens
gctccagcatccagcctgtgtgttctgtaatggaactgaccccctcccctgaaaacgaaggggccccggggctggcaagcagggaaagctccacggtgcgyggctgtggcacagacttctggaaggctggctgagtggaatgcagggaagagggcagtacctgggaaaggacccacccatcttcctgctgctgtaactgct

SEQ ID NO: 51850 - DNA, 201 bp, Homo sapiens
aacttggtttttagcttttcactatcttggacccctgagtaatttcagtgttacattaaaaacaatgtttaatccggtgcctagagaaaagtcaagcttastaccccagatgctgcccagccagtgctaactgtagcattttctcttttctatggccaccaagtgcaggcctgatttgcttggctgctcaaggcaggacag

SEQ ID NO: 51851 - DNA, 201 bp, Homo sapiens
gctcatacctgtaatcccagcactctgggagaccgaagcagtatcacctgaggtcaggagttcgagaccagcctggccaacatggtgaaaccctatctctrctaaaaatacaaaaattagccgggcatggtggtgggcgcctgtaatcccatctactcgggaggctggggcagaagaaccgcttgaacctagggtggggtg

SEQ ID NO: 51852 - DNA, 201 bp, Homo sapiens
acatggtgaaaccctatctctactaaaaatacaaaaattagccgggcatggtggtgggcgcctgtaatcccatctactcgggaggctggggcagaagaacygcttgaacctagggtggggtggaggttgcagtgagctgagatcgagccattgcactccaacctgggcactaagagtgagactccatctcaaatttaaaaa

SEQ ID NO: 51853 - DNA, 201 bp, Homo sapiens
aaattagccaggtgtggtggcaggcgcctgtaatcccagctacgaggggagctgaggcaggagaattgcttgaacccagggggtggaggttgcagtgagcyaagatcgcaccactgcatgcctgggcaacacagcgagatcgtctcaaaaaaaaaaaaaaaaaaaaaaaaagactggttgggccatgcaacagctcttttt

SEQ ID NO: 51854 - DNA, 201 bp, Homo sapiens; identical to SEQ ID NO: 9703

SEQ ID NO: 51855 - DNA, 201 bp, Homo sapiens
aagtcgaggtgggaggatcacttgagttcaggagttcgagaccagcttgggcaatatggtgaaaccccgtctctactaaaaatacaaaaattagccaggcrtggtggcgtgcacttgtagtcccagctactcaggaagctgaggcgggagaatcacttgaacccgggaggcagaggttgcagtgagctgagatcactcctc

SEQ ID NO: 51856 - DNA, 201 bp, Homo sapiens
agaccagcctggccaacatggtgaaaccccatctccactaaaaatacaaaaattagccaggtgtggtggcaggcgcctgtaatcccagctacgaggggagytgaggcaggagaattgcttgaacccagggggtggaggttgcagtgagctaagatcgcaccactgcatgcctgggcaacacagcgagatcgtctcaaaaaa

SEQ ID NO: 51857 - DNA, 201 bp, Homo sapiens
ggctcacgcttgtaatcccagcactttggaaggccgaggcgggttgatcacttgaggtcaggagttcgagaccagcctggccaacatggtgaaaccccatytccactaaaaatacaaaaattagccaggtgtggtggcaggcgcctgtaatcccagctacgaggggagctgaggcaggagaattgcttgaacccagggggt

SEQ ID NO: 51858 - DNA, 201 bp, Homo sapiens
agacctgtccagactgagaaactcacgtccccactcccctcaccctttgcttatggacgtgccaacgccacagttcattattccgcccacatggctgccartagtcctgataccttaggtgtctgcgaaagggcgtctggcagggctggggttggtgacaggcacctgtctctcccacaggcctacttagagtttttcact

SEQ ID NO: 51859 - DNA, 201 bp, Homo sapiens
tggagccggcaaacaacctcccgggggcaaggacgtgcttgtgggcggggagcgctggaggccggcctgcctctcttcttggggggggctgccgcctcccytgcgcacccttcgcgggattagtgtaactcccaatggctaccacttccagcgaccgccaaccctcaagcgaagactgactttggctccctgcctggacgg

SEQ ID NO: 51860 - DNA, 201 bp, Homo sapiens
tctccaagctttatgacttcccatctctcccattctctaggagacatattaggctctgccatgcaaaacacacaaaatcttctccagatgccctatggctrtggagagcagaatatggtcctctttgctcctaacatctatgtactggattatctaaatgaaacacagcagcttactccagagatcaagtccaaggccatt

SEQ ID NO: 51861 - DNA, 201 bp, Homo sapiens
tgaaaacaaattatgaaaaaaaagtctttaagatatcattaacaattttatattggctaaatgttgaaatgatcatattttggatatattggattaaatamaatacactattaaaattaatttaatgtttctctttatgtggttactagaaaatttaaaatttaaaattacacagggcgatcacattctatttctagtaga

SEQ ID NO: 51862 - DNA, 201 bp, Homo sapiens
acccaaatctgtcttaattttttttctttccaatgtcacagatcttggaaatgcttgaagaccacaaggctgaaaagtgctttgctggagtcctgttctcwgagctccacagaagacacgtgtttttgtatctttaaagacttgatgaataaacactttttctggtcaatgtctttccctgtttcctgttcattcaataaa

SEQ ID NO: 51863 - DNA, 201 bp, Homo sapiens
cagtccagtgaaatcacaagaaccataaccaaactctcatttgtgaaagtggactcacactttcgacagggaattcccttctttgggcaggtggagtattytccagttcactcatcaacccatgtactgttacctaattagcacaatagttatggtttgtgctaaaaccatgcctggttaatgttatcatttaatataacc

SEQ ID NO: 51864 - DNA, 201 bp, Homo sapiens
tctgtcattcgttatgcttagaaagctcttttcatctctttgttcttcgagacaaccactactcatacttcagagcttaatttacattttgctttccctcaaaatttttttaaaaggttccaggtctgggttatgtgctctcttatgtgctcccagagcatcctgaacttctgcaataatatgtttggctactgtatttta

SEQ ID NO: 51865 - DNA, 201 bp, Homo sapiens
aaaataatgaagggaggattcatgcagaagcacgttttctcagaagaaggaatgtgtatgactcaaagtccaaataggagtattatattggatcatctttyttctggaactttgagccaggattaaaggatagctgtaaagtcaaggagatattctgatgcagaaatcagttctcacaacatctgattgatgtctgatgtc

SEQ ID NO: 51866 - DNA, 201 bp, Homo sapiens
gtctgagaagggaagaaaatcctgtcacatgctacagcatgaatgatccttgaggacgttatggtaagtgaaataagctagtcacaaaaagaccaatactrtatgattcacgtacatggggtttctaaagtagtcaaagtcatagaaacagaaaacaggatggtggttgccaagggctagggaaagagagaaatggggaat

SEQ ID NO: 51867 - DNA, 201 bp, Homo sapiens
ggctggaccaggcacacaacaaacagcttccccctggaccaggcgcatcacaagcagcttccaacagtggcactggcgaatgcagtgacgccaaccagggmcccaaagagggagtcacagcccgggctcaaggagctcccaggtctgggcttctccgagggccagagctcttctctccctgtggggagcaaggggcatgtt

SEQ ID NO: 51868 - DNA, 201 bp, Homo sapiens
aaggaattaactaaaacctctgtgcttcatttccttatctgtaaaatgattgcaatactaacacctgactcttggggtggttgtgaagattaagtgaaatmatacatgttgaatcacttagtaagccccctttaactgttagatacttttactataaaagccaattctaacataattagcatttagttttaaatatatata

SEQ ID NO: 51869 - DNA, 201 bp, Homo sapiens
ttaggattgattactactaaattagtgtatgttatgtatatatttatttagcatctatctctttcactagacagtaagctctgtgatggaagaaacttcgtttttttttcactgctgtgtcctcagtgcctggaaccatgttcaacatagaggaggcactaaaaaatgtgataaatgaatatgtttggtgcctattagtta

SEQ ID NO: 51870 - DNA, 201 bp, Homo sapiens
ggagcaaggggcatgttgcagccctgtttgtgttacagctcttttaaccttgctgtgcagctcctcagctcctgcatcaagcagacaagtggagaatgagmcagatgaagaggagcattactgagcaatggaacagaaggataaggaagatgaagaggaaggagacctgcagttagtagctcatttccacagtaaggatgt

SEQ ID NO: 51871 - DNA, 201 bp, Homo sapiens
tcaaaaagtgtcttgaatgctttccacgtgccagcactgtgctagtcttgacaatgaaattattatttctacctgttccctgtttggggtgatcatatatrtgttgtcaccaaaatatacattaagatatgaacaaaatgttttgctcaaggattcactagtgctattgggagctggggatgaaggtagaggaagcctgaa

SEQ ID NO: 51872 - DNA, 201 bp, Homo sapiens
cagatgaagaggagcattactgagcaatggaacagaaggataaggaagatgaagaggaaggagacctgcagttagtagctcatttccacagtaaggatgtyctttccacagcaagtgtgtcccaacgagtgttcagcttctagcagaaaggagaccctggagtggctggctcctctctgcaaacaggtcttcccattgagt

SEQ ID NO: 51873 - DNA, 201 bp, Homo sapiens
gagcattaaaaatagtcagcctaggccaggcacggtagctcacgcctgtaatcccagcactttgggaggctgaggtgggtggattgcgtgaggccaggagwtcgagacgagcctaggcaacgtggtgaaaccctgtctctacaaaatatacaaaaaattagctgggtggggtggcatgcacctgtagtcctagcaactcag

SEQ ID NO: 51874 - DNA, 201 bp, Homo sapiens
aaatgcatgctgattggtccatgggcagccatgagtgggcccagggagcagcaccacaagttacctctctggtctgcaggcttcaagccctcaccagcttsagggtgggacttcactggggacccatccccttccacccaggaacctgtctgcctcctgctcccaggctgttcatgccaaggagcgcctgaaagtcagtgt

SEQ ID NO: 51875 - DNA, 201 bp, Homo sapiens
gccaagattgtgccactgtactccagcatgggcgccagagcaaaaccctgtctcaaaaaaataataataatagcaatcagcctaagatagcccagaagagstagacttcagctaattcatcagctcagctcttaaaccaatgctttctaccaatgtcttctcagacccctaaggttacaatattttatttattcataatac

SEQ ID NO: 51876 - DNA, 201 bp, Homo sapiens
tcagcactgtcctgagcgtgtgcacgctcggccaggctgtgacagtacccaggctcggcccgaccttgctctgagttcagagtgggtgctaacagtggagrgaagccaggcagccggagtaggcaccctggagcctgcagtgggcaggggactttgctgggcctctgagagcacagaaaatgtccacagccgcggcaaggt

SEQ ID NO: 51877 - DNA, 201 bp, Homo sapiens
aaggatgcctccttttatgctcttaagaaatataaatctcaatcccaggaggctctgcagtgtaaagtcacaaagcatgcctacatttgaagcagagaaasaaaatcaggggtccttctcccacttttcattgtggaacaaaagatttctagctactagttaaggtaggacagtaaacttacgtagttttgtgagaacatt

SEQ ID NO: 51878 - DNA, 201 bp, Homo sapiens
aacttctttttcatcttatttatttattttttgtagagatagggtctcgctatgctgcccaggctggtctcaaactcctgggctcaagagatccttctacytaagcctctcaaagtgctggaattacaggggtgagtcaccacgactgaccattaataatttctttcaatgacactttaacataggctcattcatctttac

SEQ ID NO: 51879 - DNA, 201 bp, Homo sapiens
gaaacgttgggaaatatgtaagcaagtttttaagactactaaggagccaaaagaaaaatgcaagagcacctagacccatgcatgtcccaccacaattaatragcaccttgccgtgtatcaaagataaaaatggcatttcatgactagtaatttataagaataattagaaataattctactggctcaagtgattcttgagaa

SEQ ID NO: 51880 - DNA, 201 bp, Homo sapiens
tttgttttcctatacctggcttatttcacataacataatctcctccagatttaatcatgctgccataaatagcagaatgttcttgttttttaaaatggaayggaattctatgtgtatataccaaattttctttatctgttcatctgttgatgacacttatgattccataactagacagacatcagtaatttgttagggatt

SEQ ID NO: 51881 - DNA, 201 bp, Homo sapiens
acaaagtgatgttatgatttatgaataaaatgtgaaataattaaatcaagctaacctgaaatacttatgttttgtggtgggaacatttgaaattctctaascaagtttgaaacataaaatacactattattaactatattcaccatgctgtgcaatagatcccaaaaagaaaaaaatgtattccttctgtctgagactttg

SEQ ID NO: 51882 - DNA, 201 bp, Homo sapiens
agagtccataggattgcttatgggtaatgatttggaatagatttggtttcccactgtactgattaggtttccttgggcactatgctacccagaactaaggsaaagaatactctctgctcatggagacccaaatctgtcttaattttttttctttccaatgtcacagatcttggaaatgcttgaagaccacaaggctgaaaa

SEQ ID NO: 51883 - DNA, 201 bp, Homo sapiens
taaaatgaagtagaatgaaatacaacattgaacaggtcatattgagaggcaagataattgggacttgacctgaattgggagtgatgtgtcctatgttacamcaaaatctgccactgatgagagtgatcagtcagttaacctggggtttcagattcaataatagatgagctgaaaataatgaagggaggattcatgcagaag

SEQ ID NO: 51884 - DNA, 201 bp, Homo sapiens
aattctatgacccatcttaatgattacatctgaacatatttacttatagttacataagtgtttatttctcaacctgtaaaattgcatagcaaaggattgawcttcactaggatgctataagcacttaagacatgttaatccatttttagtaaatggcactttacatgtatatttgttgctgaaggcctagtaagttcttaa

SEQ ID NO: 51885 - DNA, 201 bp, Homo sapiens
gacctacctcaagtaaaatgttcactgccatggcatgtgagggaaaagggaaataattcttatgcatggccttcaacggccaaatttcatgctcatcagtrcatcttctcttggtgtagaactgatgatgataattatgatgatggaaaaaagtgctgttgatagcaatgcctctcttccttcactttcctctaactgaac

SEQ ID NO: 51886 - DNA, 201 bp, Homo sapiens
ttgggcaggtgaggacaggacagatgaggacagcagctgttctctctgagaagtcctaactcagaaaacaatgggacagatcagagaaagggttagggacrtggacaggaattctgggaaagggcaaaaaactgattttgtctttgatgttctatagacatccttgaaatacaatattctcccagaaaaggaagagttccc

SEQ ID NO: 51887 - DNA, 201 bp, Homo sapiens
ttaatgatgtatgtatccccagcataagacaatactaatatcaaaatactattaaagtcaatctctatcaaagccttatcctttttccagctcagaaatayaatcacatgtgtttgtatgaatgctgaccatgtgcagagcactgcgctaggacccatgactacaagaaaaagattgtcagcaggttcctgcttttcaatt

SEQ ID NO: 51888 - DNA, 201 bp, Homo sapiens
gaaaaatgactggataagtaggataagatcaattaaaattatatttatctaggaattaattgctttgagctctcttgtgggctttcattggtaaggaattwtatatatatatatatataactactcacttctgcagttaaaaaaataaacaaaatacaatatattgaatcaaataaaagaatttttaaaaggacaaaatgt

SEQ ID NO: 51889 - DNA, 201 bp, Homo sapiens
aggaaaaatgactggataagtaggataagatcaattaaaattatatttatctaggaattaattgctttgagctctcttgtgggctttcattggtaaggaattttatatatatatatatataactactcacttctgcagttaaaaaaataaacaaaatacaatatattgaatcaaataaaagaatttttaaaaggacaaaat

SEQ ID NO: 51890 - DNA, 201 bp, Homo sapiens
ctgaggcaggagaatcacttgaacccaggaggcagaggttgagtgagccgagatcgtgccactgcactccagcctgggcaatagagcaagacttggtgtcaaaaaaaaaaaaaaaaaaagaattacatcagttgaaataattgctgtcccaagctacacataatttctgagggaacatatgtattatctctgaggaacaaa

SEQ ID NO: 51891 - DNA, 201 bp, Homo sapiens
caattgtaataacctcttactgaagctttttctactaccataatttaacaaagagaaatttatatttttattttcctgaaatagaaacttataaaaaaatrtttcttacttgtttgtccttctaatgggattttaactgaaaatattagaatacttctaaaggaagcatcaagtacatttcaacagtaggatctcaagagg

SEQ ID NO: 51892 - DNA, 201 bp, Homo sapiens; identical to SEQ ID NO: 9755

SEQ ID NO: 51893 - DNA, 201 bp, Homo sapiens
taatgggattttaactgaaaatattagaatacttctaaaggaagcatcaagtacatttcaacagtaggatctcaagaggatatgtgggaaaataatatacrtgttttatacttttataatataattttataattctcaaagaatttttcaaattataacaaccctgatgggtagataaggcagacagtcctatttattaat

SEQ ID NO: 51894 - DNA, 201 bp, Homo sapiens
gacagtaaacttacgtagttttgtgagaacattaatctttatgacgtataatctaaaaataatataatttttctaattcattaggtcaattacaaggatcrtagtccctgttacggctaccagtgggtgtcagaagaacacgaagaggcacatcacactgcttatcttgtgttctccccaagcaagagctttgtccacctt

SEQ ID NO: 51895 - DNA, 201 bp, Homo sapiens
ccattagctcacattgttacctatttttgtgtgcatagcaagcacacctaaaatctatcctcttagccaagtttcagtatccaatacagtattatcaactrcagtcctcatgctgtactttagatttctaaatttattcatcctacgtaacttcaactttgtaccctttgacctgcttcttcccatccctgcaaccccaac

SEQ ID NO: 51896 - DNA, 201 bp, Homo sapiens
agtgtaagggctaatcatcaaatagttttactaaatttcattttaattaccaacataatcaaatgtgcctacctaattttacaaaaatatattcttctttaaaaaaaaaaacagaacatcacattaaaggttaatgtcacccccctgaacatttttcagtactttgccatccatttatctttagaaataatgtgtgtagat

SEQ ID NO: 51897 - DNA, 201 bp, Homo sapiens
tctccatactgttttccataatggctgtggcaatgtacatttgcaccaaggggagtgaacaaattccttccagagagacactggaaacagagttttatccstgaaacaagccagtggggcaggtggagagaaagagccggaatggccatatactccctttcaggctcctggagtcttgtttacttctccctttcactccca

SEQ ID NO: 51898 - DNA, 201 bp, Homo sapiens
gtagccatcaagtaaattaaaagttgcattcctaggaatactgcaaactcttgtatgcaaaatatgcttactagatattcatgattgtaaaagttacaggttttgagatctccaaataccaaattgcaccataaagcaagtttctagcccttataacccttcaaagttagtatttgtgtggtatgaagaattctgacaggg

SEQ ID NO: 51899 - DNA, 201 bp, Homo sapiens
aataaaacaaaagtttacagagcattgaacatttctaaatcttgagtttggaggcatggaggaaggggaagatgctattcatttctactggcctttttttwcaggaaatgtgaatttcactgtgagcgcagaggcactagagtctcaagagctgtgtgggactgaggtgccttcagttcctgaacacggaaggaaagacac

SEQ ID NO: 51900 - DNA, 201 bp, Homo sapiens
aggggcggggctcctgcttgtccctggctcacctgctcctgagtgtgcaggtccggtggcgcctccttgcaggctgggctgatgggcgggggcgggggggsgggggaggaagggaatgttccaggtcctccctgggcccgggactgtgtccggggcagggatgacgtcgctgcaagttcttcccgtggccccggggctcag

SEQ ID NO: 51901 - DNA, 201 bp, Homo sapiens
tcaaaaaagaatcttaaagatgtatcttttgaatgtgagaataacagataaaaataatattatatctattgataagaatgaggaatcgttggaaaaatgcrtttgaaaaacttctgtgctgtgatccgtgtatttgcctgggaatgctaatatgcctgtttacatagcttagttcccttcttgttctgccttcacagcacc

SEQ ID NO: 51902 - DNA, 201 bp, Homo sapiens
gaaggggcggggctcctgcttgtccctggctcacctgctcctgagtgtgcaggtccggtggcgcctccttgcaggctgggctgatgggcgggggcgggggsgggggggaggaagggaatgttccaggtcctccctgggcccgggactgtgtccggggcagggatgacgtcgctgcaagttcttcccgtggccccggggctc

SEQ ID NO: 51903 - DNA, 201 bp, Homo sapiens
attcatctgttgccaagatgtaacacataaaatgtaccctaaaaacataacttccttgtcatttagccttatttctacatttaagtgaactgattacctaycattcaatccttttatcatgacttctccgtttctgagttactcattttgatgtatctcttaagtgtaagggctaatcatcaaatagttttactaaatttc

SEQ ID NO: 51904 - DNA, 201 bp, Homo sapiens
ttttctcttttttcagtggtggaattgactggaaggcagtccagtgaaatcacaagaaccataaccaaactctcatttgtgaaagtggactcacactttcracagggaattcccttctttgggcaggtggagtattttccagttcactcatcaacccatgtactgttacctaattagcacaatagttatggtttgtgctaa

SEQ ID NO: 51905 - DNA, 201 bp, Homo sapiens
cagaatgcccagggcggtttctcctccacccaggttggtgatttgccaaaaccttttatttcaccttcaggtagcaaaagatttgaatgaaaaagaaacaracacatccaagaagaaaaaaatacagatgacagtaacttgaaatgaggaaaagttttcagtatccaaggataatggaaataaaagcaaatcaaagtcaaa

SEQ ID NO: 51906 - DNA, 201 bp, Homo sapiens
atccttgtcttgttccagatcttaaaggaaagtctttcaattttccactgttaaatatgtaagctataggtttatcatacatgccctttattgtgttgagraacattgcttgtatatctaatttggtgagagttttatcataaaagagcattgaattctgtcaaatactttttctccatctaacaagatgatggtatggtt

SEQ ID NO: 51907 - DNA, 201 bp, Homo sapiens
ttctgtaaatgtaatgtatcacatttattgatatgcatatgttgaacaatttttgcatctcagggataaatcccacttgactaggtagatgatccttttamtgtattgttggatttagtctgctagtttatttcgtgtggttggttggttggtttagttttttaagtgatgagcttttgctgtgttccccaggctggactt

SEQ ID NO: 51908 - DNA, 201 bp, Homo sapiens
ctgtctttattcatccaacctcctaaatctagctatataaccatgtatctgaacaattcattgatatgtacacagcagaaagttttatcttcagagaattyggatgtttgcttatataccctaaaacggaaaaaatgtgacaaaatggcattccatcctatttccattgtattaatcttttatcatatgaatgaaaaaaac

SEQ ID NO: 51909 - DNA, 201 bp, Homo sapiens
tgctagtttatttcgtgtggttggttggttggtttagttttttaagtgatgagcttttgctgtgttccccaggctggacttgaactcctgagttcaagcartcctaccacctcagccacccacaggtgtatgccaccatgcttagctgctatgctagtattttattgaggatttttgcatctatattcatcaagaatattg

SEQ ID NO: 51910 - DNA, 201 bp, Homo sapiens
aatttctctttcatttctgattttatatatttaaggcctccctcttttttcttagctaacctagctaaaagtttttgtctgtctttttaaaaaaacaattyagtttcattgatcttttgtattctttttctagtctctatttgatttatttctgctctaatctttattattttcctttcttctgccaattttgagcttact

SEQ ID NO: 51911 - DNA, 201 bp, Homo sapiens
cccacagacgcctcagtctctggaaaaccgtgagttccacacagagagcgtgaagcatgaacctagagtccttcatttattgcagatttttctttatatcmttcctttttctttcctatgatactgtcatcttcttatctctaagattccttccagattttacaaatctagtttactcattacttgcttacttttaatcat

SEQ ID NO: 51912 - DNA, 201 bp, Homo sapiens
gaacaagcgcctcactgcatctgtgcaaacgggcggcaaactgtgtcctgggcagtaaccccaaagtcattaggtgagcaaaaaactgctagagataattstctactcaaagattgtatatggcagtgggaaccttatattgagtgctacttccttcaggaaaagaccactagatgctgcgatttttttcctttgcctttt

SEQ ID NO: 51913 - DNA, 201 bp, Homo sapiens
atttctctttcatttctgattttatatatttaaggcctccctcttttttcttagctaacctagctaaaagtttttgtctgtctttttaaaaaaacaattcrgtttcattgatcttttgtattctttttctagtctctatttgatttatttctgctctaatctttattattttcctttcttctgccaattttgagcttactt

SEQ ID NO: 51914 - DNA, 201 bp, Homo sapiens
tcagtttcattgatcttttgtattctttttctagtctctatttgatttatttctgctctaatctttattattttcctttcttctgccaattttgagcttastttgttcttcttttcctacttctctgaggaatatcattagtatctttattggaaatttttcttcttttttggtgtttattgttataagctttcctcttag

SEQ ID NO: 51915 - DNA, 201 bp, Homo sapiens
atttggagtctttccatttcccatgggtgacattgggcttggagtagaattaattacacctaagtccaatgaggacatcagtgatctgtgaataggacttmacatagcttcgttattttctgtagcaatatttaataccaacccccaaaattaaaacattcttgttttaatggagttttccataattaattaagcacacag

SEQ ID NO: 51916 - DNA, 201 bp, Homo sapiens
ctcaatcccaggaggctctgcagtgtaaagtcacaaagcatgcctacatttgaagcagagaaacaaaatcaggggtccttctcccacttttcattgtggawcaaaagatttctagctactagttaaggtaggacagtaaacttacgtagttttgtgagaacattaatctttatgacgtataatctaaaaataatataattt

SEQ ID NO: 51917 - DNA, 201 bp, Homo sapiens
tcttcctttgtggtctgatgttctgtagtggtatgatttgaatcttttaaaatttttgttctgtgcttctattaaagatttttgccttgctgttactatgrggtttacagtcaatttcaagctgataacaacttaactttgcattctttcactcccccacacacattttatgtcgttgatgtcagaatttacatattttgt

SEQ ID NO: 51918 - DNA, 201 bp, Homo sapiens
tagggaacaaaaagcttcaggattgacacaatgccaaccctccacgaagtcaagcagagtggttatacattgtacatgaggaacactctgcaaatgcgagygaatgcatgggtaaacctggaaatttgcttttctgaccttttgttccaatttcacaggtggatttgagcttcagcccatcacaaagtctcccagcctcac

SEQ ID NO: 51919 - DNA, 201 bp, Homo sapiens
ctttgctggatgaagaattcttgattccatgttgtttttatttttgttttccttcagtactttgaatatattattccactctccctcagcctgccgggttmctgctaaaaatccatggatagttgtattggaattcctttgtatgtgatatgtttctttatcaccttctgcttttcagaatttttttttgtctttgatttt

SEQ ID NO: 51920 - DNA, 201 bp, Homo sapiens
tatttagtctagcctataattctggaaagatcagttggtgacaaccttgagcaggcagagttttcatgggttccctagttggctgggccactgcctttgcycttatgtttggtagggccactggttgggccttgctctctggcaagatcactgttttgtctctgctatctggtggagctgctggctgggtactacaatggc

SEQ ID NO: 51921 - DNA, 201 bp, Homo sapiens
acagttggaagaaaaggacttatattcccatctcaatccttgattatactctccattattggtatttctattgagtgtttttaagtcatggcagtagaatmattcctagggattctctccctagaaaggatgtatttaactgcttactttctgttcttcacttacactcctctccagctcagcaggtgtggctgaggtagg

SEQ ID NO: 51922 - DNA, 201 bp, Homo sapiens
agaaaaacacatttattggagagggccgctgactctgtcaaacctcagagagtccataggattgcttatgggtaatgatttggaatagatttggtttcccwctgtactgattaggtttccttgggcactatgctacccagaactaagggaaagaatactctctgctcatggagacccaaatctgtcttaattttttttctt

SEQ ID NO: 51923 - DNA, 201 bp, Homo sapiens
agagggaagtacagacagggaatatactgtagctaaaggggagatataaatagctagaaaatggggaggttcggtgtctgctctgattcctttgggaatgbtctcatgacagatacacatatgggaagcctgtccctggacatgtgactgtgagcatttgcagaaagtatagtgacgcttccgactgccacggtgaagatt

SEQ ID NO: 51924 - DNA, 201 bp, Homo sapiens
agcaagtaaaaaccaaggtcttccagctgaagaggaaggagtatgaaatgaaacttcacactgaggcccagatccaagaagaaggaacaggtttgtgtacwacatgggtataagagaaaacacaacaggcattgattttcttagccaaataatgaattgtaagttggggggaggtgatagaattttagagacatcattctt

SEQ ID NO: 51925 - DNA, 201 bp, Homo sapiens
atctagctatataaccatgtatctgaacaattcattgatatgtacacagcagaaagttttatcttcagagaattcggatgtttgcttatataccctaaaayggaaaaaatgtgacaaaatggcattccatcctatttccattgtattaatcttttatcatatgaatgaaaaaaactaagtaattttgttaaaggttatcat

SEQ ID NO: 51926 - DNA, 201 bp, Homo sapiens
aaaaagggaaagccaaataaaaatgtcattaaatccagaagataattataatactcatcttttatttcttttggagaaactgaagcatgactctgctcatkgctgcaaagaaccttgggttctctccaggacactgacctcagcaactgagcaaagtttaatatgggagagagccagactgaactttgcttgagtggtggc

SEQ ID NO: 51927 - DNA, 201 bp, Homo sapiens
gttttaacattaattttatgagaaagggaagataactgctacatttttcatttgtatataattcaccaatactaaaattgtagtaaatgtatgttcatcartagcagttattttattttcagtgagtcaagcattttattttgcttagccatttgtcctttaactatgcttatggcttttttttaagaaacattttaatat

SEQ ID NO: 51928 - DNA, 201 bp, Homo sapiens
tgttcttctctcctttatttatatttcaccagggattacaggtagaaatggcttattatgatcttgggatatgaatattcctaaaatcccataagcaagaratcttgacaaaatgtgtttattatgttgacaagttttttggatacccagtaatataaggaagtagcccttgtgattagtcaattattagttaattatcaa

SEQ ID NO: 51929 - DNA, 201 bp, Homo sapiens
ttgcttagccatttgtcctttaactatgcttatggcttttttttaagaaacattttaatatgaattttatgaggaagggattcagtatgaaaataaatacyatacttctctcattttcatttcatataatttaccaagattaaaatggaagtaaatgtatgttcatgagtagtaattattttattttcaatgcatcaaata

SEQ ID NO: 51930 - DNA, 201 bp, Homo sapiens
tttgttgttggtgttttctccatacaactgttgagtaaggaagttggtggtgggaactaaatagatcatcttgtgataaccgtcttgtgtcagccatcagwtgacagcaactgaatcacaacatcaccaggctcttacaatttgttgtcttatttggcatgcgattctacataaattactgaaaagatcattgaagaagaa

SEQ ID NO: 51931 - DNA, 201 bp, Homo sapiens
ttgttgttggtgttttctccatacaactgttgagtaaggaagttggtggtgggaactaaatagatcatcttgtgataaccgtcttgtgtcagccatcagawgacagcaactgaatcacaacatcaccaggctcttacaatttgttgtcttatttggcatgcgattctacataaattactgaaaagatcattgaagaagaaa

SEQ ID NO: 51932 - DNA, 201 bp, Homo sapiens
agaccgatggtttgttatactagataaatccaccaagattagcaaggtaatcagaagaaaacctgatatccaaatacatgttatgttaggcttgtttccaraatggatcctattaataatgtaccaaggttttctttctgaaatggctattctttctaaagtagctaccataaccatgagttttaaaatgatattgccagt

SEQ ID NO: 51933 - DNA, 201 bp, Homo sapiens
aaccagaaataccatttgacctagtaatcccattactgggtatatacccaaaggaatataaatcattctactataatgacacatgcacatgtatgtttatygcggcactatttacaataacaaagtcatggaactaacccaaatgctcatcaatgacagactggataaagaaaatgtggtacatatacatcatggaatact

SEQ ID NO: 51934 - DNA, 201 bp, Homo sapiens
gggacaggaacaacacacaccagggcctgttgggaggtgtggggtgacgggagggaactaagcggatgggtcaataggtgcaagaaaccaccatggcacaygtatacttatgtaacaaacctgcacgttctgcacatgtatctcggaactaaaataaaattaaatatactaagactccctgtggcaaagagagagttagca

SEQ ID NO: 51935 - DNA, 201 bp, Homo sapiens
ctgttgggaggtgtggggtgacgggagggaactaagcggatgggtcaataggtgcaagaaaccaccatggcacacgtatacttatgtaacaaacctgcacrttctgcacatgtatctcggaactaaaataaaattaaatatactaagactccctgtggcaaagagagagttagcaaggaaatactacatctagcagattaa

SEQ ID NO: 51936 - DNA, 201 bp, Homo sapiens
tcaataggtgcaagaaaccaccatggcacacgtatacttatgtaacaaacctgcacgttctgcacatgtatctcggaactaaaataaaattaaatatactwagactccctgtggcaaagagagagttagcaaggaaatactacatctagcagattaatcaggcagactaaagattaatcaaggagataagctctctaagta

SEQ ID NO: 51937 - DNA, 201 bp, Homo sapiens
tctccattattggtatttctattgagtgtttttaagtcatggcagtagaatcattcctagggattctctccctagaaaggatgtatttaactgcttacttwctgttcttcacttacactcctctccagctcagcaggtgtggctgaggtaggagtaacagtccctgacaccatcaccgagtggaaggcaggggccttctgc

SEQ ID NO: 51938 - DNA, 201 bp, Homo sapiens
ctttagaaataatgtgtgtagatgtatatgtttgtggatgtgtgatttacatataataaactgtataagtttcattctataaatcactgtttgtttttcamtcagcatcctgtcttggagatttacctatgttaaattgtagatctaggtctttccttggaattgcttttaagcctataatataaatacatcacaattctg

SEQ ID NO: 51939 - DNA, 201 bp, Homo sapiens
agatgctttacttcaaacccattctccctctgttctccttccctctctactccctttcttatgtgtggtttcaggtcagtgtgcagctggaagcctctccygccttcctagctgtcccagtggagaaggaacaagcgcctcactgcatctgtgcaaacgggcggcaaactgtgtcctgggcagtaaccccaaagtcattag

SEQ ID NO: 51940 - DNA, 201 bp, Homo sapiens
catctttgtaatttatcatgaggcatcaaatgaatgctattaacattaatccctcctattttaagtcattaatccaagtaaatgctcacttatttctagcrtcttagaaaccatttaaattatgttacattatgaatcaatacattataaaattataccatcatttgtaataattttttaaaatgttgtgtgctattaaca

SEQ ID NO: 51941 - DNA, 201 bp, Homo sapiens
ccagatgccctatggctgtggagagcagaatatggtcctctttgctcctaacatctatgtactggattatctaaatgaaacacagcagcttactccagagrtcaagtccaaggccattggctatctcaacactggtgagtgattacttgagtaagggaaaacttgaatgttatttcaactggatttcccagtaggtttcag

SEQ ID NO: 51942 - DNA, 201 bp, Homo sapiens
caggttggtgatttgccaaaaccttttatttcaccttcaggtagcaaaagatttgaatgaaaaagaaacaaacacatccaagaagaaaaaaatacagatgwcagtaacttgaaatgaggaaaagttttcagtatccaaggataatggaaataaaagcaaatcaaagtcaaagagggccaaaaggaaatgctcagaatcccg

SEQ ID NO: 51943 - DNA, 201 bp, Homo sapiens
tccttccctctctactccctttcttatgtgtggtttcaggtcagtgtgcagctggaagcctctcccgccttcctagctgtcccagtggagaaggaacaagygcctcactgcatctgtgcaaacgggcggcaaactgtgtcctgggcagtaaccccaaagtcattaggtgagcaaaaaactgctagagataattgtctactc

SEQ ID NO: 51944 - DNA, 201 bp, Homo sapiens
taaatatactaagactccctgtggcaaagagagagttagcaaggaaatactacatctagcagattaatcaggcagactaaagattaatcaaggagataagmtctctaagtacacaagaattttgttagctaactcacatcatatgaagcctgttgctgtgaagtggttataaaaccattttgacaacataaacatcatgat

SEQ ID NO: 51945 - DNA, 201 bp, Homo sapiens
actgtgtcctgggcagtaaccccaaagtcattaggtgagcaaaaaactgctagagataattgtctactcaaagattgtatatggcagtgggaaccttataktgagtgctacttccttcaggaaaagaccactagatgctgcgatttttttcctttgccttttattctaagatgcctacaaggatatcctcaacatctccac

SEQ ID NO: 51946 - DNA, 201 bp, Homo sapiens
tgataatgtgaaaaattctaagggaaagcctcagaggaaaataaaacctggatggcaccaaaaaagaggggatagaacaaaagttgattgtgatactttgycctatagggatggatatgggtaaggatgaattccatgacacagcagaatagaaagaactaatcaatagcattctcagaagttgaattattcagatctctc

SEQ ID NO: 51947 - DNA, 201 bp, Homo sapiens
ctgtgatccctgtctcctctcttcttttctatatatcatatatattttgtccatattgcatcttataaaatctaggatttcttaatcaaatcagaaatcaraagacaagaggccgtgcagatgcttctcaattacgatggggttatatcctgacaaactcattgtaaagtctaaaaaatcttaagtgggaccattgtaagt

SEQ ID NO: 51948 - DNA, 201 bp, Homo sapiens
ggatttccttatatttttgctgcatatgtatccctaactaatatttagaatcttcacatgtgtttcatcttgagagaaacaagatttttatttctctcttrttcaagaaacaagagaaacatttttgaatatttcagcagcttagttttttgtttgtctgctttttattttctaagttcaacactatgttgatgaagaccc

SEQ ID NO: 51949 - DNA, 201 bp, Homo sapiens
ctcctctcttcttttctatatatcatatatattttgtccatattgcatcttataaaatctaggatttcttaatcaaatcagaaatcagaagacaagaggcygtgcagatgcttctcaattacgatggggttatatcctgacaaactcattgtaaagtctaaaaaatcttaagtgggaccattgtaagtcagggaccatctc

SEQ ID NO: 51950 - DNA, 201 bp, Homo sapiens
tacctcacagagctgttgtaataaatgaattggtacacgtaaaacacttagtagagtacatgtcacatagcaaatcctataaaagtactagttattacaaytaacatatcagttctcaatatatgcccaacccttacctggtacattatataaccttaaacataagaaaataatcatggaagtaactccttgaatgaattc

SEQ ID NO: 51951 - DNA, 201 bp, Homo sapiens
attgagaaatattttataatagatatacaaaagggcataagctataactagaaaacactgtacaactctctcatagattaagaaatagaaaattaccgacrtgggaaaaataaatcccttgtgtatcactaccacctccagaggcaatcattatcctgaatttgtcgttacaattccatggatttccttatatttttgctg

SEQ ID NO: 51952 - DNA, 201 bp, Homo sapiens
tccagaggcaatcattatcctgaatttgtcgttacaattccatggatttccttatatttttgctgcatatgtatccctaactaatatttagaatcttcacrtgtgtttcatcttgagagaaacaagatttttatttctctcttattcaagaaacaagagaaacatttttgaatatttcagcagcttagttttttgtttgtc

SEQ ID NO: 51953 - DNA, 201 bp, Homo sapiens
agtctggttcttctcctcttggtcctcctgcccacagacgcctcagtctctggaaaaccgtgagttccacacagagagcgtgaagcatgaacctagagtcyttcatttattgcagatttttctttatatcattcctttttctttcctatgatactgtcatcttcttatctctaagattccttccagattttacaaatctag

SEQ ID NO: 51954 - DNA, 201 bp, Homo sapiens
gctcattaattttcactgctgcataatatattacagtctataaattagtcataatttacacatcgagtttctcctcatggattttttttatgttttgctaytaaaaaaaatgctgcaatgaatactcatgtgcctgttttcttgtgcatctgtgtttctccaaattatgctttgagaagcataatgactgattagtgggct

SEQ ID NO: 51955 - DNA, 201 bp, Homo sapiens
cataagcattgctagtgagaaggtaagttggcattttagaaagttgatgagatagtatctataaatttgaaatgtatatacatagcaaattcacaatgggracagattcattatacaaaaatacttcggcatgccccaaagtataaatatgttaggacagccattgaattctattgtttgtagtaaattgttttagtccaa

SEQ ID NO: 51956 - DNA, 201 bp, Homo sapiens
aattttcactgctgcataatatattacagtctataaattagtcataatttacacatcgagtttctcctcatggattttttttatgttttgctattaaaaamaatgctgcaatgaatactcatgtgcctgttttcttgtgcatctgtgtttctccaaattatgctttgagaagcataatgactgattagtgggctaagcaca

SEQ ID NO: 51957 - DNA, 201 bp, Homo sapiens
gtttcaccatgttggccaggatggtctcaatctcttgacctcatgatccacctgcctcagtctcccaaagtgctttttgataattttgagaaatgatggargcatattagaatgaaaacaacctgaggatgtgcttttatctttgtatattcaaatattttttctcattaaaaagcagaaagtccgggtatgatggttcat

SEQ ID NO: 51958 - DNA, 201 bp, Homo sapiens
caaatattttttctcattaaaaagcagaaagtccgggtatgatggttcatgcctgtaaccctaacactttgcggggccgagataggaagatcccgtgaggycaggactttgaggctagcctgagcaacatggtaggaccctgtctccataaaaagcttaagaaaaaaattagcggggcgtggtggagtgcacctgtagtct

SEQ ID NO: 51959 - DNA, 201 bp, Homo sapiens
cataaaatcttcaacatgtaaaactagaagttactattgttatcatttgttttacacatgtgaacattagggccaaaagggttaaacaaattccccagagwcattcagcaaggtagtggcagagtcacactaagaagcagaatcacttgattccttatacaaaactctcaaacttctcctagcagtgcctcttaccaatta

SEQ ID NO: 51960 - DNA, 201 bp, Homo sapiens
aggaccctgtctccataaaaagcttaagaaaaaaattagcggggcgtggtggagtgcacctgtagtcttagctatttgggaggctgagatgggaggatcasttgagcctaggagttcaaggctgcactgagctatgatctaaccactgtactccagcctgggcaacagagcaagaccctgtctctgaaaaaaaaaaataca

SEQ ID NO: 51961 - DNA, 201 bp, Homo sapiens
cccacaacaggccccggtgtgtgatgttccccttcctgtgtccaagtgttctcattgttcaattcccacctatgagtgagaacatgcggtgtttgtttttytgtccttgcaatagtttgctgagaatgatggtttccagcttcatccatgtcccaggaaacaacaggtgctggagaggatgtggagaaataggaacacttt

SEQ ID NO: 51962 - DNA, 201 bp, Homo sapiens
aaaagaccatacagtacccaaagtccttaaaatcccagagctccatgcaaccagtaataggagttgtcaaactagtttcaacatttcaaaaagcctaacaraagtgatacatatacctgcactgaggctatacaggctaaatgaaatatcagatttccgtttttataagaattatggctgggcctggtggctcacgcctgt

SEQ ID NO: 51963 - DNA, 201 bp, Homo sapiens
cacttgagcctaggagttcaaggctgcactgagctatgatctaaccactgtactccagcctgggcaacagagcaagaccctgtctctgaaaaaaaaaaatacacacacacacacacacacacacacacacacacgttagtgggatagcacaaatgagaaaaactctgctctttgatcactgagtacatctctgtagatata

SEQ ID NO: 51964 - DNA, 201 bp, Homo sapiens
acttgagcctaggagttcaaggctgcactgagctatgatctaaccactgtactccagcctgggcaacagagcaagaccctgtctctgaaaaaaaaaaatacacacacacacacacacacacacacacacacacgttagtgggatagcacaaatgagaaaaactctgctctttgatcactgagtacatctctgtagatatat

SEQ ID NO: 51965 - DNA, 201 bp, Homo sapiens
ctatgatctaaccactgtactccagcctgggcaacagagcaagaccctgtctctgaaaaaaaaaaatacacacacacacacacacacacacacacacacaygttagtgggatagcacaaatgagaaaaactctgctctttgatcactgagtacatctctgtagatatatatttccttcactgcagattttgcccaagatac

SEQ ID NO: 51966 - DNA, 201 bp, Homo sapiens
atagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaata

SEQ ID NO: 51967 - DNA, 201 bp, Homo sapiens
tagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataa

SEQ ID NO: 51968 - DNA, 201 bp, Homo sapiens
agtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcaca

SEQ ID NO: 51969 - DNA, 201 bp, Homo sapiens
atgacagtaacttgaaatgaggaaaagttttcagtatccaaggataatggaaataaaagcaaatcaaagtcaaagagggccaaaaggaaatgctcagaatyccggcaccccatcgctgtgttattatccatctcctatttcccataacaacactgccttcctcaagcagcagtggagcaccagcagaatgaaggagatgtc

SEQ ID NO: 51970 - DNA, 201 bp, Homo sapiens
actccatcttcccaaccctcagcccttctgtcctccttctgctcccaccaatctgtgtttcttctgtttcactcacccagctaaaggcaacacaattcacyccgtgacgagccaggaaaatggaaagacacattttcctttattcctcacattgatatattcactgagcactataattacctcttaaatatgatataaatc

SEQ ID NO: 51971 - DNA, 201 bp, Homo sapiens
tatttatatattactgttgtattaaaggcggacaacttttcaggaggagtttaggtataaggcatagtcctagcttctgggtcatagagctgtttagaaasatataatgcagaaataattttcatatgtctgatttgcttatttctctaggtggtgaggtttctgaagaattatccctgaaactgccaccaaatgtggtag

SEQ ID NO: 51972 - DNA, 201 bp, Homo sapiens
caaataaagtcatattcatcagaggaaatgaagcaaactattactccaatgctaccacggatgagcatggccttgtacagttctctatcaacaccaccaaygttatgggtacctctcttactgttagggtaagtttggaaagaaattaccaatgacatgaagtagccttggaaacaaggttgcaacctaagggtgagaaaa

SEQ ID NO: 51973 - DNA, 201 bp, Homo sapiens
taaaaagggaaagccaaataaaaatgtcattaaatccagaagataattataatactcatcttttatttcttttggagaaactgaagcatgactctgctcatggctgcaaagaaccttgggttctctccaggacactgacctcagcaactgagcaaagtttaatatgggagagagccagactgaactttgcttgagtggtgg

SEQ ID NO: 51974 - DNA, 201 bp, Homo sapiens
atagggatggatatgggtaaggatgaattccatgacacagcagaatagaaagaactaatcaatagcattctcagaagttgaattattcagatctctctctygtattcacagggaggagtagaagatgaagtgaccctctccgcctatatcaccatcgcccttctggagattcctctcacagtcactgtaggtaccacccca

SEQ ID NO: 51975 - DNA, 201 bp, Homo sapiens
attgaatcaaataaaagaatttttaaaaggacaaaatgtgatgaaaattaacaaccaaaaaaggactcgttattcagacacgttaagcttcttgctcaagrgcacatagcaatacaaattcaaatcttctgattgtgtcaggacatccgtatatgcaaggctggagagaatacagagcagattgtgaaaagtgctatatga

SEQ ID NO: 51976 - DNA, 201 bp, Homo sapiens
gagtcagcctggaagacagcacaagaaggggaccatggcagccatgtatataccaaagcactgctggcctatgcttttgccctggcaggtaaccaggacargaggaaggaagtactcaagtcacttaatgaggaagctgtgaagaaaggtgagagcacacctgagatccttctcctggcccatcctctgtatcaagaactg

SEQ ID NO: 51977 - DNA, 201 bp, Homo sapiens
tcagaatacaaaaaaatgatacagtgatgtcggtctgagtaggcttcatgtaaggactgtggggaaagaagaaagtattgggttatgtactaggaaagtgyaaagtgtgtttggttatgggaataccctatgaaaaacccaaagggtgaatttttatgagaaaataaaagactgacttcaccagaaaagactttttacatt

SEQ ID NO: 51978 - DNA, 201 bp, Homo sapiens
tttcaggtacttgatcttcatttatatcatctttaatgtgaggcaacctgaaatctaaccaattcctcaagatgctttacttcaaacccattctccctctsttctccttccctctctactccctttcttatgtgtggtttcaggtcagtgtgcagctggaagcctctcccgccttcctagctgtcccagtggagaaggaac

SEQ ID NO: 51979 - DNA, 201 bp, Homo sapiens
ggaggccaaggcgggcagattaccttaggtcgggagttcaagaccagcctgaccaacatggagaaaccccgtctgtactaaaaatacaaaattagtcggamgtggtggtgcatgcctgtaatcccagctactcgggaggctgaggcaggagaatcacttgaacccaggaggcggaggttgcggtgagccgaaatcatgcca

SEQ ID NO: 51980 - DNA, 201 bp, Homo sapiens
agctatgatctaaccactgtactccagcctgggcaacagagcaagaccctgtctctgaaaaaaaaaaatacacacacacacacacacacacacacacacayacgttagtgggatagcacaaatgagaaaaactctgctctttgatcactgagtacatctctgtagatatatatttccttcactgcagattttgcccaagat

SEQ ID NO: 51981 - DNA, 201 bp, Homo sapiens
atactattaaagtcaatctctatcaaagccttatcctttttccagctcagaaatataatcacatgtgtttgtatgaatgctgaccatgtgcagagcactgygctaggacccatgactacaagaaaaagattgtcagcaggttcctgcttttcaatttcttcttagcttagaattttgctaagaagataaaagatatgaaca

SEQ ID NO: 51982 - DNA, 201 bp, Homo sapiens
aaaaaaaaatcaatcaattatttgatttcacagcggcacttgacatgggtagccaggaatttatcaatgacaacctttacagatcatctttgtaatttatsatgaggcatcaaatgaatgctattaacattaatccctcctattttaagtcattaatccaagtaaatgctcacttatttctagcgtcttagaaaccattta

SEQ ID NO: 51983 - DNA, 201 bp, Homo sapiens
ccggacagaagtcagcagcaaccatgtcttgatttaccttgataaggtaagagaacttccagtctatttgcaaaaaaacgtagataataatcctctaaggraacatctgggaaggtaaatgcattttagaaacatcacttccatgctagaaatttgagaattctaatgttaactctaaaagaatgttcttctctcctttat

SEQ ID NO: 51984 - DNA, 201 bp, Homo sapiens
ggttaggcatatctaatggagaacttgcagccacactgacttgtagtgaaatatctattttgagcctgcccagtgttgcttaaattgtagttttccttgcyagctattcatacaagagatgtgagaagcaccataaaaggcgttgtgaggagttgtgggggagtgagggagagaagaggttgaaaagcttattagctgctg

SEQ ID NO: 51985 - DNA, 201 bp, Homo sapiens
tctctcctttatttatatttcaccagggattacaggtagaaatggcttattatgatcttgggatatgaatattcctaaaatcccataagcaagaaatcttsacaaaatgtgtttattatgttgacaagttttttggatacccagtaatataaggaagtagcccttgtgattagtcaattattagttaattatcaacatact

SEQ ID NO: 51986 - DNA, 201 bp, Homo sapiens; identical to SEQ ID NO: 9766

SEQ ID NO: 51987 - DNA, 201 bp, Homo sapiens
accgtgagttccacacagagagcgtgaagcatgaacctagagtccttcatttattgcagatttttctttatatcattcctttttctttcctatgatactgkcatcttcttatctctaagattccttccagattttacaaatctagtttactcattacttgcttacttttaatcattcttccccaactctctgaagctctaa

SEQ ID NO: 51988 - DNA, 201 bp, Homo sapiens; identical to SEQ ID NO: 9767

SEQ ID NO: 51989 - DNA, 201 bp, Homo sapiens
ggaggctgactgggaggatcacttgagccccagaggcagagattgcactgagccaagattgtgccactgtactccagcatgggcgccagagcaaaaccctstctcaaaaaaataataataatagcaatcagcctaagatagcccagaagagctagacttcagctaattcatcagctcagctcttaaaccaatgctttctac

SEQ ID NO: 51990 - DNA, 201 bp, Homo sapiens
tggcttgttaagtcaaccaacatatttcctcctcaaagaagctttccttgatgacccaagcgccctctcctccttcctctctatttcatcagacgatttgwtttttgttttttttttttggtggcaactattacattctctcataagctttatctgtatgtttattgtaatgtcttcttcctcactcaccatagagtcaga

SEQ ID NO: 51991 - DNA, 201 bp, Homo sapiens
ctgagtagctgggattacaggtgtgcaccaccacgcccagctagtttttgtatttttagtagagacaggatttcaccacgttggccaggctggtctcgaaytcctggcctcaagtgatctgcccacctcagcttcccaaagtgctgggattataggtgtgagccaccatgcacagcctccctttgatttactttcttaatt

SEQ ID NO: 51992 - DNA, 201 bp, Homo sapiens
gtcagaaggaaatgtttaatatttataaatttatggttacattctatttaaaagaggagttaaagttaaatttacctacccacatatgttacatatatatktatttatgtatatgtattcatatatgtatatatgtgaacataagtatacatacgtatatgtatagatgcttgacaataaagaagtaagaataattcacaa

SEQ ID NO: 51993 - DNA, 201 bp, Homo sapiens
gcatatgcatagatatgcatagttttgtttggttggttgttgttgttgttctttaattacattgtaaactgaccatttataattgtatatatatacagcakacaaagtgatgttatgatttatgaataaaatgtgaaataattaaatcaagctaacctgaaatacttatgttttgtggtgggaacatttgaaattctctaa

SEQ ID NO: 51994 - DNA, 201 bp, Homo sapiens
aaggagcaatgcatgactctccagccatgggagacaaatatttacaggcaaactaaaagtcagcttaataatcacatagaaaccctattagccagaaaggaaaaaaaaaaaaagaaaatgtgacttcttaaaattaagatggaaaaaatattaataaagcaaactagaccaaggctcaacatgagccacccgtggtggact

SEQ ID NO: 51995 - DNA, 201 bp, Homo sapiens
aaaatgactggataagtaggataagatcaattaaaattatatttatctaggaattaattgctttgagctctcttgtgggctttcattggtaaggaattttatatatatatatatataactactcacttctgcagttaaaaaaataaacaaaatacaatatattgaatcaaataaaagaatttttaaaaggacaaaatgtga

SEQ ID NO: 51996 - DNA, 201 bp, Homo sapiens
gccttcgctgtgagtgtggctgtttgacttaatatacttggttcttttagtcagggtcatagggatctagtattctgtcagatgaggctttgggaggttgstaagaactgcaggaaggaatccaaatgtagcaaactaagtatagaaattaaggagcaatgcatgactctccagccatgggagacaaatatttacaggcaa

SEQ ID NO: 51997 - DNA, 201 bp, Homo sapiens
ggctaaatgaaatatcagatttccgtttttataagaattatggctgggcctggtggctcacgcctgtaatcccaacactgggaggccaaggcaggcagatmacttgagatcaggagtttgagaccagtctggccaatataatgaaaccccgtatctactaaaaatacaaaaattagtcagacgtggtggcgggcgcctgtc

SEQ ID NO: 51998 - DNA, 201 bp, Homo sapiens
gaaatatcagatttccgtttttataagaattatggctgggcctggtggctcacgcctgtaatcccaacactgggaggccaaggcaggcagataacttgagrtcaggagtttgagaccagtctggccaatataatgaaaccccgtatctactaaaaatacaaaaattagtcagacgtggtggcgggcgcctgtcatcccagc

SEQ ID NO: 51999 - DNA, 201 bp, Homo sapiens
gtagtcccagctactcgggaggctgaggcaggagaatggcgtgaacccgggaagcggagcttgcagtgagccgagattgcgccactgcagtccgcggtccrgcctgggcgacagagcgagactccgtctcaaaaaaaaaaaaaaaaaaaaaaaaaaaagtcacaaataagtttgcctttttgtctttcgtatttgtacagg

SEQ ID NO: 52000 - DNA, 201 bp, Homo sapiens
ggtattcattctttttaaatgataagtagaacctagcagtgaagccaacagttattaggcttttctttaatggaaaactttttattactgattcaatctcyttactcattatttgtcagttcagattttctatttcttcatgattcagtcttggtagtatgtatatgtctaggaatgcattcatttcttctagatcatcca

SEQ ID NO: 52001 - DNA, 201 bp, Homo sapiens
tcaaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttca

SEQ ID NO: 52002 - DNA, 201 bp, Homo sapiens
ctgtcttaattttttttctttccaatgtcacagatcttggaaatgcttgaagaccacaaggctgaaaagtgctttgctggagtcctgttctcagagctccmcagaagacacgtgtttttgtatctttaaagacttgatgaataaacactttttctggtcaatgtctttccctgtttcctgttcattcaataaatatcattg

SEQ ID NO: 52003 - DNA, 201 bp, Homo sapiens
agacgcctcagtctctggaaaaccgtgagttccacacagagagcgtgaagcatgaacctagagtccttcatttattgcagatttttctttatatcattccyttttctttcctatgatactgtcatcttcttatctctaagattccttccagattttacaaatctagtttactcattacttgcttacttttaatcattcttc

SEQ ID NO: 52004 - DNA, 201 bp, Homo sapiens
ttaattaggacaattagaaagatacattcaatagcagacacagaaaaatcctcaaagaacctaagctcaaaaaacattttaaagatttagattttttctayacacatctaccaaaatcttcactataaaggaaagtcagggtaattaatttgttcctcaagactaactcttggtatctgtgataagaaacagttctttcta

SEQ ID NO: 52005 - DNA, 201 bp, Homo sapiens
gtacaattggtacaattaaataagttatattcagttcctgggaagcactatagcaatacaaggagaaaatttgattctatttatttttgttaaggcccacstacctcctaatcctaatttctctcatttcccaaatattccttgtttgttcttactgttatgtgttttcctgtattttgctcttctactttcttttccatg

SEQ ID NO: 52006 - DNA, 201 bp, Homo sapiens
catggtttaccaggcagtctcaggtttttatgacattttctcacaagaatctcaaaattcatgctgaccagtttcattacgatgctaacactaactttgtrtggaaacaggtgggtaggtggttttaatttttattttgaagtattaaagattctacaataatgtttatttcatggatagtatatttacactatttttcta

SEQ ID NO: 52007 - DNA, 201 bp, Homo sapiens
tacataatcatggtaatggaaaacgcctgcctctttagagttttaccttgttatagagaaataaataatacattttatttatttagctttaatagatggcrtaaaagcacctccctctaatttgaatgtttactcatttcaaaaagtgtcttgaatgctttccacgtgccagcactgtgctagtcttgacaatgaaattat

SEQ ID NO: 52008 - DNA, 201 bp, Homo sapiens
tcttagcacttatagctacacaaaacaaaaatagtaacagaattaatgttgtttaattcttgcaatccatggatgcataaattcactgggggaaaaaacarctcatcattctcattaaagatgtgcttcaaaagtattttaattttatatctaatatgtatgaatcatactttgtatttattttgttttgatcagttatat

SEQ ID NO: 52009 - DNA, 201 bp, Homo sapiens
ttggggtgatcatatatgtgttgtcaccaaaatatacattaagatatgaacaaaatgttttgctcaaggattcactagtgctattgggagctggggatgamggtagaggaagcctgaaaggagctaaggaataacttctacaggaagaaaagttggaaatataacccaaatagggcctctgaggtattagaatccagattg

SEQ ID NO: 52010 - DNA, 201 bp, Homo sapiens
cctacaagttttaatctgtttaagacctacctcaagtaaaatgttcactgccatggcatgtgagggaaaagggaaataattcttatgcatggccttcaacrgccaaatttcatgctcatcagtacatcttctcttggtgtagaactgatgatgataattatgatgatggaaaaaagtgctgttgatagcaatgcctctctt

SEQ ID NO: 52011 - DNA, 201 bp, Homo sapiens
acagtctgttccaaccttgaaaagtcttgtttcctggatcttatgttcccatccatggtggcacacagtagcagtagcaggaagagcaggtatagtcctgyccaaagatcacacatgtaatacacctactattcagctaggcccctgctccagttctgtctcacagtgatggccaagttcctggttcctcataactggtgt

SEQ ID NO: 52012 - DNA, 201 bp, Homo sapiens
tatatacccaaaggattataaatcatgctgctataaagacacatgcacacatatgtttattgtggcactattcacaatcgtttctatgtcaaacttctcastttgttggtgtattgttttgcaaatttcatttaattttgtatttatatattcttgtagtccactgaatttcttcaagaggattattctgaattctttgtc

SEQ ID NO: 52013 - DNA, 201 bp, Homo sapiens
aatgaattctggtattttaagcccatttcataagaccaataatgttgaccaatctactcatattcacacagtacttctacatataccatggtctatatgarcggttgaagaaatagaaaataaaatgcaaatcacaagatgtccattaaaacagtctacctttttcctttgacagccattaattcttcttaaaatgtattg

SEQ ID NO: 52014 - DNA, 201 bp, Homo sapiens
tcctgatcacagaaattcaggtttaggagatgtgttggggttatttattacattaagtaattacattatcacttcattttgtctccatcaagtctgatgcycctctttttgtctcttatacatacattatagaaacaacctacattataaatttatcaactactaatacaaaacacctgtgggatatttagttcccttttc

SEQ ID NO: 52015 - DNA, 201 bp, Homo sapiens
acattaatctttatgacgtataatctaaaaataatataatttttctaattcattaggtcaattacaaggatcgtagtccctgttacggctaccagtgggtrtcagaagaacacgaagaggcacatcacactgcttatcttgtgttctccccaagcaagagctttgtccaccttgagcccatgtctcatgaactaccctgtg

SEQ ID NO: 52016 - DNA, 201 bp, Homo sapiens
tgaattctggtattttaagcccatttcataagaccaataatgttgaccaatctactcatattcacacagtacttctacatataccatggtctatatgagcrgttgaagaaatagaaaataaaatgcaaatcacaagatgtccattaaaacagtctacctttttcctttgacagccattaattcttcttaaaatgtattgag

SEQ ID NO: 52017 - DNA, 201 bp, Homo sapiens
aaacccaaagggtgaatttttatgagaaaataaaagactgacttcaccagaaaagactttttacattaaaatgaagtagaatgaaatacaacattgaacakgtcatattgagaggcaagataattgggacttgacctgaattgggagtgatgtgtcctatgttacaccaaaatctgccactgatgagagtgatcagtcagt

SEQ ID NO: 52018 - DNA, 201 bp, Homo sapiens
tgtggagcaagtaatcatgaagctctttagatgtcattacttcaacttcttatccatgttccttttgaaagtttgatttctcttgaggtgaattattgccrgcagggactcaataaaacaagtatattgaagtgagactgaagcgtgttctctctggcacatttaatttctttttatttccttttttgcagataatggcaa

SEQ ID NO: 52019 - DNA, 201 bp, Homo sapiens
attactgagcaatggaacagaaggataaggaagatgaagaggaaggagacctgcagttagtagctcatttccacagtaaggatgtcctttccacagcaagkgtgtcccaacgagtgttcagcttctagcagaaaggagaccctggagtggctggctcctctctgcaaacaggtcttcccattgagtgttcagctttcagca

SEQ ID NO: 52020 - DNA, 201 bp, Homo sapiens
ctgccacttcctaatagcttagctcctacttctgagtgagaagatatgatgtttggttttccattcctgagctgggaatatcaggaatactttcaagtaaygagagaccatttccatctaatattaattaaaagaaagttgagggagggaaaacaataatggtttttttctcaccctttatcaaatatgtgttgtcttttt

SEQ ID NO: 52021 - DNA, 201 bp, Homo sapiens
atgaagaggaaggagacctgcagttagtagctcatttccacagtaaggatgtcctttccacagcaagtgtgtcccaacgagtgttcagcttctagcagaamggagaccctggagtggctggctcctctctgcaaacaggtcttcccattgagtgttcagctttcagcagagaggaggttctggaatgggtagtttctctcc

SEQ ID NO: 52022 - DNA, 201 bp, Homo sapiens
tcaccagcttcagggtgggacttcactggggacccatccccttccacccaggaacctgtctgcctcctgctcccaggctgttcatgccaaggagcgcctgmaagtcagtgtccagctgtcttcagacccctctcagcctccctcccacgcttgttggtgcccaagttccaaagggggccgagacggcagggggctggcgta

SEQ ID NO: 52023 - DNA, 201 bp, Homo sapiens
agtgatggttaagaacgaggacagtctggtctttgtccagacagacaaatcaatctacaaaccagggcagacaggtatgaagaagcctacagacaggacamcttcaaaaaggaaagatcttcttcccctggatgttccccaggcaaagttcctataatcttggttccttaatagcttgtcttaccagcctacaggcctact

SEQ ID NO: 52024 - DNA, 201 bp, Homo sapiens
ttttagtctttacaatgtttttttctattatgcaatattctctcaaatactttatgtccatccacgttgtctgagacatgccactttaacattctagttaygctgtagctgtcattttaccctaagccgttagtagtactgatccacataaaattgggctgtttaggtgtttaactgtttaaatgtataatatatctgata

SEQ ID NO: 52025 - DNA, 201 bp, Homo sapiens
ttttcctttgacagccattaattcttcttaaaatgtattgagaaatattttataatagatatacaaaagggcataagctataactagaaaacactgtacarctctctcatagattaagaaatagaaaattaccgacgtgggaaaaataaatcccttgtgtatcactaccacctccagaggcaatcattatcctgaatttgt

SEQ ID NO: 52026 - DNA, 201 bp, Homo sapiens
tagtagcttcttatcaatgtttattcatttttaaaagtaatatttattaaactaaatttattaatgaaatatgtccattcctcctcattcttagaactacrtaagaattctatgacccatcttaatgattacatctgaacatatttacttatagttacataagtgtttatttctcaacctgtaaaattgcatagcaaagga

SEQ ID NO: 52027 - DNA, 201 bp, Homo sapiens
ctctctcatagattaagaaatagaaaattaccgacgtgggaaaaataaatcccttgtgtatcactaccacctccagaggcaatcattatcctgaatttgtygttacaattccatggatttccttatatttttgctgcatatgtatccctaactaatatttagaatcttcacatgtgtttcatcttgagagaaacaagattt

SEQ ID NO: 52028 - DNA, 201 bp, Homo sapiens
gattttttaaactttttattgtttttaatttttgtggaaacatagcaggtatatatatttatgggttacatgagatattttgatacaggcatgcagtgcaygataatgattatggatgataatcattatcattatccatatcattatccaatcatggataatgattattatcatgcattgcatgcctgtatcaataaatgg

SEQ ID NO: 52029 - DNA, 201 bp, Homo sapiens
aaacaagagaaacatttttgaatatttcagcagcttagttttttgtttgtctgctttttattttctaagttcaacactatgttgatgaagacccctatacmagtatgtgcagagtcagctcattaattttcactgctgcataatatattacagtctataaattagtcataatttacacatcgagtttctcctcatggattt

SEQ ID NO: 52030 - DNA, 201 bp, Homo sapiens
tctcagaaacttgtcattaaaggagaagccttcaaactcccatagagctagatggctataactcatctcctctactcaccctttactactaccccatttgmcctttttgtagataacttagggtttccatagatatcttttattagctccaatgctccaggtgcttttgtaagttataattaatttactcatataggatcc

SEQ ID NO: 52031 - DNA, 201 bp, Homo sapiens
agtattctgtcagatgaggctttgggaggttggtaagaactgcaggaaggaatccaaatgtagcaaactaagtatagaaattaaggagcaatgcatgactmtccagccatgggagacaaatatttacaggcaaactaaaagtcagcttaataatcacatagaaaccctattagccagaaaggaaaaaaaaaaaaagaaaat

SEQ ID NO: 52032 - DNA, 201 bp, Homo sapiens
gttggctattgtaatttttcaaaaaaaatcatgaacttagcacaatgggaattatttatttctcgtaattgcccattgtgagtgtttcagaacgatagacrctgagccatctaaagcctccatgggcattcacttctacaaaggaaggaaaaaaccatacacctcttaattgccttagctggccaggccatcagttctgct

SEQ ID NO: 52033 - DNA, 201 bp, Homo sapiens
atgtactgtgtatttcaaaatagcaagtggacaggacttgaactatttccaacacatagaaatgatacatacttgagttggtaggcaccctaaatcccgcratgtgatcattacacattctctgcatgtaacaaaatatctcgtgtaccccataaatatgtataaatattatgcatcctttgtacaaaaaaaattactcct

SEQ ID NO: 52034 - DNA, 201 bp, Homo sapiens
caggacatgggcttaaaggcattcaccaactcaaagattcgtaaacccaaaatgtgtccacagcttcaacagtatgaaatgcatggacctgaaggtctacrtgtaggtttttatggtaaacaaaaaattaataaatatatattgcctaatatattcaccaaattttaaattttttaaaagatacaatgtgacaaaaattaa

SEQ ID NO: 52035 - DNA, 201 bp, Homo sapiens
tatcgcaatatatctagggaatttcagataccaaggaatacatctgtcaattatacatgagatattgttgtgaaatttaatatttagttgctagagaatattttattgtgtcctcgtcatagaaaatgcctacatgatgttgtccccccacaaaaatcacaccggttatctgaccactgatctatttagtataatatgcat

SEQ ID NO: 52036 - DNA, 201 bp, Homo sapiens
caaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaa

SEQ ID NO: 52037 - DNA, 201 bp, Homo sapiens
aaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaag

SEQ ID NO: 52038 - DNA, 201 bp, Homo sapiens
ataaagtaatctgtacaccaaacccccatgacacgagtttacctatataacaaacctgcatgtgtacgcctgaacctaaaagttaagtatatatatatatwtttttttcatttaatttggtgtatatatatgccaaaaaataaattaagcagtccaaatttcggatgcaaactctcggggacaagacgctaggtgtttcta

SEQ ID NO: 52039 - DNA, 201 bp, Homo sapiens
ctaaaagttaagtatatatatatatatttttttcatttaatttggtgtatatatatgccaaaaaataaattaagcagtccaaatttcggatgcaaactctrggggacaagacgctaggtgtttctaagtgttttgttgaaagccagtgtttaagtaaacattataaattattgttgtttttgtaaataatgtagactgaaa

SEQ ID NO: 52040 - DNA, 201 bp, Homo sapiens
taaaagttaagtatatatatatatatttttttcatttaatttggtgtatatatatgccaaaaaataaattaagcagtccaaatttcggatgcaaactctcrgggacaagacgctaggtgtttctaagtgttttgttgaaagccagtgtttaagtaaacattataaattattgttgtttttgtaaataatgtagactgaaat

SEQ ID NO: 52041 - DNA, 201 bp, Homo sapiens
taaataaaataactggcatagattagaggtcacaaacagcctgtgcatcacttgtagagctttcttaaaatgcagatcctcagccgggcgtggtggctcaygcctgtaatctcagcactttgggaggccaaggcgggcagattaccttaggtcgggagttcaagaccagcctgaccaacatggagaaaccccgtctgtact

SEQ ID NO: 52042 - DNA, 201 bp, Homo sapiens
gggtagtgtggacattttaacagtattaattcttccaatccatgaacattgtatttttttcatttatttgtgttctctttgatttctttcatcagtgtttwataattttcactgtacatttcacctccttgattagatttatttctacatattgtttatagctattgtaaatgggattgtttttatttctttctcaatcat

SEQ ID NO: 52043 - DNA, 201 bp, Homo sapiens
ttcttaaaatgcagatcctcagccgggcgtggtggctcacgcctgtaatctcagcactttgggaggccaaggcgggcagattaccttaggtcgggagttcragaccagcctgaccaacatggagaaaccccgtctgtactaaaaatacaaaattagtcggacgtggtggtgcatgcctgtaatcccagctactcgggaggc

SEQ ID NO: 52044 - DNA, 201 bp, Homo sapiens
cttcagggacattttccagcaaattccaagtggacaacaacaaccgcctgttactgcagcaggtctcattgccagagctgcctggggaatacagcatgaargtgacaggagaaggatgtgtctacctccaggtgagactcttgggcaggtgaggacaggacagatgaggacagcagctgttctctctgagaagtcctaact

SEQ ID NO: 52045 - DNA, 201 bp, Homo sapiens
tttaattttcatatatttgtgaattttttctaattcctcctgttactcatttctagttttcatagtattgtggtcagaaaagatacttgatacgatgaaaygatttcagtcttcttaaatttgctaagacttgttttgtgggctaaaatatgatctatcttggagaatgtttcttgtgtgcttgagatgaaatgttctgta

SEQ ID NO: 52046 - DNA, 201 bp, Homo sapiens
tagatatgtgtggtaggagagtttgttcatgcataagttgatgggaattatagtttacaaattttatgaaacttaagcctgggaagatcaaccttttagahcctctttgagtctacgcaagtattcctgcaagacagagaagtcaaactataccaaatctctggatattaaaaaatgaacacagttagtcatccaataaaa

SEQ ID NO: 52047 - DNA, 201 bp, Homo sapiens
gtgaatacttaaactaattcaaagagagaagaaagcttcctgaaaggtcatttaattgacttttgctttccaggtgtcaaatcagacactgagcttgttcytcacggttctgcaagatgtcccagtaagagatctgaaaccagccatagtgaaagtctatgattactacgagacgggtgagtgagagtgattttcacgtag

SEQ ID NO: 52048 - DNA, 201 bp, Homo sapiens
atagatctttatttctatgaggtcaattttttgagcttggccagtttcttttggaggtgtcatcattccttgattcttcataatcctgtgtccttgcattrtttgtgcatttgaggagaaagccacttcttctggtttttataggtattctttggcagggataaaggtttgctatttagtctagcctataattctggaaag

SEQ ID NO: 52049 - DNA, 201 bp, Homo sapiens
tccactgcctctctccgagccttccagcccttctttgtggagctcacaatgccttactctgtgattcgtggagaggccttcacactcaaggccacggtccwaaactaccttcccaaatgcatccgggtaaggatctctttcctaaattaaatacaaggtagccatcaagtaaattaaaagttgcattcctaggaatactgc

SEQ ID NO: 52050 - DNA, 201 bp, Homo sapiens
taatttgtcttcactcagttctatgaacaatgtaggtgtcctagacttgtttccaagtattggggttttcaaaatagattttctgatctgtggatagcagytagttggactttctgtggagggaggaagatcctgagactttctagtccatcatcttgctttattctgaattttaattgaactacaaaacgaaaatcctcc

SEQ ID NO: 52051 - DNA, 201 bp, Homo sapiens
gtggatagcagctagttggactttctgtggagggaggaagatcctgagactttctagtccatcatcttgctttattctgaattttaattgaactacaaaamgaaaatcctcctctttattacctaaatgcatttatacttccaccaggatacatttccatagtgttatatttgccatcatctgttaccatcaaagttttta

SEQ ID NO: 52052 - DNA, 201 bp, Homo sapiens
aagtaactccttgaatgaattctggtattttaagcccatttcataagaccaataatgttgaccaatctactcatattcacacagtacttctacatataccrtggtctatatgagcggttgaagaaatagaaaataaaatgcaaatcacaagatgtccattaaaacagtctacctttttcctttgacagccattaattcttc

SEQ ID NO: 52053 - DNA, 201 bp, Homo sapiens
tcaatattgtgtgagcccagcagagagcagagggaagtacagacagggaatatactgtagctaaaggggagatataaatagctagaaaatggggaggttcrgtgtctgctctgattcctttgggaatgttctcatgacagatacacatatgggaagcctgtccctggacatgtgactgtgagcatttgcagaaagtatagt

SEQ ID NO: 52054 - DNA, 201 bp, Homo sapiens
gcttcccacagcagtgtattttggttcccattgtttcacatccatgtcagcctttggtatttcaaggattactgtattttttttttcaatttaatgagtasaaactctactatttcatgtgatctgtgatcctcacaagaaactgataaagacacactttataggaaatgtaacaaactccagctatagtctaatataaca

SEQ ID NO: 52055 - DNA, 201 bp, Homo sapiens
ttttttcagatgagtttgcaattgctgagtacaatgctccttgcagcaaaggtaagccactcacactcctccaaaaggcagtcagagctccttcagcttgycccccaaaccttctccttcataaaacgctgggtaaatatttgtcaaaaacatcaaattactcacactgcacattattatagaaaaacacatttattggag

SEQ ID NO: 52056 - DNA, 201 bp, Homo sapiens
tactttgccctatagggatggatatgggtaaggatgaattccatgacacagcagaatagaaagaactaatcaatagcattctcagaagttgaattattcaratctctctctcgtattcacagggaggagtagaagatgaagtgaccctctccgcctatatcaccatcgcccttctggagattcctctcacagtcactgtag

SEQ ID NO: 52057 - DNA, 201 bp, Homo sapiens
gagacccaaatctgtcttaattttttttctttccaatgtcacagatcttggaaatgcttgaagaccacaaggctgaaaagtgctttgctggagtcctgttytcagagctccacagaagacacgtgtttttgtatctttaaagacttgatgaataaacactttttctggtcaatgtctttccctgtttcctgttcattcaat

SEQ ID NO: 52058 - DNA, 201 bp, Homo sapiens
tgaagtggatcacgaagcagcagaatgcccagggcggtttctcctccacccaggttggtgatttgccaaaaccttttatttcaccttcaggtagcaaaagwtttgaatgaaaaagaaacaaacacatccaagaagaaaaaaatacagatgacagtaacttgaaatgaggaaaagttttcagtatccaaggataatggaaat

SEQ ID NO: 52059 - DNA, 201 bp, Homo sapiens
tcattgccccagtggactggagatacaatggccttctcaagttttggggtattacactcaaattcatatgtaatactggagaaaaggcctaattacaactwaaactggatttcccaccagcctggtggcatgggaatcttggaattaaaattacgtagaatttttaaaagtgatgtatcttctacatctgattttgtgaac

SEQ ID NO: 52060 - DNA, 201 bp, Homo sapiens
acatgaagtagccttggaaacaaggttgcaacctaagggtgagaaaatttccaaactgtgtctagttctatggagagaaaaaaactagcaattagaaaccrattgaaggttaacttttttaaagtttatgaaaagaaggcagtatattgtgattaaaagtgcgggttagactttagcagtgttgctgggaacgtaaaatgg

SEQ ID NO: 52061 - DNA, 201 bp, Homo sapiens
ctactcgggaggctgaggcaggagaatcacttgaacccaggaggcggaggttgcggtgagccgaaatcatgccattgcactccagcctgggcaagaagagygaaaaactccatcaaaaaaaaaaaatgcagatcctcagcccccatacactagacattctgattcatcaggtctagagtagggcctggtctctgtggcttt

SEQ ID NO: 52062 - DNA, 201 bp, Homo sapiens
ggtgattttttatacaatatataaatatatcagatatattatccatctattgtgtcaggtgattttttatacaatatataaatatatcagatatattacayatctattgtgtcaggtgatttcttatacgatatataaatatatcagatatattatccatctattgtgtcaggtgattttttatacactatataaatatat

SEQ ID NO: 52063 - DNA, 201 bp, Homo sapiens
aaataagtttgcctttttgtctttcgtatttgtacaggtttacaacctgctaccagaaaaggacctcactggcttccctgggcctttgaatgaccaggacratgaagactgcatcaatcgtcataatgtctatattaatggaatcacatatactccagtatcaagtacaaatgaaaaggatatgtacagcttcctagaggt

SEQ ID NO: 52064 - DNA, 201 bp, Homo sapiens
ctattcacaatagctgagagatcgaggctacccaaatgtccatcaagggatgaacaggtaaacaaaatgtggtatataaatacaacagaatattatgcagyctgagaagggaagaaaatcctgtcacatgctacagcatgaatgatccttgaggacgttatggtaagtgaaataagctagtcacaaaaagaccaatactat

SEQ ID NO: 52065 - DNA, 201 bp, Homo sapiens
aggctggagtgcagtggcgccgtctcggcctcggcctctcaaagtgctgggattacaggcatgagccaccgcgcccggcctctcctggcttgttaagtcawccaacatatttcctcctcaaagaagctttccttgatgacccaagcgccctctcctccttcctctctatttcatcagacgatttgttttttgttttttttt

SEQ ID NO: 52066 - DNA, 201 bp, Homo sapiens
tcccagatgcaggctgtttagaagcccaacccttaggagacagccagaaatgggagattttgcctgttctctctgtattgagccaaggggtggtgggggcrggtagccactggcattgctcaaaggcctatttaaaaccacctctgtgttcactgtggtctagggagactcctgattgcagagctccatctactcctggag

SEQ ID NO: 52067 - DNA, 201 bp, Homo sapiens
cctgtaagtctgtcgtttccctgctccttctgcttcccagtgcaggctagttagaagcccaacactcagtcagcaactgataaagtgggtagacgaagccsttccagggagaaactgggagctgttagctaatttttcagtactgaagtacttctttcaaacgcattgctaatttcaggagatgtttaacataaatacatc

SEQ ID NO: 52068 - DNA, 201 bp, Homo sapiens
gcccactatacacaatagtagtagaatttaaaattataaagcagccctcagtgaaatagcattttagagaagagaacttaagaacaatctcaaactgcatrttaaatttataactatattgtctgtaaaagattatgctacaattctgatatactacaattaaaaacagttggaagaaaaggacttatattcccatctcaa

SEQ ID NO: 52069 - DNA, 201 bp, Homo sapiens
ttatgatcttgggatatgaatattcctaaaatcccataagcaagaaatcttgacaaaatgtgtttattatgttgacaagttttttggatacccagtaatayaaggaagtagcccttgtgattagtcaattattagttaattatcaacatactcaacaacaatatgaaagggaaaaaaaactgtcagtctccacaaggactt

SEQ ID NO: 52070 - DNA, 201 bp, Homo sapiens
accttttagagcctctttgagtctacgcaagtattcctgcaagacagagaagtcaaactataccaaatctctggatattaaaaaatgaacacagttagtcrtccaataaaaagtatatatcatttacccccatgaacagagctatgtattggcattgacagaggtatatgcgttatgttagttatttaagaaataatctgg

SEQ ID NO: 52071 - DNA, 201 bp, Homo sapiens
acatcacattaaaggttaatgtcacccccctgaacatttttcagtactttgccatccatttatctttagaaataatgtgtgtagatgtatatgtttgtggwtgtgtgatttacatataataaactgtataagtttcattctataaatcactgtttgtttttcactcagcatcctgtcttggagatttacctatgttaaatt

SEQ ID NO: 52072 - DNA, 201 bp, Homo sapiens
tggatattaaaaaatgaacacagttagtcatccaataaaaagtatatatcatttacccccatgaacagagctatgtattggcattgacagaggtatatgcrttatgttagttatttaagaaataatctggagaatttatcatcccctctgagagatttctgcacaatttaattaaggaccctatagtgtgctgtaggataa

SEQ ID NO: 52073 - DNA, 201 bp, Homo sapiens
cgtagttttgtgagaacattaatctttatgacgtataatctaaaaataatataatttttctaattcattaggtcaattacaaggatcgtagtccctgttayggctaccagtgggtgtcagaagaacacgaagaggcacatcacactgcttatcttgtgttctccccaagcaagagctttgtccaccttgagcccatgtctc

SEQ ID NO: 52074 - DNA, 201 bp, Homo sapiens
gtggagatgacatcctatgtgctcctcgcttatctcacggcccagccagccccaacctcggaggacctgacctctgcaaccaacatcgtgaagtggatcaygaagcagcagaatgcccagggcggtttctcctccacccaggttggtgatttgccaaaaccttttatttcaccttcaggtagcaaaagatttgaatgaaaa

SEQ ID NO: 52075 - DNA, 201 bp, Homo sapiens
attatgctttgagaagcataatgactgattagtgggctaagcacatcttccccattgctgaatattgccaaagagcagttggcttcccacagcagtgtatwttggttcccattgtttcacatccatgtcagcctttggtatttcaaggattactgtattttttttttcaatttaatgagtacaaactctactatttcatgt

SEQ ID NO: 52076 - DNA, 201 bp, Homo sapiens
catccaagaagaaaaaaatacagatgacagtaacttgaaatgaggaaaagttttcagtatccaaggataatggaaataaaagcaaatcaaagtcaaagagrgccaaaaggaaatgctcagaatcccggcaccccatcgctgtgttattatccatctcctatttcccataacaacactgccttcctcaagcagcagtggagc

SEQ ID NO: 52077 - DNA, 201 bp, Homo sapiens
ttcaacggccaaatttcatgctcatcagtacatcttctcttggtgtagaactgatgatgataattatgatgatggaaaaaagtgctgttgatagcaatgcstctcttccttcactttcctctaactgaaccgtctcattcccaggcagtatatggttctggtcccctccctgctccacactgagaccactgagaagggctg

SEQ ID NO: 52078 - DNA, 201 bp, Homo sapiens
gagtactacgcaaaaatttttttgtttcctggaggattttcaaaattcaaaatatcaagtcactttgagacatattgagtctgatgttaaaaaggaaatgwtctagagtcaactgaaacacacactttaagtacaagtgaggtcaggcctagagaaagattttgggagcatagtggcgacagtttaacttgtgaaggcaaa

SEQ ID NO: 52079 - DNA, 201 bp, Homo sapiens; identical to SEQ ID NO: 9777

SEQ ID NO: 52080 - DNA, 201 bp, Homo sapiens
atgtatcctaatcatgggaagggcaccttgggagaagttgcagatggctgacgtgctttctctagcattcagctaaaaaatgggatggtccatgattctgygttctctgtgttctgcaaaacaacattaagtagaaaacaaacagaagcagaggcacatttccttcttttgccacagaaacaatgccactgttgagtgcaa

SEQ ID NO: 52081 - DNA, 201 bp, Homo sapiens
tagtcaacaagcaatctgccacatgcaaagtattgcaagggaccaaaaaatataagctatatgtcccatctcatttactcttcataaccatcccattttayagtcagggaaactgtctggatttgaactcagaagaccatgataaaggcaaaatcagaagtcacttttagtcctgagtttctggggtctgagattcctcct

SEQ ID NO: 52082 - DNA, 201 bp, Homo sapiens
agttcactttgttcactgccctcgagcctttatccaaggctaaacccacatgctgtacctacttttggaattggtccaggaattttatacctgtgtgaatktggagaaactctctcagacacccatttggaaatgcattagtgtttttctcagtgagtcctccatgcttgctgttccaatggccctccaggtttgggccca

SEQ ID NO: 52083 - DNA, 201 bp, Homo sapiens
ggagtctcatataacagcacctaatcaagggagcagtgatcccattatagtcacagatcccacccacaaaaatggagaggggtgccaaagatgggaatctygagggccatctcagaatcaggtctgcaaacctgcaacttgtcgcatccagtcgggaaacttcacttcttttggtatttgactctagaacagttggcacca

SEQ ID NO: 52084 - DNA, 201 bp, Homo sapiens; identical to SEQ ID NO: 9781

SEQ ID NO: 52085 - DNA, 201 bp, Homo sapiens
gtcccagaggagagaccgtgctaaagctaattactaagcagtacaaaaataatctctctctctctctttctctctctctctctctctctctctctctctctatatatatatatatatatatatatgtaattttttttttgagacagtctcactctgccgcccaggctggactgcagtgacacaatctcggctgactgcaac

SEQ ID NO: 52086 - DNA, 201 bp, Homo sapiens
tcccagaggagagaccgtgctaaagctaattactaagcagtacaaaaataatctctctctctctctttctctctctctctctctctctctctctctctctatatatatatatatatatatatatgtaattttttttttgagacagtctcactctgccgcccaggctggactgcagtgacacaatctcggctgactgcaacc

SEQ ID NO: 52087 - DNA, 201 bp, Homo sapiens
cggagataaagagtgcatataggccaggcatggtggctcatgcctggaatcccaacactttgggaggccgaggcaggtggatcgctggatcccaggagttygagaccagtctgggcaacatggtggaaccctgtctctacaaaacaaaaacaacaacaacaacaacaaaaattagctgggcatggtggtacaagcctgtag

SEQ ID NO: 52088 - DNA, 201 bp, Homo sapiens
attcctggtagggttctgacatatacctgccctggaccaatgactagggagctggctacagaggtggaggtgagcctaggaaagcagaaatacaaggagagggggaaaaaaaagtcaaatctcaaaatatctagccgcagacataagctcctctgacggtaatttcttgaggggggaaaaagttgctatttaaagctagga

SEQ ID NO: 52089 - DNA, 201 bp, Homo sapiens
ctagattgacacagtagttgcattcctgaaaaattcagtatatattaaaaccgtgcaaaaactattttgttagcatgtaacacaaagttaggttctgaggkaattttgagcaagtttttgacccttggggactttgggcaggacatcctacagctgtgtggatgctggctgattctgcatggtacgggactgtcatgcacg

SEQ ID NO: 52090 - DNA, 201 bp, Homo sapiens
gcattccctctatagcttccacctgaccacagccagcccaagccctgctcagaaccccaggcctgccagcgagcctgtgactggaattatctattagggakcaagcattaacttgacacaggagcagccctggctcagctggaggcatccgcatgctgtggtgccccaggaacagaggcacccccgaaatgcaggctgtgt

SEQ ID NO: 52091 - DNA, 201 bp, Homo sapiens
gcaggtcattttcaaagtcaagtgctgtattatgtatttttaagaatttaacttggctaaaactgtgctaccttaagggggctccaatcctttttttttcyttttctttttttttttttgttttagacggagtcttgctcttgtcgcccaggctggagtgcagtggcatgattttggctcactacaacctttgcctcctgg

SEQ ID NO: 52092 - DNA, 201 bp, Homo sapiens
tgaaggtgtggtgccactccattgcttaacaccatccagtggatccccaagccctacagggaggcagagcatagcccagactcctcagcagaacacatgtrcatgaacgtgggatctggtgattgcctacctacctcttcaaccgcctccatccttcacacaacctgcgctccatttaccaaaccactggcagttccccaa

SEQ ID NO: 52093 - DNA, 201 bp, Homo sapiens
cattttcaaagtcaagtgctgtattatgtatttttaagaatttaacttggctaaaactgtgctaccttaagggggctccaatcctttttttttctttttctttttttttttttgttttagacggagtcttgctcttgtcgcccaggctggagtgcagtggcatgattttggctcactacaacctttgcctcctgggctcaa

SEQ ID NO: 52094 - DNA, 201 bp, Homo sapiens
tgccactccattgcttaacaccatccagtggatccccaagccctacagggaggcagagcatagcccagactcctcagcagaacacatgtgcatgaacgtgkgatctggtgattgcctacctacctcttcaaccgcctccatccttcacacaacctgcgctccatttaccaaaccactggcagttccccaaatgagccacat

SEQ ID NO: 52095 - DNA, 201 bp, Homo sapiens
tcttatttaaaaacacgaattacaggtaattttcctaatgaaacacatttaaaaggcatcttttgtggtctctgtatagagtgtatgggggacctgttcaygtctacatcctagccactgttagtttcaacataccactctatttcaaaacttcccttttctggcaaagatccaaaacttactaaaattcttttgtcttct

SEQ ID NO: 52096 - DNA, 201 bp, Homo sapiens
tattatgtatttttaagaatttaacttggctaaaactgtgctaccttaagggggctccaatcctttttttttctttttctttttttttttttgttttagayggagtcttgctcttgtcgcccaggctggagtgcagtggcatgattttggctcactacaacctttgcctcctgggctcaagggtttctcctgcttcagcct

SEQ ID NO: 52097 - DNA, 201 bp, Homo sapiens
gcctggggcccagtcacacctccctgaccccagtttcctctcccagtggcgctgctgggtgctgttccccgggactgcggcagagccctcctcgcgggccygacacggtgtccggccgcacggatgaccggtagagggcagcagcgcgctccgggtcggtcgggagcagggccttcctagtccagaaaccgcggcaggtcc

SEQ ID NO: 52098 - DNA, 201 bp, Homo sapiens
gaataatgggagggacctaatttaattagaagagttagggaagttctctttgaagaagttacattacagggaacactaaaatgtgggtaggagtgagctaygcaaagtcatggagaaagagtattccaggtagaagaaatagcatgcgtgaagaccttaagcaagtggaaggcagctgctgaggctggggactgggaggtt

SEQ ID NO: 52099 - DNA, 201 bp, Homo sapiens
aaatggtacctacagtaatggtacccagtaatagtacctacaaaagactgggaggatgagggaagggagggagctcccagctgtgtggggaggagcatacrggcgagggtaaccccccatatggtattatagggatttgcgtctatttctgtcctccctccagactctagcctcatggttctcagacatgggtatgcatca

SEQ ID NO: 52100 - DNA, 201 bp, Homo sapiens
aaatgatctagagtcaactgaaacacacactttaagtacaagtgaggtcaggcctagagaaagattttgggagcatagtggcgacagtttaacttgtgaargcaaatgtggtcactgatggaagaagcctgaagcagagaacaaggtcttggggaaacctggaagccatgggggtgggaaaaagaaaagtatctgttggaa

SEQ ID NO: 52101 - DNA, 201 bp, Homo sapiens
ggaggattgtttgaaaccaatagttcaagaccagtctgggcaacatagtgagacccctccacccccacccccacacacaaaaattatctgggcatggtggyacatgcctatagccccagctactccagaagctgaggtgggatgatcacttgaaccccggagttcaaggctgcagtgagctctgatcgcaccacttcactc

SEQ ID NO: 52102 - DNA, 201 bp, Homo sapiens
tgttttggacttgacaatgcccatttgttgggcatggttccggtgggatgctgtattatgcagctagagaatgtatttgtcctggaagagttcactttgtycactgccctcgagcctttatccaaggctaaacccacatgctgtacctacttttggaattggtccaggaattttatacctgtgtgaatttggagaaactct

SEQ ID NO: 52103 - DNA, 201 bp, Homo sapiens
ccacatgcacccacatctgttgctgtaacttcccctctgatatcaaacaacccttcttcccccattcacaataactcactggcggagtgcggtggctcagrcctgtaatcctagcaattctgaaggctgaggcaggtggatcacctgaggtcagaagatcgagaccagcctgtgcaacatggtgaaaggctatctctacta

SEQ ID NO: 52104 - DNA, 201 bp, Homo sapiens
ggcttgaacccgggaggcggaggtggcagtgagctgtgatcatgccactgcactccagcctgggcaacagagcaagaccctgtctcaaaaaaaacagaaakagagtaagaatagttttgtctgtatctgccaacagccacgtctgtggagtcagaggaatgaaggggtcaaagggagcaggcacatcatagagaatacccc

SEQ ID NO: 52105 - DNA, 201 bp, Homo sapiens
aaaccccatttctactaaaaatacaaaaattagccgggtacagtggcacgtgcctgtagttccagctaatcaggaggctgagatggaaggatggcttgaayccgggaggcggaggtggcagtgagctgtgatcatgccactgcactccagcctgggcaacagagcaagaccctgtctcaaaaaaaacagaaatagagtaag

SEQ ID NO: 52106 - DNA, 201 bp, Homo sapiens
cagagcgagatcctaactcaaaaaaaaaaaaaaaagaaggaaggagacaaaacaaaagtatactgtgtcagtaacaggtataaccgcaaatcaggaagacwgtggaaagaccactctgctcggtttcatgccctcctgtcccacctgctgctcagccatggttttcccccagctctagggggtgggaggggcacccaggac

SEQ ID NO: 52107 - DNA, 201 bp, Homo sapiens
ggtgaaaccccgtttctactaaaaatacaaaaattagctgggtgtggtggtgcacacctgtaatcccagctactagggaggctgaggcaggagaattcctygaacccaagaggcggagattgcagtgagccaagatggcactactgcactcctgggtgacagagcgagatcctaactcaaaaaaaaaaaaaaaagaaggaa

SEQ ID NO: 52108 - DNA, 201 bp, Homo sapiens
aaaagcgatcactccagcagagctttcaagtcatggtggtttatgaagggagttagaattgcacctggggagcaagtgctgaggttaatggcagtgcaatyccccgtctgttttattggaactgttgtcagaggcagaatgctgggctggagggactgtggccctagcaatgttttggacttgacaatgcccatttgttgg

SEQ ID NO: 52109 - DNA, 201 bp, Homo sapiens
actgtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgc

SEQ ID NO: 52110 - DNA, 201 bp, Homo sapiens
ttttaattgtggtaaaatagacatataattttcattttataaaaaatgtccattttaataatttttaggcagacagttcagtgacattaagtacattcacyactgtttgtctccagaatgttttcatcatcccagactgaaactctgcccattaaacgctaactccccatcctcccctcccagcccctggtaacttctgct

SEQ ID NO: 52111 - DNA, 201 bp, Homo sapiens
ctgtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgcc

SEQ ID NO: 52112 - DNA, 201 bp, Homo sapiens
tgtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgcca

SEQ ID NO: 52113 - DNA, 201 bp, Homo sapiens
gtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgccaa

SEQ ID NO: 52114 - DNA, 201 bp, Homo sapiens
tgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgccaag

SEQ ID NO: 52115 - DNA, 201 bp, Homo sapiens
ctattttggggtaaaatatttaaatttctttcaggtcctgctatctgttgtgttgatatctttttattttattttattttattttattttattttattttattttattttattttattttattttattttattttatttttgagacagtctcactctgttgccaaggctggagtgcagtggcatgatctcggcttactgca

SEQ ID NO: 52116 - DNA, 201 bp, Homo sapiens
tggggtaaaatatttaaatttctttcaggtcctgctatctgttgtgttgatatctttttattttattttattttattttattttattttattttattttattttattttattttattttattttattttatttttgagacagtctcactctgttgccaaggctggagtgcagtggcatgatctcggcttactgcaacctct

SEQ ID NO: 52117 - DNA, 201 bp, Homo sapiens
tgctcagatggagtctcatataacagcacctaatcaagggagcagtgatcccattatagtcacagatcccacccacaaaaatggagaggggtgccaaagaygggaatctcgagggccatctcagaatcaggtctgcaaacctgcaacttgtcgcatccagtcgggaaacttcacttcttttggtatttgactctagaacag

SEQ ID NO: 52118 - DNA, 201 bp, Homo sapiens
cttttcttttgagatggagtctctctctgtcacccaggctggagtgcaatggcacaagctcagctcactgcaacctctgcctcctgggttcaagcaattcycctgcctgagcctcctgagtagctaggatttcagacacgtgccaccatgcctggctaatttttgtatttttagtagagatggggtttcaccatgttggcc

SEQ ID NO: 52119 - DNA, 201 bp, Homo sapiens
atagacactgtggaagtctgcagagaccggagcataacctctgcctcctctccccgggcctagcctctcacagccctcagagaaaaccctgagctgcggcdtggccgagacgggggcgtggcctggcaggtgggcgggcccttccgtgggcggggccgcgaggttttcaggagcccgagcgagggcgccgcttttgcgtcc

SEQ ID NO: 52120 - DNA, 201 bp, Homo sapiens
tgtggtgggctctcacgcggccaagcctccccaacgggcgccgccccctgctccacggcgcccggtcccatcgaccacccaaggactgaagagcacaggcrcatggggtgggactggtgggcagctctgcccctagccctgacgcgggatccactaggcaaagccagctgggctcctgagtcaggtggggacttggagaac

SEQ ID NO: 52121 - DNA, 201 bp, Homo sapiens
attcttcattttatctattgagatcactttgaacttttatcccattttccaaaatgcagcctcctgcctgtgtgtgtcatctataaatacaaggtcattasctctgaggcccatttgaagccacaagaaattcactgagacagaaagtggctactttgtttgcattactcaatctcatcacctacaaaagaaacaaacact

SEQ ID NO: 52122 - DNA, 201 bp, Homo sapiens
aaggctaaacccacatgctgtacctacttttggaattggtccaggaattttatacctgtgtgaatttggagaaactctctcagacacccatttggaaatgmattagtgtttttctcagtgagtcctccatgcttgctgttccaatggccctccaggtttgggcccagcacctgccaggagaagcattccctctatagcttc

SEQ ID NO: 52123 - DNA, 201 bp, Homo sapiens
accgcaaatcaggaagactgtggaaagaccactctgctcggtttcatgccctcctgtcccacctgctgctcagccatggttttcccccagctctagggggygggaggggcacccaggacactgaagaaatctcctggtcagaacaccttgtatgaacaggactcctagggaaaggggtttcctagtccggctaggggttgg

SEQ ID NO: 52124 - DNA, 201 bp, Homo sapiens
cggccaagcctccccaacgggcgccgccccctgctccacggcgcccggtcccatcgaccacccaaggactgaagagcacaggcacatggggtgggactggygggcagctctgcccctagccctgacgcgggatccactaggcaaagccagctgggctcctgagtcaggtggggacttggagaacttttatgtctaggtaga

SEQ ID NO: 52125 - DNA, 201 bp, Homo sapiens
gaaattaaggctgcagtgagctgtaatcgcaccactgcactccagcctggacagcagagtgagaccctgtctcaaaacaaaacaatcacaaactatgtagrtggaaagaatacataggattcgcagaattcctggctttagtcatcagagtgcctgtaaggaatgtggaaaaagacctggaagctttacctctcggcactg

SEQ ID NO: 52126 - DNA, 201 bp, Homo sapiens
cccacagcaccaggcagtgcacactggccaagactccgtggtaaatattgctggcctttatgttgagagggggaaaaaaaagcctgcctgtgaagatcatygcccagtggccatgctcctgtgaaaacacaattggaaagccatttcctaaggggcgagggtgggtctgggaccatgctgtggcttgggtgattggtggtt

SEQ ID NO: 52127 - DNA, 201 bp, Homo sapiens
gggtgggtctgggaccatgctgtggcttgggtgattggtggttgcaggagtgagggtgctgccctgggaaggcgctgaggccctgttgggtgggaatcgayggctgcggctttctcccggaggagggagagcggtgttgttacctagtgttgggaacacatccgtccagcaccgtgaactgcaaacaagcagagtaaccct

SEQ ID NO: 52128 - DNA, 201 bp, Homo sapiens
gtatttgactctagaacagttggcaccattggccactcccaccttgaaattcattcaatgactcctatttatttattatttttattttttatttttggctstcactatgttgcccaggatggagtgaagtggctatttctaggtgtgatcattgcacactacaatcttgagctcctgggctcaagcatgggacactgagcc

SEQ ID NO: 52129 - DNA, 201 bp, Homo sapiens
gggcatgtgaatcttcaagtttccatgacagtgccaaacttctaccaagtggttataccaattcacatttccactagcaacaagtgagaattctgtttgcwccatatcatcgccaacactttttattatcagacattttatttttggccaatatgatttatataatatgtgatgtattatagctttaatttgcatttctaa

SEQ ID NO: 52130 - DNA, 201 bp, Homo sapiens
acagaaacaatgccactgttgagtgcaagtcacactttgtctcatagataagaggtggccccaaagaagctgggatgaatgagtcactacctgtcttgtgrctgtactgcacttcatgttcttaccttcggcttctccaggtctcgccctagtgagccaagaactttctctcacatgctgcctttatttaagcctggcctt

SEQ ID NO: 52131 - DNA, 201 bp, Homo sapiens
agcagagctttcaagtcatggtggtttatgaagggagttagaattgcacctggggagcaagtgctgaggttaatggcagtgcaattccccgtctgttttaytggaactgttgtcagaggcagaatgctgggctggagggactgtggccctagcaatgttttggacttgacaatgcccatttgttgggcatggttccggtgg

SEQ ID NO: 52132 - DNA, 201 bp, Homo sapiens
ctctcccttttgtgaaaactcttgacactttatctggtcttttaaaagtagcacttactactacttcctctatccttttttctgagcctgcccggctgccmgcctctctggaagataagttccctgaggaaagaccttgtcttctgtgtcctgccctcactggctgtagcagatcacttatggtttggggaccattcaagg

SEQ ID NO: 52133 - DNA, 201 bp, Homo sapiens
ttcatgtctacatcctagccactgttagtttcaacataccactctatttcaaaacttcccttttctggcaaagatccaaaacttactaaaattcttttgtmttctttcccatggtcaggcccagcagttggaattctttttgaggccattttcccaagtctttatcacgtcacaagacttgctgtgtacatggcaaaagga

SEQ ID NO: 52134 - DNA, 201 bp, Homo sapiens
cagacgcgccaccttaagagctgtaacactcaccgtgaaggtctatagattcactcctgaagccagcgaggccatgagccccccagaaggaagaaactccraacacgtccaaacatcagaaggaacaaaccccagacacaccacctttaagaactgtaacactcaccgtgagggtccacgacttcactcttgaagtcagtg

SEQ ID NO: 52135 - DNA, 201 bp, Homo sapiens
atctcgagggccatctcagaatcaggtctgcaaacctgcaacttgtcgcatccagtcgggaaacttcacttcttttggtatttgactctagaacagttggsaccattggccactcccaccttgaaattcattcaatgactcctatttatttattatttttattttttatttttggctctcactatgttgcccaggatggag

SEQ ID NO: 52136 - DNA, 201 bp, Homo sapiens
tgggatctggtgattgcctacctacctcttcaaccgcctccatccttcacacaacctgcgctccatttaccaaaccactggcagttccccaaatgagccayattccttcattcgtctcctgcccagaatgccctccctctgtcccgtccaggtgacaaagtcatctttttctttttcaccaagtcccagatataggcactc

SEQ ID NO: 52137 - DNA, 201 bp, Homo sapiens
tcaccgtgaaggtctatagattcactcctgaagccagcgaggccatgagccccccagaaggaagaaactccaaacacgtccaaacatcagaaggaacaaaycccagacacaccacctttaagaactgtaacactcaccgtgagggtccacgacttcactcttgaagtcagtgagaccaggaacccaccaatttcggacaca

SEQ ID NO: 52138 - DNA, 201 bp, Homo sapiens
ggccatctcagaatcaggtctgcaaacctgcaacttgtcgcatccagtcgggaaacttcacttcttttggtatttgactctagaacagttggcaccattgrccactcccaccttgaaattcattcaatgactcctatttatttattatttttattttttatttttggctctcactatgttgcccaggatggagtgaagtgg

SEQ ID NO: 52139 - DNA, 201 bp, Homo sapiens
acccttcctgactcctctctataaacagcagccaccacccgagccatggcacccccatctcctttttcccactttactttcttccattgcatttacctctrcctgtcagtacctatttcctcttccttttgttgtctatcacctcttccgtccaccagaatgtaagctccatgagggcaggcttggtccattttgctcaca

SEQ ID NO: 52140 - DNA, 201 bp, Homo sapiens
agtctgatgttaaaaaggaaatgatctagagtcaactgaaacacacactttaagtacaagtgaggtcaggcctagagaaagattttgggagcatagtggcracagtttaacttgtgaaggcaaatgtggtcactgatggaagaagcctgaagcagagaacaaggtcttggggaaacctggaagccatgggggtgggaaaaa

SEQ ID NO: 52141 - DNA, 201 bp, Homo sapiens; identical to SEQ ID NO: 9776

SEQ ID NO: 52142 - DNA, 201 bp, Homo sapiens
tgaggggtacacatgggtctgggactcagctctccaaactgtcaccttcttcccctcactgggcccctcaatcctgactcctccaacacacacacgcgcgcacacacacacacacacacacacatacacgctattctcatcccaacttcttttggccacttctaatcaatgagaccgagctttccctgcacccagcgatgg

SEQ ID NO: 52143 - DNA, 201 bp, Homo sapiens
gaggggtacacatgggtctgggactcagctctccaaactgtcaccttcttcccctcactgggcccctcaatcctgactcctccaacacacacacgcgcgcacacacacacacacacacacacatacacgctattctcatcccaacttcttttggccacttctaatcaatgagaccgagctttccctgcacccagcgatggc

SEQ ID NO: 52144 - DNA, 201 bp, Homo sapiens
aatgccgccctcttgctcagtgcctggaagaggcattggtgactccccgctaatgctaggggtagctaccgtgcaggagcagtcaggctcttgcagggccwatgtggtttcatcaattttctcctgcatttacccagcccctccgaattctgagaagtgcgtccaagatctcttggactccttgactcagttcacccttgt

SEQ ID NO: 52145 - DNA, 201 bp, Homo sapiens
gacactgcagtcaggatcttgtcttgttcatctgtgtatcgcaggcccagtttgtgcctggcccacagtatgtgcttagtaaatgtcttgtggatgagtgragtatactgggaagcccagcctccctcatggcaacacctgctgttattagactttccactggaggggcagggaggatgagggcctgagagagcaagatat

SEQ ID NO: 52146 - DNA, 201 bp, Homo sapiens
aagattttgggagcatagtggcgacagtttaacttgtgaaggcaaatgtggtcactgatggaagaagcctgaagcagagaacaaggtcttggggaaacctrgaagccatgggggtgggaaaaagaaaagtatctgttggaaaatagaatgatagaaagatagggaaaaaactaaggaagccaaaggaagagatatttcaag

SEQ ID NO: 52147 - DNA, 201 bp, Homo sapiens
tctgtgtatcgcaggcccagtttgtgcctggcccacagtatgtgcttagtaaatgtcttgtggatgagtgaagtatactgggaagcccagcctccctcatrgcaacacctgctgttattagactttccactggaggggcagggaggatgagggcctgagagagcaagatatccatggaggtgctgagtggtaagctgaaaa

SEQ ID NO: 52148 - DNA, 201 bp, Homo sapiens
ctgtgtatcgcaggcccagtttgtgcctggcccacagtatgtgcttagtaaatgtcttgtggatgagtgaagtatactgggaagcccagcctccctcatgkcaacacctgctgttattagactttccactggaggggcagggaggatgagggcctgagagagcaagatatccatggaggtgctgagtggtaagctgaaaag

SEQ ID NO: 52149 - DNA, 201 bp, Homo sapiens
taaaatgacaagtgcaggtgtctttacaggaagaacaagctgaaacacagataactctcaacataggaaaggagtctatcccacagccttttctaatcttyttatttaaaaacacgaattacaggtaattttcctaatgaaacacatttaaaaggcatcttttgtggtctctgtatagagtgtatgggggacctgttcatg

SEQ ID NO: 52150 - DNA, 201 bp, Homo sapiens
taaaaatacaaaaattagctgggtgtggtggtgcacacctgtaatcccagctactagggaggctgaggcaggagaattcctcgaacccaagaggcggagaytgcagtgagccaagatggcactactgcactcctgggtgacagagcgagatcctaactcaaaaaaaaaaaaaaaagaaggaaggagacaaaacaaaagtat

SEQ ID NO: 52151 - DNA, 201 bp, Homo sapiens
gacggtgtttccagaacagtgcctccgttgttcattcccgtgcatcaggaagtttggctctgctgagtgttgaaagcaaaactctcctgtttatttgtctstgtatactaacagacttaaacagcagacagcactggaatgtccagttactgcatccagatgtgtttgtttcactcttaacattgtggaaaagaatgcaga

SEQ ID NO: 52152 - DNA, 201 bp, Homo sapiens
agtaccaagtattggcaaggctggggagcaattgaaactttcctgcgtgattggtgagaatgtaaattggcatactataaagcagggttccccaacccccrggccatggacccatactggtctgttaggaagcgggtcacatagcaggaggtgagcggcaggctagcaagctaaacttcatctgtgtttgcagccactcct

SEQ ID NO: 52153 - DNA, 201 bp, Homo sapiens
tccagaacagtgcctccgttgttcattcccgtgcatcaggaagtttggctctgctgagtgttgaaagcaaaactctcctgtttatttgtctctgtatactracagacttaaacagcagacagcactggaatgtccagttactgcatccagatgtgtttgtttcactcttaacattgtggaaaagaatgcagaaggcagatc

SEQ ID NO: 52154 - DNA, 201 bp, Homo sapiens
gctaagcccaggtgctgctgctgctgcttgttcccggactgcactgtgggcaccactgctctggagtctgcagagctccagcagggactcctgttgaggasagacgggcatatagtgggagcccaggcctaggacgagtaactctaggacaaacaaaaattccagatacagtgcaagaagaggtagtgatgaatgaaaaag

SEQ ID NO: 52155 - DNA, 201 bp, Homo sapiens
aaggagattcataaaagaaagaggctgggtacagtagttcatgcctgtaataccttgggaggccaaggtaggaggattgtttgaaaccaatagttcaagaycagtctgggcaacatagtgagacccctccacccccacccccacacacaaaaattatctgggcatggtggcacatgcctatagccccagctactccagaag

SEQ ID NO: 52156 - DNA, 201 bp, Homo sapiens; identical to SEQ ID NO: 9780

SEQ ID NO: 52157 - DNA, 201 bp, Homo sapiens
tccttttaaccctgtggttgcacggcctctggggtgtccatttctttcttttgacacgtcccttttcctgaaagtttcagcaaaccccataggcagagggrgttagaaaaaggaaaagagaagttagggcaggaggagcactgttcttataggacaggaagggtctgtcttctctcttgggtcctccacacaaaatcggag

SEQ ID NO: 52158 - DNA, 201 bp, Homo sapiens
ccaccagctcccaccttgagcccacaaatctaccttctgagccactgcagccccaggtagctccccaggcctaggctctctcttctcctttgtccatgctrtttggcagccttggccaggaatgcctactgctctccctagctaattcctgatcattaatactccagatctgaatcccctatgtgcagaggcccctcaggc

SEQ ID NO: 52159 - DNA, 201 bp, Homo sapiens
attcctgatcattaatactccagatctgaatcccctatgtgcagaggcccctcaggctgggttttcaaattctcctctgtgctccatagcaccctgcacakcctctaacagcatttatcacaccctcttatggctgctggttacttggccatctccctgctgggatggctccctgaaggcagtgattgagttaatccttga

SEQ ID NO: 52160 - DNA, 201 bp, Homo sapiens; identical to SEQ ID NO: 9772

SEQ ID NO: 52161 - DNA, 201 bp, Homo sapiens
tcattaatactccagatctgaatcccctatgtgcagaggcccctcaggctgggttttcaaattctcctctgtgctccatagcaccctgcacagcctctaayagcatttatcacaccctcttatggctgctggttacttggccatctccctgctgggatggctccctgaaggcagtgattgagttaatccttgatgtatccc

SEQ ID NO: 52162 - DNA, 201 bp, Homo sapiens
caaagatccaaaacttactaaaattcttttgtcttctttcccatggtcaggcccagcagttggaattctttttgaggccattttcccaagtctttatcacktcacaagacttgctgtgtacatggcaaaaggaaggcccaacggagccacattgggaagtgggccctggggagtctgctgagacactggttgctaagtgac

SEQ ID NO: 52163 - DNA, 201 bp, Homo sapiens
actaaaattcttttgtcttctttcccatggtcaggcccagcagttggaattctttttgaggccattttcccaagtctttatcacgtcacaagacttgctgygtacatggcaaaaggaaggcccaacggagccacattgggaagtgggccctggggagtctgctgagacactggttgctaagtgactgccctgtcttccatg

SEQ ID NO: 52164 - DNA, 201 bp, Homo sapiens
aagaggctgggccagagatttctcaaggtcccaacttcaaccttggtgttctgtccgccttgatttacaaaatggtcttgatcttttccaattaaaattcyatttagtagagatacacagaaagtttgcaattcttccacaagaaaactgctgtatggcatagaaaaatatctacataatattttttgtttcttcttctta

SEQ ID NO: 52165 - DNA, 201 bp, Homo sapiens
ctcccttttgtgaaaactcttgacactttatctggtcttttaaaagtagcacttactactacttcctctatccttttttctgagcctgcccggctgcccgsctctctggaagataagttccctgaggaaagaccttgtcttctgtgtcctgccctcactggctgtagcagatcacttatggtttggggaccattcaagggt

SEQ ID NO: 52166 - DNA, 201 bp, Homo sapiens
tgtaaaattgattacaaaaaagtctacaatattaaatcaagaaatagtgttccaaatatatatatttagaagtatgaaaatgccagaagaaagaaccatayaaattaatgatgattgcctgaggaagttctgcccagttcttccattgggagcatctagaaaagctggagaaactatttttttagaatctatttaaagaca

SEQ ID NO: 52167 - DNA, 201 bp, Homo sapiens
caaccagggaccctctgcccctagaataagaacatactagaagtcccttctgctaggacaacgaggtaagtgcttctggtaaaaatgtgtcatagtgtgtstgtgtctgtgtgtgtatgatacatatataaatatatgcatatttgtacatatatatatacatatgtacaaatatacatacatataaggtctctctgtcgc

SEQ ID NO: 52168 - DNA, 201 bp, Homo sapiens
taataatagaaataaagtgcacaataaatgtaatgggctcgaatcattctgaaatcaccccacccctatcccccgccagtcggtggaaaaattgtcttccrtgaaactggtccctggtgccaaaaagttgaagactgctacttttattttttattttgttttattttttagatgaagtctaactctgttgcccaggctgga

SEQ ID NO: 52169 - DNA, 201 bp, Homo sapiens
gaataagaacatactagaagtcccttctgctaggacaacgaggtaagtgcttctggtaaaaatgtgtcatagtgtgtgtgtgtctgtgtgtgtatgatacrtatataaatatatgcatatttgtacatatatatatacatatgtacaaatatacatacatataaggtctctctgtcgcccaggctgaaataaagcagtgtg

SEQ ID NO: 52170 - DNA, 201 bp, Homo sapiens
cccacccctatcccccgccagtcggtggaaaaattgtcttccatgaaactggtccctggtgccaaaaagttgaagactgctacttttattttttattttgktttattttttagatgaagtctaactctgttgcccaggctggagtgcagcagcacaatctcagctcactgtaacctccacctcccaggtttaagcaattct

SEQ ID NO: 52171 - DNA, 201 bp, Homo sapiens
atatgtacaaatatacatacatataaggtctctctgtcgcccaggctgaaataaagcagtgtgatcatagctcactgcagcctcaaactcttaggcttaaygatcctcctgcctcagcctcccaaatagctcagactacaggtgcacaccagcatgcctggctaatttttctgttttttgtagagacaaggtctcactatg

SEQ ID NO: 52172 - DNA, 201 bp, Homo sapiens
caagcaatctgcctgcctgggctcccaaagtgctgggattacaggcgtgagccactgtgcccagccagagactgctaccttaaagaacagttagtcgtctrctaaagttgaaccacacatgccctgtgatgctgaaattctactcataagtatatacacactagaaatccatgcacttatgcgtgaaaacacacatagaaa

SEQ ID NO: 52173 - DNA, 201 bp, Homo sapiens
aatttcggacacagtatgataaataagcaaatagacaagacaagtaagggcttgtgatcattgctttgatggaaataagatggtttttgaaagagtaacayggcaggggatttatttcaaatagtgtgtgcaggagaagtctcgctgtggaaacactgatgtgagatctcgccgcagtaagagcagagagaagagggttca

SEQ ID NO: 52174 - DNA, 201 bp, Homo sapiens
gaagaaatagcatgcgtgaagaccttaagcaagtggaaggcagctgctgaggctggggactgggaggttggggctggaagcagacaagcctagagaagttstcaggggctagacgatggggttttgacctagaatataaactttgtttgtagttcatagggaagacattgaaggtttaatatatgggaatgacgggaacct

SEQ ID NO: 52175 - DNA, 201 bp, Homo sapiens
aataagatggtttttgaaagagtaacacggcaggggatttatttcaaatagtgtgtgcaggagaagtctcgctgtggaaacactgatgtgagatctcgccrcagtaagagcagagagaagagggttcacatgaaggaagcagcacttgcgaaggtcctgaggctggaaagagtttggaatgcgtaccatgtgtgtattcca

SEQ ID NO: 52176 - DNA, 201 bp, Homo sapiens
ttaaccctgtggttgcacggcctctggggtgtccatttctttcttttgacacgtcccttttcctgaaagtttcagcaaaccccataggcagagggagttaraaaaaggaaaagagaagttagggcaggaggagcactgttcttataggacaggaagggtctgtcttctctcttgggtcctccacacaaaatcggagcttcc

SEQ ID NO: 52177 - DNA, 201 bp, Homo sapiens
caattcaagatgagatttgggtggggacacagccaaaccatatcaaagagtaagggacaaggttttttcaaacctatgaggcaggtggagatggtgtgctrcagctgtaggattccctggcctggggagaagtccacttatatgtctctgagtactacgcaaaaatttttttgtttcctggaggattttcaaaattcaaaa

SEQ ID NO: 52178 - DNA, 201 bp, Homo sapiens
gacctctgttgaagctccgtattgtccataggagttaagggatctttgactcactcactgaagcagagctgtgtctcacttacatagggctcccctgagcygaatttggtgtctggcacataagaggcgtttgataaatgattcttgattgaaattcaagcccttataggtaacagtgaagtgccccaccaacttggagta

SEQ ID NO: 52179 - DNA, 201 bp, Homo sapiens
  misc_feature (1)...(201): n = A,T,C or G, or insertion/deletion polymorphism (see Tables 1-2)
ctatttggcagccttggccaggaatgcctactgctctccctagctaattcctgatcattaatactccagatctgaatcccctatgtgcagaggcccctcangctgggttttcaaattctcctctgtgctccatagcaccctgcacagcctctaacagcatttatcacaccctcttatggctgctggttacttggccatctc

SEQ ID NO: 52180 - DNA, 201 bp, Homo sapiens
agtaagggacaaggttttttcaaacctatgaggcaggtggagatggtgtgctgcagctgtaggattccctggcctggggagaagtccacttatatgtctcygagtactacgcaaaaatttttttgtttcctggaggattttcaaaattcaaaatatcaagtcactttgagacatattgagtctgatgttaaaaaggaaatg

SEQ ID NO: 52181 - DNA, 201 bp, Homo sapiens
gctatgactctgttttccaaaccaaacctgggacatgtaaaatgacaagtgcaggtgtctttacaggaagaacaagctgaaacacagataactctcaacayaggaaaggagtctatcccacagccttttctaatcttcttatttaaaaacacgaattacaggtaattttcctaatgaaacacatttaaaaggcatcttttg

SEQ ID NO: 52182 - DNA, 201 bp, Homo sapiens
tcctctctcccttttgtgaaaactcttgacactttatctggtcttttaaaagtagcacttactactacttcctctatccttttttctgagcctgcccggcygcccgcctctctggaagataagttccctgaggaaagaccttgtcttctgtgtcctgccctcactggctgtagcagatcacttatggtttggggaccattc

SEQ ID NO: 52183 - DNA, 201 bp, Homo sapiens
ttgaggtcaggagtttgagaccagcctgcccaacatggtgaaaccccgtttctactaaaaatacaaaaattagctgggtgtggtggtgcacacctgtaatsccagctactagggaggctgaggcaggagaattcctcgaacccaagaggcggagattgcagtgagccaagatggcactactgcactcctgggtgacagagc

SEQ ID NO: 52184 - DNA, 201 bp, Homo sapiens
accccgtttctactaaaaatacaaaaattagctgggtgtggtggtgcacacctgtaatcccagctactagggaggctgaggcaggagaattcctcgaaccsaagaggcggagattgcagtgagccaagatggcactactgcactcctgggtgacagagcgagatcctaactcaaaaaaaaaaaaaaaagaaggaaggagac

SEQ ID NO: 52185 - DNA, 201 bp, Homo sapiens; identical to SEQ ID NO: 9775

SEQ ID NO: 52186 - DNA, 201 bp, Homo sapiens
aattatctattagggatcaagcattaacttgacacaggagcagccctggctcagctggaggcatccgcatgctgtggtgccccaggaacagaggcaccccygaaatgcaggctgtgtgtttgctgcagagacaccatggcccataactccccaagcataagtgagcagctctgctgtccaggcaatgaagtcaagaaaggg

SEQ ID NO: 52187 - DNA, 201 bp, Homo sapiens
atggaaggatggcttgaacccgggaggcggaggtggcagtgagctgtgatcatgccactgcactccagcctgggcaacagagcaagaccctgtctcaaaamaaacagaaatagagtaagaatagttttgtctgtatctgccaacagccacgtctgtggagtcagaggaatgaaggggtcaaagggagcaggcacatcatag

SEQ ID NO: 52188 - DNA, 201 bp, Homo sapiens; identical to SEQ ID NO: 9778

SEQ ID NO: 52189 - DNA, 201 bp, Homo sapiens
ttagggatcaagcattaacttgacacaggagcagccctggctcagctggaggcatccgcatgctgtggtgccccaggaacagaggcacccccgaaatgcargctgtgtgtttgctgcagagacaccatggcccataactccccaagcataagtgagcagctctgctgtccaggcaatgaagtcaagaaagggaaccaaccc

SEQ ID NO: 52190 - DNA, 201 bp, Homo sapiens
aaccagattatgtttttgaaagaacatgctggctgctggctggaaaatgaaagcaagaccagaaataagagagccagtgaggagtctccagtctggcccaygcaaagagatggcggcggcttacagtagggcagtggataggcttgggaggtggcaccaacaggacttgctgagggattggatattggggggatgtttaaa

SEQ ID NO: 52191 - DNA, 201 bp, Homo sapiens
attattagatgcctgagtttgaaactttgagtcaatccaggcatccatgcctacttctgatttgctgtagcttgtgtgccacagcctcccagtttctgtgraaaccccaccatacatcagccccagcacaaagcacaacctcgtcagagctagcccacctccagcaccgtgactgctccaggcttaatctctcctggtgtt

SEQ ID NO: 52192 - DNA, 201 bp, Homo sapiens
tagcttgtgtgccacagcctcccagtttctgtggaaaccccaccatacatcagccccagcacaaagcacaacctcgtcagagctagcccacctccagcacygtgactgctccaggcttaatctctcctggtgttgacacttttgccagtgatggtgtctcatgggattcatgctctttataaaccattgccttcttcctat

SEQ ID NO: 52193 - DNA, 201 bp, Homo sapiens
gccctcagagaaaaccctgagctgcggcgtggccgagacgggggcgtggcctggcaggtgggcgggcccttccgtgggcggggccgcgaggttttcaggakcccgagcgagggcgccgcttttgcgtccgggaggagccaaccgtggcgcaggcggcgcggggaggcgtcccagaggtgagcgccctgcagcggcagggga

SEQ ID NO: 52194 - DNA, 201 bp, Homo sapiens
agaaataaagtgcacaataaatgtaatgggctcgaatcattctgaaatcaccccacccctatcccccgccagtcggtggaaaaattgtcttccatgaaacyggtccctggtgccaaaaagttgaagactgctacttttattttttattttgttttattttttagatgaagtctaactctgttgcccaggctggagtgcagc

SEQ ID NO: 52195 - DNA, 201 bp, Homo sapiens
gccaaaggaagagatatttcaagaagaaataggtggccaaagctgcccaatgctaaacaaaacaaaacaaaacaaaacaaaacccacaaggagattcataraagaaagaggctgggtacagtagttcatgcctgtaataccttgggaggccaaggtaggaggattgtttgaaaccaatagttcaagaccagtctgggcaac

SEQ ID NO: 52196 - DNA, 201 bp, Homo sapiens
tacagaggtggaggtgagcctaggaaagcagaaatacaaggagagggggaaaaaaaagtcaaatctcaaaatatctagccgcagacataagctcctctgasggtaatttcttgaggggggaaaaagttgctatttaaagctaggatatatgtggttccatttttttcatcggtacattaataacatcattttccactatgt

SEQ ID NO: 52197 - DNA, 201 bp, Homo sapiens
aaaagaacaggacacatggtaagcactcaataaatattgactattaatattataccctaccacctagcatgggatggggtataatattatgcatcaaaatrtattttaagcatcaacaaatatttatcatcaaaaaactaaccatcaaataatatatatcaacagagatgaatgaatgccactgctttaatttagactctt

SEQ ID NO: 52198 - DNA, 201 bp, Homo sapiens
atagtatttagaaaagaacaggacacatggtaagcactcaataaatattgactattaatattataccctaccacctagcatgggatggggtataatattaygcatcaaaatatattttaagcatcaacaaatatttatcatcaaaaaactaaccatcaaataatatatatcaacagagatgaatgaatgccactgctttaa

SEQ ID NO: 52199 - DNA, 201 bp, Homo sapiens
taagtaagtggaagttatatgacctcttctcccgcagtttccccattggtaaaatgggggatgataatagtactgattcatagggttgtggtgagggttgmatcagttaatgcatgtatagtatttagaaaagaacaggacacatggtaagcactcaataaatattgactattaatattataccctaccacctagcatggg

SEQ ID NO: 52200 - DNA, 201 bp, Homo sapiens
agggaacaatattaatgtgttagggaagactattgatatgctggagaataatattaacatattcaagaatgtgaatttcacatttgcttatgtgcaatttyttgcatgtaaaggcagaaaactgcacccagctgtgccaaaacacaaaagaatacacaaaatacacctccaatattagtcagctacctcattctccatgtg

SEQ ID NO: 52201 - DNA, 201 bp, Homo sapiens
gggcttgtgatcattgctttgatggaaataagatggtttttgaaagagtaacacggcaggggatttatttcaaatagtgtgtgcaggagaagtctcgctgkggaaacactgatgtgagatctcgccgcagtaagagcagagagaagagggttcacatgaaggaagcagcacttgcgaaggtcctgaggctggaaagagttt

SEQ ID NO: 52202 - DNA, 201 bp, Homo sapiens
agcttgtgtgccacagcctcccagtttctgtggaaaccccaccatacatcagccccagcacaaagcacaacctcgtcagagctagcccacctccagcaccktgactgctccaggcttaatctctcctggtgttgacacttttgccagtgatggtgtctcatgggattcatgctctttataaaccattgccttcttcctatt

SEQ ID NO: 52203 - DNA, 201 bp, Homo sapiens
ccctctgagctatataactcttcctttaccttccaacagaggcctttcattacatttaaagcaaatggaatgcatagtaggcaccaaagatggaggtgctrtgcaaataatagacaccaagctctctgcaggtggggtccttgtgtgttttctcttcatagcacccagcacaatacttggaacataagccagacacgttca

SEQ ID NO: 52204 - DNA, 201 bp, Homo sapiens
catagcacccagcacaatacttggaacataagccagacacgttcattgagcaccatttctgctgcacccatgaaaaaaacactcaacccagacagatggtyagctccccgacaggacttaagcaagtgggccagtctctgtttattgtcgtacactcacacaatcacacagctgccaggcgagcactaggcacttatcaca

SEQ ID NO: 52205 - DNA, 201 bp, Homo sapiens
aaggaatgttctgcttcagggaggattggccctggtctatgattgctgtcatgatgatactcagcaagtttccttagataacttcagagttaacaaggatktaaaaatgcttccatttcaaactcaccgttatacatatgcagaaactgaggacaatgaaagttagagttgtctaggatacccagactgtggctgaaggag

SEQ ID NO: 52206 - DNA, 201 bp, Homo sapiens; identical to SEQ ID NO: 9770

SEQ ID NO: 52207 - DNA, 201 bp, Homo sapiens
ccgcgggctcctccccctcggtccctgccccttttgcgccctctgctggtctctagggaaagcgcatctcctgaaatcagaagtcgcacccaagctgtccygtttccttagctcctagtaaagcgatatgacccatccatcccctcctcctcaaagcctcacatgaatcttctttgaggtactctctgatgcttcactctt

SEQ ID NO: 52208 - DNA, 201 bp, Homo sapiens; identical to SEQ ID NO: 9771

SEQ ID NO: 52209 - DNA, 201 bp, Homo sapiens
gcatattcaattttgttttgttcaaaggtcacagtgacaactaagtttgcagcgggattcaaatccgagctccacagtgtaataaatgtgagatcttagayaagtgcttaacctctctgagttaatcatctatcaaataatgaaaagcactataagccaactcttcaactttcaggacattgttcacccgaaacccgaaat

SEQ ID NO: 52210 - DNA, 201 bp, Homo sapiens; identical to SEQ ID NO: 9774

SEQ ID NO: 52211 - DNA, 201 bp, Homo sapiens; identical to SEQ ID NO: 9773

SEQ ID NO: 52212 - DNA, 201 bp, Homo sapiens
taagccaactcttcaactttcaggacattgttcacccgaaacccgaaatccaataactgtgcactgtcttctaacacagccataatttacctagatgtacygcttagaaatgtctcactctcatggtgaccttagttctatctgtccctagagagccgcaagaccattttgtctggaggttctctgctcactggacaatag

SEQ ID NO: 52213 - DNA, 201 bp, Homo sapiens; identical to SEQ ID NO: 9779

SEQ ID NO: 52214 - DNA, 201 bp, Homo sapiens
gaagataagttccctgaggaaagaccttgtcttctgtgtcctgccctcactggctgtagcagatcacttatggtttggggaccattcaagggtttcccacytacacatctgcccatgcttcttcctccccatggaatttcttctccccatcctaccactcgtctgcctgatgaatttccttgtttagcaagactgcccatc

SEQ ID NO: 52215 - DNA, 201 bp, Homo sapiens
cataaaacattagccttttattatctcacagttacaaggagtcaggaatccaggcatagtgtggctggggtctctgctcagagtcttacagactgaaatcmgggtgtttgctgggctgaattccttctggagcttggggttgtgggcagaaaccagttccttgtagctgtagaaatgacatcctattttgtctttgctggt

SEQ ID NO: 52216 - DNA, 201 bp, Homo sapiens
ctcgctaagcccaggtgctgctgctgctgcttgttcccggactgcactgtgggcaccactgctctggagtctgcagagctccagcagggactcctgttgargagagacgggcatatagtgggagcccaggcctaggacgagtaactctaggacaaacaaaaattccagatacagtgcaagaagaggtagtgatgaatgaaa

SEQ ID NO: 52217 - DNA, 201 bp, Homo sapiens
ggggtacccggctgaagtgaagcaacattgtgtctcttcctgctgttttctccacctcccctcagcaaatcatgaatgaataaacaaacgaatgaatgaasaaacatagagttattataaggattaagtgaaggcagggtgcagtggctcatgcctgtaatcccagcatgttgggaggccaaggtaggaggatcgcttgag

SEQ ID NO: 52218 - DNA, 201 bp, Homo sapiens
gattaagtgaaggcagggtgcagtggctcatgcctgtaatcccagcatgttgggaggccaaggtaggaggatcgcttgagctcaggagttgaagaccagcrtgggcaacaaagcgagacccccatctctatatttttattttaatttagaataataaataaaatttttttaaaagaaaagattaagtgaaatgttttttaa

SEQ ID NO: 52219 - DNA, 201 bp, Homo sapiens
atggtcaggcccagcagttggaattctttttgaggccattttcccaagtctttatcacgtcacaagacttgctgtgtacatggcaaaaggaaggcccaacrgagccacattgggaagtgggccctggggagtctgctgagacactggttgctaagtgactgccctgtcttccatggcgcagtgattcaaagccaggcctca

SEQ ID NO: 52220 - DNA, 201 bp, Homo sapiens
acattgttcacccgaaacccgaaatccaataactgtgcactgtcttctaacacagccataatttacctagatgtactgcttagaaatgtctcactctcatrgtgaccttagttctatctgtccctagagagccgcaagaccattttgtctggaggttctctgctcactggacaatagggacagtggaattgtcctcatcct

SEQ ID NO: 52221 - DNA, 201 bp, Homo sapiens
agccataatttacctagatgtactgcttagaaatgtctcactctcatggtgaccttagttctatctgtccctagagagccgcaagaccattttgtctggargttctctgctcactggacaatagggacagtggaattgtcctcatccttgtgcttgagtctttggaaaccaaatgaccccagaaatgtcatgaaagagatt

SEQ ID NO: 52222 - DNA, 201 bp, Homo sapiens
tcttcttcttaattagctttcctattttcccttaggaaaacaaaaagtcctttctcctgattcaccaaaaaataaaatactgactaccatcactgtgatgwgattcctatagtctcaggaactgaagtctttaaacaaccagggaccctctgcccctagaataagaacatactagaagtcccttctgctaggacaacgagg

SEQ ID NO: 52223 - DNA, 201 bp, Homo sapiens
gtggtatagaactcctgggctcaagcagtcctcccatcttggcctcccaaagtgctgggattacaggcatgagccaccatgcccagtcctgtcttcaaaakattaatggagaaaaatattgctggggtacttaagttgtgccaggtactacagggggatcctgcatgaatgaaactgagtgcctgcccctcaagacttaca

SEQ ID NO: 52224 - DNA, 201 bp, Homo sapiens
gtcactgatggaagaagcctgaagcagagaacaaggtcttggggaaacctggaagccatgggggtgggaaaaagaaaagtatctgttggaaaatagaatgmtagaaagatagggaaaaaactaaggaagccaaaggaagagatatttcaagaagaaataggtggccaaagctgcccaatgctaaacaaaacaaaacaaaac

SEQ ID NO: 52225 - DNA, 201 bp, Homo sapiens
gaatcttcaagtttccatgacagtgccaaacttctaccaagtggttataccaattcacatttccactagcaacaagtgagaattctgtttgctccatatcrtcgccaacactttttattatcagacattttatttttggccaatatgatttatataatatgtgatgtattatagctttaatttgcatttctaagatttcta

SEQ ID NO: 52226 - DNA, 201 bp, Homo sapiens
agaggtggaggtgagcctaggaaagcagaaatacaaggagagggggaaaaaaaagtcaaatctcaaaatatctagccgcagacataagctcctctgacggyaatttcttgaggggggaaaaagttgctatttaaagctaggatatatgtggttccatttttttcatcggtacattaataacatcattttccactatgtatc

SEQ ID NO: 52227 - DNA, 201 bp, Homo sapiens
tcttcaagtttccatgacagtgccaaacttctaccaagtggttataccaattcacatttccactagcaacaagtgagaattctgtttgctccatatcatcrccaacactttttattatcagacattttatttttggccaatatgatttatataatatgtgatgtattatagctttaatttgcatttctaagatttctaatg

SEQ ID NO: 52228 - DNA, 201 bp, Homo sapiens
aggtcccagccccagagcttctgattcagcggggctggggtaaggcccagtaatttgcattgctcgctaagcccaggtgctgctgctgctgcttgttcccrgactgcactgtgggcaccactgctctggagtctgcagagctccagcagggactcctgttgaggagagacgggcatatagtgggagcccaggcctaggacg

SEQ ID NO: 52229 - DNA, 201 bp, Homo sapiens
aaagtcaaatctcaaaatatctagccgcagacataagctcctctgacggtaatttcttgaggggggaaaaagttgctatttaaagctaggatatatgtggwtccatttttttcatcggtacattaataacatcattttccactatgtatcttcaagatccggtgtaacagccttgcaaatttgccagaatgaagaaggaat

SEQ ID NO: 52230 - DNA, 201 bp, Homo sapiens
acagtgccaaacttctaccaagtggttataccaattcacatttccactagcaacaagtgagaattctgtttgctccatatcatcgccaacactttttattrtcagacattttatttttggccaatatgatttatataatatgtgatgtattatagctttaatttgcatttctaagatttctaatgaggtttggtacttttt

SEQ ID NO: 52231 - DNA, 201 bp, Homo sapiens
ttcacacaacctgcgctccatttaccaaaccactggcagttccccaaatgagccacattccttcattcgtctcctgcccagaatgccctccctctgtcccrtccaggtgacaaagtcatctttttctttttcaccaagtcccagatataggcactcccaggcagagttagatacctatattattgcagcatttatcaaatt

SEQ ID NO: 52232 - DNA, 201 bp, Homo sapiens
tgaatgaaaaagcgatcactccagcagagctttcaagtcatggtggtttatgaagggagttagaattgcacctggggagcaagtgctgaggttaatggcastgcaattccccgtctgttttattggaactgttgtcagaggcagaatgctgggctggagggactgtggccctagcaatgttttggacttgacaatgcccat

SEQ ID NO: 52233 - DNA, 201 bp, Homo sapiens
atgggattcatgctctttataaaccattgccttcttcctatttctttcatttatttttcctctcattctcctgccctctgagctatataactcttcctttmccttccaacagaggcctttcattacatttaaagcaaatggaatgcatagtaggcaccaaagatggaggtgctgtgcaaataatagacaccaagctctctg

SEQ ID NO: 52234 - DNA, 201 bp, Homo sapiens
atattattgcagcatttatcaaattacactataaccatttatttacatgtccaaccctactcccccaggctgcaagctcctgagagccagatcgtatttakatttgtatttctggcaagaagcacaagggctacggaagcttaatacacatttgttgaatggatggttagttttaagaagtacctaataaaccttggtatt

SEQ ID NO: 52235 - DNA, 201 bp, Homo sapiens
aatgacgggaacctctggcagggctctgcctgtgagcatcacatagcaccccgaggatgtgtttgctactctaggtttcagtggagaaaaaagcaagtgamaacccttctgttcctgctcagcaaaagctttgatcaccagcccccttcccctgaatatactggagaaaaataacagaagtgcatttcaaggtccacatgt

SEQ ID NO: 52236 - DNA, 201 bp, Homo sapiens
agaaaaataacagaagtgcatttcaaggtccacatgtgagaagaccctaagctgtcctggctgttcaggtagaagttgtcatcttcctcaatgatctcggmtgttggaagacatggccaggcagacagaatctaaaagttcttccaggtgtgacatgagtccctggagctcagtgacagaaaccagtgtccaaaaccagat

SEQ ID NO: 52237 - DNA, 201 bp, Homo sapiens
ctccagaatgttttcatcatcccagactgaaactctgcccattaaacgctaactccccatcctcccctcccagcccctggtaacttctgctctgcttcctrtctctgaatttatctattctagatatcttgtaagtggattcatgcaatatttgttcttttgtgactggcttattttactcagcataatgtcttcaaagtt

SEQ ID NO: 52238 - DNA, 201 bp, Homo sapiens
cagcccttggagacctacctaggcaatttgtcactcaggcttcaagctgccagccgaggaggggagctgagaagactctataatgagatctttgcactgtwattaagtgccaggctttgttttacacctatctttcccgccttgcccgatcccaccgccaagctcctccaggcagtgagtggggagtgtcagctgctctgt

SEQ ID NO: 52239 - DNA, 201 bp, Homo sapiens
tgctggtggagtcacctgaagactctgaacaaccctggatgcccaagccacactccacaccaactaaatttgtaattttttaaagtctcctggtgattccrgtgtgtagccaagtttgagaaccattggtttccatcagtgattctcaaatttgagtgtgtataaaattcacacaatggctaaggatacagattcctgaga

SEQ ID NO: 52240 - DNA, 201 bp, Homo sapiens
gaggtcccagaggagagaccgtgctaaagctaattactaagcagtacaaaaataatctctctctctctctttctctctctctctctctctctctctctctmtctatatatatatatatatatatatatgtaattttttttttgagacagtctcactctgccgcccaggctggactgcagtgacacaatctcggctgactgc

SEQ ID NO: 52241 - DNA, 201 bp, Homo sapiens
ggtcccagaggagagaccgtgctaaagctaattactaagcagtacaaaaataatctctctctctctctttctctctctctctctctctctctctctctctmtatatatatatatatatatatatatgtaattttttttttgagacagtctcactctgccgcccaggctggactgcagtgacacaatctcggctgactgcaa

SEQ ID NO: 52242 - DNA, 201 bp, Homo sapiens
ctaatctcagaagtgatatcccatcaattttgtcatgctctatttgttagaagaagttgctgggtccagttcacacttaaggagagaagattacagaaagrcatgaatatcaggaggcagaaatcttagggagccatcatagaagctgtctagtacaaaggatataacaaacaatgctgccttacagattttcgtatatat

SEQ ID NO: 52243 - DNA, 201 bp, Homo sapiens
ttaaggagagaagattacagaaaggcatgaatatcaggaggcagaaatcttagggagccatcatagaagctgtctagtacaaaggatataacaaacaatgytgccttacagattttcgtatatatattgtggcatatgagcatatcaggttatgcacctaggcatggagttcctaggtcttagggcatgtgaatcttcaag

SEQ ID NO: 52244 - DNA, 201 bp, Homo sapiens
cgatggctccacctccatatcccacagtcagtccaacaccagtttatcccaaaatgaactcatccctccaagttcaccttccgccaccctaccacccctarcttgtatttcctaactccatgactgacacaactatccaccaatcacaaagccagtgtcttgtgaatttgccctgactgctctttctcttataaggatcca

SEQ ID NO: 52245 - DNA, 201 bp, Homo sapiens
gcatcatacttcttggccagcttcttgaccagattcttattcttgagtttttttggcacctcagtgtccacttggggggatatccgtggccttggtctcgycacagtgctgctgttcccccaggacccacacttgggacagggagtggacttaagcctgacggtgcccgagaagcgcttgtccttctgggggtcatagttc

SEQ ID NO: 52246 - DNA, 201 bp, Homo sapiens
atcacctgaggtcaggagttcgagaccagcctggccaacgtggtgaaaccccatctctactaaaaatacgaaattggccgggcatggtggtgcacacttgkaatcccagctactcgggagactgaggcaggagaactgcttgaacctgggacggggaggttgcagtgagccaagatcatgccattgcactctagcctgggt

SEQ ID NO: 52247 - DNA, 201 bp, Homo sapiens
acctgaactagaactaagggctttctgaactggcctgtcagtgtccttccatccagccacctgttcctgcccaggcaggagagccactctttgcttcttgyttcttttatctctaataaatagccttagtatttttcagttcagctgcttaacctgaatgttaatacatttttaataaggaaaaaagatctggattgaatt

SEQ ID NO: 52248 - DNA, 201 bp, Homo sapiens
aagtatctcttaagctcactcttttatgtccctgttacactatccaaggccagaccaccattatctcataggtgattccgacactactttcttatatgttyttctctgtttctagtgcctcttcctcccatgtatgttttctacactgcacccaaaatggtcttttaaggaaacacaaataagatggtcatttctctgctt

SEQ ID NO: 52249 - DNA, 201 bp, Homo sapiens
catataagcatcccttgggtgcagcaggttcaaatcctataaacatgaatgttcacttctcattcaggtgtctgatgtccctcaagtgccttactctcctstgctacccactcagtcaccaggtccttttgctgctgtgttccaagtatctcttaagctcactcttttatgtccctgttacactatccaaggccagaccac

SEQ ID NO: 52250 - DNA, 201 bp, Homo sapiens
tatgggaaagagcattaaaaataaagaaaaataaaggttattgaaagtattttacatttcagttacggtgactggtggttgatctctggagaacagtcatyacacagccaaacaaatgggggcctccagaaatgtatggtcacgcccacagcatcctcagtgccacccggcattcatttctgctgctttcatcagtattct

SEQ ID NO: 52251 - DNA, 201 bp, Homo sapiens
ctgcactgcagctaggtgacagcaaaaccctgtctcaaaaaaacaccaaacaacataggatactgttatataacagctagttcctatacctgtaatcttaytaattcatttaaaatacatcagtgcgggccgggtgtggtggctcacacttataatcccaacactttggaaggccaaggcgggaggatcacttgaagccac

SEQ ID NO: 52252 - DNA, 201 bp, Homo sapiens
ttcaggggcctggggatgtgtacttgcactccaagtcgaggagactgaactttttaccaaagacttggtgttctgtagaagtatgagcagatgagtgacargatctggtttatatgttaagaagttctcagctgtaaggtgaatagattggaggtgttggggcaaaggcaggggacccagtgaagacaaggagcgaggctc

SEQ ID NO: 52253 - DNA, 201 bp, Homo sapiens
ctttttttaagtgaccgtaagtgtgaaatttcagtaaaacaattgtttaatcataggcatgactgcaagttgactaaataaaagcatactatttactgaargtgggaggaatccttaatagtgcacgtagtagttttcatagttcacgtacgtcgcaacattcattcctccattttaataaaggaagaggaaactgaccct

SEQ ID NO: 52254 - DNA, 201 bp, Homo sapiens
tgggaatacagatgcctgccactacgcccggctaattttttgtatatttagtagagacaggatttcactgtgttagtcaggatggtctcgatctcctgacytcgtgatccacccgcctcggcctcccaaagtgctgggattacaggcgtgagccacgcgcccggcacagctccatcttttttacttacctctttattggtg

SEQ ID NO: 52255 - DNA, 201 bp, Homo sapiens
ttctgcctcagcctcccaagtagctgggaatacagatgcctgccactacgcccggctaattttttgtatatttagtagagacaggatttcactgtgttagycaggatggtctcgatctcctgacttcgtgatccacccgcctcggcctcccaaagtgctgggattacaggcgtgagccacgcgcccggcacagctccatct

SEQ ID NO: 52256 - DNA, 201 bp, Homo sapiens
atcagttgaacccaggagttcaagaccagcctagccatcatagtgagacaccatctctacaaaaaatttaaaaattagccaggcatagtggcacactcctrtggctgagataggaggatcgcttgaccccaggaggttgaggctgcagcaagctgtgatagtgccactgcactctagcctgggtgaatacagcaagaccct

SEQ ID NO: 52257 - DNA, 201 bp, Homo sapiens
gtctattaaaggaaattcagatttttattagaaaaaaagtgtgtggctctttccataactgtactcttaatttttataaattggccacctaaaagggaacmtttttttgcttcatacaatttacattccttcctactcagatgaatctgacttgcaaacatgtgtgaagatggcttattgactatgaggaaggggctggtg

SEQ ID NO: 52258 - DNA, 201 bp, Homo sapiens
ggtgttctgacagtgcacggggagtcccggagtgactcctccatgagtggaaggaactcagtgtcattgccagtcgaggagaaaggaaacagttcaacagytatttttgtttgttttgtttgtcttgggtttgttttgtttcgttttgtttttgagacagggtttcgttctgtcacccagactgaagtacagtggcgcaat

SEQ ID NO: 52259 - DNA, 201 bp, Homo sapiens
tgtgctattatttagactgggaatcagcaaacttctgtaaagggccagatagtgaacattttaggctttgtgggccacactgtctctgtcgcaactatttmactctcttgttgtagcttagaagcagtcgtaggctgggtgcgatggctcatgcctgtaatcccagcactttgggaggctgaggtgggcggatcacctgag

SEQ ID NO: 52260 - DNA, 201 bp, Homo sapiens
taaattatagtcactatggaagctgcgtcaggcagcccctacccagtaagcgaccttcgtgctgaccttcaggtctgcagagcagttgccccttccatggrtgtggcaccaggcagagcaggggcagaagaggggtgtttcccacgcactgtcccttccagtccgtctcagaggggcatcaaaatgagaaagagcttgtgc

SEQ ID NO: 52261 - DNA, 201 bp, Homo sapiens
gtgagccactgtgcccatgatgatgcttagaataatgatatttagaagaaaaacctccatacatgggcctgtgaataaattatagtcactatggaagctgygtcaggcagcccctacccagtaagcgaccttcgtgctgaccttcaggtctgcagagcagttgccccttccatgggtgtggcaccaggcagagcaggggca

SEQ ID NO: 52262 - DNA, 201 bp, Homo sapiens
catctaccgagcctggcccgaggctggtacccagagatgcttccagtcttccagcagcaacgcactgactgtaagaaaagcctgcttataaaccccctacwggcatttggaagctggtccctggggtcctctacagattcatttcgcccccaaccccatcccctttgtgccaccctcgttattgcactcttccatccggat

SEQ ID NO: 52263 - DNA, 201 bp, Homo sapiens
ttaccctgagtgccagttacagtgattcacatctgaaagaacagtactgcaggagagggacagcccagggtggatgggtggggtgggcaggagctggctgscaactccttccctgagctgggcctgcagagccctgaggagtggggcatgctgtcctttttgcctgatttccaaggattctgcttaacgaattacttcgtt

SEQ ID NO: 52264 - DNA, 201 bp, Homo sapiens
ctcagaatgtgacatttttattctgcatacaatgaattttgaaaagggatattctacgaccattgaaaatcaaaagagactgcatttttccctcatcaacyacctggaaatctctcagaagtgaggtgagacacctagtggggctgtgctgctggtttgatttacctgccaagcagagcattctcctaatcctgacaatgg

SEQ ID NO: 52265 - DNA, 201 bp, Homo sapiens
tttttttttgagacagagtttcactcttgttgccaggctggagtgcaatctcgtgaccttggctcactgcaacctccgcctgccagcctaagtagctgggrttacaggcacacaccaccatgcccagctaattttttgtatttttagtagggatggggtttcaccatgttagccaggctggtctcaaactcctcaccttgg

SEQ ID NO: 52266 - DNA, 201 bp, Homo sapiens
gttaaggatgcaagagcccggcgccttcccgtagccccggccctgtcattaattaatgctggggctccattcggtgcagcgcagtcccagggatgcaaccrcaacttttgcgcacaataggctctcgatctgtaatccagccaacccaggcctgtagtgtgtaaatgccaactcagcgggagggctctggctgtcgcccag

SEQ ID NO: 52267 - DNA, 201 bp, Homo sapiens
acaggcacacaccaccatgcccagctaattttttgtatttttagtagggatggggtttcaccatgttagccaggctggtctcaaactcctcaccttgggtkatccgcctgccttggcctcccaaagtgctgggattacaggcttgagccactgcgctcggcctgcattttattattctaagatatagccaaattttatgcc

SEQ ID NO: 52268 - DNA, 201 bp, Homo sapiens
aaaaatattttgtcagattattttcagcacaacctgcacatctccttaaatttttttaatgaccagagttaccccttttaaatagaattcttcgtgtttaytacataaaagtaaaattcatactgttgtcttgacacttagtttttattcattttgagatctaagactgaaaagtctacttgtttaaatccccaatcacct

SEQ ID NO: 52269 - DNA, 201 bp, Homo sapiens
gtttgtttacttagatttttatgacttcactttctcaatttcctctgtggccagattcatcaggcattcagtcactttcatctctgtcaggctggccttgkgttctgtctgtctgttctgctgcatagttgtcatcctgagatctcccttcacccatatcctagggattccctttgcctttcctgttcgatccattttctt

SEQ ID NO: 52270 - DNA, 201 bp, Homo sapiens
attattaattatagactgttcagacaaggttatgcagaattttcttagtttgcactgactaaacctaatctttcaagttaataatgttgctaaaccacctrcatagcagagacactctgctcctacgatttcatatgctttagatacccggacgacactgtttagactacttcatttaaagaccccagagaagtgacgtgc

SEQ ID NO: 52271 - DNA, 201 bp, Homo sapiens
gaccctgtctcaaaaaaaaaaaaaaaaaaaaagttatcaaagaattatataacattttgtgtgtgtgtgtgtgtgtgtgtgtgtgtgtgtgtgtgtgtgtrtgtcaggttgtttattggctccttaggaagaaaaaaatacgtgtatgaaataattgattaacagtacaagaactcataattatttgtttaaatgtttaat

SEQ ID NO: 52272 - DNA, 201 bp, Homo sapiens
catgagccaccgtgcccaacctattttattttcaagacagggccttgccctgtcacccgagctggagtgcagtggctcaatcatggctcactatagcctcracctcctggggtcaggcagttctcccacctcagcctctcgagtagctgagactacaggcatgcactgccacacccggctaatgtttaaaaaatttttttg

SEQ ID NO: 52273 - DNA, 201 bp, Homo sapiens
ggcaaaacagaatcagccaaagagctttgccaggtttgggacacccattcatgaccagccagcaagagagacagtgagttcaatctgagaagagtctggtractcccagaataaaccattccttcctggccagccgtggtggttcatgcttgtaatcccagcactttgggaggccaaggcgggtggatctcctgaagtcag

SEQ ID NO: 52274 - DNA, 201 bp, Homo sapiens
gaactcctgtgttcaagcagtcctcctgcctcaacctcccagagtgttgggattacaggcatgagccaccatgcctcactaattaagctttttcttttttkgggggttaggggggtgtcgggggttgggacggagtcttgccctgtagcccaggcctggagtgaagtggcatggtctcggctctctgcaacctccgcctcc

SEQ ID NO: 52275 - DNA, 201 bp, Homo sapiens
caaggctggagtgcagtggtgcaatcttggctaacttcaacctccgcctagattagggaggatctctgacatccattagcattaactagaagtcagacgcrtcagaaggtttctatttaccctcttactcacttcttagcccctttattaagccacctcattttaaactgggcaaaacagaatcagccaaagagctttgcc

SEQ ID NO: 52276 - DNA, 201 bp, Homo sapiens
cagtggtgcaatctcggctcactgcaagctccgccttctgggttcacgccattctcctgcctcagcctcccgagtagctgggactacaggcatccaccacyacacccggctaattttttgtatttttagtagagacggggtttcactgtgttagccaggatggtctcgatctcatctcgtgatccgcctgcctcagcctcc

SEQ ID NO: 52277 - DNA, 201 bp, Homo sapiens
atgctgattggcgggactccgggtggcggcctgtcgtcacttccggcagccggaggcagcagaggaagccgaggggcggccatcttggctccgtgaggctytgaggtgccggggtgcggcggcggcagcggcggccagcagggcggaggctgaggcagcaagctcgctagagagggagaagcagtcgggcgcaggcgcctc

SEQ ID NO: 52278 - DNA, 201 bp, Homo sapiens
agtggtgcaatctcggctcactgcaagctccgccttctgggttcacgccattctcctgcctcagcctcccgagtagctgggactacaggcatccaccaccrcacccggctaattttttgtatttttagtagagacggggtttcactgtgttagccaggatggtctcgatctcatctcgtgatccgcctgcctcagcctccc

SEQ ID NO: 52279 - DNA, 201 bp, Homo sapiens
gcagcaacgcactgactgtaagaaaagcctgcttataaaccccctacaggcatttggaagctggtccctggggtcctctacagattcatttcgcccccaamcccatcccctttgtgccaccctcgttattgcactcttccatccggatggcatttagctgggtccgggtctgtcacccgtctgaccaccagctccttgagg

SEQ ID NO: 52280 - DNA, 201 bp, Homo sapiens
ttgtagtagaaattccattgaagaaacgtttgactctgttcgttttctaactctgttctcctctaacactgggttcaaaagtgtttcaatctagttgttgmctatattctgtaaaacatctagtaaataatttgtaaagaaacttcactggcctttcattaaaagtgttatgaggtaattgctggcacgaaatgtcttctc

SEQ ID NO: 52281 - DNA, 201 bp, Homo sapiens
cctgggaggcggaaattgtagtgagccaagaccgtaccattgcacttcagcctgggtgacagagactccatctcaaaaaaaaaaaaaaaaaaaaaaaaagmagcagctgtagacaataccaaatgaatgaacgtgactgtgttccaacaaaactttatttacaaaaacagggatgggccggatgtagccagaggccataat

SEQ ID NO: 52282 - DNA, 201 bp, Homo sapiens
agtagctgggactacaggcatccaccaccacacccggctaattttttgtatttttagtagagacggggtttcactgtgttagccaggatggtctcgatctyatctcgtgatccgcctgcctcagcctcccacagtgctgggattacaggcgtgagccaccacgcctggcccatctgggagttcttttgctttcccattact

SEQ ID NO: 52283 - DNA, 201 bp, Homo sapiens
cttgtactaccagttcctgaaccttttgagagttctataatacaaatcaggattttccaatatctccatagctggcttaggattaatctttcttatatgtrttaagtcattttccttctttttttagtttctgaaagtatatctgttaccacttttattttctttgtcttgtggcttttttccttatgccttatatttttt

SEQ ID NO: 52284 - DNA, 201 bp, Homo sapiens
aatcacaggctttcctcatttgtgtgatttttttattttgttcatgtcttcaagagtggagccctaagaagaaagctgagagctcccagtaaaggggtgaygagtgcctggcttagcctcatagaggccagaggaacgtcggtctttacactgggacattccacacacgcaacacagagttattttctatggacagttgag

SEQ ID NO: 52285 - DNA, 201 bp, Homo sapiens
agggctttgtaaactgcacagcactgcacagttgtgcgatattttgataagagcagtgctctatatacatttctaatgtattcctcatggttatttatatyctggtaattttgaagccctgtccctgttttgtgtttgggaggtggggagggagatagactttctctgcactaaaaatgttatttcaacaagtggttcttt

SEQ ID NO: 52286 - DNA, 201 bp, Homo sapiens
tttctaatgtattcctcatggttatttatatcctggtaattttgaagccctgtccctgttttgtgtttgggaggtggggagggagatagactttctctgcrctaaaaatgttatttcaacaagtggttctttgtgatctgcaacccataatgggccttaaggcttctcaaggtgggcatgaaacatctaaaaattccagtc

SEQ ID NO: 52287 - DNA, 201 bp, Homo sapiens
ttagaacctaaatttataacatcaaatagctttctttgcataagttcccttggagccagtcactcatagtactttccatatgggaaggataacaaaggaamatatggaaattcagcttgcatgtggtagatacctagtaaaatctgataagttaattttgttagtaccaaattcattttaacactaaattaatttttcctg

SEQ ID NO: 52288 - DNA, 201 bp, Homo sapiens
ctcactgctagtgcaggtgcttgaagctgccatcggggacccagatactttctggtgatagtgtatatggggggcatctgctggagcttgggagatttggrcccccattctggctctgttgctaactagttgtgcagcttcagacaaagcttctgaagctttgacttcatttctttatttgtttttaaaattgcaggctga

SEQ ID NO: 52289 - DNA, 201 bp, Homo sapiens
cttgcccagaattgcctttctttttttctttttcccccttattgtggagaacggggtctcgctgtattgcccaggcaggtcccagaattgcctttcaagtrggagacctgccatagactcagagtcccaaaccctctgaccccaaaactcagatttgcaatcattatattgtgctattatttagactgggaatcagcaaac

SEQ ID NO: 52290 - DNA, 201 bp, Homo sapiens
ataatcctgcagtgaggatgtcctcttctaacacaaataacttcatccattttaattttctgttttaattgcttagtttttattaaagcctattgaaaackctctttaaaataagagttatataatttaagtatagggaatttaattttaaggcttttcttcagcttaaagattttgttggtgaatttaaatgcctgtagt

SEQ ID NO: 52291 - DNA, 201 bp, Homo sapiens
gattgtacaaaattgaaatttgcaaacatcttactgagtttactgtttccttctgggtgttaggcctactgtagaaatcagaaaaatcggaaatattttgytgcttgctttgtgaaactcatgatgtgacatggattaaatttctaaaaagtttatttaattgcctttaaaattagtatgtcaaaaagtttatttatttat

SEQ ID NO: 52292 - DNA, 201 bp, Homo sapiens
atggtatttgcctaaaacagctccattagacttggaaggatacgcatgatattggtgtttccacttttctgtttcaaatgctgtggtttctttgttttttygtttttgagatggagtctccctctgtcaccaaggctggagtgcagtggcccgatctcagctcactgcaacctccgcctcccaggttcaagcaattctcct

SEQ ID NO: 52293 - DNA, 201 bp, Homo sapiens
ggaaaaggatcttgtgttcactgctgcatctccccagaacctacctagaacagtgccttgcagttagtagacattcaggaaatatttgttgaatgaatgartatactcaggaaatgctttgttgtcataatcctgcagtgaggatgtcctcttctaacacaaataacttcatccattttaattttctgttttaattgctta

SEQ ID NO: 52294 - DNA, 201 bp, Homo sapiens
actttttctccacagcacttactgtcctctgatacactatatgtttattcatttattgccccctcccccaactagaatgtaaactctatgaggaaaaggaycttgtgttcactgctgcatctccccagaacctacctagaacagtgccttgcagttagtagacattcaggaaatatttgttgaatgaatgaatatactcag

SEQ ID NO: 52295 - DNA, 201 bp, Homo sapiens
cactttgggaggccaagacgggcagatcacttgaggccaggagttcgagaccagcctggccaacgtggtgaaacccccatctctactaaaaatacaaaaaytagccgggtgtggtgacgcacgcctgtaatcccagctactcaggaggctgaggcacgagaattgcttgaacgttggaggcagaggttgcagtgagccaag

SEQ ID NO: 52296 - DNA, 201 bp, Homo sapiens
gtctggacagtcaatcagaaatattgttgtctctctctagcgtgggcaaggcactgttgtgattgagatcctcagcaaaacagacacctctctccttgagyctgacattctaggcagtggataaacaagtaagttacctagtatggagcacagcagcacgtgtgagagagcgcagagcaggcacgggtttcatcagcactc

SEQ ID NO: 52297 - DNA, 201 bp, Homo sapiens
ctcatgtttagttgtttttgcttattaaccacttgttttgacattgtgtgcttttctgcaaataggtcattcgcatagaaaatgctgacactttaccgagstgacatttaacttcataattcatcatagttaagtgaattgtgtcgtgtaaacttgacagtatgtaatgccttttaaaagatcattatgcaggctgggcac

SEQ ID NO: 52298 - DNA, 201 bp, Homo sapiens
acatcagccaagtgtggtggcacacctgtggtcccagctcttcgggatgctgaggtgggaggcttgagcccaggaggttgaagctgcagtgaactgtgatkgtgcacagcactccagcttgggcaacagaatgagaccctgtctcaaaaaaaaaagaaagaaaaaggaaaaagtctggacagtcaatcagaaatattgttg

SEQ ID NO: 52299 - DNA, 201 bp, Homo sapiens
tccacctgccttggcctcccaaattgctgggattataggtgtgagccacagcacctggcctctttaacagtgttttgttgagtttattaaaacaatttccrggacatatgttttattgttgatgtgtttgccattgtgaaaagttttattaaattggccacccattccaccattgcatctcccccacccgccagcctgctg

SEQ ID NO: 52300 - DNA, 201 bp, Homo sapiens
gagggcagctagccaacacagacatgctgaaggacagtgagggtgacagaggaagtgagctcaggtacaccttgctggactgctgagcacatatggaagtsacactgaacattcagaaattatttttatggaattccatgctttcatagactcttttctgttgttgtggtatttgataaaattccctaaaagcatttttta

SEQ ID NO: 52301 - DNA, 201 bp, Homo sapiens; identical to SEQ ID NO: 9798

SEQ ID NO: 52302 - DNA, 201 bp, Homo sapiens
atttcagaggtccaatactttttgctgtgtgccctaagaaaatacttatttgaaagatggaatacttgctatctaatggaattgtgataggaattattttrtaaatcaaagatttgttttctgtgtcctctgtgtgcacaactctgtgctgggtgctagtaggtgtgtttaaagatgaggaaggagcgacatggtcctacc

SEQ ID NO: 52303 - DNA, 201 bp, Homo sapiens
acatcctgtactttcctacctcccctttggctgtgatcccctctactcaaaacaaacactcttccctatcttcattgcattttgttgaaatcccatggctsttcatagctctcctcagatgcaggcccacccccacccgtgctgtttcctccttgtctcatcctgcctgtcacgttctcctgctcggcgggctccacctct

SEQ ID NO: 52304 - DNA, 201 bp, Homo sapiens
ttggggcctgaccaccacaagtgctcattaagtgccaccagctgttgtgggggtgatgacactgtgcctccagttccactcagtctgtgtactttattatsccacagacacatcctgtactttcctacctcccctttggctgtgatcccctctactcaaaacaaacactcttccctatcttcattgcattttgttgaaatc

SEQ ID NO: 52305 - DNA, 201 bp, Homo sapiens
cctcattcaccgtttgtccttttggtctttctaaaagcccgcttctggtcatatgacctttctgaattaaaaccttcagtgacctccactatttcacctgrccacgtccctgcgaggccctgagtggcgtggtccaggctgccccagcagccccagctctgctgccccatcaaggcagagcactagggtgagtgccaggca

SEQ ID NO: 52306 - DNA, 201 bp, Homo sapiens
gcccccgcacccagccttgcttttccattttgtatagttatcattgcatggatttgaggggaggcaatcaccaggtagccttaggactctatgtcccttgytctaggtctcttccacttgtgccctttttttatgccagtcaccagcaggctatttcaggtcctcattcaccgtttgtccttttggtctttctaaaagccc

SEQ ID NO: 52307 - DNA, 201 bp, Homo sapiens
gtgatctcagctccctgtaacctccgcctcctgggttcaagcaattctcctgcctcagcctcctgagtagctgggactataggcgtgcgccaccatgcccrgctaatttttgtatttttagtagagatggggtttcaccatgttggccaggatggtctcaatctcttgacctggtgatctgcccgcctcaacctcccaaaa

SEQ ID NO: 52308 - DNA, 201 bp, Homo sapiens
ttatatatgtggcacacaccttctacttgatggtatatcttcactctcttgatactgtctctcagtgaatagcagaggctcctaattttaaagcagttacrtttatcagtctttttttaatatgctttgcactttttatgtcttttttgtttttttgtttttttgtttttgagacggagtttcgctctgtcacccaggctg

SEQ ID NO: 52309 - DNA, 201 bp, Homo sapiens
gctccctgtaacctccgcctcctgggttcaagcaattctcctgcctcagcctcctgagtagctgggactataggcgtgcgccaccatgcccggctaatttytgtatttttagtagagatggggtttcaccatgttggccaggatggtctcaatctcttgacctggtgatctgcccgcctcaacctcccaaaatgctgggat

SEQ ID NO: 52310 - DNA, 201 bp, Homo sapiens
gtcccagaaccatcagttctctcccaacaattgaagatacctgcgttaacacataataaattctcatatgtgtcctgttatttctccagtctgtttatttrgtcctatacccataccgtggtgtttttattactgcagctgtggattgtatgttttaggtcaagttcccctcctgatgattcttttttttttctctctctc

SEQ ID NO: 52311 - DNA, 201 bp, Homo sapiens
ttctctcccaacaattgaagatacctgcgttaacacataataaattctcatatgtgtcctgttatttctccagtctgtttatttggtcctatacccatacygtggtgtttttattactgcagctgtggattgtatgttttaggtcaagttcccctcctgatgattcttttttttttctctctctctttttttggtgagatg

SEQ ID NO: 52312 - DNA, 201 bp, Homo sapiens
ttaagcctgacggtgcccgagaagcgcttgtccttctgggggtcatagttcttcaagctgatctgcaactccaccatcttcaggaacttggggcactttcrctggttcccgtgcaggacttcctgcaccgcctcatccagggtgtcgtgagagactttgctgcttatgggttctcatgccacgctaaccagaaaagagggt

SEQ ID NO: 52313 - DNA, 201 bp, Homo sapiens
gtcgaaaattaagtttatattgttttttaatagcatgctttttttttttttttgagacagagtctggctctgtcgcccaggctggagtgcagcgcgatctyggctcactgcaagctccaccttttggactcaagcaacctcccacttcagcctccccagtagctgggaccacaagcacacagtaccgcacctggcttattt

SEQ ID NO: 52314 - DNA, 201 bp, Homo sapiens
tccctctctctgtccagtgcctttcagagtggagtcctctaacggagctgattgtgcccagtcacagacagtgaggacttccccagctttttttgcctggkgcaagctggtttttatatcccattaaagcatcataaagccaacccggacaagagaattgggatgtctctctgcacacatgagcctttttgtttgtttgtt

SEQ ID NO: 52315 - DNA, 201 bp, Homo sapiens
atgcctgtaattccagcactttaggaggccaaggtgggcagatcacaaggtcaagagatcgagacctgaggtcaggagtttgggaccagcctggccaacayggcaaaatcccatctctactaaaaatacaaaaaatagccggggatggtggtgtgcgcctgtagtcccagctactcgggaggctgaggcaggagaatcact

SEQ ID NO: 52316 - DNA, 201 bp, Homo sapiens
gtgctgaaggccagcccactttctgctgtaattattctgccttctgatgttattctcgaaaaatggccagattccaggcgtgactaatggttggtgtaaaytaggcatgagaaggtttgattacaccttcaattgtatgattctatcatgatggtataggtttgcagtgagtcttaaaccacatagcactgacacgtagtg

SEQ ID NO: 52317 - DNA, 201 bp, Homo sapiens
taagtgggatggtagctacagggagacattaggccaaggtattttttagaagatggacaaaatatcaacatatttctctactaatggggataatctcataraaaggaggaaattggtgctgtcgaagagattttggaataggtgaggggatggtggaggcattggtctttggataacatggacagttcttccatagaaata

SEQ ID NO: 52318 - DNA, 201 bp, Homo sapiens
ttttttcaattagcaaattgatttagagtgctttagaattgaccccttcttccatggtatttgcctaaaacagctccattagacttggaaggatacgcatsatattggtgtttccacttttctgtttcaaatgctgtggtttctttgttttttcgtttttgagatggagtctccctctgtcaccaaggctggagtgcagtg

SEQ ID NO: 52319 - DNA, 201 bp, Homo sapiens
gttttatcagctttcctgtgggaacaataaagttaatgacacagggagcataggttagggccagttgttactttggcacaaacacctgtgattcgttttcygagactagttttaaactggtcgtgctgaaggccagcccactttctgctgtaattattctgccttctgatgttattctcgaaaaatggccagattccaggc

SEQ ID NO: 52320 - DNA, 201 bp, Homo sapiens
tagtgcaagtaaaactggggaaatctgaacgaggtcagtggattagatcaaggtctgtttctcttcagaatctcaaatcttaaaaggttttgtattttctraacacaaataaaagctggaaagccaatcagtagtaatctgaaagttcacaatgtcagtagacgtctcatggtattgggaagaaagataagcattgaggct

SEQ ID NO: 52321 - DNA, 201 bp, Homo sapiens
tttttttctttttgagacagagtcttgctctgtcgcccagtctggagtgcagtggtgcaatcttggctcactgcagctctctacctcctgggcccaagcartccttccacctcagcctcctgagtagctgggaccagaggtgtgtactaccacatccggctgattttttgtattttctacagagacaaagcatccccatgt

SEQ ID NO: 52322 - DNA, 201 bp, Homo sapiens
attttgattttgagacagtatctcgctctgtcacccaggctggagtgcagtggagcaatcacagcttgctgtaaccttgacctcttgggctcaagcaatcsttccgactcagcctcctgagtagctgggactacaggcgtgccccaccacatgcatggctaatttttaattttttcgtagagatgagatctccctgtattg

SEQ ID NO: 52323 - DNA, 201 bp, Homo sapiens
gagtgcagtggcatgatctcagctcactgcaaactctgcctcccgggttcacaccattctcctgcctcagcctcccgagtagctggcagtacaggtgcccrccaccacacccagctaattttttgtagagacagggtttcaccgtgttagccaggatggtctcgatctcctgaccttgtgatccgcccgtctcggcctccc

SEQ ID NO: 52324 - DNA, 201 bp, Homo sapiens
atggtggcgcgcacctgagtcccagctactcatgaggctgaggcaggagaattgcttcaacctgggaggcggaggttgcagtgagctgagattgcgccacygcactccagctgacagagtgagactccatctcaaaaaaaaaaaaggatttttctaagatttctattttacattaaatagaaggcagttggtttgcatgaa

SEQ ID NO: 52325 - DNA, 201 bp, Homo sapiens
aattttctaatttttaagtatattagaaaatataattgtattgcatgagtagatagaagggaattataggaagtcagaattaatattttcaaaggggctgrgcacagtggctcatgcctgtaattccagcactttgggaaaccaaggcaggaggattgctggaggtcaggagctcaagaccagcctaagcaacagagcgag

SEQ ID NO: 52326 - DNA, 201 bp, Homo sapiens
cgcaagtgcctctgccctcaggttgatccatgttgccatgggcagtgtgaaggcctcctcctgcagctgcctccttcctctttatacctcaagggattatrggaggaaaagttaagaaaaacacttctatagtaattgaccagtaaccctgatttttccggtggaagattaggaaatgtccaggcaccatggctcatgcct

SEQ ID NO: 52327 - DNA, 201 bp, Homo sapiens
acctcccacctcaacctcccaaagtgctgggatgacagacatgagcccccgcacccagccttgcttttccattttgtatagttatcattgcatggatttgrggggaggcaatcaccaggtagccttaggactctatgtcccttgttctaggtctcttccacttgtgccctttttttatgccagtcaccagcaggctatttc

SEQ ID NO: 52328 - DNA, 201 bp, Homo sapiens
ttggctctaattcactttgtttcatttctgctgtactgttagtagagacttaaaaatgattgccttcatttgacctgctcccctgtcatcagaactgtgayaactctgtaacaagcattgtgctgcggaggatttaaaagctatgtggtcattagaatgctgaggctggctcagaccgcagttgttggtagttagtgcttt

SEQ ID NO: 52329 - DNA, 201 bp, Homo sapiens
ttatatagttgagtgttttgcttttcttttttttttttctgagacacggtgtcgctctgtcacccagtctggagtgtagtggcgtgatcagggcttactcragttcccaggcttatgcgatcctcccacctcagcctcctgagtatctggaaccacaggcactgccaccatgctggctaatttttgtattttctgtagaga

SEQ ID NO: 52330 - DNA, 201 bp, Homo sapiens
tcacacctgtaatcccagcactttgggaggctgagccgggtggatcacgaggtcaggagttcaagaccaccctggctaacatggtgaaatcccgtctctaygaaaaatacaaaaaattagccgggcgtggtggtgggtgcctgtagtcccagctacttgggagactgaggcaggagaatggcgtgaacccaggaggcagag

SEQ ID NO: 52331 - DNA, 201 bp, Homo sapiens
tttggctctaattcactttgtttcatttctgctgtactgttagtagagacttaaaaatgattgccttcatttgacctgctcccctgtcatcagaactgtgwcaactctgtaacaagcattgtgctgcggaggatttaaaagctatgtggtcattagaatgctgaggctggctcagaccgcagttgttggtagttagtgctt

SEQ ID NO: 52332 - DNA, 201 bp, Homo sapiens
ctccagcctgggcgacagagcgagactccatttcaaaaaaaaaaagtagaaataaggtgagtttctcttatttaaatggccttttacaattacaaaacttwaaaatttttctggtatagtccttatagggactttccttaaagttcacatttgcctttcagtacattattcctatccaaatttaactatctttggtcatca

SEQ ID NO: 52333 - DNA, 201 bp, Homo sapiens
gggctgatcacttgaggccaggagttcgagaccagactggccaacatggcaaaaccctatctctactgaaaatatagaaattaactgggcatggtggcgcrcgcctgtgattccagctactcaggagactgaggcacaagaattgcttcaacccgggaggcataggttgcattgagctgagattgcaccactgcactgtga

SEQ ID NO: 52334 - DNA, 201 bp, Homo sapiens
aggcgggcggatcacgaggtcaggagatcgagaccatcctggctaacatggtgaaaccccgtctctactaaaaatacaaaaattagctggacatgatggcrggcacctgtagtcccagctactaaggaggctgaggcaggagaatggtgtgaacctgggaggcggagctttcagtgagccaagatggcgccactatactcc

SEQ ID NO: 52335 - DNA, 201 bp, Homo sapiens
ttaaatagaattcttcgtgtttattacataaaagtaaaattcatactgttgtcttgacacttagtttttattcattttgagatctaagactgaaaagtctrcttgtttaaatccccaatcacctatttttttcttaaaaagtgatttatgtcataccactgtagcaaataatatgttaatgtttgtttcattttcctgaaa

SEQ ID NO: 52336 - DNA, 201 bp, Homo sapiens
tatttaaaagtaaaagaaaattaggaaacgaaaatatatcttaaagacttttaatcattttcaactaaaatattttggataatactgccttatatttaggyagtatatattaaagattttcacatgcatgattgtactgtcgatgaccctgctgtatactactgatctgattatgaagtggttggcagttatttatagtag

SEQ ID NO: 52337 - DNA, 201 bp, Homo sapiens
ggttgatccatgttgccatgggcagtgtgaaggcctcctcctgcagctgcctccttcctctttatacctcaagggattataggaggaaaagttaagaaaarcacttctatagtaattgaccagtaaccctgatttttccggtggaagattaggaaatgtccaggcaccatggctcatgcctataatcccagcactttggga

SEQ ID NO: 52338 - DNA, 201 bp, Homo sapiens
gcgccgctgcactccagcctgggtgatgacagagcgagactccatctcaaaaaaaaaaaaaaaaaaagactagcattgattggccaggcatggtggctcaygcctgtaatcccagcactttgggaggccgaggcaggtggatcacctgaggtcgggaatttgagaccatcctagccaacatggagaaacccagtctctact

SEQ ID NO: 52339 - DNA, 201 bp, Homo sapiens
ctatatgtacattattgggcaaccatcaccactattcatttccaggcagatagttaatactcatttttttgtggtttctatatttgcaaatttacctgttsgaaaaaatttatttgtaacacccaaatcagtacagcgctttggtaatccttttcggacatatgcagaacggtgaaaaaatatgcacatccctagttgagg

SEQ ID NO: 52340 - DNA, 201 bp, Homo sapiens
agttttcatgggattagttggttttttgttttttgttttttttactagtagcagtagaatcttttcaaatatgccttaatataggcgctggggcttgcccrtggtgctcttgatatataaggcccggacattctgccagttttttctcgagcagtgacaccaagaagttaacagccaggtgaatgttatgcacaagctcat

SEQ ID NO: 52341 - DNA, 201 bp, Homo sapiens
tttttttttaatttataatgagaaaataaatttacatttccttcttaggtctctagaggatccattttttttctgcaaagcatctgtccacaccctcttamcatgcttgtatgccttaaagatctagcttggcctgtcagcagtgtgcttcattgggaatcgatgcagcaccctcctgcctgcaagctgactaaaagcctt

SEQ ID NO: 52342 - DNA, 201 bp, Homo sapiens
attcagtgttaaccaatcatatatagtaaagaaggtgttcttaaacagacacacacataaaacaaacttatgtattaatctgctgttgcaaaatgttgtgrccagaggcttgcagaaacctaacccccagaagcaatgatttcgtattcactaattcagtgagcacagtaactgcatagaatgaacaatgagaattgactg

SEQ ID NO: 52343 - DNA, 201 bp, Homo sapiens
tatgtatgtcacattatacacctattggacagcattagagtattcactctgattttctcttggggcaggaattgccccttgtttcagttgctattcccccrttagcaccccgtgtatatcatgagtgccttgaaggtttgacaccacacttttctgtttcttttattccctgctaatgcctaccatatagttgactagccg

SEQ ID NO: 52344 - DNA, 201 bp, Homo sapiens
taatttaacgtattaaatatgtttctttttacattttttaatggagctactagaaaattgaaaattacatatgtatgtcacattatacacctattggacarcattagagtattcactctgattttctcttggggcaggaattgccccttgtttcagttgctattcccccgttagcaccccgtgtatatcatgagtgccttg

SEQ ID NO: 52345 - DNA, 201 bp, Homo sapiens
tcaggttacttcacactacatttttttctgtaaggattaaagcagtaggaactttgttattgtgccaattgaagttttttcttttcttttcttttcttttyttttttttttgagacagagtcttgccctgtgacccaggctggagtgcagtggtgtgattttggctcactgcaacctctgcctcccgggttcaagagatac

SEQ ID NO: 52346 - DNA, 201 bp, Homo sapiens
tagttgggcgtggtgacataccccagctacccagtaggctgaggcacaagaatcgcttgaacctcggaggcggaggttgcagtgagccgagatcacaccaytgcactccagcctgggtgacggtgagactctgcctcaaaaaataaataaataataaactgtcctgtttgggaaattagctgttatctccttttcttctga

SEQ ID NO: 52347 - DNA, 201 bp, Homo sapiens
gttagtgcttagagctctgtagcagtagcagtagtggccttttttggcgtcctagggaatcttggtcatgggatgtagcagggaaacttataatttgaaarcaaggagaaccagttcatgcttttcatgtggtctgtcgtgtaatgacttttactgctgccaccactgggttattttgggcactgttgatttagttttctt

SEQ ID NO: 52348 - DNA, 201 bp, Homo sapiens
cattatagttggctgatatgtcaaatatgctttttttttttttttaattgagatggagtcttgctctgtcgcccaggttggagtgcagtggtgcaatctcrgctcactgccaacctctgccgcccgggttcaagcgattgtcgtgcgcagcctcccgagtagctgggattacaggctcccgccaccatgcctggctatttt

SEQ ID NO: 52349 - DNA, 201 bp, Homo sapiens
tttcgtagagatgagatctccctgtattgcccaaggtggtctctaactcctgggctcaagcaggcctcctgtcccagcctcccaaagcactggaattacargtgtgagccaccacactcagtcaaaactattttttaaaatattttattataggaaaatttaaaaaaatagaatgttatttatcaatgcttctcagccaca

SEQ ID NO: 52350 - DNA, 201 bp, Homo sapiens
ttgacctcttgggctcaagcaatccttccgactcagcctcctgagtagctgggactacaggcgtgccccaccacatgcatggctaatttttaattttttcktagagatgagatctccctgtattgcccaaggtggtctctaactcctgggctcaagcaggcctcctgtcccagcctcccaaagcactggaattacaggtgt

SEQ ID NO: 52351 - DNA, 201 bp, Homo sapiens
aagactttatcacttaactctcttaggccattcattaattacacagtaagtagggggaaaaggtacatatcttaatatacagcacctccatggccaggtgyggtggctcacacctgtaatcccagcactttgggaggctgaggtgggcggatcatgaggtcaggagattgagaccatcctggtgaacatggtgaagccccg

SEQ ID NO: 52352 - DNA, 201 bp, Homo sapiens
gtgagccaccgcaccccaccaatgtagtgtaaagtttaaaaaattgtataaatggactcatgctatgtgtattctcctattggcttttgctttgcttcctyttttttgtttttttgagacggagtttcgctcttgttacccaggctggagtacagtggcgtgatctcagcactgcagcctctgcctcctggattcaagtga

SEQ ID NO: 52353 - DNA, 201 bp, Homo sapiens
cagtgcgggccgggtgtggtggctcacacttataatcccaacactttggaaggccaaggcgggaggatcacttgaagccacaaatttaagaccagcctggrtaatatagcgagaccctgtctctacaaaaaaaataaataaagaaaaaataaaatatgtcagtgtgttttgggaacaggttgagagcatagcatgctcata

SEQ ID NO: 52354 - DNA, 201 bp, Homo sapiens
caccagtgatggacatttttggctattgtgactagaacagttttcttttagtattctgtaaaaatactttttattgtgcttaccccaggaatcttatttamattttaagtaattgtatataactgtgataagaatgtcgcttattagatcaagactaagaaaaggcaggccgggtgtggtggctcatacctgtaatcccag

SEQ ID NO: 52355 - DNA, 201 bp, Homo sapiens
tatattgattgattgaggctgggtcttactttgtagcccaagctgaagtgcagtgtcatgatcatagctcactgtagcctggaacttctgggcttaagcartcctcccgtcttggcctcccaaagccttgggattataggcatgagtcaccacccccagcctgattatacatatttaaaatattgagaatagactgggcac

SEQ ID NO: 52356 - DNA, 201 bp, Homo sapiens
atgcacatagcttaacaagtcaaatatactaaaaagttctaatgacaatcagaagtttcttttcttatccctctttttcctcagcattattactcaaaggmcccaacttttttaagctctttcttctgttactccaatagctttctccaaatttatcattttaaacatcattgacttccacttcccacttccatatctaca

SEQ ID NO: 52357 - DNA, 201 bp, Homo sapiens
agaaattccattgaagaaacgtttgactctgttcgttttctaactctgttctcctctaacactgggttcaaaagtgtttcaatctagttgttgactatatkctgtaaaacatctagtaaataatttgtaaagaaacttcactggcctttcattaaaagtgttatgaggtaattgctggcacgaaatgtcttctcttaggga

SEQ ID NO: 52358 - DNA, 201 bp, Homo sapiens
gttatttaaaatccagtgtctgcattcacatcagtgtcataaatctgataaattaatacaaataggagatggcaaatgaaatccaagacaggcacttcttatattgattgattgaggctgggtcttactttgtagcccaagctgaagtgcagtgtcatgatcatagctcactgtagcctggaacttctgggcttaagcaat

SEQ ID NO: 52359 - DNA, 201 bp, Homo sapiens
gattatgccggcagtctagtcggttaataaagcccaggagttgcagcgttacggatcggtgctttgagaggccaggttgccgcgcaatggattgtgcaaaygtgtgtgtcagatcactgcagtggtcagtgcttattttagccgaactctgcttttaacttggtcaggcagttcttgagagactgtcacattaataacata

SEQ ID NO: 52360 - DNA, 201 bp, Homo sapiens
aagtgattctcctgcctcagcctcccaagtagctgggattacaggcacccgctgccacacccagctaatttttgtatttttagtagagacagggtttcacygtgttagccaggctggtctcgaactcctgacctcaagtgatccacccgcttcagcctcccaaagtgctgaattacaggtgtggccaccgtgcccggcaaa

SEQ ID NO: 52361 - DNA, 201 bp, Homo sapiens
ctgggtgaatacagcaagaccctgtctccaaaaataaaaatttaaataaaaatgttttaattcagggacaagcagttcttgattttaaagacgtatctgcyttatgttggggctatcagaattccagttgctaattgattaatctgctctgttaggagaacgtttgttgaatacctgccctgccaggctttctgcttacac

SEQ ID NO: 52362 - DNA, 201 bp, Homo sapiens
tcgaaatttacatcaagctgtcagctttggtttatagggcttctgaaattgagcagctcattcttcattggcaagttgtagccagatattaaagaaaactrgaagaattcagaatctagttcagtcaggaataatcttatcaggtcatttctggaagtcaattctgtgaattaatattttagcagcgttttttgcttctaa

SEQ ID NO: 52363 - DNA, 201 bp, Homo sapiens
acccacagaagctactgactgtgaaattttagctacagcatgatcctgccaaactgaaagaggtaggcattagtaaggaaaaattaagaggggcaaaagcmttgttatgaagtcttgttattatgacagtcttgggaaaagctgtccatagcatgcagtccacaacttctcgtcctggttcgcagtttgaatgtctctggt

SEQ ID NO: 52364 - DNA, 201 bp, Homo sapiens
gtttttatgaaccaaatcaactaaaattgtatagccaaacaaggagtctgccaattttaaccaagttgtccgctctaccatacccaaatcgcaacgagaartgtcatgaactgcacagattcctccatgtttagtaggcatcccagcattccgtgaccgggctaagtataaagcagggagtgcaagttacccacagaagct

SEQ ID NO: 52365 - DNA, 201 bp, Homo sapiens
cagaagaaatcaggaggatggcaatctcactgctagtgcaggtgcttgaagctgccatcggggacccagatactttctggtgatagtgtatatggggggcrtctgctggagcttgggagatttgggcccccattctggctctgttgctaactagttgtgcagcttcagacaaagcttctgaagctttgacttcatttcttt

SEQ ID NO: 52366 - DNA, 201 bp, Homo sapiens
aaataaaaaaattaatgtaatacagctactatgaacccacaaaaactttaaaaaaattttttaattattaaaaaaatgtaatgctgctactgttttgcttwtgtagattgtgggctagaataggaaataaaactatcatttttaacacttttctggggggaaatattattcgaatttcataacaattagcttgatgacctt

SEQ ID NO: 52367 - DNA, 201 bp, Homo sapiens
aagtatctttccacctcagcctcctgaggtagctgggactataggcgcgcaccaccacacccaactaaagtaacctattttatttatttatgagacggagyctccctctgttggccagcctggagtgcagtggtgccatctcggctcactgcaacccctgcctcccgagttcaagtgattctcctgcctcagcctcccaag

SEQ ID NO: 52368 - DNA, 201 bp, Homo sapiens
agactccttctctaattaaaaaaaaaaaaaagcacacacattgttgctactcttattttacatttttagaaaactgatttgttgtattactcagctaaagytaagcaattttttaaaatttagtttttaatttttattaaatactgactgcatacaaaagaatgttccatgtttagcatataaatatgtatatgagatgag

SEQ ID NO: 52369 - DNA, 201 bp, Homo sapiens
aaaaaagcacacacattgttgctactcttattttacatttttagaaaactgatttgttgtattactcagctaaagctaagcaattttttaaaatttagttkttaatttttattaaatactgactgcatacaaaagaatgttccatgtttagcatataaatatgtatatgagatgagcacccttatactacctgcttcaaga

SEQ ID NO: 52370 - DNA, 201 bp, Homo sapiens
agactgtgaatgtgaagcatctggctctatgcgtcagacacagcaggcactagataactgttagcttcctgcttcctccctgtcctgcttgtttaacttarcataaagcttatttacacatttgctgcctgccagtatctacctaatacataattccaatagagaggtgaatacataaagttatttgggctaatatcctgc

SEQ ID NO: 52371 - DNA, 201 bp, Homo sapiens
cataataaagtagatatgcacaatggtgatttgatagcttcagggatttactccagtttcatttttaaagtgtgtgtgtgtgtgtgtgtgtgtgtgtattyttttttttttttttttttttttttgagacagggtctagctctgttgtccaggctggagtgcagtggcatgatctcaggtcactgcaacctccaccacact

SEQ ID NO: 52372 - DNA, 201 bp, Homo sapiens
actagagtttccttaaaataaagattaatgactagtaactatttgcctatggttttgtaaaaatgtagacattttctgaaatgcgtgtttatagctgctgycttttataatgatttgtattttatggttgagattgggctgggtttgtagtttgcgaccacacgtgagtttcattgtctgtgaagggcagaagctttcttg

SEQ ID NO: 52373 - DNA, 201 bp, Homo sapiens
aagtaacatgtgctgagctgagcttcacggtgagcataggaaccccctctgagggctcagtgcacttggcaacattgtaagagcctttaatcatttaatcsaaggtggtggttctgtattaccttgggtttttttttttttctttttggagacagggtctcactctgttgcccaggctcaagtgcagtggcgccatctcag

SEQ ID NO: 52374 - DNA, 201 bp, Homo sapiens
atattgtgctattatttagactgggaatcagcaaacttctgtaaagggccagatagtgaacattttaggctttgtgggccacactgtctctgtcgcaactrtttaactctcttgttgtagcttagaagcagtcgtaggctgggtgcgatggctcatgcctgtaatcccagcactttgggaggctgaggtgggcggatcacc

SEQ ID NO: 52375 - DNA, 201 bp, Homo sapiens
cctttatttgaggagcctgttagttggactaggaaagatggtttgtatgtatgtgttttttcaattagcaaattgatttagagtgctttagaattgacccyttcttccatggtatttgcctaaaacagctccattagacttggaaggatacgcatgatattggtgtttccacttttctgtttcaaatgctgtggtttcttt

SEQ ID NO: 52376 - DNA, 201 bp, Homo sapiens
aaggcctcagatcaactcagcatttatttatttatttatttttatttttttgagagggagtctcgctgtcttgccaggctggagtgcagtggcatgatctyggctcactgcaacctctacctcccaaattcaagcaattctcctgccttagcctcccgagtagctgggattacaggcccatgccaccatgcccagctaatt

SEQ ID NO: 52377 - DNA, 201 bp, Homo sapiens
ccgaacgctctggaaatagagggcaggccgtagtcacccaggaggcagccaggtcggaccgtttcctccagaagtctgccgtgtcccgctgttcgcgggckggtctgcgaagtacatcgattatgccggcagtctagtcggttaataaagcccaggagttgcagcgttacggatcggtgctttgagaggccaggttgccgc

SEQ ID NO: 52378 - DNA, 201 bp, Homo sapiens
ggcgggactccgggtggcggcctgtcgtcacttccggcagccggaggcagcagaggaagccgaggggcggccatcttggctccgtgaggctctgaggtgcyggggtgcggcggcggcagcggcggccagcagggcggaggctgaggcagcaagctcgctagagagggagaagcagtcgggcgcaggcgcctcctccgcagc

SEQ ID NO: 52379 - DNA, 201 bp, Homo sapiens
ttggatggatcttgaatacaacagtgggacacactgttatttctttgtggtgctcttgataccaatatatttagtcttatcacttggcctaggcaagcacrgaatgcccatgttccagggagctgagtcgggagagggcagaaggaaagatctgtggctttctgctttctctgcttgttttcagtgtccctgccctcagtt

SEQ ID NO: 52380 - DNA, 201 bp, Homo sapiens
caggttcaagagattctctcacctcagcctccttagtagctgggactacaggcacacaccaccgtgcttggttaattttttgtattttagcagagatgggktttcaccatgttggccaggctggtctgaaactcctgagctcaggcaatccgcccacctcggcctcccaaagtgttaggattacaggcgtgaaccaccgcg

SEQ ID NO: 52381 - DNA, 201 bp, Homo sapiens
aagtgaccctcccacctcaggcccccaagtagctgggattacagatgtgcatgccgtctccctattcacattttattttactttattttgttttttgagaygcagtcttgctctgttgctcaggctggagtgcagtgggctgatcttcgctcacttcaactctgcctcccaggttcaagagattctctcacctcagcctcc

SEQ ID NO: 52382 - DNA, 201 bp, Homo sapiens
caagcatttagagtatgctcctaagccagggtttttatgaaccaaatcaactaaaattgtatagccaaacaaggagtctgccaattttaaccaagttgtcygctctaccatacccaaatcgcaacgagaagtgtcatgaactgcacagattcctccatgtttagtaggcatcccagcattccgtgaccgggctaagtataa

SEQ ID NO: 52383 - DNA, 201 bp, Homo sapiens
ccctctagtggacatttgacaatgtctaaagacatctttggttatcacagctggagaaaggtttggctgaccaggaatgctactaaacattttacagtacrtaggacagccttccacagcaaagaattacccggcctaaaatgtcagtagtgccagcgttgagaaaccctggtatgtacttagccccccatgtactcaaca

SEQ ID NO: 52384 - DNA, 201 bp, Homo sapiens
agtttttgttgttctagccagagagaaccatttgacatctgataggtggctacatggagacacttaacactctgggaggatacagcgtaccagagagactrccattatgactatcatgaggatcacaccaagcatttagagtatgctcctaagccagggtttttatgaaccaaatcaactaaaattgtatagccaaacaag

SEQ ID NO: 52385 - DNA, 201 bp, Homo sapiens
acctggggtcgggagttcaagaccagcctggccaacatggtgaaaccccatctctactaaaaatacaaaaattagctaggtgtggtggtacatgccggtastcccagctatttgggaggctgaggcaggaggatggtttgagcctgggagatggaggttgtagtgagccgagatcacaccattgtattccagcctggacgg

SEQ ID NO: 52386 - DNA, 201 bp, Homo sapiens
tgtagttccagctacttaggaggctaagatgggaggatcacttgagcctagaagttggaggctgcagtgagctgtgatggtgcccctgcattccagcctgsgcaacagagcaagaccctgtctcaaaaaaaagctgaagcaaagaacaaagagtgtattggtcctttcagaattccttttttttgtaaggcagggacaggg

SEQ ID NO: 52387 - DNA, 201 bp, Homo sapiens
ctactaaaattacaaaaaattagccgggcatggtggcaggcgcctgtagtcccagctacttgtgaggctgaggcaggagaatcgcttgaacctgggaggtrgaggttgcagtgagccaagattgagccactgcactccacagcctggccacagagcgagactccgtctcgaaaaaaaaaaaaaggaacaaactatgatgtg

SEQ ID NO: 52388 - DNA, 201 bp, Homo sapiens
taaaattccatctctaccaaaaatacaaaaaaattagctgggtgccaggcacagtgcctcacacctataatcccagcactttgggaggccgaggcaagtgsatcacctggggtcgggagttcaagaccagcctggccaacatggtgaaaccccatctctactaaaaatacaaaaattagctaggtgtggtggtacatgccg

SEQ ID NO: 52389 - DNA, 201 bp, Homo sapiens
tttcaccacatttggccaggctggtcccgaactcctgaactcaggtgatccatccacctcagcctcccaaagtgctcggattacaggcatgagtcactgcrctcggcctcattttatttctcttctctggacattttccatcttaatactttcatcttgagatttgacacttaggactgcacagggcattttaggtgtgga

SEQ ID NO: 52390 - DNA, 201 bp, Homo sapiens
catgatggctcacgccaccatgtaatcccagcactttgggaggccatgacaggaggattgcttgaacccaggagttcaagaccagcctgggcaacatggtmaaattccatctctaccaaaaatacaaaaaaattagctgggtgccaggcacagtgcctcacacctataatcccagcactttgggaggccgaggcaagtgga

SEQ ID NO: 52391 - DNA, 201 bp, Homo sapiens
tgctatgtaaattagatatggatgtctccatccaattaaaatattaaacaagacaagaacaagacttttcaatggagaattcatccaagttgatactgctsacccagtagtaaagcattttttgagtaagatttaaccaccattcttaaatctagactgagtaggacagaaagggaaatccctgtgtttttaaattttaat

SEQ ID NO: 52392 - DNA, 201 bp, Homo sapiens
agagagtctcaccgccaaaccttaaaagacagggcccattgttttaataatatttggactttcctttcctatcttataaatgaattaaaagactggaaaaytattgggtttaacttctttagttaaggcactaaatgtgacagctttcccttaaaattgatgcttgagtcttcagtgagatacaattagctttccctgcac

SEQ ID NO: 52393 - DNA, 201 bp, Homo sapiens
gattttctcttatgcagagtaaatcccctcagcctccttgggtactcccacaggagtttcgctgaacagaagcctactttattccatacttggaattgttyccccccccccacctgaatttgtttgattcctgctaaaattcatttaattgattttctgccttaattccagtcttttgggggattttggaataatgggtca

SEQ ID NO: 52394 - DNA, 201 bp, Homo sapiens
catcttcttatgatggatgtgagtattaatgaaataatgcatataaaagggctttgtaaactgcacagcactgcacagttgtgcgatattttgataagagyagtgctctatatacatttctaatgtattcctcatggttatttatatcctggtaattttgaagccctgtccctgttttgtgtttgggaggtggggagggag

SEQ ID NO: 52395 - DNA, 201 bp, Homo sapiens
tttaccctcttactcacttcttagcccctttattaagccacctcattttaaactgggcaaaacagaatcagccaaagagctttgccaggtttgggacaccmattcatgaccagccagcaagagagacagtgagttcaatctgagaagagtctggtgactcccagaataaaccattccttcctggccagccgtggtggttca

SEQ ID NO: 52396 - DNA, 201 bp, Homo sapiens
taaggacgtgaggcagagagtcatacctcaggagaatgtacagcaccaggtagcattaaaggtccgcagtttaccaaagggtccagatggctgagtctaartagaaacactggagaagccaagagaagtggaaagtccagccttctgaatgcttttaatttggctacatagcaagcatacataggatgagcgtgactttaa

SEQ ID NO: 52397 - DNA, 201 bp, Homo sapiens
agtatttcatgaaaaattgttgggttatctttggtcggagattatttttaaatgttcttaacagcacaaactaaaggctgtgctttttttttgtacttttytattgatatagttgtacgaggctgtactttttattgaatattcttaatattgactagagtttttttaaaaataatacagtacaaaaatattttcatgtaa

SEQ ID NO: 52398 - DNA, 201 bp, Homo sapiens
caggaggctgaggcaggagaatcgcttgaacccaggagggggaggttgcagtgagccgagatcgcaccgctgcattccagcatggcgacagagcaacactscatctcaaaaaagaaaaaaaaaattagccaaatgtggtggcacatgcctgtattcccagctacttgggaggctgtggtgggaggattgcttgatcctggg

SEQ ID NO: 52399 - DNA, 201 bp, Homo sapiens
cctcacctcaggagatccgcccacctctgcctcccaaagtattgggattacaggtgtgagctaccgcgcccagccgttgtatagcttttttaaagaaatayctattgaaggtgccgattttaaaattaggttgtcaggccgggcacctcaggaggctgaggcaggagaatcgcttgaacccaggagggggaggttgcagtg

SEQ ID NO: 52400 - DNA, 201 bp, Homo sapiens
ttactagtagcagtagaatcttttcaaatatgccttaatataggcgctggggcttgcccgtggtgctcttgatatataaggcccggacattctgccagttktttctcgagcagtgacaccaagaagttaacagccaggtgaatgttatgcacaagctcatcgtctgtcatcttcacgtggccaacagccacagccaaacat

SEQ ID NO: 52401 - DNA, 201 bp, Homo sapiens
ttttctgttgttgtggtatttgataaaattccctaaaagcattttttagagggccagctattaaaatctttaacagggaaaaggttgcttttcatagttasagtttatatgtgcatggtttgtgcatacagacatttgtctctttttcttccgtgtcctctcctctcccgcagtgaagttattcgaagtcattgaaactga

SEQ ID NO: 52402 - DNA, 201 bp, Homo sapiens
aattgaccccttcttccatggtatttgcctaaaacagctccattagacttggaaggatacgcatgatattggtgtttccacttttctgtttcaaatgctgkggtttctttgttttttcgtttttgagatggagtctccctctgtcaccaaggctggagtgcagtggcccgatctcagctcactgcaacctccgcctcccag

SEQ ID NO: 52403 - DNA, 201 bp, Homo sapiens
tgaccccttcttccatggtatttgcctaaaacagctccattagacttggaaggatacgcatgatattggtgtttccacttttctgtttcaaatgctgtggkttctttgttttttcgtttttgagatggagtctccctctgtcaccaaggctggagtgcagtggcccgatctcagctcactgcaacctccgcctcccaggtt

SEQ ID NO: 52404 - DNA, 201 bp, Homo sapiens
ggagtgcagtggtgcgatctcggctcaccgcaacctccgcctcccaggttcaaacgattctcctgcctcagccttctgagtagctgggactacaggcaccygccaccatgcctggctaatttttttatttttagtagagatggggtttcaccatattggccaggctggtctcgaactcctgaccttgtgatcctcctgcct

SEQ ID NO: 52405 - DNA, 201 bp, Homo sapiens
tcttccatggtatttgcctaaaacagctccattagacttggaaggatacgcatgatattggtgtttccacttttctgtttcaaatgctgtggtttctttgktttttcgtttttgagatggagtctccctctgtcaccaaggctggagtgcagtggcccgatctcagctcactgcaacctccgcctcccaggttcaagcaat

SEQ ID NO: 52406 - DNA, 201 bp, Homo sapiens
gggaggccgaggcaggagaatcgcttgaacccaggaggcagaggttgcggtgagccaagattgcaccattgcactccagcctgggcaacaagagcaaaacyccatctcaaagaaaaaaaaaaaaggctgcttttttttttttttttttttttttaagatggatggagtcttgcagtgtggcccaggctgcagtacagtggc

SEQ ID NO: 52407 - DNA, 201 bp, Homo sapiens
ggtatttgcctaaaacagctccattagacttggaaggatacgcatgatattggtgtttccacttttctgtttcaaatgctgtggtttctttgttttttcgkttttgagatggagtctccctctgtcaccaaggctggagtgcagtggcccgatctcagctcactgcaacctccgcctcccaggttcaagcaattctcctgc

SEQ ID NO: 52408 - DNA, 201 bp, Homo sapiens
tgatattggtgtttccacttttctgtttcaaatgctgtggtttctttgttttttcgtttttgagatggagtctccctctgtcaccaaggctggagtgcagkggcccgatctcagctcactgcaacctccgcctcccaggttcaagcaattctcctgcctcagcctcccaagtagctgggattacaagtgtgcaccaccacg

SEQ ID NO: 52409 - DNA, 201 bp, Homo sapiens
tctgtttcaaatgctgtggtttctttgttttttcgtttttgagatggagtctccctctgtcaccaaggctggagtgcagtggcccgatctcagctcactgsaacctccgcctcccaggttcaagcaattctcctgcctcagcctcccaagtagctgggattacaagtgtgcaccaccacgcccagctaattttttattttt

SEQ ID NO: 52410 - DNA, 201 bp, Homo sapiens
cctcccaggttcaagcaattctcctgcctcagcctcccaagtagctgggattacaagtgtgcaccaccacgcccagctaattttttatttttttttttgtrattttagtagagacaaggtttcaccagtgttggccaggctggtctcagactcctgatctcaagtgatctgccctcctcagcctcccaaaatgctgggatt

SEQ ID NO: 52411 - DNA, 201 bp, Homo sapiens
ctggccgggcgtggtggctcacgcctgtaatcccagcactttgggaggccaaggcgggcagatcacctgaggtcgggaggtcgaggccagcctgaccaacrtggagaaaccccatctctactaaaactacaaaattagccaggcacggtggctcatgcctgtaatcccagctactcgggaggctgaggcaggagaattgct

SEQ ID NO: 52412 - DNA, 201 bp, Homo sapiens
ctccttgggaggctgaggcaagagaactgcttgaccctgagaggcagaggttgcggtgagccaggatcacgccactgcactccagcctgggtgacagagcragactctgtctcaaaaaaaaaaaaaaaaaaaaaaaagatggatgttgtcataaacctggtctttcataaattaacctgtagtcattaatagcttagaaat

SEQ ID NO: 52413 - DNA, 201 bp, Homo sapiens
aacttttcatgtaattatttttattcaagttacatattacacacagtttaaagagtcaagacttgttaaaaaagagtcccctagactcactggtttccttrtctcccaggatggccacttttaatcttttaaagtgattctttagtcttttaaatgattctttcatactttataacatgcttgtagtcttacttgtttttc

SEQ ID NO: 52414 - DNA, 201 bp, Homo sapiens
acacattattaaacaagaatgacaaggaatgcattaaacattaaactaatagtttagaaaagggaacaaaataaatctcaggaataaataataatgtaagragtcagtaaagctaaaggcagaaaataatgaatttgaaaacagtagaaatggtaaatccaaaactttggtgggtgtccccccccctcccaccgacaagga

SEQ ID NO: 52415 - DNA, 201 bp, Homo sapiens
aataataatgtaaggagtcagtaaagctaaaggcagaaaataatgaatttgaaaacagtagaaatggtaaatccaaaactttggtgggtgtcccccccccycccaccgacaaggaagtgagaagagaggcaatgaaatagataagctactaagtgctgccagggggaagggagagaaaacacagaaaaatgagggggaaat

SEQ ID NO: 52416 - DNA, 201 bp, Homo sapiens
ccacttggggggatatccgtggccttggtctcgccacagtgctgctgttcccccaggacccacacttgggacagggagtggacttaagcctgacggtgccygagaagcgcttgtccttctgggggtcatagttcttcaagctgatctgcaactccaccatcttcaggaacttggggcactttcactggttcccgtgcagga

SEQ ID NO: 52417 - DNA, 201 bp, Homo sapiens
aggaggaggatattgagcagaaccataagaaactagtgattaagagtccaggtgtgaaaatagaaaccacgtctcagaagctcagagagaagaagaactgraaaggcagcatctttgatggatttggccatgaagaggaggaggaataaagcagaatggaggccagaaaagagtgtgtatgtctaacggtttcattggaat

SEQ ID NO: 52418 - DNA, 201 bp, Homo sapiens
ttctgtgtataatctctctctctctctctttttttcttggtttggaggagactttccccttgtctataagtaacttaaatataaaatgttataacaatacrtttattagtttgaagccccaattttctttttttttttttcttttaagtgaaaacaagtttataaaagaagtaaagaaacaggccaggcgctgtggctcac

SEQ ID NO: 52419 - DNA, 201 bp, Homo sapiens; identical to SEQ ID NO: 9800

SEQ ID NO: 52420 - DNA, 201 bp, Homo sapiens
attgtaaagaaaagatttgctacattgcatatgtttttagaagtgctttctgtgtataatctctctctctctctctttttttcttggtttggaggagactytccccttgtctataagtaacttaaatataaaatgttataacaatacgtttattagtttgaagccccaattttctttttttttttttcttttaagtgaaaa

SEQ ID NO: 52421 - DNA, 201 bp, Homo sapiens
ttacttgatattccctggtcatggcaaagcctctctccacttttcttcccttctattgtcacttccattctttttccatagtccatagaaatcatttttaygtgacagtgatgagctgaccagaagctatagaagctatagtacttcctatatcctaatgggttttaaaaacactggctggggcatactcaccctttctga

SEQ ID NO: 52422 - DNA, 201 bp, Homo sapiens
aattttttggttgagctcattcttttccaagaaaaagaatagatttccagctccatctttttttttttttttttttttttttttttttgagacaaatctcrctttgtcgcccaggctggagtgcagtggcgcgatctcggctcactgcaagctccgccccctgggttcacgccattcttctgcctcagcctcccaagtagc

SEQ ID NO: 52423 - DNA, 201 bp, Homo sapiens
tctcttcagaatctcaaatcttaaaaggttttgtattttctaaacacaaataaaagctggaaagccaatcagtagtaatctgaaagttcacaatgtcagtwgacgtctcatggtattgggaagaaagataagcattgaggctaatatcaccctatgcttgattaagtttttgttttatatgttaaaatcactaaaccgaaa

SEQ ID NO: 52424 - DNA, 201 bp, Homo sapiens
gaccaaaaagtgtgagaatgtttgatgtagagaaactccaagctcattccctggactttggctatagatgctttcttcaggggtgggtcttctgggcctgwgtcctgcaggatgcccagtaggaagcacagcctctttgatcttatgggggtgggctcatttgctgttttggagctcaggtgcaaagccgagttacttgat

SEQ ID NO: 52425 - DNA, 201 bp, Homo sapiens
aaataaagaaaaataaaggttattgaaagtattttacatttcagttacggtgactggtggttgatctctggagaacagtcatcacacagccaaacaaatgkgggcctccagaaatgtatggtcacgcccacagcatcctcagtgccacccggcattcatttctgctgctttcatcagtattctctcccgttaacagcagtg

SEQ ID NO: 52426 - DNA, 201 bp, Homo sapiens
agttctagcagcaatctttcacttgctaaggttaggccgagcagtgatctcaacaacagtactggccagtctcctcaccacaaagtgcagagaagtgtttyttcaagccaaaagcaaagacgctacagtgaccatggtaagttttggagtatcccagtgccttctcttagagtccaggcaagaggtctcctagcactggga

SEQ ID NO: 52427 - DNA, 201 bp, Homo sapiens
atttatttgatggagtctcattttctcgcccaggctggagttcagtggcaccatcttggctcactataacctccgtttccaggtttcaagtggttctcccrcctcagcctttcaagtagctggtgggattataggcatccgccaccaagctcagctaatttttgtatttttagtagagacggggtttcaccatgttggcca

SEQ ID NO: 52428 - DNA, 201 bp, Homo sapiens
agatggaaatgttctgaatcttgactgatggtgaccacatgaatctgaacatgtaataaaagagtatagaatgagatacacaaacatacaaattagtgcargtaaaactggggaaatctgaacgaggtcagtggattagatcaaggtctgtttctcttcagaatctcaaatcttaaaaggttttgtattttctaaacacaa

SEQ ID NO: 52429 - DNA, 201 bp, Homo sapiens
atctttggaatagtgaccggatgccgtggctcatgcctgtaatcctagcacttcgggaggctgaggtgggcagatcgcttgagcccaggagtttgagaccrgcctgggtaacataaggagacctcatttctacaaaaaattagctggacatggtggcacgtgcctatagttccatctactcgggaggctgaggtgggatga

SEQ ID NO: 52430 - DNA, 201 bp, Homo sapiens
ttttgtgtttgtttgtttgtttgtgactgagtctcgcactgtctcccaggctggagtgcagtagtgcgatctcagctcactgtaacctctgcctcccaagktcaagcgattcttgtgcctcagcctcctgagtagcagggattacaggcgtgcgccaccacacccagctaatttttgtatttttagtagagaccaggtttc

SEQ ID NO: 52431 - DNA, 201 bp, Homo sapiens
gcacagtggctcacaagccctgtcatcccagcacttcgggaggcctagacaggaagatcacttgaggccaagagttcaaggtcagcctggacaaagtagcstgagacccccgtctctataaaaatatatatattttttaattttaaaagatagtcatgaatacaaaacagttgggaagattaataggaactctcttcatgc

SEQ ID NO: 52432 - DNA, 201 bp, Homo sapiens
ggagtatcccagtgccttctcttagagtccaggcaagaggtctcctagcactgggaagcattctcttgctcagagcctggcttgatgtcctttcttggcawtgctttctttctttcttcttttttttttttttttttttttttttttgagacagagtctcactctgttgcccaggctggagtggagtggcacgattttggc

SEQ ID NO: 52433 - DNA, 201 bp, Homo sapiens
ttagagtccaggcaagaggtctcctagcactgggaagcattctcttgctcagagcctggcttgatgtcctttcttggcattgctttctttctttcttcttytttttttttttttttttttttttttgagacagagtctcactctgttgcccaggctggagtggagtggcacgattttggctcactgcaacctccacctccc

SEQ ID NO: 52434 - DNA, 201 bp, Homo sapiens
tcttggcattgctttctttctttcttcttttttttttttttttttttttttttttgagacagagtctcactctgttgcccaggctggagtggagtggcacrattttggctcactgcaacctccacctcccaggttcaagcgattctcctgcctcagcctcctgaatagctgggactacaggtgtgtaccaccatgcctggc

SEQ ID NO: 52435 - DNA, 201 bp, Homo sapiens
aggctggagtgcaatggcatgatctcggctcactgcaacctcagcctccgaagtagctgggactataggcacacaccaccacacctggccaatattgtatytttagtagagacgggatttcaccatgttggccaggctggtctagaactcctgacctcaggtgatccacccaccttggcctcccaaagtgctggattacac

SEQ ID NO: 52436 - DNA, 201 bp, Homo sapiens
cctgaccaacgtggtgaaaccccatctctactaaaaataaaaaaattacctgggcatggtggtgtgtgcctgtaattccagctactcaggaggctgaggtrggagaatcgcttgaacctgggaggcagaggttgcagtgagccaagatcgtgtgactgcactccagcctagtgacagagtgagagtccatctcaaaaaaaa

SEQ ID NO: 52437 - DNA, 201 bp, Homo sapiens
tactcaggaggctgaggtaggagaatcgcttgaacctgggaggcagaggttgcagtgagccaagatcgtgtgactgcactccagcctagtgacagagtgasagtccatctcaaaaaaaaaaaaaaaaatttgtacttaagtgtaatatatagccagttgtggccagtaactctcataatagacaggacagccctggagaat

SEQ ID NO: 52438 - DNA, 201 bp, Homo sapiens
gctgaggtaggagaatcgcttgaacctgggaggcagaggttgcagtgagccaagatcgtgtgactgcactccagcctagtgacagagtgagagtccatctmaaaaaaaaaaaaaaaaatttgtacttaagtgtaatatatagccagttgtggccagtaactctcataatagacaggacagccctggagaatatatggaacc

SEQ ID NO: 52439 - DNA, 201 bp, Homo sapiens
agactgaagcaacagtgtactaatatcactagtaaaccatctacagtgcctgctattctagggtgtaactgagagctcagaactcattctcacatcaggayttgtgctcctagcatttgtaggtgacgtgttgatctaggtctgccttttttgtgttcatgttagtcactaacaaggggggtttctagtgcttatggacca

SEQ ID NO: 52440 - DNA, 201 bp, Homo sapiens
gtgtctactaaaaatacaaaaacaaaatcagctgagcttggtgtcaagtgcctgtagtcctagctgctcaggaggctgaggcaggagaatggcgtgaaccygggaggtggagcttgcagtgagccaagatcatgccactgcactccagcctgggccaacagagcgaggctccatctcaaaaaaaaaaaaaaaaaaatgaaa

SEQ ID NO: 52441 - DNA, 201 bp, Homo sapiens
ccacagcctggccacagagcgagactccgtctcgaaaaaaaaaaaaaggaacaaactatgatgtgcacaactcagatggatctcaagggaattatactgcrtgaaagtacacaaaaggttacattccatggatgcccattcatataacattcttgaaatgacagaattctagagatggcgagcaggttagcggttgcaggg

SEQ ID NO: 52442 - DNA, 201 bp, Homo sapiens
gactgcaatgtctcataattatcacactctgcttttctccatctctgtggctttacatattctcagtgttcagctcttggtctgcaacatatctgcgtacraacacacacacacacacacacacacacacacacacacacactgaggaatggctcccgggtcccagtagttcccactctctggtagaggagttgtgtttgt

SEQ ID NO: 52443 - DNA, 201 bp, Homo sapiens
cattttgtgacagcctaatcaaaaattctctcctccttcatccttagttccaaactgcttatcacttccctgttccataggccacttaggattgagttgayatgaggagtaacatttgttctgtaagattatggttattattcgttgaatttttagcaatatttacattctcttgttctcttttatgactcgtgtgtgtgt

SEQ ID NO: 52444 - DNA, 201 bp, Homo sapiens
tacaggtgtgagccaccgcgcctggccttatttatttgtttattttttgagatggaattttgctcttgttacccaggctggagtgcaatggcatgatctcvgctcactgcaacctcagcctccgaagtagctgggactataggcacacaccaccacacctggccaatattgtatttttagtagagacgggatttcaccatg

SEQ ID NO: 52445 - DNA, 201 bp, Homo sapiens
tcaaaaattctctcctccttcatccttagttccaaactgcttatcacttccctgttccataggccacttaggattgagttgatatgaggagtaacatttgktctgtaagattatggttattattcgttgaatttttagcaatatttacattctcttgttctcttttatgactcgtgtgtgtgtgtgtgtgtttcaacattg

SEQ ID NO: 52446 - DNA, 201 bp, Homo sapiens
tccagcagagaagggtcactaggatacaatgtggcatgcatgagctaaaaacagaagtgatttaactctcagagggaaaatggatcagataacacttcatrgagatgacgacatctggttcatttttgaagagtgaatagaaagatcccagccctccataccaagagaataactcctgcaaacattttctgacctggtgcc

SEQ ID NO: 52447 - DNA, 201 bp, Homo sapiens
ttttcctttttttttttttttttaaatggagatgggggtctcgctatgttgcccaagctggtctcaaactcccaagttcaaactattctctcaccacagcsttctaaagtgctaggattacagacgtgagccaccatgcccagcgctagaactgggcgctgtaccgaactgaatagaactgctagtctgtagttctattca

SEQ ID NO: 52448 - DNA, 201 bp, Homo sapiens
ttgggaggccgaggcgggtggatcacctgaggtcaggagttcaagaccagcctggccaacatggcaaaaccctgtctctactaaaaaaatacaaaaattarctgggtgtggtggcacgtgcctgtaatcccagctacttgggggaggccaaggcacgagaattgctcgaacccgggaggcggaggttgcagtgagccaaga

SEQ ID NO: 52449 - DNA, 201 bp, Homo sapiens
ttctgatctcatagcactattcctgatcagagaactccagttgcttcaacacacagtatcagtagtgcagccaccccagatcgaatccgcttcccaagagkcactgccagtcgtagcactttccacggccagccccgggaacggcgaaccgcaacatataatggccctcctgcctctcccagcctgtcccatgaagccaca

SEQ ID NO: 52450 - DNA, 201 bp, Homo sapiens
ctgctttaatctgtagttttcctttttttttttttttttaaatggagatgggggtctcgctatgttgcccaagctggtctcaaactcccaagttcaaactrttctctcaccacagccttctaaagtgctaggattacagacgtgagccaccatgcccagcgctagaactgggcgctgtaccgaactgaatagaactgctag

SEQ ID NO: 52451 - DNA, 201 bp, Homo sapiens
ttcactttctcaatttcctctgtggccagattcatcaggcattcagtcactttcatctctgtcaggctggccttgtgttctgtctgtctgttctgctgcayagttgtcatcctgagatctcccttcacccatatcctagggattccctttgcctttcctgttcgatccattttcttccccttggttcactcccaggtttca

SEQ ID NO: 52452 - DNA, 201 bp, Homo sapiens
cctgggcccaagcaatccttccacctcagcctcctgagtagctgggaccagaggtgtgtactaccacatccggctgattttttgtattttctacagagacraagcatccccatgttgctcaggctggtctcgaactcctgggctaaagtgatccttctgcctgggcctcccaaagtgctgggattaaagggatgagccacc

SEQ ID NO: 52453 - DNA, 201 bp, Homo sapiens
gtggcatgatcttggctcactgcaacctccacctcccaggtcccagcagttctcctgcctcagcctcctgagtagctgggattacaggcatgcacaaccayacccggctaatttttgtatttttaatagagacagggtttcaccatattggctaggctggtcttgaacttgggagctcaagcaatccactcaccttggcct

SEQ ID NO: 52454 - DNA, 201 bp, Homo sapiens
tgaaaagagtgaattgtttaaattctttgcaaacccctttaatatctggcttaatagaagttagctgggttcctgtgtctgctctgcattcacactatttmagtatgttgttttggttgaagtgtataaagaaatgtagctacaaaaggaagggagcatattaataccttttcaggtgattgtggatattgttctttgaca

SEQ ID NO: 52455 - DNA, 201 bp, Homo sapiens
atgcctgtaatctcagcacttggggaggctaaggcagaagtgtcacttgaggtcaggagtttgagaccagcctggtcaacatggtgaaaccctgcctctaytaaaaatccaaaaaaattagctgggcgtggtggcgcgcacctgtaatcccagctactcaggaggctgaggcaggaaaatctcttgaacccgggaggcaga

SEQ ID NO: 52456 - DNA, 201 bp, Homo sapiens
cttcatcttccattctttctgttaaaaatgtgtgtgtgggccgggcacggtgactcatgcctgtaatctcagcacttggggaggctaaggcagaagtgtcmcttgaggtcaggagtttgagaccagcctggtcaacatggtgaaaccctgcctctactaaaaatccaaaaaaattagctgggcgtggtggcgcgcacctgt

SEQ ID NO: 52457 - DNA, 201 bp, Homo sapiens
aaaggagcattgttatacaacaccccagggagtgatcacaatgaaattagtgatataattaggaactaagaacttgaggaggaagactgaccctatgaagktgtggggtcagtgaattacagatcctggtaagttccaacagttattagagtactagattgagtgagcaggaaggtagaagaagttagttaaagaatggga

SEQ ID NO: 52458 - DNA, 201 bp, Homo sapiens
agaatctcttagtaagatgaaatacgatgaaatcacagctacatatttgttattggggagaaaatcttcagaggtaagagtaatcagaaagagctgaaatrccctgtatgtaattattagtttatataaactgttttcttagtttttatcttttgaatatttgtaacatttgatacatcattttttagatttacttgcaaa

SEQ ID NO: 52459 - DNA, 201 bp, Homo sapiens
agagtcagcatggcgttgtgctactctccagccacattcagttgcccagctgcaggcatggcatttgcagagattggggttttgtcacattagtatagtgraaggacaaaggagcattgttatacaacaccccagggagtgatcacaatgaaattagtgatataattaggaactaagaacttgaggaggaagactgaccct

SEQ ID NO: 52460 - DNA, 201 bp, Homo sapiens
gaccaccattatctcataggtgattccgacactactttcttatatgttcttctctgtttctagtgcctcttcctcccatgtatgttttctacactgcaccsaaaatggtcttttaaggaaacacaaataagatggtcatttctctgcttgaacaactcttcattggcttcccattgctcttacgatgaaaacccaaacttc

SEQ ID NO: 52461 - DNA, 201 bp, Homo sapiens
atatctgaggcatatactagttatcatgttcatttccaagattctttgccctctgaatctcctgtgctgctattggagtctctatatggtttactacaggrcattagtctgtcatccacatgtccctaggcacatgtccctggacacactcctcctggagtggcaggaatgactagtgacctccaccgacttcctccctgt

SEQ ID NO: 52462 - DNA, 201 bp, Homo sapiens
tctactcaactacaccttcccctgtctactcaaactccggtttatctagaagattatgagtgcttttaaaaagatccaagataaaacttcaaaagaagtgrcccataaaatctatacttttctcttccaaaaggtgatggcatctctcctacaaaagaggatgtaattcactcagatgtacaagatgaactggttcattct

SEQ ID NO: 52463 - DNA, 201 bp, Homo sapiens
gttatttcggacacctgctgagccttaggttgtcaggtgctgagacatggaaagacctcacagtctaacaggaagtgaatgaaaacagtgacagtgcagayggaagcctacgtgcacacacggggaggtctgactgccagtgccccaaagatgtggtgttcacactgagtcttcaaagagctctaatgatgaagagtgttg

SEQ ID NO: 52464 - DNA, 201 bp, Homo sapiens
tttaggctgggcacagtggctaacccctataatctcagcgctttgggaggctgaggtgggaggatcacttgagcccaagagtctgagatcagcctgggcaycagagtgagacctcatctctacaaaaaaaattaaaaagaaaatagctgagcgtgatgatgcacacctgtagtaccagctacttgagagcttgagaggctc

SEQ ID NO: 52465 - DNA, 201 bp, Homo sapiens
cctgttctgaatattttatataaatggaaccatttcacatgtatccttttgtgtctacttctttctttgactcagcataatgttttcatggttcatccaakttgtagcatgtattttcttttccctttttttttttttgagatggcatttcgctcctgttgcccagagtgcaatggcacgatcttggctcactgcaaactc

SEQ ID NO: 52466 - DNA, 201 bp, Homo sapiens
tgtctacttctttctttgactcagcataatgttttcatggttcatccaatttgtagcatgtattttcttttccctttttttttttttgagatggcatttcrctcctgttgcccagagtgcaatggcacgatcttggctcactgcaaactccacctcccgggttcaagcgattctcctgcctcagcctcctgagtagctggg

SEQ ID NO: 52467 - DNA, 201 bp, Homo sapiens
caattgtgtacaaatttctatgtggacttaaatgttttaatttctttccttctttcttggggaggagacggtctcactctgtcacctaggctaaagtacartggtgcaaacacggctcattgcaacttcgacctcccagacccaagtgatcctcccacctcagcctcccaaatagctgataccacaggcatgcatcaccat

SEQ ID NO: 52468 - DNA, 201 bp, Homo sapiens
agctttcctagcaggtatgaagtagtacctcatgcttttgatttgcatttctttaatgaccaatgatattgggcatcttttcatgtgtttcttggccataygtatagctttttttttttttttttttttgagactgagttttgctcttgttacacaggctggagtgcaatggtgcgatctcagctcaccgcaacctctacc

SEQ ID NO: 52469 - DNA, 201 bp, Homo sapiens
atgcttttgatttgcatttctttaatgaccaatgatattgggcatcttttcatgtgtttcttggccatacgtatagctttttttttttttttttttttgaractgagttttgctcttgttacacaggctggagtgcaatggtgcgatctcagctcaccgcaacctctacctcccaggtttaagtgattctcctacctcagc

SEQ ID NO: 52470 - DNA, 201 bp, Homo sapiens
ccaaagtattgggattacaggtgtgagctaccgcgcccagccgttgtatagcttttttaaagaaatatctattgaaggtgccgattttaaaattaggttgwcaggccgggcacctcaggaggctgaggcaggagaatcgcttgaacccaggagggggaggttgcagtgagccgagatcgcaccgctgcattccagcatggc

SEQ ID NO: 52471 - DNA, 201 bp, Homo sapiens
tttttttttttttttttttttgagacaaatctcgctttgtcgcccaggctggagtgcagtggcgcgatctcggctcactgcaagctccgccccctgggttmacgccattcttctgcctcagcctcccaagtagctgggaatacagatgcctgccactacgcccggctaattttttgtatatttagtagagacaggatttca

SEQ ID NO: 52472 - DNA, 201 bp, Homo sapiens
cacaccattctcctgcctcagcctcccgagtagttgggactacaggcacctgccaccacgcctggctaattttttctattttttagtagagacggggtttygccgtgttagccaggatggtcttgatcacctgacctcgtgatcctcccgcctcgacctcccaaagtactggaattacaggcgtgagccactgtgcccatg

SEQ ID NO: 52473 - DNA, 201 bp, Homo sapiens; identical to SEQ ID NO: 9797

SEQ ID NO: 52474 - DNA, 201 bp, Homo sapiens
tatatttaaaaattagagcattgctaaaagtgaaacatcaatttatgggaaaattaatactcagaagtaggatttctacttacttttatttctctcacctrtaggtgaagtatttgactatttggttgcacatggcaggatgaaggaaaaagaagcaagatctaaatttagacaggtatgaattaatgtgtctttactatg

SEQ ID NO: 52475 - DNA, 201 bp, Homo sapiens
ctgcttgggcagaggcctgggtgggcacgttcacacagatttctggggaagagcactgcttgggcctgaggcctgagtgcatggcgtgcctggagcagagygtagagatgcttctcctacatggcagcagctgaggggatgacaagggccttgtggccttgggctttcagaggatcaccaggcagctatgtttggaactca

SEQ ID NO: 52476 - DNA, 201 bp, Homo sapiens
aatgcctgtagttaaagccagcttagttcaaattccacatatttctggctaactttatatctatatttaaaaattagagcattgctaaaagtgaaacatcratttatgggaaaattaatactcagaagtaggatttctacttacttttatttctctcacctataggtgaagtatttgactatttggttgcacatggcagga

SEQ ID NO: 52477 - DNA, 201 bp, Homo sapiens
aaagcaaactgatctgctacgatgaggagatgtattagagatgtgaggaggttaaaataattgccagataagcaggagagtgaatggactagagaaatgtwatagaattgccaggcagccttaaggcttccctgaggttggtgaccaaggatttaaagtgggaagagtcagcatggcgttgtgctactctccagccacatt

SEQ ID NO: 52478 - DNA, 201 bp, Homo sapiens
tttgaacaaaatcattttactcttgtggggttttttttgcctattgtagatatgacatataaaatgtaaacattatagaaatatagaaattcattatgtaraaagtaagttccttgaaatttgtctcttcaaagacaatcactttcagcagtttggtgtatattcccagagttttttatatagacattaacttttaaaaaa

SEQ ID NO: 52479 - DNA, 201 bp, Homo sapiens
tctgggcatggtggcgtgcccctgtaatcccagctactcaggaagctgaggcaggcgaattgcttgaacccaggaggcagaggttgtggtgagccgagatygcaccactgcagtccagcctgggcaacaagagcaaaactctgtctcaaaaaataaagaaagaaaataaagtaaagaaataggaggaaagcagagggtgcc

SEQ ID NO: 52480 - DNA, 201 bp, Homo sapiens
agttctaatgacaatcagaagtttcttttcttatccctctttttcctcagcattattactcaaaggccccaacttttttaagctctttcttctgttactcyaatagctttctccaaatttatcattttaaacatcattgacttccacttcccacttccatatctacatttctttccctagcttttctattgcagtgatata

SEQ ID NO: 52481 - DNA, 201 bp, Homo sapiens
gagcacgtgaagaggtgaatgggcaaggaaggcttccaggtcaggtagcatttccagtgttccagcctgcaggcatctaccgagcctggcccgaggctggyacccagagatgcttccagtcttccagcagcaacgcactgactgtaagaaaagcctgcttataaaccccctacaggcatttggaagctggtccctggggtc

SEQ ID NO: 52482 - DNA, 201 bp, Homo sapiens
ttgcttgatcctgggaggcagagccaagattgctccactgcactccagcctgggtgacagagtaagaccttgcctcaaaaaacaagtaaataaaagactgrcattcctatttatgtagataagttcattttttctcattgtactgtatttaccaaataaatttaagacaaaaatgcccttttttatagagtaacacagcat

SEQ ID NO: 52483 - DNA, 201 bp, Homo sapiens
accaccagctccttgagggcaagaggcgcctgctgccctcagggtccgcgcccagcccgcagctgctcagatccggagacgggaaggtttgttggcgagarcctgactcccgggtcacagttaaggatgcaagagcccggcgccttcccgtagccccggccctgtcattaattaatgctggggctccattcggtgcagcgc

SEQ ID NO: 52484 - DNA, 201 bp, Homo sapiens
gtgtttcaacattgtcttttcttatgattaaaaactactaagaacttgagtatagcagctggggtagatagtttacagataatgattgatataggtatttytttttttttttttttttttttttttttgagacagagtctcactctgtcacccaggctggagtgcagtggcctgatctcggctcactgcaagctccgcctc

SEQ ID NO: 52485 - DNA, 201 bp, Homo sapiens
ggagtgcagtggcctgatctcggctcactgcaagctccgcctcccgggttcacgccattctcctgcctcagcctcccgagtagctgggactacaggcgccygccaccactcccaggtaattttttgtatttttagtagagacggggtttcaccatgttagccaggatggtctcgatctcctgaccttgtgatccacccacc

SEQ ID NO: 52486 - DNA, 201 bp, Homo sapiens
tggtagatttgtattatagttcagttcttaactttcaaatttcttctagttcaaaagtgacttaatagaaaatatcaatagaagacttaattagaagtttstggtgttacagattgtagtctacaggactacagaaatgtttcatggtcaggcacagtggctcacacctgtaatcccagcactctgggaggccaaggcagg

SEQ ID NO: 52487 - DNA, 201 bp, Homo sapiens
caaagggtgtcttcatataagcatcccttgggtgcagcaggttcaaatcctataaacatgaatgttcacttctcattcaggtgtctgatgtccctcaagtrccttactctcctgtgctacccactcagtcaccaggtccttttgctgctgtgttccaagtatctcttaagctcactcttttatgtccctgttacactatcc

SEQ ID NO: 52488 - DNA, 201 bp, Homo sapiens
ggtagatttgtattatagttcagttcttaactttcaaatttcttctagttcaaaagtgacttaatagaaaatatcaatagaagacttaattagaagtttckggtgttacagattgtagtctacaggactacagaaatgtttcatggtcaggcacagtggctcacacctgtaatcccagcactctgggaggccaaggcaggt

SEQ ID NO: 52489 - DNA, 201 bp, Homo sapiens
tgctttagatacccggacgacactgtttagactacttcatttaaagaccccagagaagtgacgtgctggtgttacagtaatgcaaacagaatcttttcttyttttttttttctttttttctttttttttctgcgatggagtctcgctcttttacccaggctagagtgcaatggcacgatctcgggtcactgcaacctccat

SEQ ID NO: 52490 - DNA, 201 bp, Homo sapiens
ccacccccgggtttaaacgattcttatacctcagcctcctgagtagctaggattacaggggcccgccaccacacccaactaatttttgtatttttagtagwgatgggtttttgccatgttggccaggctggtctggaactcctggcctcaagcaatccacccgcctcagcctcccaaagtgctgggattacaggcgtgggc

SEQ ID NO: 52491 - DNA, 201 bp, Homo sapiens
ccgccaccacacccaactaatttttgtatttttagtagagatgggtttttgccatgttggccaggctggtctggaactcctggcctcaagcaatccaccckcctcagcctcccaaagtgctgggattacaggcgtgggccaccacgcccagcctcaagttaataatttataatcccagcactttgggaggccaagacgggc

SEQ ID NO: 52492 - DNA, 201 bp, Homo sapiens
gaacccaggaggcagagcttgcagtgagcagagatcacactgcactccagcctgggcgacagagtgagactccgtctcaaaaaaaaaaaaataaataacayttgtgtgcattcatgtgtacgtgtgtctgtacacatgtacaagaaacaaccgagcatttctttaaaaaccttagtcagttagaactgtctctgttgcagg

SEQ ID NO: 52493 - DNA, 201 bp, Homo sapiens
ctccatataagcctaatccctatatataaaaaatcacggaattccacagttttgaacatttttttttctttttgagacagagtcttgctctgtcgcccagyctggagtgcagtggtgcaatcttggctcactgcagctctctacctcctgggcccaagcaatccttccacctcagcctcctgagtagctgggaccagaggt

SEQ ID NO: 52494 - DNA, 201 bp, Homo sapiens
aagattatcattgataaaaatatcagctacctctttttttttccccacagagtctcactttatcgcccaggctggagtgcagtggcatgatctcagcccayggcaatcttcgccttccaggttcaagtgattcctgtgcttcagcctcccgagtggctgggactacaggcgcccaccatcgcgcctggctaatttttgtat

SEQ ID NO: 52495 - DNA, 201 bp, Homo sapiens
gaagatttgtcccgtgacttaaaaaacagttctataggccgggtgcagtggctcacgcctgtaatcccagcactttgggaggccgaggtgggtggatcacraggtcaggagatcgagaccatcctggataacacggtgaaaccctgtctctactaaaaatacaaaaaattagctgggcatggtggcgggcgcctgtagccc

SEQ ID NO: 52496 - DNA, 201 bp, Homo sapiens
tcctccttccgaggattccaatctgccttccaaggagctgggattacaggcacacaccaccatacccagctaaagtatatttttcattgtaccaaggactyattatgctattttagaaaagtcaccaaggaaccaagtattttaagtgggttaaacttagagcatagcctggacccatttgcagaaaatataaacttgggt

SEQ ID NO: 52497 - DNA, 201 bp, Homo sapiens
cttcatagttggattaaaaaaaaatcacaaggaatataatagtgggaagaaaatcttgtttccttgattttcatttcaatcctttggggctagctagccarctctggatttcaaattccaacttttcacacccgtcctcccgccccccacaaaaaaactttatcactgttgcctagaacaagctaacgtaaacatgtttat

SEQ ID NO: 52498 - DNA, 201 bp, Homo sapiens
tcttgaactcctggcctcagatgattcgtccacctcggcctcccaaagtgctgggatcataggtgtgagccaccgtgcccagcccccatattattattatyaattgaaaaactcaaggcttttcttgatcttgggacattgatgtttaaattagtgctagaattaatctgtacttcatgtttgttattgttaatattataa

SEQ ID NO: 52499 - DNA, 201 bp, Homo sapiens
gtgatgtacctactttattattctaccaaaatggaatagagtgttcattttcgtacatgcttctacactgtagataatttttgtctatctgaaggtctcartctgtttttgctgctgtaacacaataccagggactaggtaatttataaagataagaaatttatttcttacaattgtggaggctgggaagtccaagatcca

SEQ ID NO: 52500 - DNA, 201 bp, Homo sapiens
ctcccgggtttaagcaattcgcctgcctcagcctcctgagtaagtgggattacaggtgtgtgccaccacgcccagctaatttttgtatttttagtagagakgggatttcatcatgttggccaggatggtctcgatctcttgaacccatgaactgcccacctcagcctcctaaagtgctgggattacaggtgtgagccacca

SEQ ID NO: 52501 - DNA, 201 bp, Homo sapiens
acggacattcgagcgtatactgagtattcaatatgtgtgaacattaacaaagttattttcatcttaattacgaatctgcaccagtgatgactgactctgcrtctctcctattcagattgtgtctgcagttcaatactgccatcagaaacggatcgtacatcgagacctcaaggtgagtagaagtgcctcactcagtgtatg

SEQ ID NO: 52502 - DNA, 201 bp, Homo sapiens
ttgccctcacccatgaatttctccagactggaaagttcaaggcataggaaaattgtttttagaaatccacacggacattcgagcgtatactgagtattcawtatgtgtgaacattaacaaagttattttcatcttaattacgaatctgcaccagtgatgactgactctgcgtctctcctattcagattgtgtctgcagttc

SEQ ID NO: 52503 - DNA, 201 bp, Homo sapiens
tacttagatttatgatctttttatatatttttgtcattcataatttctttttgaggcaagttccctggccacccgcagtagctcatgcctgtattcatagygctttgggaggccaaggcaaggaggatcacttgagcccaggagtacaagactgcattgtgctatgattgtaccgctgtactccagccggggcaacagagg

SEQ ID NO: 52504 - DNA, 201 bp, Homo sapiens
atgccttagtactgctgcaacagcaattacgtttcaccatgagtttgggaggggacattcattcaaaccatagcacgtatggacaaaaaaagggtgtagaraaaaccagaagttgctttttcccttttcactacttagatttatgatctttttatatatttttgtcattcataatttctttttgaggcaagttccctggcc

SEQ ID NO: 52505 - DNA, 201 bp, Homo sapiens
attcaaacatgtaatctgctattttattttaaggtaatagatttttatgattactgtttggaaaaaaaaaaagcaactataggttagcagttgctccagartctccaaaacaagcttaggagatttttattctttaccagaaatgagatggcttgggaggaaggtgtgtgcattacacacaggttgctctgtggtcactgc

SEQ ID NO: 52506 - DNA, 201 bp, Homo sapiens
catgggattccataaaaatcccgatactccccttatatggcacaatttacattgtattggaattgctcgtttgtctgtctccttctctagtttgtaggctrtctccagtctgtaggggaagatgacagaacttaacacagtgcttggaacctgttaggtacttaataaatatttgctaaatgaatgcaataatactgtttt

SEQ ID NO: 52507 - DNA, 201 bp, Homo sapiens
ctcaatctcttgacctggtgatctgcccgcctcaacctcccaaaatgctgggattgcaggtgtaagccagcgtgcccaacctttgatgtagtttcttgcayttaggtctttgcgcctgcttttccctgtacctgaaatactctttactcttctgtttagggaacatttctgagaagtaatcattgacaaatcccctttccc

SEQ ID NO: 52508 - DNA, 201 bp, Homo sapiens
tatcgtgattgtaaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagatca

SEQ ID NO: 52509 - DNA, 201 bp, Homo sapiens
aatgtcaggttacttcacactacatttttttctgtaaggattaaagcagtaggaactttgttattgtgccaattgaagttttttcttttcttttcttttctttttttttttttttgagacagagtcttgccctgtgacccaggctggagtgcagtggtgtgattttggctcactgcaacctctgcctcccgggttcaagag

SEQ ID NO: 52510 - DNA, 201 bp, Homo sapiens
atgtcaggttacttcacactacatttttttctgtaaggattaaagcagtaggaactttgttattgtgccaattgaagttttttcttttcttttcttttctttttttttttttttgagacagagtcttgccctgtgacccaggctggagtgcagtggtgtgattttggctcactgcaacctctgcctcccgggttcaagaga

SEQ ID NO: 52511 - DNA, 201 bp, Homo sapiens
ttcacaacagtcctgtgaagcagttgttttctttttttttctttgagacagagttttgctcttgttgcccaggctggagtgcaatggcgtgatctcggctmaccgcaacctccacctccctggttcaagtgattcccctgcctcagcctcccgagtagctgggattacaggcacccgccaccacgcccagctaattttttt

SEQ ID NO: 52512 - DNA, 201 bp, Homo sapiens
tctttgagacagagttttgctcttgttgcccaggctggagtgcaatggcgtgatctcggctcaccgcaacctccacctccctggttcaagtgattcccctscctcagcctcccgagtagctgggattacaggcacccgccaccacgcccagctaatttttttgtatttttagtagagacagggtttctccatgttggtcag

SEQ ID NO: 52513 - DNA, 201 bp, Homo sapiens
attgggctcggcaccatcagacataacttcttcccacacacagctgtgctcaagcagaagccctcaggtggtctccttgatctgtgtggggcctagagttrcttccaccacagcaaaatctcattattgttgctgcaggaaaagaatggatactgagtggcagaaatacgaaactggataaatttttgcctttataagaca

SEQ ID NO: 52514 - DNA, 201 bp, Homo sapiens
ttgattaagcccaggagtttacagctgcggtgagctgtgattgcaccactgcactccagccagggtaacagagcaggagcccctcttaaaaaaaaaaaaaraaaagaaaagaaaaatctcattatggttttaatgtaacattttcctaattactgatgaggtcatgcattttttcatatttaggttttttgtttcttctgt

SEQ ID NO: 52515 - DNA, 201 bp, Homo sapiens
ggtgaaaccccgtctctactaaaaatacagaaaattagccaggcgtcgtggcaggcgcctgtagtcccagctactcgggaggctgaggcaggagaatggcrtgaagccgggagacggagcttgcagtgagccgagatcgcgccacagcactccagcctgggcaacagagcgagactctgtattaaaaaaaaaaaagtgtga

SEQ ID NO: 52516 - DNA, 201 bp, Homo sapiens
taggtgctgtagaggccatatacctgggacacatagctttcctgctctttaggatttcctgctccttgcaggacaaagcagcctgagctttatgaaactartctgtaactctcaaacttaagcaaacattagaatcacctgaagggctttagaaccgtgatcactgggccctacccctagaccttgattttacccgtagaa

SEQ ID NO: 52517 - DNA, 201 bp, Homo sapiens
cctcccgagtagctgggactacaggtgcctgccatcacgcctggctaattttttttgtatttttagtagagacggggtttcaccgtgttatccaggatggwctcgatctcctgacctcgtgatccacccatcttggcttcccaaagtgctggaattacaggtgtgagcccccacgtccggccttttttgtgtcttctttaa

SEQ ID NO: 52518 - DNA, 201 bp, Homo sapiens
gagtggacttaagcctgacggtgcccgagaagcgcttgtccttctgggggtcatagttcttcaagctgatctgcaactccaccatcttcaggaacttgggrcactttcactggttcccgtgcaggacttcctgcaccgcctcatccagggtgtcgtgagagactttgctgcttatgggttctcatgccacgctaaccagaa

SEQ ID NO: 52519 - DNA, 201 bp, Homo sapiens
cccttttcaggatacataacagctgtgtgctaggatattatcgtcataactattccaatgtgtgatgactatgaggtatattattttctcagagttgggcwatacataacatttgaataagccagactaacatctttctaggctatagttctaatgtagagcaataaaaatagaaccaaacaaaatatacaaacatgtgga

SEQ ID NO: 52520 - DNA, 201 bp, Homo sapiens
caggaataaataataatgtaaggagtcagtaaagctaaaggcagaaaataatgaatttgaaaacagtagaaatggtaaatccaaaactttggtgggtgtcyccccccctcccaccgacaaggaagtgagaagagaggcaatgaaatagataagctactaagtgctgccagggggaagggagagaaaacacagaaaaatgag

SEQ ID NO: 52521 - DNA, 201 bp, Homo sapiens
gtaaacactaacaaggattttgtgttattattttcttgctttgtccgtgtaattttaccacatatggatcactcatcaatgtagtgtaaaggttttttttkgtctgttttttgtttcttttgtgtttgtttgtttgtttgtgactgagtctcgcactgtctcccaggctggagtgcagtagtgcgatctcagctcactgta

SEQ ID NO: 52522 - DNA, 201 bp, Homo sapiens
aaatcccacaataattgaatcctcttaatcaagttatgggaaagagcattaaaaataaagaaaaataaaggttattgaaagtattttacatttcagttacrgtgactggtggttgatctctggagaacagtcatcacacagccaaacaaatgggggcctccagaaatgtatggtcacgcccacagcatcctcagtgccacc

SEQ ID NO: 52523 - DNA, 201 bp, Homo sapiens
gactctgcgtctctcctattcagattgtgtctgcagttcaatactgccatcagaaacggatcgtacatcgagacctcaaggtgagtagaagtgcctcactyagtgtatgctctgtctgtttgtgtgcagttctctcagtggtcattacacaaatgaggtatagattagccttattagcattttttaaaatcccacaataat

SEQ ID NO: 52524 - DNA, 201 bp, Homo sapiens
gtagttaaagccagcttagttcaaattccacatatttctggctaactttatatctatatttaaaaattagagcattgctaaaagtgaaacatcaatttatrggaaaattaatactcagaagtaggatttctacttacttttatttctctcacctataggtgaagtatttgactatttggttgcacatggcaggatgaagga

SEQ ID NO: 52525 - DNA, 201 bp, Homo sapiens
gcttttcatagttacagtttatatgtgcatggtttgtgcatacagacatttgtctctttttcttccgtgtcctctcctctcccgcagtgaagttattcgargtcattgaaactgaaaaaacactctacctaatcatggaatatgcaagtggaggtaagaacatttttatatatattgggttttttttctttctccctttta

SEQ ID NO: 52526 - DNA, 201 bp, Homo sapiens
aggttttgtggtttgttgcttgcttgcttgcttgcttcttaatgccatatatcttggcatttatcagtccataattactaaattcttaaaatccataaatrtttattattctttctaggttgcaataaaaataattgacaaaactcagttgaatccaacaagtctacaaaaggtaagattggttcaatgtctagtactttt

SEQ ID NO: 52527 - DNA, 201 bp, Homo sapiens
aactacagactgttgaaaacaatcggcaaggggaattttgcaaaagtaaaattggcaagacatatccttacaggcagagaggtaaataccagttatgcttrtttctgttatgacagttgctctgtttatttccatgtaagagaaagaaaagaatatagatataggccttatttcttttttttaagatggagtctcgctccg

SEQ ID NO: 52528 - DNA, 201 bp, Homo sapiens
caaataaatttaagacaaaaatgcccttttttatagagtaacacagcatctggtggaatgacacgacgaaatacttatgtttgcagtgagagaactacagmtgatagacactcagtgattcagaatggcaaagaaaacaggtaggagattctacctgtttgtaagaaaagttgtttttcccaagagaaatggaagcatgtt

SEQ ID NO: 52529 - DNA, 201 bp, Homo sapiens
tatattcagtcatttaaaaaatgaactctttattttagctggaccagctattccttctgttgtggcgtatccgaaaaggagtcagaccagcactgcagatrgtgacctcaaagaagatggaatttcctcccggaaatcaagtggcagtgctgttggaggaaagggaattgctccagccagtcccatgcttgggaatgcaag

SEQ ID NO: 52530 - DNA, 201 bp, Homo sapiens
tccatgcctgcatgttcatgtgtttttgtctaagtaacatatttctgttttgactcatgtctgtgcctaaaatgtgaataatggaaagttaagcacaagtyatatgaacagtttatctgttctgtcatatttaggaacgtaactacctgcagtttcctataatggcacccagtaactctgaaacaagtgcccatttatgtt

SEQ ID NO: 52531 - DNA, 201 bp, Homo sapiens
tggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttttttaaata

SEQ ID NO: 52532 - DNA, 201 bp, Homo sapiens
taaaacttgaaactatattcagtcatttaaaaaatgaactctttattttagctggaccagctattccttctgttgtggcgtatccgaaaaggagtcagacmagcactgcagatagtgacctcaaagaagatggaatttcctcccggaaatcaagtggcagtgctgttggaggaaagggaattgctccagccagtcccatgc

SEQ ID NO: 52533 - DNA, 201 bp, Homo sapiens
tcccttatttttaaccttctgaacactatagtggttagcatttatatcatttattcagccattctaatatttattgagtagcagttttgtaccaactgctrttctaagatataaggaataataaattcctgttactgttttcatgaaacttaaattctagtgtaattaaaatcatgtagaaataaacataaacatgatcac

SEQ ID NO: 52534 - DNA, 201 bp, Homo sapiens
gaagataaaaaagagaaatttcccttatttttaaccttctgaacactatagtggttagcatttatatcatttattcagccattctaatatttattgagtascagttttgtaccaactgctgttctaagatataaggaataataaattcctgttactgttttcatgaaacttaaattctagtgtaattaaaatcatgtagaa

SEQ ID NO: 52535 - DNA, 201 bp, Homo sapiens
aagctaaaggcagaaaataatgaatttgaaaacagtagaaatggtaaatccaaaactttggtgggtgtccccccccctcccaccgacaaggaagtgagaaragaggcaatgaaatagataagctactaagtgctgccagggggaagggagagaaaacacagaaaaatgagggggaaataccagatactgaagaatttaaat

SEQ ID NO: 52536 - DNA, 201 bp, Homo sapiens
gatcactacattttgtgacagcctaatcaaaaattctctcctccttcatccttagttccaaactgcttatcacttccctgttccataggccacttaggatwgagttgatatgaggagtaacatttgttctgtaagattatggttattattcgttgaatttttagcaatatttacattctcttgttctcttttatgactcgt

SEQ ID NO: 52537 - DNA, 201 bp, Homo sapiens
tttttaacaaaaattttggccagtagtataaattcagtgaatatgttttcattgcacagatagtaaaaccacttgatacatacctcatggggatatggacygctttatgcgctgctttttaccacaccttaaatagtgcctggttgtgtgtgtgtgtgtgtgtgtgtgtgtgtgtgtgtgtgtgtgtaactcagtaaatat

SEQ ID NO: 52538 - DNA, 201 bp, Homo sapiens
tgatcactacattttgtgacagcctaatcaaaaattctctcctccttcatccttagttccaaactgcttatcacttccctgttccataggccacttaggawtgagttgatatgaggagtaacatttgttctgtaagattatggttattattcgttgaatttttagcaatatttacattctcttgttctcttttatgactcg

SEQ ID NO: 52539 - DNA, 201 bp, Homo sapiens
gggatccagtttcatggtttttcgtatgtataatcacttgctgcctcacctctcctttctttgctgatctgcatcgtggacagagtctccgtgtctaaacrcacactttgttcttcagaagtggttattctggttcacttaacaattgccatttgaaaagcaattatttttattttattttcatatttttaaattttattt

SEQ ID NO: 52540 - DNA, 201 bp, Homo sapiens
gcactccagcctggggcaacagagtgagactccatctcaaaaaaaaaaaaagaaaaaaaaaaaaagaaaggaatttggaggtatgcagcgtctagctttgratcagcagttcagtaatattggagttggtggtattttaaggtagttttgtcttttctgtcatgtttgagaccctgtagctacaggataatgttttacagt

SEQ ID NO: 52541 - DNA, 201 bp, Homo sapiens
tagaagtgctttctgtgtataatctctctctctctctctttttttcttggtttggaggagactttccccttgtctataagtaacttaaatataaaatgttrtaacaatacgtttattagtttgaagccccaattttctttttttttttttcttttaagtgaaaacaagtttataaaagaagtaaagaaacaggccaggcgc

SEQ ID NO: 52542 - DNA, 201 bp, Homo sapiens
tgccctaaacaaatagggggtttgtttttctccaaaaagaaatttggggtagggtgcggtggctcacacctgtaatcccagcactttgggaggccaaggcrggtggatcacgaggtcaggagatcgagaccacggtgaaacctcgtctctactaaaaatacgaaaaaaattagccgggcacggtggcgggtacctgtagtc

SEQ ID NO: 52543 - DNA, 201 bp, Homo sapiens
atgatatatacattgtataactatttagacttacatggtgcatgatttacattgtaattacatagaggcttatacagtctaataaaaattaatattaactrtttgattgcaaagaggattgttctgcattttattactttttttttttttttgagacagagtttcactcttgttgccaggctggagtgcaatctcgtgacc

SEQ ID NO: 52544 - DNA, 201 bp, Homo sapiens
atctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtcaggcaacccacaatgagaatcctggctccagca

SEQ ID NO: 52545 - DNA, 201 bp, Homo sapiens
tatttaattagctttttttttttttaaatttcctgaggcggagtctcacactgttacctgggctggagtgcagtggcacgatctcgctcgctgcaacctcygcctcccgggttcaagcgattctcctgcctcagcctcccaggtagctaggattacaggcagccgccaccacacccagctaatttttaaattttattttat

SEQ ID NO: 52546 - DNA, 201 bp, Homo sapiens
gtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgct

SEQ ID NO: 52547 - DNA, 201 bp, Homo sapiens
ttgatcactacattttgtgacagcctaatcaaaaattctctcctccttcatccttagttccaaactgcttatcacttccctgttccataggccacttaggwttgagttgatatgaggagtaacatttgttctgtaagattatggttattattcgttgaatttttagcaatatttacattctcttgttctcttttatgactc

SEQ ID NO: 52548 - DNA, 201 bp, Homo sapiens
tcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgctt

SEQ ID NO: 52549 - DNA, 201 bp, Homo sapiens
cttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttt

SEQ ID NO: 52550 - DNA, 201 bp, Homo sapiens
ttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgctttt

SEQ ID NO: 52551 - DNA, 201 bp, Homo sapiens
aacgtggtgaaacccccatctctactaaaaatacaaaaattagccgggtgtggtgacgcacgcctgtaatcccagctactcaggaggctgaggcacgagarttgcttgaacgttggaggcagaggttgcagtgagccaagatcgggccactgcactacagcctgggcaacagcacaactctgtctcaaaaaaaaaaaaaaa

SEQ ID NO: 52552 - DNA, 201 bp, Homo sapiens
gctgaggcacgagaattgcttgaacgttggaggcagaggttgcagtgagccaagatcgggccactgcactacagcctgggcaacagcacaactctgtctcaaaaaaaaaaaaaaaaaagcattatgcaatcaagtaataacatgaaaatatttgtgcccattcattatgtaaaatttattctttcagagttagggttaata

SEQ ID NO: 52553 - DNA, 201 bp, Homo sapiens
attaacacctgggtatgggcaactctctaaccgctggtttggtttggagttgactctatgggtatggaaaggttgcaccaggccgggcgcagtggctcacrcctgtaatcctagcactttgggaggctgagactggcggatcacctgaggtcaggagttcgagaccagcctggccaacgtggtgaaaccccatctctacta

SEQ ID NO: 52554 - DNA, 201 bp, Homo sapiens
tgctctgtctgatgcctcttttctctccgtttgtttattcactctccttctctactggcttttcaccagcagcatttacacatgctcaagtctatataccttttttttttttaactaaaaagccatgcctgttcctctttcagatacacgctttttctctcttccctttcatagccatatttctctaaacatttcctagat

SEQ ID NO: 52555 - DNA, 201 bp, Homo sapiens
gctctgtctgatgcctcttttctctccgtttgtttattcactctccttctctactggcttttcaccagcagcatttacacatgctcaagtctatataccttttttttttttaactaaaaagccatgcctgttcctctttcagatacacgctttttctctcttccctttcatagccatatttctctaaacatttcctagatt

SEQ ID NO: 52556 - DNA, 201 bp, Homo sapiens
gaggtatattattttctcagagttgggcaatacataacatttgaataagccagactaacatctttctaggctatagttctaatgtagagcaataaaaataraaccaaacaaaatatacaaacatgtggaacctaaaacacacagaattcttggatcaaagaaaaattgcaaacaaaaattacagtatatctaggaattaat

SEQ ID NO: 52557 - DNA, 201 bp, Homo sapiens
atgatgtatttcactggaaccatacaggttttgattcgcagagttgggagccctgggtagatactgaatcagactaagtttaatcacagaaattattcctrcgtaagtctgatcttatgttttcaagatagcattgtaaaattcagagtatgttaccatccccctttgagacctctgctgtttttaataaatggaagcatt

SEQ ID NO: 52558 - DNA, 201 bp, Homo sapiens
cagtctaaaccaccattactttaaaggtgttcttgtttccttgtttcatatactactaagagaaatgctagcaagccttcatcctgatatcagggatattrattaaaatgtgaaaaaaaaatttagaatcaataagtatggttgaagaaaaaaccacggaacaacttcatagttggattaaaaaaaaatcacaaggaatat

SEQ ID NO: 52559 - DNA, 201 bp, Homo sapiens
aagatctggattgaattcctggtttaaaagttgaactcctgaattataatttagtaattatgagtgtgacatatggttccacaaatctcttaagaggtttrtattgaattcaaatttagaaaaaaaaatctgtcaattatattgacagacttggattttatctgtgttactctacaacagctggtaggcttaatcgtttaa

SEQ ID NO: 52560 - DNA, 201 bp, Homo sapiens
gtaattcatgatgactttcaagtatcaaaatattttagtttaatattttcactaagctgatggaggtattccttatttgtatgaagtaaagatgtttcctsaaaacacttatatctaattttctaaattagtattcttttctattgatttcagaggtggtgattctttattctacattgataagcagttgacagtgctaat

SEQ ID NO: 52561 - DNA, 201 bp, Homo sapiens
aaacacttatatctaattttctaaattagtattcttttctattgatttcagaggtggtgattctttattctacattgataagcagttgacagtgctaatartatattccttgaagtgtcacctttcttccctaaataattaatgttgtgtaaactgccacctaggcgtgcatcagctggttctgttgttttcacctccatt

SEQ ID NO: 52562 - DNA, 201 bp, Homo sapiens
tattcttttctattgatttcagaggtggtgattctttattctacattgataagcagttgacagtgctaataatatattccttgaagtgtcacctttcttcsctaaataattaatgttgtgtaaactgccacctaggcgtgcatcagctggttctgttgttttcacctccattgtatcctgagctcctacttctcaccacca

SEQ ID NO: 52563 - DNA, 201 bp, Homo sapiens
ttttctgtgtattgaagtatgttctatctaacctaacatattaaagaatttgcagagaagtaaacaatcttaagattattctgtaagcacgtttttccctrcaaaattaacaatgatgcagccctgcctccaactccagaaaaaccctggactgaggaggctgtggagaaaccctgttgctctctgaaagcccttcattgt

SEQ ID NO: 52564 - DNA, 201 bp, Homo sapiens
ctattttagaaaagtcaccaaggaaccaagtattttaagtgggttaaacttagagcatagcctggacccatttgcagaaaatataaacttgggtgcaaatkaggcctttgtgagagaattataacagtaacatcagccagaatcacaaacacatgtcaggagtttattgtgtgccaggtgctgttccatgcactctgtatg

SEQ ID NO: 52565 - DNA, 201 bp, Homo sapiens
tcttatgcagagtaaatcccctcagcctccttgggtactcccacaggagtttcgctgaacagaagcctactttattccatacttggaattgtttccccccycccacctgaatttgtttgattcctgctaaaattcatttaattgattttctgccttaattccagtcttttgggggattttggaataatgggtcatttgtat

SEQ ID NO: 52566 - DNA, 201 bp, Homo sapiens
gttttcaggttttgtaacttttttcatctatgttttatataatgcttgttaaattcatttcaagctattttataatttttgttgctaatgtaaatggaacwtttttttcctcaagaaggcaataatcatataacttcttgcatttgggaaacttttgatctctcatttggaatgtcgaaaattaagtttatattgtttttt

SEQ ID NO: 52567 - DNA, 201 bp, Homo sapiens
tttgtgtctatttcttttactctacttcatgcttgtgatattcttccatgttgaggttttcatttgtaaccaactgttgtagttgtttgacttggcctccrtttgctatggattgaatcgtatgcctcaaaattcatatgtgtaagccctaacccccagtgtgactgtatttggtgatagggtctttatagaaggttaagt

SEQ ID NO: 52568 - DNA, 201 bp, Homo sapiens
gggattaccagtgtaagccaccacatccggctaatgccaaatgtttctattcaggaatgtgcatgtgtctcaaatttgttttcaggttttgtaactttttycatctatgttttatataatgcttgttaaattcatttcaagctattttataatttttgttgctaatgtaaatggaacttttttttcctcaagaaggcaata

SEQ ID NO: 52569 - DNA, 201 bp, Homo sapiens
gaggcaggagaattgcttgaatctgggaggtggaggttgcggtgagccaagatcgcgccattgcactccagcctgggcaacaagagtgaaactccgtctcaaaaaaaaaaaaaaaaaaaggatgatttcttacccaaacaaaacacataaactgtattatgcccttcttttagatattatggtgggaatgggatattcaca

SEQ ID NO: 52570 - DNA, 201 bp, Homo sapiens
aggcaggagaattgcttgaatctgggaggtggaggttgcggtgagccaagatcgcgccattgcactccagcctgggcaacaagagtgaaactccgtctcaaaaaaaaaaaaaaaaaaaggatgatttcttacccaaacaaaacacataaactgtattatgcccttcttttagatattatggtgggaatgggatattcacaa

SEQ ID NO: 52571 - DNA, 201 bp, Homo sapiens
ttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactattctctcaccacagccttctaa

SEQ ID NO: 52572 - DNA, 201 bp, Homo sapiens
ctgaggcaggagaatggatgaacccgggaggcggagcttgcagtgagccgagatcgagccactgcactccagcctgggcgacagagcgagactccgtctcaaaaaaaaaaaaaaaaaagatgtaaataaaactccagaaatattgaaagaaaccttgggattatttgctttgtaacttggactggtgaaggtgtttctgtc

SEQ ID NO: 52573 - DNA, 201 bp, Homo sapiens
aggcaggagaatcgcttgaacctgggaggtggaggttgcagtgagccaagattgagccactgcactccacagcctggccacagagcgagactccgtctcgaaaaaaaaaaaaaggaacaaactatgatgtgcacaactcagatggatctcaagggaattatactgcgtgaaagtacacaaaaggttacattccatggatgc

SEQ ID NO: 52574 - DNA, 201 bp, Homo sapiens
cagtgacagtgcagacggaagcctacgtgcacacacggggaggtctgactgccagtgccccaaagatgtggtgttcacactgagtcttcaaagagctctartgatgaagagtgttggctgagttcttaccatgtgccaaggaccatgctcagtgctttttcatggattagctacattttaaggtgaaaaaaaagttgggta

SEQ ID NO: 52575 - DNA, 201 bp, Homo sapiens
agctctaatgatgaagagtgttggctgagttcttaccatgtgccaaggaccatgctcagtgctttttcatggattagctacattttaaggtgaaaaaaaarttgggtaattgcctaaaattacactgccaacctgaatccagctcttaatccctatctgtaacaaaatctccccagtaagtagataatatttactaaatta

SEQ ID NO: 52576 - DNA, 201 bp, Homo sapiens
ttgggtaattgcctaaaattacactgccaacctgaatccagctcttaatccctatctgtaacaaaatctccccagtaagtagataatatttactaaattarattgaatccattcagcttcagaaacttttttctgtgtattgaagtatgttctatctaacctaacatattaaagaatttgcagagaagtaaacaatcttaa

SEQ ID NO: 52577 - DNA, 201 bp, Homo sapiens
agtttctggtgttacagattgtagtctacaggactacagaaatgtttcatggtcaggcacagtggctcacacctgtaatcccagcactctgggaggccaargcaggtggatcacttgaggtcaggagttcgagaccagcctggccaacatggtgaaaccccgtctctactaaaaatacgaaaattaaccatgtgtggtggc

SEQ ID NO: 52578 - DNA, 201 bp, Homo sapiens
catccacagaaagttacccaagtgcgttatgtttataagactatgttactaattgatcttggcttgattttcatggcaacatgggtagtattccctttacsaaggttaaaatgtgaaaactcattcattactaaggttccaggccctttctatagattctccattctcagaatgtgacatttttattctgcatacaatgaa

SEQ ID NO: 52579 - DNA, 201 bp, Homo sapiens
gactacagaaatgtttcatggtcaggcacagtggctcacacctgtaatcccagcactctgggaggccaaggcaggtggatcacttgaggtcaggagttcgwgaccagcctggccaacatggtgaaaccccgtctctactaaaaatacgaaaattaaccatgtgtggtggcacgcgcctgtagtcccagctaccagggagac

SEQ ID NO: 52580 - DNA, 201 bp, Homo sapiens
ctagttttaaactggtcgtgctgaaggccagcccactttctgctgtaattattctgccttctgatgttattctcgaaaaatggccagattccaggcgtgamtaatggttggtgtaaactaggcatgagaaggtttgattacaccttcaattgtatgattctatcatgatggtataggtttgcagtgagtcttaaaccacat

SEQ ID NO: 52581 - DNA, 201 bp, Homo sapiens
tgcctgtaatcccagcactttgggaggctaaggtgggagcattgcatgaggccaggagttcgagaccagcctgggcaaaatggcaaaccctcatctgtacaaaaaaaaaaaaaatacaaaaaattagctaggcatggtggtacatgcctgtggacccagctactttggaaactaaggcaggaggatcacttgagccccgaa

SEQ ID NO: 52582 - DNA, 201 bp, Homo sapiens
gacgtgggagaatcacttgaacacaagaggtgaaggttgcagtgagccgatatcatgccactgcactgcagcctgggtgacagagtaagactctgtctccaaaaaaaaaaaaaaaaaaaaaaaaaaaaaagcagacaacttgcaacattatcttcatccttgtacactaatttgtttttgtttgatttccaaatattaatg

SEQ ID NO: 52583 - DNA, 201 bp, Homo sapiens
ggagacggagagtgcagtgagctgagatcaagccattgccctccagcctgggcgacagagggatactccgtctcaaaaaaaaaaaaaaaaaaaaaaaggcygggcgcggtggctcacacctgtaatcccagcactctgggaggccgaggcgggcagatcacgaggtcaggagatcgagaccatcctggctaacacggtgaa

SEQ ID NO: 52584 - DNA, 201 bp, Homo sapiens
tgaaagccactttccagcaaccactgaagaaagagtatctcattatttttacttaaagcactacagaaagtggtgttctgattttattaatattttttagrccaggcatggtggcttatgcctgtaatcccagcactttgggcggatcacttgagcccaggagttcaagaccatcctggacaacatggcaaaaccccgcct

SEQ ID NO: 52585 - DNA, 201 bp, Homo sapiens; identical to SEQ ID NO: 9801

SEQ ID NO: 52586 - DNA, 201 bp, Homo sapiens
gattgaattcctggtttaaaagttgaactcctgaattataatttagtaattatgagtgtgacatatggttccacaaatctcttaagaggtttatattgaaytcaaatttagaaaaaaaaatctgtcaattatattgacagacttggattttatctgtgttactctacaacagctggtaggcttaatcgtttaattttttta

SEQ ID NO: 52587 - DNA, 201 bp, Homo sapiens
tttgctgcttatgggttctcatgccacgctaaccagaaaagagggtttagttggttttataaattattaatagtttgggaggaaattgatattttaatgaygccaagtctttctttcttttttttctttcttttttttttttgagacggaatttcgctcttgttgcccaggctagagtgcagtggcgtgatctcagctcac

SEQ ID NO: 52588 - DNA, 201 bp, Homo sapiens
cctaatacataattccaatagagaggtgaatacataaagttatttgggctaatatcctgccactacctctcttgggattctttggctgctctttttgcctrcggaattaaatttttactagtcttctatctggtcccatttacctgtcctttttgttttcacattgcatccctggtatgacctctgctgtaactcaggagt

SEQ ID NO: 52589 - DNA, 201 bp, Homo sapiens
tgagtagctgggactacaggcacccgccaccatgcctggctaatttttttgtatttttagtagagacggggtttcaccatgttagccaggatggtctcgakctcctgacctcgtgatccacccgccttggcctcccaaagtgctgggattacaggcgtgagccactgcgcccggcacacatgagcctctttaaggagatct

SEQ ID NO: 52590 - DNA, 201 bp, Homo sapiens
gccaggctggtctcgaactcctgaccttgtgatcctcctgcctcagcctcctaaagtgctgggattacaggcgtgagctaccgcacctggcctgaatcaasatttttttagccacaacttgtgccttacaagttttttattctaaggattagacaagtaaattatttttcaccgtattacattagttcacctactatacca

SEQ ID NO: 52591 - DNA, 201 bp, Homo sapiens
tatggcgtagcattcatgcctgcagcccaccaggcctggggctgcaagagcatgagccctgggtctgtcatctgtcagcatgcatcctctgtttgcagcartgtgccctgtaaatattttcatttcctgtgtgtgcggagacttggaaaaggttgggaagcactggactgtgctaactggaattttaaaagactgttgcca

SEQ ID NO: 52592 - DNA, 201 bp, Homo sapiens
ccctttttcctcagaattttgttttctgtcttatatagcatctgacactccgatttggagagagagaatgctattttgagtcttgcttatttttctgtttrtttaaggctgattggaagttttgtgcatttggatggatcttgaatacaacagtgggacacactgttatttctttgtggtgctcttgataccaatatattt

SEQ ID NO: 52593 - DNA, 201 bp, Homo sapiens
tttgagtaagatttaaccaccattcttaaatctagactgagtaggacagaaagggaaatccctgtgtttttaaattttaatgagatttacagaggaagaaraaaaggaacattaaacacaaatatatgcaaaatacccagtaggatttattaaagcattattgactatggatttcatcagggtctttgtggggaaatcctg

SEQ ID NO: 52594 - DNA, 201 bp, Homo sapiens
cccgagtagctgggactacaagcacccgccaccacgcccggctaattttttgtatttttagtagagatggggtttcaccgtgttagccaggatggtctcartctcctgacctcatgatctgcccgccttggcctcccaaagtgctgggattacaggcgtgagccaccacgcccggcctatttattttttattgattgagtg

SEQ ID NO: 52595 - DNA, 201 bp, Homo sapiens
ttcttcggcaaattgttccttttccctctcttcacccacccatatatcttatttcttcactaatttaaaatatgagtgagctgtaggatgcctggacctakgttaacttctgaaacaaacatgttaagttccaattttagccttaaatattttcgacatttagccttaaatgttttcttctttatatgagtgttcatacgg

SEQ ID NO: 52596 - DNA, 201 bp, Homo sapiens
cccacctgtaatcccagcattttaggaggctgaggcaggtggatcatgaggtcaggagatcaagaccatcctgaccaacatggtgaaaccctgtctaaaawttagctgggcgtggtggcatgcgcctgtagtcccagctacttgggaagctgaggcaggagaatcacttgaacccaggaggcagaggttgcagtgagccga

SEQ ID NO: 52597 - DNA, 201 bp, Homo sapiens
atcccagcactttgggaggccgaggcaagtggatcacctggggtcgggagttcaagaccagcctggccaacatggtgaaaccccatctctactaaaaatayaaaaattagctaggtgtggtggtacatgccggtagtcccagctatttgggaggctgaggcaggaggatggtttgagcctgggagatggaggttgtagtga

SEQ ID NO: 52598 - DNA, 201 bp, Homo sapiens
aaaaaaaaaaaaaaaaaaaaaaggctgggcgcggtggctcacacctgtaatcccagcactctgggaggccgaggcgggcagatcacgaggtcaggagatcragaccatcctggctaacacggtgaaaccctgtgtctaccaaaaatataaaaaattagccgggcgtggtggcaggtgcctgtagtcccagctactcgggag

SEQ ID NO: 52599 - DNA, 201 bp, Homo sapiens
ctacgaaaaatacaaaaaattagccgggcgtggtggtgggtgcctgtagtcccagctacttgggagactgaggcaggagaatggcgtgaacccaggaggcrgagcttgcagtgagcagagatcacactgcactccagcctgggcgacagagtgagactccgtctcaaaaaaaaaaaaataaataacacttgtgtgcattca

SEQ ID NO: 52600 - DNA, 201 bp, Homo sapiens
tgcagtatttaaattttctcacatttctaatttttaaactgttcaaattagaatccagcttgaattcatacattatagttggctgatatgtcaaatatgctttttttttttttttaattgagatggagtcttgctctgtcgcccaggttggagtgcagtggtgcaatctcggctcactgccaacctctgccgcccgggttc

SEQ ID NO: 52601 - DNA, 201 bp, Homo sapiens
gactgaggcaggagaatggcgtgaacccaggaggcagagcttgcagtgagcagagatcacactgcactccagcctgggcgacagagtgagactccgtctcaaaaaaaaaaaaataaataacacttgtgtgcattcatgtgtacgtgtgtctgtacacatgtacaagaaacaaccgagcatttctttaaaaaccttagtcag

SEQ ID NO: 52602 - DNA, 201 bp, Homo sapiens
ggagtgcagtggtgcaatctcggctcactgccaacctctgccgcccgggttcaagcgattgtcgtgcgcagcctcccgagtagctgggattacaggctccygccaccatgcctggctatttttttttttttttttttttttttttagtagagatggggtttcgccatgttggccaggctgttctcaaactcctgacctcag

SEQ ID NO: 52603 - DNA, 201 bp, Homo sapiens
agccgggagacggagcttgcagtgagccgagatcgcgccacagcactccagcctgggcaacagagcgagactctgtattaaaaaaaaaaaagtgtgagggytgggagaggtcgggtctgggagagaccataggaagccctcagcaggtggaaggctcctgctcaaagctgtgagacagaggagaaaccaggactgagccct

SEQ ID NO: 52604 - DNA, 201 bp, Homo sapiens
acaatagttgccatttggtgatcacttaactgtataccagccagcaatactttgtagagtatctcatttaaaatatgtaatatggttttatttaattagctttttttttttttaaatttcctgaggcggagtctcacactgttacctgggctggagtgcagtggcacgatctcgctcgctgcaacctccgcctcccgggtt

SEQ ID NO: 52605 - DNA, 201 bp, Homo sapiens
ctcatgcctgtaatcccaacactttgggaggccaaggcaggcgtatcgtttgagcccaggagttcaagaccagcctgggcaacatgacaaaactctctctrctaaaaatacaaaattagccaggcatggtggagtgcgcctgtattcccagccacttaggaggctgaggtgggagaaccacctgagcccaggaagttgagg

SEQ ID NO: 52606 - DNA, 201 bp, Homo sapiens
tgccctctaggagatggccagcctttcctgtgctgccactgttgtctcaccttacagtcttcctggctccagatgagtttgagagcttttgcttatctttktaacccatttagtatctaacgtggcattttatacataggaagcttctctcatcagtattggtggatgtgaaccaaattgaatactggcaggttggtgaca

SEQ ID NO: 52607 - DNA, 201 bp, Homo sapiens
atttggtgatcacttaactgtataccagccagcaatactttgtagagtatctcatttaaaatatgtaatatggttttatttaattagcttttttttttttwaaatttcctgaggcggagtctcacactgttacctgggctggagtgcagtggcacgatctcgctcgctgcaacctccgcctcccgggttcaagcgattctc

SEQ ID NO: 52608 - DNA, 201 bp, Homo sapiens
gggaggccaaggcaggcgtatcgtttgagcccaggagttcaagaccagcctgggcaacatgacaaaactctctctactaaaaatacaaaattagccaggcrtggtggagtgcgcctgtattcccagccacttaggaggctgaggtgggagaaccacctgagcccaggaagttgaggctgcattgagccatgatcgtaccac

SEQ ID NO: 52609 - DNA, 201 bp, Homo sapiens
ctcatacttgattgatattttggctgcatatagaattctagactgaatgccctttttcctcagaattttgttttctgtcttatatagcatctgacactccratttggagagagagaatgctattttgagtcttgcttatttttctgtttatttaaggctgattggaagttttgtgcatttggatggatcttgaatacaaca

SEQ ID NO: 52610 - DNA, 201 bp, Homo sapiens
tactgttatataacagctagttcctatacctgtaatcttattaattcatttaaaatacatcagtgcgggccgggtgtggtggctcacacttataatcccarcactttggaaggccaaggcgggaggatcacttgaagccacaaatttaagaccagcctggataatatagcgagaccctgtctctacaaaaaaaataaataa

SEQ ID NO: 52611 - DNA, 201 bp, Homo sapiens
catgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaa

SEQ ID NO: 52612 - DNA, 201 bp, Homo sapiens
gccaggagaatcgcttgaacctgggaggcggaggttgcatctagccaagatcgcgccgctgcactccagcctgggtgatgacagagcgagactccatctcaaaaaaaaaaaaaaaaaaagactagcattgattggccaggcatggtggctcacgcctgtaatcccagcactttgggaggccgaggcaggtggatcacctga

SEQ ID NO: 52613 - DNA, 201 bp, Homo sapiens
aggtacgtaagtaggcctctcagatttcaggttggttctctgcctggtagatacaagggcaaaactattctggaaccatattgatgttaaaaaaatttttwacggacttcctgccggcaaggatttttttaaaagattttttaaatgtgtctaagaaatgttttaatttgtcttctgattatacagtgatttacaattcat

SEQ ID NO: 52614 - DNA, 201 bp, Homo sapiens
gaggcggagcttgcagtgaatcgagatggcgccactgcactccagcctggggcaacagagtgagactccatctcaaaaaaaaaaaaagaaaaaaaaaaaargaaaggaatttggaggtatgcagcgtctagctttggatcagcagttcagtaatattggagttggtggtattttaaggtagttttgtcttttctgtcatgt

SEQ ID NO: 52615 - DNA, 201 bp, Homo sapiens
tgtttgagaccctgtagctacaggataatgttttacagttacagctacatggttgcattcaaggaaggaggaaggaactgtactggcaactctgtccttacccccccaccctccttttttttttgagatgaagtttctgtcactcaggctggagtgcagtggcggaatctcagctcactgcaactgtcgcctcccttgttc

SEQ ID NO: 52616 - DNA, 201 bp, Homo sapiens
agcagggctcacagagggcaacaggaccccgctggagtgaagaaggggactggagggtaaattaaaagaatagcagcttgtctgccctcatccccggtgtkgggggagcagcctggcatggagtccaaatggacctcatatttcccaaagactcaaagcatctggggcctacctggaatgtcccaggaacacctactgccc

SEQ ID NO: 52617 - DNA, 201 bp, Homo sapiens
aattaggaggtaacttcatatcattacagaaagcttttctaaaatgcctaatcctgtcataattctaattctattttggctaaatttcatttttgtcttgrtgttttccctctaggctgaaaatctattgttagatgccgatatgaacattaaaatagcagatttcggttttagcaatgaatttactgttggcggtaaact

SEQ ID NO: 52618 - DNA, 201 bp, Homo sapiens
ccaggagaatcgcttgaacctgggaggcggaggttgcatctagccaagatcgcgccgctgcactccagcctgggtgatgacagagcgagactccatctcaaaaaaaaaaaaaaaaaaagactagcattgattggccaggcatggtggctcacgcctgtaatcccagcactttgggaggccgaggcaggtggatcacctgag

SEQ ID NO: 52619 - DNA, 201 bp, Homo sapiens
agtgagctatgatcacaccactgtactccagcctgggtgattgagcaagaccttgtctctaaataaataaatatttaaaagtaaaagaaaattaggaaacraaaatatatcttaaagacttttaatcattttcaactaaaatattttggataatactgccttatatttaggcagtatatattaaagattttcacatgcatg

SEQ ID NO: 52620 - DNA, 201 bp, Homo sapiens
cttagaaagtgtatctggccattgcagtggctcatgcctgtaatcccaacactctgggaggccgaggtgggctgatcacttgaggccaggagttcgagacyagactggccaacatggcaaaaccctatctctactgaaaatatagaaattaactgggcatggtggcgcgcgcctgtgattccagctactcaggagactgag

SEQ ID NO: 52621 - DNA, 201 bp, Homo sapiens
acaagaattgcttcaacccgggaggcataggttgcattgagctgagattgcaccactgcactgtgacagagtgagactctgtctttaaaaaaaaaaaaaaagtgtgtccatctgaagaacttttaattacagctaatgtcaatatgtactgctaaaccttttcttacttttttttgatatattaaaagatcacatactcat

SEQ ID NO: 52622 - DNA, 201 bp, Homo sapiens
cctgtctcaaaaaaaaaaaaaaaaaaaaagttatcaaagaattatataacattttgtgtgtgtgtgtgtgtgtgtgtgtgtgtgtgtgtgtgtgtgtgtgtcaggttgtttattggctccttaggaagaaaaaaatacgtgtatgaaataattgattaacagtacaagaactcataattatttgtttaaatgtttaatgtt

SEQ ID NO: 52623 - DNA, 201 bp, Homo sapiens
caagaattgcttcaacccgggaggcataggttgcattgagctgagattgcaccactgcactgtgacagagtgagactctgtctttaaaaaaaaaaaaaaagtgtgtccatctgaagaacttttaattacagctaatgtcaatatgtactgctaaaccttttcttacttttttttgatatattaaaagatcacatactcatt

SEQ ID NO: 52624 - DNA, 201 bp, Homo sapiens
tgcttatttctgttatgacagttgctctgtttatttccatgtaagagaaagaaaagaatatagatataggccttatttcttttttttaagatggagtctcrctccgtcacccaggctggagtgcagtggcatgatctcagctcactgcaaactctgcctcccgggttcacaccattctcctgcctcagcctcccgagtagc

SEQ ID NO: 52625 - DNA, 201 bp, Homo sapiens
atcccaacaatttgggaggccgaggcgggtggatcacctgagttcaggagttcgagaccagcctggccaacatggtgaaaccccgtctctacaaaaatataaaaaaaaaattagccaggcatgtggcgcacacctgtaatcccagctactcgggaggcggagacaggagaatcgcttgaacccaggaggcgaaggttgcag

SEQ ID NO: 52626 - DNA, 201 bp, Homo sapiens
tatttctgttatgacagttgctctgtttatttccatgtaagagaaagaaaagaatatagatataggccttatttcttttttttaagatggagtctcgctcygtcacccaggctggagtgcagtggcatgatctcagctcactgcaaactctgcctcccgggttcacaccattctcctgcctcagcctcccgagtagctggc

SEQ ID NO: 52627 - DNA, 201 bp, Homo sapiens
cacagcatatgcttctccaaaagcctagacaataatgatttctattttattttattttatttttttatttttttaagacagagtctcacgctgtggctcakgctggagtgcagtggcgcgatctcggctcactacaagctccgtctcccggcttcacaccattctcctgcctcagcctcccgagtagttgggactacaggc

SEQ ID NO: 52628 - DNA, 201 bp, Homo sapiens
ggcatgagccaccacgcccagcctaattaagctttctcaaaagaacatgaaacatatattaggtgtctgggagttttttgttttgtttttgtttttgtttwttttctgaggcagagtctcactctgtcacccaggctggagtgcagtggtgcaatctcggctcactgcaagctccgccttctgggttcaagccattctcct

SEQ ID NO: 52629 - DNA, 201 bp, Homo sapiens
agctgatgggtcgatgggcgcagcaaaccaccatggcacatgtatacctgtttaacctgcacgttctgcacatgtatcccagaacttaaagtaaaaaaaaaaaaaaaaaaaaaaaaggaaaaactttgaacaaaatcattttactcttgtggggttttttttgcctattgtagatatgacatataaaatgtaaacattata

SEQ ID NO: 52630 - DNA, 201 bp, Homo sapiens
tgctgtggtagttgaggcaaagggacagtttctgtagagtgatgagggagtgacttaggtggcctggtcttctgtcccttatctgtgtatctggagaaggragcctgaacaccttcattgtgatggtttagatcagttttatgtctgtaacccccgtgttctcttttacatactcattttactttcgtatcggttggtaaa

SEQ ID NO: 52631 - DNA, 201 bp, Homo sapiens
gcaaaccaccatggcacatgtatacctgtttaacctgcacgttctgcacatgtatcccagaacttaaagtaaaaaaaaaaaaaaaaaaaaaaaaggaaaawctttgaacaaaatcattttactcttgtggggttttttttgcctattgtagatatgacatataaaatgtaaacattatagaaatatagaaattcattatgt

SEQ ID NO: 52632 - DNA, 201 bp, Homo sapiens
accgtgttttcatcgtgtgtgagcagggaagggaactttactgcctttgttaggcctatgccgaggattcgtgggatttgctttatcagagactctgaagscaaaaatgcatcatacttcttggccagcttcttgaccagattcttattcttgagtttttttggcacctcagtgtccacttggggggatatccgtggcctt

SEQ ID NO: 52633 - DNA, 201 bp, Homo sapiens
cctgtctctactaaaaatacaaaaaattagctgggcatggtggcgggcgcctgtagccccagctgttcaggaggctaaggcgggagaatggcatgaacccrggagacggagcttgcagtgagctgagactgcatcactgcactgcagcctgggtgacagagtgagactccgtctcgaaaaaacaaacaaacaaacaaaaaa

SEQ ID NO: 52634 - DNA, 201 bp, Homo sapiens
aacccatgaactgcccacctcagcctcctaaagtgctgggattacaggtgtgagccaccacgcccggccaatgactcttatttttcaaaattttcatagcttttttttttttttggtcatttactcttccacatgaattttagaattaagttgccattttctaaaaacagagcatgaaattttgattagattagttttcat

SEQ ID NO: 52635 - DNA, 201 bp, Homo sapiens
acccatgaactgcccacctcagcctcctaaagtgctgggattacaggtgtgagccaccacgcccggccaatgactcttatttttcaaaattttcatagcttttttttttttttggtcatttactcttccacatgaattttagaattaagttgccattttctaaaaacagagcatgaaattttgattagattagttttcatg

SEQ ID NO: 52636 - DNA, 201 bp, Homo sapiens
tttggactcaagcaacctcccacttcagcctccccagtagctgggaccacaagcacacagtaccgcacctggcttattttattttattttattttatttawttattttattttattttatttttggtagagatggagtttcaccatattgcccaggctggtcttgaactcctgagcttaagcagtccgcctgcctcggcct

SEQ ID NO: 52637 - DNA, 201 bp, Homo sapiens
ccaattttctttttttttttttcttttaagtgaaaacaagtttataaaagaagtaaagaaacaggccaggcgctgtggctcacacgtgtaatcctagcacwttgggaggccgaggcaggtggatcacctggggtcaggagttcgagaccagcctggccaacatggtgaaaccccatctctactaaaaatacaaaattagcc

SEQ ID NO: 52638 - DNA, 201 bp, Homo sapiens
aaatggacctcatatttcccaaagactcaaagcatctggggcctacctggaatgtcccaggaacacctactgcccggcccctcctctttcccctcaccaarcatgatgactgcaatgtctcataattatcacactctgcttttctccatctctgtggctttacatattctcagtgttcagctcttggtctgcaacatatct

SEQ ID NO: 52639 - DNA, 201 bp, Homo sapiens
tatttttagtagagatggggtttcaccatgttggccaggatggtctttgtctcctgacttcatgatctgcctgccttggcctcccaaagtgctgagactayaggcgtgagccaccacacctggcctatttatttattatttatttatttatttatttatttatttgatggagtctcattttctcgcccaggctggagttca

SEQ ID NO: 52640 - DNA, 201 bp, Homo sapiens
atgatcatagtgtactgtagccttgaactcctgggctcaaatgatcctcctgtgttggcttcttgagtagctgggactacaggcatggaccaccacacctsgctaattttttattttttgtagagatgaagtcttcccatgttacccaggctggtctcaaattcctggcctcaagggatcctccagtctcagccttccaaa

SEQ ID NO: 52641 - DNA, 201 bp, Homo sapiens
ctggcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaa

SEQ ID NO: 52642 - DNA, 201 bp, Homo sapiens
tggcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaag

SEQ ID NO: 52643 - DNA, 201 bp, Homo sapiens
ggcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaagt

SEQ ID NO: 52644 - DNA, 201 bp, Homo sapiens
gcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaagtt

SEQ ID NO: 52645 - DNA, 201 bp, Homo sapiens
atataattaggaactaagaacttgaggaggaagactgaccctatgaaggtgtggggtcagtgaattacagatcctggtaagttccaacagttattagagtwctagattgagtgagcaggaaggtagaagaagttagttaaagaatgggaagctcaaacttggatcatgaaaggttttcagatattgggaatgtcaaagact

SEQ ID NO: 52646 - DNA, 201 bp, Homo sapiens
tgtcacattagtatagtgaaaggacaaaggagcattgttatacaacaccccagggagtgatcacaatgaaattagtgatataattaggaactaagaacttgaggaggaagactgaccctatgaaggtgtggggtcagtgaattacagatcctggtaagttccaacagttattagagtactagattgagtgagcaggaaggt

SEQ ID NO: 52647 - DNA, 201 bp, Homo sapiens
gtcacattagtatagtgaaaggacaaaggagcattgttatacaacaccccagggagtgatcacaatgaaattagtgatataattaggaactaagaacttgaggaggaagactgaccctatgaaggtgtggggtcagtgaattacagatcctggtaagttccaacagttattagagtactagattgagtgagcaggaaggta

SEQ ID NO: 52648 - DNA, 201 bp, Homo sapiens
tcacattagtatagtgaaaggacaaaggagcattgttatacaacaccccagggagtgatcacaatgaaattagtgatataattaggaactaagaacttgaggaggaagactgaccctatgaaggtgtggggtcagtgaattacagatcctggtaagttccaacagttattagagtactagattgagtgagcaggaaggtag

SEQ ID NO: 52649 - DNA, 201 bp, Homo sapiens
ttgatcattttcatctgtttgttgttactgtctttacagcatctagccctggtattatgaatgttgtttcttctgctgactccctgagaatagtaaaggctttttttttttttttttttttttagctcttttataaagtagatttttgttccctgcattgcttctctttttttctggggttctttcttgttaccgctcttt

SEQ ID NO: 52650 - DNA, 201 bp, Homo sapiens
tggctcactgcagctctctacctcctgggcccaagcaatccttccacctcagcctcctgagtagctgggaccagaggtgtgtactaccacatccggctgattttttgtattttctacagagacaaagcatccccatgttgctcaggctggtctcgaactcctgggctaaagtgatccttctgcctgggcctcccaaagtgc

SEQ ID NO: 52651 - DNA, 201 bp, Homo sapiens
aggagaattgcttgaatctgggaggtggaggttgcggtgagccaagatcgcgccattgcactccagcctgggcaacaagagtgaaactccgtctcaaaaaraaaaaaaaaaaaaggatgatttcttacccaaacaaaacacataaactgtattatgcccttcttttagatattatggtgggaatgggatattcacaagaag

SEQ ID NO: 52652 - DNA, 201 bp, Homo sapiens
caggatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttc

SEQ ID NO: 52653 - DNA, 201 bp, Homo sapiens
ccttaaaggaaagaaactgcccttgaattccaaggacatgattactgagctggaattccaaataatgtgtcccagtgagactcctgggggtagttttgtcyggtaactgtgtgtgttagatgaaactgcagacttccagccactctatcttaccatgtctgttaacagttaatttgctctgatgaatttgcccatcttgga

SEQ ID NO: 52654 - DNA, 201 bp, Homo sapiens
gaccataggaagccctcagcaggtggaaggctcctgctcaaagctgtgagacagaggagaaaccaggactgagccctggacacagcacggggagaggcccyggggagaagaagtgaagctggcaaggcagcagcaaggagggagggccctccaggtgtcaggcaggtggacatcatgacctaaggctcaccttgcgggaac

SEQ ID NO: 52655 - DNA, 201 bp, Homo sapiens
acaccaggtcttgacagttctgggttggttctctgtgaagtatgtaaatttcctttctcctttcttgtgattcagtacatgaatcagacctgcagcttttktccaacacctacatggttgtgtaggggtaatgagctcataactcattgtgttgctttattctcacagggaagttgtcacactgattggtgtgctattctg

SEQ ID NO: 52656 - DNA, 201 bp, Homo sapiens
aggatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttcc

SEQ ID NO: 52657 - DNA, 201 bp, Homo sapiens
ggatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttcca

SEQ ID NO: 52658 - DNA, 201 bp, Homo sapiens
gatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttccag

SEQ ID NO: 52659 - DNA, 201 bp, Homo sapiens
tggtggtacatgcctgtggacccagctactttggaaactaaggcaggaggatcacttgagccccgaagtttgaggctgcagtgagctgtgattgtgccackgcactccagcctgggtgacaaagtgaggccctatctcaaaaatgaataaataaaattgtggtaacaacatataacataaaaccatcttaaccatcttaac

SEQ ID NO: 52660 - DNA, 201 bp, Homo sapiens
gtatttattgagtactccttatgtgccagttagggctataaagatgaataagatgtcttttccccagttgagatatgcataagacagttcgtgtttgcctrtttcagtagtcagtattttcttttgcttattcagtttccactgaaacttatgttttccaaatacaaaattagaattccaactttgcgtttttcaggcgca

SEQ ID NO: 52661 - DNA, 201 bp, Homo sapiens
catcttaaccatcttaaccatttttaagtgtacagtttagtggcattgagtacattcatactgttgtgcaatctgtcctcatgtctcttttctttccaaayggaaactctcccaattaagcaagaactctctatttcctcctccccactggcaccaccattctgctttctgtctcaatacatttgactgctccaggtaact

SEQ ID NO: 52662 - DNA, 201 bp, Homo sapiens
tgtaattccagctactcaggaggctgacgtgggagaatcacttgaacacaagaggtgaaggttgcagtgagccgatatcatgccactgcactgcagcctgrgtgacagagtaagactctgtctccaaaaaaaaaaaaaaaaaaaaaaaaaaaaaagcagacaacttgcaacattatcttcatccttgtacactaatttgtt

SEQ ID NO: 52663 - DNA, 201 bp, Homo sapiens
ctctgtatattcacttggttagcccacagattggtttggacctaattccctttccttctttaactgcccaaagggcttttctatttaaaaaaaaaaaaaaatttttttaaagttttcagattcaatacccacctatttgtatgcttacccatcccagagtcagctaaatttaaagtgtcagtaaattgtaaagaaaagatt

SEQ ID NO: 52664 - DNA, 201 bp, Homo sapiens
ttaaccatttttaagtgtacagtttagtggcattgagtacattcatactgttgtgcaatctgtcctcatgtctcttttctttccaaatggaaactctcccwattaagcaagaactctctatttcctcctccccactggcaccaccattctgctttctgtctcaatacatttgactgctccaggtaactcatagaagaggga

SEQ ID NO: 52665 - DNA, 201 bp, Homo sapiens
aggaggatattgagcagaaccataagaaactagtgattaagagtccaggtgtgaaaatagaaaccacgtctcagaagctcagagagaagaagaactggaarggcagcatctttgatggatttggccatgaagaggaggaggaataaagcagaatggaggccagaaaagagtgtgtatgtctaacggtttcattggaattgg

SEQ ID NO: 52666 - DNA, 201 bp, Homo sapiens; identical to SEQ ID NO: 9802

SEQ ID NO: 52667 - DNA, 201 bp, Homo sapiens
ctgagggagtagaaactatgaaaacttgggagatggaggttgcaatgagccgagatcatgtcactgctctccagcctaggcaacagagggagactgtttcaaaaaaaaaaaaaaaaaaaaagaaacaaaagaatggctgctccatagacagagcagcagtatcagctgcttgactgagtctacttatagttatttcttgat

SEQ ID NO: 52668 - DNA, 201 bp, Homo sapiens
ggaggcagagatgggagggttgcttgaggccggaagttcagtctgggcaagacttggtctctaaaaataaattacctaggtatggtggtgcatacctgtastcctagctattcaggaggctgaggcaaagaatcacttgagccccggagttcaaggctgcagtgagctatgatcacaccacagtgccccagcctggacaag

SEQ ID NO: 52669 - DNA, 201 bp, Homo sapiens
ttgaacctgggaggcggaaattgtagtgagccaagaccgtaccattgcacttcagcctgggtgacagagactccatctcaaaaaaaaaaaaaaaaaaaaaraaagaagcagctgtagacaataccaaatgaatgaacgtgactgtgttccaacaaaactttatttacaaaaacagggatgggccggatgtagccagaggcc

SEQ ID NO: 52670 - DNA, 201 bp, Homo sapiens
cccagcctggacaagagagcaagaccctgtctggctcaagcaacaacaaaggaaggaaggaagaaggaaggaaggaaggaaggaaggaaggaaggaaggawggatggaagggagggagggagggagggaggaaggaaggggaaaaagagagaggaagggagggagggagggaggaaagagagaaaaaggcaggcaggcagg

SEQ ID NO: 52671 - DNA, 201 bp, Homo sapiens
attgactatggatttcatcagggtctttgtggggaaatcctgcttatacccacctcaatcttcctccctcccttccttccactggccttatcgtgattgtwaaatagggcaacactacattccataaaatagaataagtgtccctatgagctgagcagaagttggctttagagacaggcaaaggctgaagaaggctgaggc

SEQ ID NO: 52672 - DNA, 201 bp, Homo sapiens
gcctggacaagagagcaagaccctgtctggctcaagcaacaacaaaggaaggaaggaagaaggaaggaaggaaggaaggaaggaaggaaggaaggatggawggaagggagggagggagggagggaggaaggaaggggaaaaagagagaggaagggagggagggagggaggaaagagagaaaaaggcaggcaggcagggcaa

SEQ ID NO: 52673 - DNA, 201 bp, Homo sapiens
cttatcgtgattgtaaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagat

SEQ ID NO: 52674 - DNA, 201 bp, Homo sapiens
cggaccctgcacccatggattccatccaccgctggccaggagctgagtagaggcaccgagcacgtgaagaggtgaatgggcaaggaaggcttccaggtcasgtagcatttccagtgttccagcctgcaggcatctaccgagcctggcccgaggctggtacccagagatgcttccagtcttccagcagcaacgcactgactg

SEQ ID NO: 52675 - DNA, 201 bp, Homo sapiens
ttatcgtgattgtaaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagatc

SEQ ID NO: 52676 - DNA, 201 bp, Homo sapiens; identical to SEQ ID NO: 9808

SEQ ID NO: 52677 - DNA, 201 bp, Homo sapiens
gccgggcgtggtggcaggcacctgtagtcctagctactcgggaggctgaggcaggagaatggcatgaacctgggaggcagagcttgcagtgagccgagatygggccaccacattccagcctgggcgacagagccagactccatctcaaaaaaaaaaaaaaattagccaggtgcggtggtgcatgcctgtaattccagctac

SEQ ID NO: 52678 - DNA, 201 bp, Homo sapiens
gggttcaagcgattgtcgtgcgcagcctcccgagtagctgggattacaggctcccgccaccatgcctggctatttttttttttttttttttttttttttaktagagatggggtttcgccatgttggccaggctgttctcaaactcctgacctcaggtgatccgcccgccttggcctcccaaagtgctgggattacaggcgt

SEQ ID NO: 52679 - DNA, 201 bp, Homo sapiens
ctaggtctgagactagacaagtgtcaaattcatgctctgccactagttaactgtgcgatgccagcaagttacttctctgcccttcagtttccttctctgtraaatgcatataatgtaataatatatttcatctcaaagcattattgtgaaaataaactaaggtaatgtgtgaaaagtgctcatcatcatcactggtacaga

SEQ ID NO: 52680 - DNA, 201 bp, Homo sapiens
ttttgtctaacttatttttcagttgagatataggctactcttcccaactcagtcttgaagagtatcaccaactgcctcatgtgtggtgaccttcactgtcrtatgccagtgactcatctggagtaatctcaacaacgagttaccaatacttgctcttgattgataaacagaatggggttttggatcttagcaattctcaca

SEQ ID NO: 52681 - DNA, 201 bp, Homo sapiens
gattgataaacagaatggggttttggatcttagcaattctcacaattctcatgtattccacagcagcaaagtttagtaagtattgccttctaagtataatktaaatttttataaattaaataatttcaagaacatttaccttgttttaagcagtttgcttccagttgttccagttgaattgtaaactgaaaaatatattgc

SEQ ID NO: 52682 - DNA, 201 bp, Homo sapiens
gattggtattactcacaaacaaacaaaagtattcccactcaggaaagaaatcgtgtgtttgcctcaggccaacttctgaagtttctaccagctgcagttgytgattctggtatttatacctgtattgtcagaaggtattatgcagaaggctcccatcttctttcaccctgctcccctttcttcagtggttgattgcctgag

SEQ ID NO: 52683 - DNA, 201 bp, Homo sapiens
aggaggaaatgattcaattatttcctctcaagggattactcaatgttgtttttatgtttaaatatttatttgtcaacatcaagaattcttagtacatgatkcaccagcatttttgaacaagtcatagatttggccacaaatcaaatttcaggatgggaggagtgtctcccctttaaaatagaagagagtgagtagtctatg

SEQ ID NO: 52684 - DNA, 201 bp, Homo sapiens
agaggaattcacatgcctatagatgtaaaggtatgaacaacaggtgactttggtttaccctggaatatctgggaatgctaatagcctcaataacggctcargagacttgtgaaagatacaatttaggagaatctaatgcatttcttctctcaaggctctcttcttcccccattttcccactggccacccatgcaggtagaa

SEQ ID NO: 52685 - DNA, 201 bp, Homo sapiens
tttgctactccttagttgctttgtgatgactacttgcacatgtgtctgtttgtgagttatttttgtgagcatgctgctaccagcctgtgtggatgtctgtrgtttcacatgatacattttattttctaaagtctactgaattttatggtttttttttcaaaaatagaaactcatattctttccttcttaatttagtttctt

SEQ ID NO: 52686 - DNA, 201 bp, Homo sapiens
attgattttcttggccttacagatgagaagccagattccacacaaattattttgtttgttagagtttaagcgtgtgtgtgtgtgtgtatgttatgccccamgatcattttctcctctttgcatttggttgttttatcatctcacaggctgagtaaaacgactatgcatggaacactgtagaagaaaaattatattaaaaaa

SEQ ID NO: 52687 - DNA, 201 bp, Homo sapiens
agtgatggaaacacctgcagagtgatggagacgggcttggacataggcatgtgccatttggggctgttgcagttggagagcttccttgagaaggcaaataytgagccaagttgaaaggactctagggacctggcatctgggataagtggggagggtggcccaggtagcacaggcataggcagatttggggggaagcataag

SEQ ID NO: 52688 - DNA, 201 bp, Homo sapiens
aaattagccaggcatggtggcatgcatctgtaatcccagctactcgggaggctgaggcaggagaatcccttgaacctgggaggcagaggttgcagtgagcrgagattgtgccactgcactccagcctgggcgacagagtgagactctatctcaaaaaaaaaaaagaaaaaaaagaaaaggcagggtccctgccttcaggga

SEQ ID NO: 52689 - DNA, 201 bp, Homo sapiens
tctgttagcaatattttgtagttttcacaggagatatctcatatattatccaatgaatttatactttggtattttgatttttaaatgctatggtaaatggmatttttaacaaacttcacttttcaagtttccatctctaatatatagaattgctatttatttttatattccatgatcttgataaacttaatatttccagta

SEQ ID NO: 52690 - DNA, 201 bp, Homo sapiens
tcgggcggctgaggcaggagaatcgcttgaacccgggaggcggaggttgcagtgagccgagatcgcgtcattgcactcactccagcctgggcaagaagagsaaaactccgtctctgtccggacaatcctagattatttgcattttcatatgaattttagaaacagcttcttaatttctttgaaaaattttcctgggatttg

SEQ ID NO: 52691 - DNA, 201 bp, Homo sapiens
agcaatccccacaggaagtacacattcctctgtgcatccagctggggattttagagagagagtgacctggaaaggaatcctgttgaaatgatttacttackgagttttcattatttaacctgatgacagtaagctctttgtcaattttcactttttccccccaattttgtgtcacatcaccttgataattcttgattccat

SEQ ID NO: 52692 - DNA, 201 bp, Homo sapiens
gcaaatattgagccaagttgaaaggactctagggacctggcatctgggataagtggggagggtggcccaggtagcacaggcataggcagatttggggggawgcataaggctaacaacagacacttgtgtgacaaggactatgaggtggcattgattttcttggccttacagatgagaagccagattccacacaaattattt

SEQ ID NO: 52693 - DNA, 201 bp, Homo sapiens; identical to SEQ ID NO: 9880

SEQ ID NO: 52694 - DNA, 201 bp, Homo sapiens
tctttaatcacacctctctttcactttccacggtagtcaggaggcggagatcgctgcttctcacctactttctgaacttggcctccgcagtcgcgacctgrcgtgaaggaggagctgccgcccccgccccagcctcggggacgcctctctgaaggtaagggtgggctccgctgccacccgcatcccctccccaccccccag

SEQ ID NO: 52695 - DNA, 201 bp, Homo sapiens
aagcaaaaagcctggggcgcatttgtgtacttgagacgcggagcccctctcaccttcggcatcccccggggacccctcttccaccctcagccctcccctcytcttcctctgaagagccgggcggccgctgcggccagcggtcctccctcctggcatcctctgctgtgaaccgcggcctgcagggtgcttgcgagcggcccg

SEQ ID NO: 52696 - DNA, 201 bp, Homo sapiens; identical to SEQ ID NO: 9882

SEQ ID NO: 52697 - DNA, 201 bp, Homo sapiens
gccttatctctttaatcacacctctctttcactttccacggtagtcaggaggcggagatcgctgcttctcacctactttctgaacttggcctccgcagtcscgacctggcgtgaaggaggagctgccgcccccgccccagcctcggggacgcctctctgaaggtaagggtgggctccgctgccacccgcatcccctcccca

SEQ ID NO: 52698 - DNA, 201 bp, Homo sapiens
tttatactttggtattttgatttttaaatgctatggtaaatggcatttttaacaaacttcacttttcaagtttccatctctaatatatagaattgctattkatttttatattccatgatcttgataaacttaatatttccagtagtttttttttttgtagatttcaaaagttggtctacatataattatgctctctgttaa

SEQ ID NO: 52699 - DNA, 201 bp, Homo sapiens; identical to SEQ ID NO: 9883

SEQ ID NO: 52700 - DNA, 201 bp, Homo sapiens
gaggagcacccggaccggagggtccccagaccgggacctccgagtcagggaggattctacgccagggagcgccccagactgagagcgccccagaccgctayactcccggacccggagcttcgcccgaccgcgggcagtgcccacctgcagcctccaccggccggggttagcagccaggagctgccagacgcctgacattct

SEQ ID NO: 52701 - DNA, 201 bp, Homo sapiens
ttataaatcctcaagtcagtataagtctctcaactttgttcatctttgtcaagattgcccagacaggccgggcaggtggctcacccctgtaatttcaacamtttgggaggctgaaatgggtggatcacctgaggtcgagagttcaaaaccagcctgaccaacacggagaaaccctgtctctactaaaaatacaaaagtagc

SEQ ID NO: 52702 - DNA, 201 bp, Homo sapiens
ttataacaataagacttttaaatgttcaggatgtttatgtttaaagcattagactgataagaaatctgatctatttcttgtatgactagatgtagtcactrcagtggaaaccaacatacgaaagagcaggcggcacattttcatcctgacccctcagatcactcacaataaggagtttgcctacgagcaggaggttgccct

SEQ ID NO: 52703 - DNA, 201 bp, Homo sapiens
tatttattatgtggtgaattatctaaattgggtaaaaagaattaaaatcattgtccaattgaacattttgcctgtcggctatgggtttcccttttcctttkgttaaataacagttctgccacaaaataaaaatctagaaacacacattcccctttggcctccttaaaaaaaattaaaacttcaacaattgcacccctctct

SEQ ID NO: 52704 - DNA, 201 bp, Homo sapiens
gaacaaaacgggttctatatccacacatacttccacttctctgagtaagtgacttgatgtcagagaatctcacaccagattataacaataagacttttaartgttcaggatgtttatgtttaaagcattagactgataagaaatctgatctatttcttgtatgactagatgtagtcactgcagtggaaaccaacatacgaa

SEQ ID NO: 52705 - DNA, 201 bp, Homo sapiens
agacatttttaattttggtgatgtccaattaatcaatgtgtcccaaatggctatttttttttgtgtcctagctaagaatttttttttttgcctgtccaagrgcatgatttatttatttattttttgcctgttcaagggtcttctctgtatttttatgaaatatttacggttctagcttttatgtttaggtccatggtctat

SEQ ID NO: 52706 - DNA, 201 bp, Homo sapiens
cattcgtatatattttttagtgaaggcaaaatattttgccttatttaaattgtatttctttttatattgttgatgtgtaggaattatttatgtattgtggrtgcaagttctttgccagatagatgtaaagtgagaatatttccagggttatctattcatttttaagtgatgtctttgtttagtagacatttttaattttgg

SEQ ID NO: 52707 - DNA, 201 bp, Homo sapiens
tttccagggttatctattcatttttaagtgatgtctttgtttagtagacatttttaattttggtgatgtccaattaatcaatgtgtcccaaatggctattkttttttgtgtcctagctaagaatttttttttttgcctgtccaagagcatgatttatttatttattttttgcctgttcaagggtcttctctgtatttttat

SEQ ID NO: 52708 - DNA, 201 bp, Homo sapiens
tggtgttgtcaagtttctttatattttaacaattttcacaggtgttagatgaagatcaccatggtcttaacttgaagttccccgactcatgatgatgagcmcttttcatgttttcattggccattcgtatatattttttagtgaaggcaaaatattttgccttatttaaattgtatttctttttatattgttgatgtgtag

SEQ ID NO: 52709 - DNA, 201 bp, Homo sapiens
cctcaccaataattggtgttgtcaagtttctttatattttaacaattttcacaggtgttagatgaagatcaccatggtcttaacttgaagttccccgactmatgatgatgagcccttttcatgttttcattggccattcgtatatattttttagtgaaggcaaaatattttgccttatttaaattgtatttctttttatat

SEQ ID NO: 52710 - DNA, 201 bp, Homo sapiens
tgagagctctgctgcttcattgcctcaccaataattggtgttgtcaagtttctttatattttaacaattttcacaggtgttagatgaagatcaccatggtyttaacttgaagttccccgactcatgatgatgagcccttttcatgttttcattggccattcgtatatattttttagtgaaggcaaaatattttgccttatt

SEQ ID NO: 52711 - DNA, 201 bp, Homo sapiens
tatatgacccaaaacttccataggaataagtgcaatgcttgcatatctgaaacctgctgttacatctctttgcacttaataaatatgtgttgactgattcrttctcctgggtggtgctgagaaagtaaaaatcatggctgataaaaattctgtttatggttttgtctaacttatttttcagttgagatataggctactctt

SEQ ID NO: 52712 - DNA, 201 bp, Homo sapiens
gaaactcatattctttccttcttaatttagtttctttcaggacattctcatgagactggtgaaatataactgcgaagtagcatgataactgtgaaatagcrtgatcattgtgaaagctatatgacccaaaacttccataggaataagtgcaatgcttgcatatctgaaacctgctgttacatctctttgcacttaataaat

SEQ ID NO: 52713 - DNA, 201 bp, Homo sapiens
caagtcagtataagtctctcaactttgttcatctttgtcaagattgcccagacaggccgggcaggtggctcacccctgtaatttcaacactttgggaggcygaaatgggtggatcacctgaggtcgagagttcaaaaccagcctgaccaacacggagaaaccctgtctctactaaaaatacaaaagtagccaggcgtgata

SEQ ID NO: 52714 - DNA, 201 bp, Homo sapiens
tatagtattctatataaataatataacatatattttatatagaatattatatataatataatatatattttatatagaatattatatataatataatatayattttatatagaatattttatatatataatattatatatatgtatttgagacagagtctcctatgaacatacttgtggacttatgattttattttgacac

SEQ ID NO: 52715 - DNA, 201 bp, Homo sapiens
tgtaatgaatatatcatcagtttggctttgcatattcaaatgcagcagaatttaatgtggtgcctgcacatgggaagtgttgtggatgtttattgactgacacacagtttgtttagatagataaggctgcttttccattggataactgtgggggatttagctccaaattaattcattaacatttcataagagatcttaaca

SEQ ID NO: 52716 - DNA, 201 bp, Homo sapiens
attatataaatataaattatatatttatatataattattatataaatcattatataattattataattataatatataatataatataatattatatatamtatatagtattctatataaataatataacatatattttatatagaatattatatataatataatatatattttatatagaatattatatataatataata

SEQ ID NO: 52717 - DNA, 201 bp, Homo sapiens
cttattttaataacccagtccaaattataaaaagaaaagctttaccaccctaatctctggtatagagaatgttctctttttttagttgacattggggggaraaaaagcttgactttgaagttcagcaagtctggtttcaaccccagccacaactgggtgaactttgtcaaattacttaaacagtcttatccttgggttttt

SEQ ID NO: 52718 - DNA, 201 bp, Homo sapiens
aaatcttgttcccaacatgccagattttctttattttctatatatatataatattttatatataatattatatataatattttatatataattttatatawaaaatattatatataatattatatataatattttctatataaaatgtgtatataattatatataattatataaaatataatatagaatatctaataatgt

SEQ ID NO: 52719 - DNA, 201 bp, Homo sapiens
actgcaggtcctgaaaacattttcatcaataaaaaaaaataaaaaaacagaataaaaatgatacccagatgtcctctagtgaaatgaggggaaaaaaaaaatccatccccggcttattgtgagagtcactgaatgagagcctgactcactgaaattcatataagattaatgtaaccaagttccctgtcttttgacactggt

SEQ ID NO: 52720 - DNA, 201 bp, Homo sapiens
caggcagaatgtcagttgtaaatcttgttcccaacatgccagattttctttattttctatatatatataatattttatatataatattatatataatattwtatatataattttatatataaaatattatatataatattatatataatattttctatataaaatgtgtatataattatatataattatataaaatataat

SEQ ID NO: 52721 - DNA, 201 bp, Homo sapiens
attgagaaatcttcatactgttttccttagagattgaactaattgacattcccagcaacaatgtataagcattcccttttctccatatccatgccaacatstgctgttttttgagtttttgataatagccattcagacgggtcttctggtttttggaggggaggattgggtgaagcaagaaggagtttggagggaaggagt

SEQ ID NO: 52722 - DNA, 201 bp, Homo sapiens
ctaattgtactactttacattcccaccagttgtgtatgagagctctgctgcttcattgcctcaccaataattggtgttgtcaagtttctttatattttaayaattttcacaggtgttagatgaagatcaccatggtcttaacttgaagttccccgactcatgatgatgagcccttttcatgttttcattggccattcgtat

SEQ ID NO: 52723 - DNA, 201 bp, Homo sapiens
tcacttgaagaacattctgattccctcaggcagaatgtcagttgtaaatcttgttcccaacatgccagattttctttattttctatatatatataatattwtatatataatattatatataatattttatatataattttatatataaaatattatatataatattatatataatattttctatataaaatgtgtatataa

SEQ ID NO: 52724 - DNA, 201 bp, Homo sapiens
tccgataagataaaagaaataagacagatattcggggtagagatgtaagagcatggtgaaagacagactgctcctgtttagatccatatataaaagctttrttttttgaatcccaaattccatcccttggtcatctgtactggttcattcaataaatatttctgaggctgggcatggtgactcaagcctgtaatcccagca

SEQ ID NO: 52725 - DNA, 201 bp, Homo sapiens; identical to SEQ ID NO: 9885

SEQ ID NO: 52726 - DNA, 201 bp, Homo sapiens; identical to SEQ ID NO: 9886

SEQ ID NO: 52727 - DNA, 201 bp, Homo sapiens
atttttaaataataaaataaccattatgtatattgatggtttttaagaagaaaagcaatattaagtaaaggctgaatttagattaagttatttcacaatgytaagtgactcttttaattgtctgacttattttaacagtcccacattcaataggactggatatgcgaatgtcaccatatataaaaaacaatcagattgcaa

SEQ ID NO: 52728 - DNA, 201 bp, Homo sapiens
ctctgttttagttaagactaagctacctgggaaataaaaagaggacattggggctgatattctcacaaatgaaaggaacacaaagaacaaaacgggttctmtatccacacatacttccacttctctgagtaagtgacttgatgtcagagaatctcacaccagattataacaataagacttttaaatgttcaggatgtttat

SEQ ID NO: 52729 - DNA, 201 bp, Homo sapiens; identical to SEQ ID NO: 9888

SEQ ID NO: 52730 - DNA, 201 bp, Homo sapiens
ccaggctgggtttggccaatgggaggcactggcaggaggtcagagggtggtcatgtacctgcctctccacgtggggcttctggagcagctgtgcttctccytctgggagcacctcttctcagctggcctgcctcatgcatctgcaatccctcagacacccgtctgtgagaatatcttggattgttttattcacggttgtgc

SEQ ID NO: 52731 - DNA, 201 bp, Homo sapiens
attacaaatgtactcaagaacctgcagggactcctgttgtttgtgagctcaacaatgtgccacatctggccacaagctcttcacctcttctttttcagtcyatccacctaagttctagttacacttctcctcagccaaacccagatgctagctctctcacactcaagcttgtgctgccttcaatgtgtgacaacatactaa

SEQ ID NO: 52732 - DNA, 201 bp, Homo sapiens
aaggtaagaagaaatttggaaggaaatagatgaaaattacacaattaaaatagacacaagtggccgggcacagtggctcatgcctgtaatcctagcacttygggaggccaaggcaggcagatcacttgaggccaggagtttgagaccagcctggccaacatgaggaaaccccatctctactaaaaatataaaaatcagctg

SEQ ID NO: 52733 - DNA, 201 bp, Homo sapiens
gctaagcccagattccattttgcttgctaatctgttatcagtgagttgtgtttttggattttcttaaaggccattttccatcctgctatgtaaatcctcayggtcctgagatccatctcaacagctcacttttcttccccgataggattgctattcctactgagttcccaataacagaatctgccccaagcccagaaaggt

SEQ ID NO: 52734 - DNA, 201 bp, Homo sapiens
attcctacccaattttatatacttttgacagttttatcacaactcctgtgtttgcagtagttatttttcccttcccttcatacatttatgtccagtacctrtggaccctccttgtgaactcttctctaatttctcacagaccaggaagggtttggaatataactggggctcagctatcaagggcctaagcataataaagta

SEQ ID NO: 52735 - DNA, 201 bp, Homo sapiens
aattctttatcaaagacgctttagccacttaggtgactcttgcttcttctcctacctcccacactgctaagcccttagaggcaacaagtgtctcagacccrttgatgccttctccttaatgccctgacagcaccttgtccgttcctttctcattattgcatgagttacaaccctctgcatcttgcaacccaagtaccacac

SEQ ID NO: 52736 - DNA, 201 bp, Homo sapiens
accatcatccctactttattcccttggtcccccaccaggataactctgccacttcttaattctgtccataagatttgaaagaggacttaaaaattgatgarttttgttctggtagccataggcactagctgaaataccttaaaagtactcagagagtcttcatgactttctttatgttggtgaaacatttgcaaatttata

SEQ ID NO: 52737 - DNA, 201 bp, Homo sapiens
gcctatgtctccattttattaactattactaaatacatatttgatgctcataataataatacacatttattcattatttcctatgtacaaggactcatctrcttattttacatttaactttctcatttattttctcaatacttcaaagtaaaagacaaagaaagttgaataacttgcgaaatactacagttatggagcaag

SEQ ID NO: 52738 - DNA, 201 bp, Homo sapiens; identical to SEQ ID NO: 9911

SEQ ID NO: 52739 - DNA, 201 bp, Homo sapiens
ccttatccctgcattggataatgaattgcatttactaccacaggccttaagaccagaactttaaatatttatccagaagcagacacttatccttcaatcgyccctctcccatcattgtcctggtgatgagatcttcacagtaatgttggtggtgtgaattcagagttagaagtcctttgcttcaaggacttagcaaaccat

SEQ ID NO: 52740 - DNA, 201 bp, Homo sapiens
ggctcacccctgtaatttcaacactttgggaggctgaaatgggtggatcacctgaggtcgagagttcaaaaccagcctgaccaacacggagaaaccctgtstctactaaaaatacaaaagtagccaggcgtgatagtgcatgcctgtaatcccagctactcgggcggctgaggcaggagaatcgcttgaacccgggaggcg

SEQ ID NO: 52741 - DNA, 201 bp, Homo sapiens
ttcctagtgaccaagataactgagagcaattgcttacttttggctggaattaagaacaaactagcacagaaaatagtaatctggatgttttccatctcagkgggcctctagtaggtgaaaaggggcttctaaccttcaagttaagccacagaaggctgatgagattgtgtgcctaaaaattaattacttttgttcacaaat

SEQ ID NO: 52742 - DNA, 201 bp, Homo sapiens
cttgtccacttttttgttatttagtctgtgacagtaaaaaggagaaacactttgggatgaagactgttatttcctgatagtgttttgtggcagtggtttgmcgtcaacatctcttgagtctagaatattttggaggatgacatacattcaccaacagccataaaacttggagaggaatgtcttcaaagagtccagtgagaa

SEQ ID NO: 52743 - DNA, 201 bp, Homo sapiens
ataagtctctcaactttgttcatctttgtcaagattgcccagacaggccgggcaggtggctcacccctgtaatttcaacactttgggaggctgaaatgggyggatcacctgaggtcgagagttcaaaaccagcctgaccaacacggagaaaccctgtctctactaaaaatacaaaagtagccaggcgtgatagtgcatgcc

SEQ ID NO: 52744 - DNA, 201 bp, Homo sapiens
gcaatctgccttagttggggtttcaagtctggacagaacctggccctgaccaaactttctaatcatatcttccaccaattccccaaactgggttattccayttcctcagaaaacacacttcctctctgcacttaggcttatggtattctctctgcccaggtgggcatttccttttttgcatctccctgaatcctactcatc

SEQ ID NO: 52745 - DNA, 201 bp, Homo sapiens
aaatcctcaagtcagtataagtctctcaactttgttcatctttgtcaagattgcccagacaggccgggcaggtggctcacccctgtaatttcaacactttkggaggctgaaatgggtggatcacctgaggtcgagagttcaaaaccagcctgaccaacacggagaaaccctgtctctactaaaaatacaaaagtagccagg

SEQ ID NO: 52746 - DNA, 201 bp, Homo sapiens
ggtggctcacccctgtaatttcaacactttgggaggctgaaatgggtggatcacctgaggtcgagagttcaaaaccagcctgaccaacacggagaaacccygtctctactaaaaatacaaaagtagccaggcgtgatagtgcatgcctgtaatcccagctactcgggcggctgaggcaggagaatcgcttgaacccgggag

SEQ ID NO: 52747 - DNA, 201 bp, Homo sapiens
ttttgtttttttaatggttatgtaagtgaagtagattataaataggcacatacaggatttcaaaactgtaacaaaattaagaaaaagctggttcaatgagsttagattctatgagattaatctgaaaagggagagtagttatgagaagtcttaaaaaagtgggtgtttgccagagaaacaagcggacactggaagatttct

SEQ ID NO: 52748 - DNA, 201 bp, Homo sapiens; identical to SEQ ID NO: 9898

SEQ ID NO: 52749 - DNA, 201 bp, Homo sapiens
tggaagctttattttttaaactgagaaactaatgcttacgtggcctagtttaagaatgaatgctccaacttaatacatgttttaaaaagatgttttgggayaccaaatgtaaaagaattccgagtttgtgttattttattgaacaaacctattcagcacttggggaatcgcaggcagcattgcagactcgctggctcctgg

SEQ ID NO: 52750 - DNA, 201 bp, Homo sapiens
ggaggccaaggcaggcagatcacttgaggccaggagtttgagaccagcctggccaacatgaggaaaccccatctctactaaaaatataaaaatcagctggrtgtggtggcacacacctgtaatcccagcagcttgggaggctgaggtatgaaaatcacttgaacctagaaggcagaggttacagcgagcccagattgcacc

SEQ ID NO: 52751 - DNA, 201 bp, Homo sapiens; identical to SEQ ID NO: 9899

SEQ ID NO: 52752 - DNA, 201 bp, Homo sapiens; identical to SEQ ID NO: 9901

SEQ ID NO: 52753 - DNA, 201 bp, Homo sapiens; identical to SEQ ID NO: 9902

SEQ ID NO: 52754 - DNA, 201 bp, Homo sapiens; identical to SEQ ID NO: 9904

SEQ ID NO: 52755 - DNA, 201 bp, Homo sapiens
tcaacttctttcctctacttggaagcgtccagccaatggcatggttacttcccagcaatccccacaggaagtacacattcctctgtgcatccagctggggwttttagagagagagtgacctggaaaggaatcctgttgaaatgatttacttacggagttttcattatttaacctgatgacagtaagctctttgtcaatttt

SEQ ID NO: 52756 - DNA, 201 bp, Homo sapiens; identical to SEQ ID NO: 9905

SEQ ID NO: 52757 - DNA, 201 bp, Homo sapiens; identical to SEQ ID NO: 9907

SEQ ID NO: 52758 - DNA, 201 bp, Homo sapiens; identical to SEQ ID NO: 9910

SEQ ID NO: 52759 - DNA, 201 bp, Homo sapiens
gctttgcatattcaaatgcagcagaatttaatgtggtgcctgcacatgggaagtgttgtggatgtttattgactgacacacagtttgtttagatagataargctgcttttccattggataactgtgggggatttagctccaaattaattcattaacatttcataagagatcttaacagttacttattctttcccaaggtat

SEQ ID NO: 52760 - DNA, 201 bp, Homo sapiens
aaagaaactctaatttctagtagagggcaatccttttactagaaatcctttgtaatgtggggttggtgaaggcagaatcattggccttgttagtttcccaygcagatgagaatatagtgggagctgagcttcaaacccagctgggtgaatgaaggtaatggaagcagggaggaggcaagagaggacatagaaagaggaagg

SEQ ID NO: 52761 - DNA, 201 bp, Homo sapiens
tttgtaatgaatatatcatcagtttggctttgcatattcaaatgcagcagaatttaatgtggtgcctgcacatgggaagtgttgtggatgtttattgactsacacacagtttgtttagatagataaggctgcttttccattggataactgtgggggatttagctccaaattaattcattaacatttcataagagatcttaa

SEQ ID NO: 52762 - DNA, 201 bp, Homo sapiens
gatgctttcatgtatgcatctaatttcatcttcatctctatcccagagcttgggatggagacctgcagggtgttcattctgggcaatggtagccagatccrgtaaaacatgtttatcttcaaagtagcttatggagagatgaagagagttctgtagaaagatgtggaagagggcagttggaaagaaactctaatttctagt

SEQ ID NO: 52763 - DNA, 201 bp, Homo sapiens
tttactcatgatagggtcatcgcaactatgcatagctaaaatcaaattttgcttttcaagtttgttttacctggagccctagagttcagggttatggtttyctttgtcactccccttgagggaagcttcttagtcacactctccttctctttctctgcactctatgcactctagaaaagctcctttttttttttcttcatc

SEQ ID NO: 52764 - DNA, 201 bp, Homo sapiens
gagagcaaaaccagctttttttttttttttctagtttggtgtcagagtttctgcaaattaaaaaagagcttaatctttagtaatactcattggattcaaartttaatgagaggctttgtgatggtatactatggtgtacataaatgttgtcgagtggtttttaatctttgtttgcaatactttcaacatcatcaatggcct

SEQ ID NO: 52765 - DNA, 201 bp, Homo sapiens
aaaattaagaaaaagctggttcaatgaggttagattctatgagattaatctgaaaagggagagtagttatgagaagtcttaaaaaagtgggtgtttgccaragaaacaagcggacactggaagatttctgattaagttggcagaaatttatgggtgcttaaaatgccttgctttattcatgtattagaagcccttgccttt

SEQ ID NO: 52766 - DNA, 201 bp, Homo sapiens
tatgacgcaaagaggttttctgaacacactatcaagatttaagaaatttcagggggaaattacattactaattcaaagccacatctgttctttattctttytttgtgacttaattttccaaagataaagcaatctgaatgctaacttaacttactttttttgaatggcaatacaactatttggagagcaaaaccagctttt

SEQ ID NO: 52767 - DNA, 201 bp, Homo sapiens
gatgactgaggacgcaggtgattacacctgtaaatttatacacaatgaaaatggagccaattatagtgtgacggcgaccaggtccttcacggtcaagggtragctactgacattaatgagatagaatactacgtgaaagaagtcgaagtgggaacagcggtgcccttctggttgggtttcttgcacttctccctcctccct

SEQ ID NO: 52768 - DNA, 201 bp, Homo sapiens
atgtaataatatatttcatctcaaagcattattgtgaaaataaactaaggtaatgtgtgaaaagtgctcatcatcatcactggtacagagtaaactctgartaaatagtaattatctttattacactgggattacagcattacagcagatgtagtgtatgaataaatggtgaagaagtcattgttagggctactatggggg

SEQ ID NO: 52769 - DNA, 201 bp, Homo sapiens
cttctcctcagccaaacccagatgctagctctctcacactcaagcttgtgctgccttcaatgtgtgacaacatactaatctggaatggttttctacttccytctgtcaatgcatgtcctctgacctttcctcaaccaaaataaatgaaacccaacaacaccaaacttcactcttcacttaggaaagttcatgactgactaa

SEQ ID NO: 52770 - DNA, 201 bp, Homo sapiens
caattatagtgtgacggcgaccaggtccttcacggtcaagggtgagctactgacattaatgagatagaatactacgtgaaagaagtcgaagtgggaacagyggtgcccttctggttgggtttcttgcacttctccctcctccctttacttcctcctgctccatcttatcttatacattctgaactatgacgcaaagaggtt

SEQ ID NO: 52771 - DNA, 201 bp, Homo sapiens
agactaagctacctgggaaataaaaagaggacattggggctgatattctcacaaatgaaaggaacacaaagaacaaaacgggttctatatccacacatacytccacttctctgagtaagtgacttgatgtcagagaatctcacaccagattataacaataagacttttaaatgttcaggatgtttatgtttaaagcattag

SEQ ID NO: 52772 - DNA, 201 bp, Homo sapiens
gaaatggaatttcttatttcagaattgtcaggctcttcaaggatcaaggtacagggcgcacaagtcatttttggtcattgataatgtgatgactgaggacrcaggtgattacacctgtaaatttatacacaatgaaaatggagccaattatagtgtgacggcgaccaggtccttcacggtcaagggtgagctactgacatt

SEQ ID NO: 52773 - DNA, 201 bp, Homo sapiens
aagactaagctacctgggaaataaaaagaggacattggggctgatattctcacaaatgaaaggaacacaaagaacaaaacgggttctatatccacacatayttccacttctctgagtaagtgacttgatgtcagagaatctcacaccagattataacaataagacttttaaatgttcaggatgtttatgtttaaagcatta

SEQ ID NO: 52774 - DNA, 201 bp, Homo sapiens
cagtttctacaacagagattaatgggggtgaagtaaagtcaggacttactttcctagagactttggacaattttgaggggcaaagcttcctgagtttgtgmtttttaatatgtgagttaaaattttaagccattgaaaaacatataagcaaatattctaagaagataatatgtattctaagaagaatgaaccagaattcta

SEQ ID NO: 52775 - DNA, 201 bp, Homo sapiens
cctcctccctttacttcctcctgctccatcttatcttatacattctgaactatgacgcaaagaggttttctgaacacactatcaagatttaagaaatttcmgggggaaattacattactaattcaaagccacatctgttctttattctttttttgtgacttaattttccaaagataaagcaatctgaatgctaacttaact

SEQ ID NO: 52776 - DNA, 201 bp, Homo sapiens
ggatgtcctttgaagatgaaaccataagttgtcctgatggattgcatgttcaatatgtgaggaagagaagagtcaataataaatggagtcttggtctgagmcaacattcagcatggagttgtcatcattacaattagaagacaatgggagatgctgaattttctttggggcaagggaggcaaggaggctggaggagatcag

SEQ ID NO: 52777 - DNA, 201 bp, Homo sapiens
cattgcaattcaaaattgattggtcaggaactcaaacaaatacttggacactgatagcagcattattcaaaatagtcaatagctagaagcaacccagatgyccattaagggatgaatggataaacaaagtgtggtaggcacacacagtggaatattattcagtcattagaaacaataaagtacagacccatgctacaatat

SEQ ID NO: 52778 - DNA, 201 bp, Homo sapiens
accgtggattggtattactcacaaacaaacaaaagtattcccactcaggaaagaaatcgtgtgtttgcctcaggccaacttctgaagtttctaccagctgmagttgctgattctggtatttatacctgtattgtcagaaggtattatgcagaaggctcccatcttctttcaccctgctcccctttcttcagtggttgattg

SEQ ID NO: 52779 - DNA, 201 bp, Homo sapiens
acaaatgcagaccacagcaataaagtctgtggaattagtatgtgagaaattacacaatggtctaaaatattagtcttgaagggatcttaatgatgatttaktcatttcacatgtgcaaactgttaagactgctggctgtttttcacatggccaccagcccatttctttttcctgagtgtctgcagtccacagagcttcttc

SEQ ID NO: 52780 - DNA, 201 bp, Homo sapiens
tagaaactcatattctttccttcttaatttagtttctttcaggacattctcatgagactggtgaaatataactgcgaagtagcatgataactgtgaaatarcatgatcattgtgaaagctatatgacccaaaacttccataggaataagtgcaatgcttgcatatctgaaacctgctgttacatctctttgcacttaataa

SEQ ID NO: 52781 - DNA, 201 bp, Homo sapiens
gtttgggtaagcatcaattacttatctaaaatttgtaataagaaaagtcttcataattcatgattgtgtttatctttatgttagtaaatttctatgttggktctattcttccccttatattttaagaaaagaagtaagaaagtaaatgattatttttctgaaagaaaaaattaatgtatttattattattcatagaccttc

SEQ ID NO: 52782 - DNA, 201 bp, Homo sapiens
caccccttaatgtgaagtgacatgggcaagttgcttaatctctctgtgcctcagtgtccttgtctgtaaaatgggcatcataataatagcgcctgccacaytgggtgagtgtgagaatgaaggaattaatacatgtaaatcacttagactgtgtctggcatagaggacattctaaagaaaagttagctattatcattatat

SEQ ID NO: 52783 - DNA, 201 bp, Homo sapiens
cagcaagtctggtttcaaccccagccacaactgggtgaactttgtcaaattacttaaacagtcttatccttgggtttttatttgtaactataaaatttgastgatgttaatgataagtaccacagagtattgtactttgaatgaaaggtcttaattgtcaaatgaacaactgaattattttataggaagagttcaacttta

SEQ ID NO: 52784 - DNA, 201 bp, Homo sapiens
tagtgagaagccaaaataatttagttcttttcaaagaagaaattatagactagcttattttaataacccagtccaaattataaaaagaaaagctttaccascctaatctctggtatagagaatgttctctttttttagttgacattggggggaaaaaaagcttgactttgaagttcagcaagtctggtttcaaccccagcc

SEQ ID NO: 52785 - DNA, 201 bp, Homo sapiens
tgagagtcactgaatgagagcctgactcactgaaattcatataagattaatgtaaccaagttccctgtcttttgacactggtttacagtaagagcaggccrcacatggccagctctggagtgtgttaggacatttacattttacatttcagtgtgatatctgctaagtcaaatgaagaagtcttgaaagataccttctaag

SEQ ID NO: 52786 - DNA, 201 bp, Homo sapiens
ctgaaaacattttcatcaataaaaaaaaataaaaaaacagaataaaaatgatacccagatgtcctctagtgaaatgaggggaaaaaaaaaatccatccccrgcttattgtgagagtcactgaatgagagcctgactcactgaaattcatataagattaatgtaaccaagttccctgtcttttgacactggtttacagtaag

SEQ ID NO: 52787 - DNA, 201 bp, Homo sapiens
atccttatctcattactaatcttaggaaaaagtaaaatgtttcactattatgaggtcacctgtaggtttcttatagatgttctttatcagattaagaaagrtcatttctactctcggttttctgatcgttattaattcagaaagggtgttgaattttgccagatgcttttatttgcatttattgagataattacatatttt

SEQ ID NO: 52788 - DNA, 201 bp, Homo sapiens
ttgtgctttctcctgttgcagtgaggactgggtatttcatgttctttctgagtccacccagagctaattggaatcaccatggtgtctacgctgtataaatrccaaatgggaaaggggatctattgtcccttgagatttttctagtttggatcaaatcagtttctacaacagagattaatgggggtgaagtaaagtcaggac

SEQ ID NO: 52789 - DNA, 201 bp, Homo sapiens
gttgtgctttctcctgttgcagtgaggactgggtatttcatgttctttctgagtccacccagagctaattggaatcaccatggtgtctacgctgtataaaygccaaatgggaaaggggatctattgtcccttgagatttttctagtttggatcaaatcagtttctacaacagagattaatgggggtgaagtaaagtcagga

SEQ ID NO: 52790 - DNA, 201 bp, Homo sapiens
ggattgttttattcacggttgtgctttctcctgttgcagtgaggactgggtatttcatgttctttctgagtccacccagagctaattggaatcaccatggygtctacgctgtataaatgccaaatgggaaaggggatctattgtcccttgagatttttctagtttggatcaaatcagtttctacaacagagattaatgggg

SEQ ID NO: 52791 - DNA, 201 bp, Homo sapiens
actcttcacttaggaaagttcatgactgactaaggtactgtctatagtctcatgcaacttaccttgcatttgccccatcaaaatcctctctgcaccaccaytccatccagtggccctgggtggctgatcatcatggaatccattgcacccttgtcctctgctccaggctgggtttggccaatgggaggcactggcaggagg

SEQ ID NO: 52792 - DNA, 201 bp, Homo sapiens
ccaaacttcactcttcacttaggaaagttcatgactgactaaggtactgtctatagtctcatgcaacttaccttgcatttgccccatcaaaatcctctctkcaccaccattccatccagtggccctgggtggctgatcatcatggaatccattgcacccttgtcctctgctccaggctgggtttggccaatgggaggcact

SEQ ID NO: 52793 - DNA, 201 bp, Homo sapiens
ctcaaccaaaataaatgaaacccaacaacaccaaacttcactcttcacttaggaaagttcatgactgactaaggtactgtctatagtctcatgcaacttaycttgcatttgccccatcaaaatcctctctgcaccaccattccatccagtggccctgggtggctgatcatcatggaatccattgcacccttgtcctctgct

SEQ ID NO: 52794 - DNA, 201 bp, Homo sapiens
ttttcatattacaaatgtactcaagaacctgcagggactcctgttgtttgtgagctcaacaatgtgccacatctggccacaagctcttcacctcttctttytcagtccatccacctaagttctagttacacttctcctcagccaaacccagatgctagctctctcacactcaagcttgtgctgccttcaatgtgtgacaac

SEQ ID NO: 52795 - DNA, 201 bp, Homo sapiens
cattaaataaatgagcatgaagggatggaggattgcagcagtgctccataagcactgcccgtctttcagccttagtggtcacaggagtcagaattccgtayggggaagatttcactgaggatgggccaccctagtggagaactgcgagcaaatctgtggactcatccatttattattttcatgggtcttttgaaatcttct

SEQ ID NO: 52796 - DNA, 201 bp, Homo sapiens
ttttgaacaagtcatagatttggccacaaatcaaatttcaggatgggaggagtgtctcccctttaaaatagaagagagtgagtagtctatgaggagggacytacaaagactggaaactattcttagctccgtcactgactccaagttcatcccctctgtctttcagtttgggtaagcatcaattacttatctaaaatttgt

SEQ ID NO: 52797 - DNA, 201 bp, Homo sapiens
ctgaatccttctgagatgtgatgacttataaacgtaggttgagtttactcatgatagggtcatcgcaactatgcatagctaaaatcaaattttgcttttcragtttgttttacctggagccctagagttcagggttatggtttcctttgtcactccccttgagggaagcttcttagtcacactctccttctctttctctgc

SEQ ID NO: 52798 - DNA, 201 bp, Homo sapiens
ttcttggctgccgtcctgtggcagcttaatggaacaaaaattacagactttggtgaaccaagaattcaacaagaggaagggcaaaatcaaaggtatttttrtattgaagagaaccatcctcttccccttgcacatggtttgcacctgcaaagtaggcattaaaagtaacaggttgctttcttagtttcagcaatgggctgg

SEQ ID NO: 52799 - DNA, 201 bp, Homo sapiens
catggtttgcacctgcaaagtaggcattaaaagtaacaggttgctttcttagtttcagcaatgggctggcttgtctagacatggttttaagaatagctgaygtgaaggaagaggatttattgctgcagtacgactgtctggccctgaatttgcatggcttgagaaggcacaccgtaagactaagtaggaaaaatccaagta

SEQ ID NO: 52800 - DNA, 201 bp, Homo sapiens
atagctaaaccttacaagactaggaatggtaagtggcaaataccaagtttttctcccaaagaaaaagtcccataataactgttggttacctgtctattaayctttcagtagctaggctgctaagcccagattccattttgcttgctaatctgttatcagtgagttgtgtttttggattttcttaaaggccattttccatcc

SEQ ID NO: 52801 - DNA, 201 bp, Homo sapiens
cactgcaggtcctgaaaacattttcatcaataaaaaaaaataaaaaaacagaataaaaatgatacccagatgtcctctagtgaaatgaggggaaaaaaaamatccatccccggcttattgtgagagtcactgaatgagagcctgactcactgaaattcatataagattaatgtaaccaagttccctgtcttttgacactgg

SEQ ID NO: 52802 - DNA, 201 bp, Homo sapiens
tgataatagccattcagacgggtcttctggtttttggaggggaggattgggtgaagcaagaaggagtttggagggaaggagtggaggcttgagtgggcctmgagtttggagtatgggcaagaaggatcccagagacaagcactttgcccacagctacacagctaatggagctggggggcccagcatattctccagaggccc

SEQ ID NO: 52803 - DNA, 201 bp, Homo sapiens
taaaccttacaagactaggaatggtaagtggcaaataccaagtttttctcccaaagaaaaagtcccataataactgttggttacctgtctattaatctttmagtagctaggctgctaagcccagattccattttgcttgctaatctgttatcagtgagttgtgtttttggattttcttaaaggccattttccatcctgcta

SEQ ID NO: 52804 - DNA, 201 bp, Homo sapiens
gataaacccatagaatcagaaagcagattggtggtggctatgggtttgtggtggaagaggaagaatggggacttcatgttaatgggtatggggttatactyggggatggtgaaaatgttttgaaactagatagagttagtggttgtaccacattgtgaatgtaccaaatgtcactaaattgtgcacttcgaaatagttaat

SEQ ID NO: 52805 - DNA, 201 bp, Homo sapiens
atagtcaatagctagaagcaacccagatgcccattaagggatgaatggataaacaaagtgtggtaggcacacacagtggaatattattcagtcattagaarcaataaagtacagacccatgctacaatatgaacaaaacttggaaagattatgctaagtgaaataaggcagtcacaaagggcacttattgtgtgactccat

SEQ ID NO: 52806 - DNA, 201 bp, Homo sapiens
ttagaaaaagattggagcaggttaaggagatggggattgggagaggagacattgcaattcaaaattgattggtcaggaactcaaacaaatacttggacacygatagcagcattattcaaaatagtcaatagctagaagcaacccagatgcccattaagggatgaatggataaacaaagtgtggtaggcacacacagtggaa

SEQ ID NO: 52807 - DNA, 201 bp, Homo sapiens
atacaaaaattagctgggcatggtgatgtgtgcatgtagtcccagctattctggaggctgaggtgggaggatcacctgagcctgggaggtggagactgcartgagccatgatcacaccactgcactccatcctgggtgaaagagtgagaccttgcctcagaaataataataataatgataataagtaaacatttctgagca

SEQ ID NO: 52808 - DNA, 201 bp, Homo sapiens
ataataataataatgataataagtaaacatttctgagcacctacttggtgctcttccaggcacatgagctatatcaatagacaaaactcacaaaaataatmttgccttctggaggtcatattccaatggataaaacagaaaataataaacatgatgcataagtagaatgttagaagtgatgaatgccttagaaaaagattg

SEQ ID NO: 52809 - DNA, 201 bp, Homo sapiens
gctttcattccttccctagtcctttctggaacagttaaatttataaaatgatttgaataaaagtgatttggataaacttctaggaatactatcaggttgakgtctagctcattctgagctatttggatttacagttgcagggattgatttgtagctgacttagagaaaaacctagctttcctagtgaccaagataactgag

SEQ ID NO: 52810 - DNA, 201 bp, Homo sapiens
tcttgataaacttaatatttccagtagtttttttttttgtagatttcaaaagttggtctacatataattatgctctctgttaaaaccagtagttttaattmtttcttctcaatctttatgctttctaattttatttttatttcttcacttgttgcaaagcagttgtcccaggtgggagccaaaatccttatctcattacta

SEQ ID NO: 52811 - DNA, 201 bp, Homo sapiens
gagcaaaaccagctttttttttttttttctagtttggtgtcagagtttctgcaaattaaaaaagagcttaatctttagtaatactcattggattcaaagtytaatgagaggctttgtgatggtatactatggtgtacataaatgttgtcgagtggtttttaatctttgtttgcaatactttcaacatcatcaatggccttg

SEQ ID NO: 52812 - DNA, 201 bp, Homo sapiens
tgtcaaatgaacaactgaattattttataggaagagttcaactttaataaatactcctgcagaatttcatcattatgatgttaaaattgatggaagctttwttttttaaactgagaaactaatgcttacgtggcctagtttaagaatgaatgctccaacttaatacatgttttaaaaagatgttttgggataccaaatgta

SEQ ID NO: 52813 - DNA, 201 bp, Homo sapiens
agagaactgataaactattagaggttgtggaggaattcgtgaatatgggccagtgatttttctaccttaaaactgggagcccatgcatggagacttaagayggaaaagaaccgtatcagcaaatctcatttgagattcttctcacattcatcagtgcatatgcatgttgcatctacattttgtgaagcaaggagtactagg

SEQ ID NO: 52814 - DNA, 201 bp, Homo sapiens
attctgtaatatatagagtctaaaaatatacagtgtggagaatagatgtcttaagtcttccaatccgtaaacgtggtatatccctttattacttagatgtytcatctctgttagcaatattttgtagttttcacaggagatatctcatatattatccaatgaatttatactttggtattttgatttttaaatgctatggta

SEQ ID NO: 52815 - DNA, 201 bp, Homo sapiens
atgtactcaagaacctgcagggactcctgttgtttgtgagctcaacaatgtgccacatctggccacaagctcttcacctcttctttttcagtccatccacmtaagttctagttacacttctcctcagccaaacccagatgctagctctctcacactcaagcttgtgctgccttcaatgtgtgacaacatactaatctggaa

SEQ ID NO: 52816 - DNA, 201 bp, Homo sapiens; identical to SEQ ID NO: 9909

SEQ ID NO: 52817 - DNA, 201 bp, Homo sapiens
atctatttcttgtatgactagatgtagtcactgcagtggaaaccaacatacgaaagagcaggcggcacattttcatcctgacccctcagatcactcacaayaaggagtttgcctacgagcaggaggttgccctgcactgtgccctcatccagaacgacgccaaggtgatacttattgagatggaggctctgagcgagctgg

SEQ ID NO: 52818 - DNA, 201 bp, Homo sapiens
tagatgtagtcactgcagtggaaaccaacatacgaaagagcaggcggcacattttcatcctgacccctcagatcactcacaataaggagtttgcctacgarcaggaggttgccctgcactgtgccctcatccagaacgacgccaaggtgatacttattgagatggaggctctgagcgagctggacatgctgcaggctgagg

SEQ ID NO: 52819 - DNA, 201 bp, Homo sapiens; identical to SEQ ID NO: 9913

SEQ ID NO: 52820 - DNA, 201 bp, Homo sapiens
gttttgtctaacttatttttcagttgagatataggctactcttcccaactcagtcttgaagagtatcaccaactgcctcatgtgtggtgaccttcactgtygtatgccagtgactcatctggagtaatctcaacaacgagttaccaatacttgctcttgattgataaacagaatggggttttggatcttagcaattctcac

SEQ ID NO: 52821 - DNA, 201 bp, Homo sapiens; identical to SEQ ID NO: 9915

SEQ ID NO: 52822 - DNA, 201 bp, Homo sapiens
taaacttttcatccacttgataaaatgctgatattacagaaacgtgtttcacttctcatgagcacgtgcttttaatagattacacaaactccaaggatttyacaatcgtttatcagcacactgacatttaataggaagagtaactttatgtgaagctactttttgtcctaactgtggaactgatattaaaaggcacacttg

SEQ ID NO: 52823 - DNA, 201 bp, Homo sapiens
taaaatgctgatattacagaaacgtgtttcacttctcatgagcacgtgcttttaatagattacacaaactccaaggattttacaatcgtttatcagcacaytgacatttaataggaagagtaactttatgtgaagctactttttgtcctaactgtggaactgatattaaaaggcacacttgaacagtgtgagttgttcact

SEQ ID NO: 52824 - DNA, 201 bp, Homo sapiens
aatagattacacaaactccaaggattttacaatcgtttatcagcacactgacatttaataggaagagtaactttatgtgaagctactttttgtcctaactktggaactgatattaaaaggcacacttgaacagtgtgagttgttcactgcctgctaatgaaggctcatgcaagtatgtatgttcacgttactaaaaaatta

SEQ ID NO: 52825 - DNA, 201 bp, Homo sapiens
aatatttataataaatagctaatacacagtcatgtgtaccacttggacctttgaaatgttcacatttaccatcttgattacaagtatttgttttttaagaratataattttggctgggtgcagtggctcatacctgtaatcacatcaccttgggaggccaaggcaggaggatcacttgagcccaggagtttgaggctgcag

SEQ ID NO: 52826 - DNA, 201 bp, Homo sapiens
gtggaactgatattaaaaggcacacttgaacagtgtgagttgttcactgcctgctaatgaaggctcatgcaagtatgtatgttcacgttactaaaaaattvcaatgattataaccagagtaagcagctgaaataatctggtaattttaataataaatgcttttgaagcaaagtgggttcactgagggtaatattttttgtt

SEQ ID NO: 52827 - DNA, 201 bp, Homo sapiens
tctcaaaaaaaaaaaaaagaaatgtcacggtgaaagggatgatggggcttggacaggatgctagcaaggaagtgacaagaagccctcagtttctacatagygtttgaaaacaaagcaacagggttggatgagagattggatgtagtggatgagaaaaggcgaggaaaagaagacctctaggtttgcaccatattagaattc

SEQ ID NO: 52828 - DNA, 201 bp, Homo sapiens; identical to SEQ ID NO: 9943

SEQ ID NO: 52829 - DNA, 201 bp, Homo sapiens
tgtcacggtgaaagggatgatggggcttggacaggatgctagcaaggaagtgacaagaagccctcagtttctacatagcgtttgaaaacaaagcaacaggrttggatgagagattggatgtagtggatgagaaaaggcgaggaaaagaagacctctaggtttgcaccatattagaattctaagcaggggtgttgttaggca

SEQ ID NO: 52830 - DNA, 201 bp, Homo sapiens
aaaattttagtgtcaaaagattaccaaatgattatttagtcagaatctatttcaaaattgtgtaattttaaacaagatatctaattcactttttttgtttmgaatatattttttcacatgtactatagatcctatggtgacgaaatattaaataatttagtgacttttttatatatccagaaaacattggcttttttttga

SEQ ID NO: 52831 - DNA, 201 bp, Homo sapiens
tcgtattttgggcatatgttatccattctacttccctaactgtctaaggacagtgtgacttttagggtcttaggtatgcttacttgccttttagtgtgagkttgtatattaatctagctaggagctgggttacgtctaacatttcctgtagatacagctgtcagaagctaaaattacctgtagtgtctctttgttgcctct

SEQ ID NO: 52832 - DNA, 201 bp, Homo sapiens; identical to SEQ ID NO: 9945

SEQ ID NO: 52833 - DNA, 201 bp, Homo sapiens
agggttggatgagagattggatgtagtggatgagaaaaggcgaggaaaagaagacctctaggtttgcaccatattagaattctaagcaggggtgttgttasgcagtgcatatatgggtttgtagttgagagacgagctatgggcaagagataaagacttaagagtcatcagccttctagattatatttaaagcaatgaggc

SEQ ID NO: 52834 - DNA, 201 bp, Homo sapiens
ataaaatgtctgcccatgtgctctaataagagataggctgggaataagatacatttttatgtgcatactaagcagtttaacaacaacaacaaaaaagttcmtaaagaccaggccaaagttcctctgctacagggcagtctaaggaagtattccaagacagagcaaaaattccactaagaaagaaataatgaaaacaataat

SEQ ID NO: 52835 - DNA, 201 bp, Homo sapiens; identical to SEQ ID NO: 9946

SEQ ID NO: 52836 - DNA, 201 bp, Homo sapiens; identical to SEQ ID NO: 9948

SEQ ID NO: 52837 - DNA, 201 bp, Homo sapiens
agaaaaggcgaggaaaagaagacctctaggtttgcaccatattagaattctaagcaggggtgttgttaggcagtgcatatatgggtttgtagttgagagaygagctatgggcaagagataaagacttaagagtcatcagccttctagattatatttaaagcaatgaggctagtgagatcaccaagggagtgaaaataggag

SEQ ID NO: 52838 - DNA, 201 bp, Homo sapiens
tagtctgagaaggagaaagagggggagttggatttgctgtctcaggaatcgtagaggtggaagatccatgtataagtggaacagtgcacagttcaaacacrtattgtttaagggttgactgtaataatatttgctatgaagggtaaaatgaaatatttctaccctcagtcatttgtttgatcagtatggcagtgatatgta

SEQ ID NO: 52839 - DNA, 201 bp, Homo sapiens
tgtctcaggaatcgtagaggtggaagatccatgtataagtggaacagtgcacagttcaaacacatattgtttaagggttgactgtaataatatttgctatkaagggtaaaatgaaatatttctaccctcagtcatttgtttgatcagtatggcagtgatatgtatgtccaaagcaatcacactcaagagatacaaatttac

SEQ ID NO: 52840 - DNA, 201 bp, Homo sapiens
aagtcaatgtttgtcaggtagacaattaacaatgttccctcagaaaagcacaattaggagatgattacgttgagatttttttaattcattgagacagtatrtaggaattttaggaacatgtgtttggcactagatgtggttttggcttttaatcacacataaaaccataatatagcctgatttttttcaactatgcatttt

SEQ ID NO: 52841 - DNA, 201 bp, Homo sapiens
acatgccttgaaaagaacctaaactttcaccttgggctgatctctaggattagtgcaaatctggctaagtgttaacggcgtgcccaggctcagaaacaatytgcaaatactgagggagatggattgttgttggttgtgttggttgctgcagattttgtgttttgtcttttatttctgtttttagtgcttggcattcaaaaa

SEQ ID NO: 52842 - DNA, 201 bp, Homo sapiens
tattatatatattttttatttatggatgctacaattgtgttcttcccctatctatgactctgcttagattggtgtgcaggccaaatctggttacttctcaygctctgatttaagaaactttatatttatttctgatagtgatgcacaccattatgtcaaatttagaatacacagctattaactttattgctccccagatca

SEQ ID NO: 52843 - DNA, 201 bp, Homo sapiens
aaaccaacagccaatatcatactgaataggcaaaagctggaagcattccccttgaaaacaggcatgagacaaagatgccatttctcaccactcctttcaamacagtatcggaaattctggccggggcaatcaagcaagagaaagaaataaaggtattcaaacaggaagagagaggaagtcaaactatccttgtttgcagat

SEQ ID NO: 52844 - DNA, 201 bp, Homo sapiens
tcaagcaagagaaagaaataaaggtattcaaacaggaagagagaggaagtcaaactatccttgtttgcagatgacataatcctatatctagaaaaccccawcaactcagccccaaagcttcttaagctgataagcaacttcagcaaagtctcagaatacaaaatcaatgtaagaaactcactagcattcctattcagcaac

SEQ ID NO: 52845 - DNA, 201 bp, Homo sapiens
ccgagatcgcgccactgtgctccagcctgaggggacagagcgagactccgtctcaaaaaaaaaagaaaaaacaaaaaagtcaccacaggaaaatattttcyagaggtaacaattaacttctttttggccattaaaaatacactaaaacaaaaatccaaccataacaaccaaccaaccaaactattgttgtctgagtaaaag

SEQ ID NO: 52846 - DNA, 201 bp, Homo sapiens
acgttggggagatgaggaggaatacccagaaataaataaaactcccctggatgtgctatctcagtgcaatcatcagtatctctcttctcaacaaaaaaccrtgagcatgaacaactttcatttatgcactcagggactttcatttttatacatttattactgccaatcttgcaaggttttatttctgcttctaccacacag

SEQ ID NO: 52847 - DNA, 201 bp, Homo sapiens
aagtagatgataataataagtgggtatgataataaatagatgatgtaaatggatgatataaccacagtgaaaatcctggaaaaagaaaagttaggttgctrtagaaaatccacgtttgtagctagttgtgttatgtaaaacaaaagctgatgctgagattgagatctggtttggctatattggcttgatcaggacacaggc

SEQ ID NO: 52848 - DNA, 201 bp, Homo sapiens
tagatgagattctcagagagactgtgcagactaagaaaaaagaaagtaacatcagaaaatgccacaaatcctatggcttcattatctctgatgaatgtgakctttttttttttctggaaaatatacataccaacatttcgtgcagttcatgataaaccaatcccttttgaacattgcccagaaagcaaacagacttcccat

SEQ ID NO: 52849 - DNA, 201 bp, Homo sapiens
cattgcccagaaagcaaacagacttcccatggtgcacaaatgtagccatagggaatattgttcattcctcattgcactgagtatgcttcagtgttcacctsccttctggcccactacacctgtcaggggtattttatagactaaatagtgtcagttagtctaaatcactcatagacatgtactaggtggttttcctttttc

SEQ ID NO: 52850 - DNA, 201 bp, Homo sapiens
tgtaatagatcaaattaaaacattttatttcctgaaagccttttttgcctgttgtaatgtgcaggacccctctcctttaatgggagagacaggaagttacstgaatctaggctgaaaaggttatgtgaaaagaaagtataataataaaagggacacttggctttttaaatctttgttttctcttaacctaagtaaggcata

SEQ ID NO: 52851 - DNA, 201 bp, Homo sapiens
gacccctctcctttaatgggagagacaggaagttacctgaatctaggctgaaaaggttatgtgaaaagaaagtataataataaaagggacacttggctttwtaaatctttgttttctcttaacctaagtaaggcatattaaaaataaatgttaaggtgaaaaataaatgttgtctttatgaaaaattaaaactgctctcag

SEQ ID NO: 52852 - DNA, 201 bp, Homo sapiens
tattgttcataccttcatgctttttaacatgatattttccatcctggaatgaccttaccccagattctgctcattttcaaaaccctgattcattgtcatcwtttctgtattcctaccttgattacccacttccccaaaagagttaatcactcacttttgtactatgcctgtgccatatatatatatataattatatattat

SEQ ID NO: 52853 - DNA, 201 bp, Homo sapiens
agttattcatctattcatatatgaatattcagcatattctatttattcagtatattcaatatttatttaatatattcaatgttccaggttgctttaggctstagtgacataatgtggacaaaagcagacatggtccctactcgttcagagttcagagtgtaaagatgtttatcagattcaaaagtcttcagcttttttcac

SEQ ID NO: 52854 - DNA, 201 bp, Homo sapiens
aaataaggttttatatatataagcaagtctttgctacataataattcaacacatatatatatgttgttttatatatatatatatatatatatatatatgtrtgtgtgttgaattattaggtagcaaacacttggaaccaacccaaatgtccctcagtgatagactgggtaaagaaaatgtggcatatatacaccatggact

SEQ ID NO: 52855 - DNA, 201 bp, Homo sapiens
ttgatttgtagttgaacatccttgatttttagttgaacagctgtgttctgagcatcactgtgaggtacttgagaagtcagcattggaggggcttctctgakgctcttatggccccaagatgctcctgtctaaagcaggcaacatggcattctctgccatgggatcaagtgagactgggtgaacgagttctctctgaattga

SEQ ID NO: 52856 - DNA, 201 bp, Homo sapiens
gatttgtagttgaacatccttgatttttagttgaacagctgtgttctgagcatcactgtgaggtacttgagaagtcagcattggaggggcttctctgatgstcttatggccccaagatgctcctgtctaaagcaggcaacatggcattctctgccatgggatcaagtgagactgggtgaacgagttctctctgaattgata

SEQ ID NO: 52857 - DNA, 201 bp, Homo sapiens
agcatcactgtgaggtacttgagaagtcagcattggaggggcttctctgatgctcttatggccccaagatgctcctgtctaaagcaggcaacatggcattytctgccatgggatcaagtgagactgggtgaacgagttctctctgaattgataatgacaaaataagatgcctaaactgttacaatagtttatcaagaacta

SEQ ID NO: 52858 - DNA, 201 bp, Homo sapiens
gcatcactgtgaggtacttgagaagtcagcattggaggggcttctctgatgctcttatggccccaagatgctcctgtctaaagcaggcaacatggcattcwctgccatgggatcaagtgagactgggtgaacgagttctctctgaattgataatgacaaaataagatgcctaaactgttacaatagtttatcaagaactac

SEQ ID NO: 52859 - DNA, 201 bp, Homo sapiens
ggagttgtagggataaagtcaccctctggcattagtggcaaggcttacgaaagcatatctagggaagtgtgtaatctttgagtccgtatctggaggaaggycaagtttcttaatctcatttttctcaggaaggcatgaaatttgatattttgctaagtgtaaaggaaaagtgaagtttgattggagcttgaagagattacc

SEQ ID NO: 52860 - DNA, 201 bp, Homo sapiens
gggcttctctgatgctcttatggccccaagatgctcctgtctaaagcaggcaacatggcattctctgccatgggatcaagtgagactgggtgaacgagttytctctgaattgataatgacaaaataagatgcctaaactgttacaatagtttatcaagaactactgaactctaggataaaatattttatttcactggaata

SEQ ID NO: 52861 - DNA, 201 bp, Homo sapiens
gcttctctgatgctcttatggccccaagatgctcctgtctaaagcaggcaacatggcattctctgccatgggatcaagtgagactgggtgaacgagttctstctgaattgataatgacaaaataagatgcctaaactgttacaatagtttatcaagaactactgaactctaggataaaatattttatttcactggaatata

SEQ ID NO: 52862 - DNA, 201 bp, Homo sapiens
aatcgtagcacttttggaggccaaggcaggcagatcactgaggtgggcggatcacttgaggtcatcagttcaagaccagcctggccaacctggtgaaaccstgtctctaccaaaagatacaaaaattagccaggcatggtggcatcctattcaggaggctgaggtgggaggatcacttgaacccaggaggcagaggttgca

SEQ ID NO: 52863 - DNA, 201 bp, Homo sapiens
ttgagttgtaattttttcacagcctggactatgtgaatgatatcaaaaacattatcagattctgaagcaaaaagttcaaaaagaacatcctccatctattytcttctattctccctcccacactccttttcttctcaccttgccctttccttctacatggattaagtacacactgctcgtaagggtacagtgctagaaaca

SEQ ID NO: 52864 - DNA, 201 bp, Homo sapiens
tttatatacacattcaactgctgttacaaaaatcaaagttattattttatataataaggaggatcacaagcttattatttattccaaatgttgaagataargttggccttaagaatatgatgggccgggcacggtggctcacgcctgtaatcccagcactttgggaggccaaggcaggtggattacctgaggtcgggagtt

SEQ ID NO: 52865 - DNA, 201 bp, Homo sapiens
gatctatagagtagtccatttataagacctgatatatttacttcagaaagtttggaggatttaattgatgtgaaaccttgcccgtcttcaaaatccgtagwaggttctgttctaccttgttcaacatagtagaactttcagcatgcaaataacgtacttctgtctgttttgcctcttgaagtccattcaaagacttattgt

SEQ ID NO: 52866 - DNA, 201 bp, Homo sapiens
tatgcggagaagggaatggttgataagggttggagatgtggtagactcaactctcaagctgcctcactatgcagaggaggaggaagagatgcattttttgktagttttgtttgtttcatatggttttttttttctttgaaggaaggatctgagtaccacttaaatgcttatggaaagataaaatagaggaggagtggctga

SEQ ID NO: 52867 - DNA, 201 bp, Homo sapiens
tatttattcagtatattcaatatttatttaatatattcaatgttccaggttgctttaggctgtagtgacataatgtggacaaaagcagacatggtccctastcgttcagagttcagagtgtaaagatgtttatcagattcaaaagtcttcagcttttttcacaaacggtcttacctggtagatagaataatctgagctgtt

SEQ ID NO: 52868 - DNA, 201 bp, Homo sapiens
aggcagaatatctcaaatgtgaggatcaaagccataatcaaacatgtggagaaggggccagtaggtagcctgaaaggaaagcttttctggttatagacatrcactacataataatgtttcagtcaacacaggaccatatgtatgatggtggtcccataagattataatggagctgaaaaattctatcacctattgacctca

SEQ ID NO: 52869 - DNA, 201 bp, Homo sapiens
ataggctagaccacacagcctggggtgggtttgttgcctagcagcagtaggctagaccatctaggtttgtgtaaatgcactctatgatgttcacacagccrtgaaattgactagcaatgcatttctcagaacgtatctttgtccttaattgacacatgtctatacataccaggtatacttgaacacaatttttgcgaatcc

SEQ ID NO: 52870 - DNA, 201 bp, Homo sapiens
aatagttcattttcccagataattgtttatttattttgctttgcctctacctgagaaaggagaagatttgggttctatgcctacctcccttcattcccttyctccacagtggtcagatccattaaagaacagagtccttggtcagatcaacatagcattcatgaaaaccaactctcagaaaggaggaatatgcaacgactg

SEQ ID NO: 52871 - DNA, 201 bp, Homo sapiens
aaaggagaagatttgggttctatgcctacctcccttcattccctttctccacagtggtcagatccattaaagaacagagtccttggtcagatcaacatagsattcatgaaaaccaactctcagaaaggaggaatatgcaacgactgtcactgcaaacttccaaataaagaatcttcttagtgatattttcaaaatatattg

SEQ ID NO: 52872 - DNA, 201 bp, Homo sapiens
gatttgggttctatgcctacctcccttcattccctttctccacagtggtcagatccattaaagaacagagtccttggtcagatcaacatagcattcatgamaaccaactctcagaaaggaggaatatgcaacgactgtcactgcaaacttccaaataaagaatcttcttagtgatattttcaaaatatattgacaggagtt

SEQ ID NO: 52873 - DNA, 201 bp, Homo sapiens
tgggtggtaggtgcctgtattagttttctagagttgttgtaacaaatgggaggcttaaaacagaaatgtattcgctcacagttctgagatgcagaagtctraaatgcaggtgtcagaaagaccatgtgccctttcgaaggctctagagaagaatcttcctgtgcctcctcccagcttctacgggctactggcagtccttag

SEQ ID NO: 52874 - DNA, 201 bp, Homo sapiens
agatgcagaagtctaaaatgcaggtgtcagaaagaccatgtgccctttcgaaggctctagagaagaatcttcctgtgcctcctcccagcttctacgggctmctggcagtccttagtgttccttgcctctgtagctgcaccactcatctttcccgccttcttcgtatggtcttctctctgtagctatttgttcttttcttac

SEQ ID NO: 52875 - DNA, 201 bp, Homo sapiens; identical to SEQ ID NO: 9950

SEQ ID NO: 52876 - DNA, 201 bp, Homo sapiens
gaagaatcttcctgtgcctcctcccagcttctacgggctactggcagtccttagtgttccttgcctctgtagctgcaccactcatctttcccgccttcttygtatggtcttctctctgtagctatttgttcttttcttacaaagacatcagtcattagattagggttcaccctaatccaatatcacttcattttaacttga

SEQ ID NO: 52877 - DNA, 201 bp, Homo sapiens; identical to SEQ ID NO: 9951

SEQ ID NO: 52878 - DNA, 201 bp, Homo sapiens
cttggtattctaacattcgtgaattcccttactgcaatttctaaaaacatgtgcttacatgtcagcacattagtcaactaaataatttctttcctttgctrttcatgttgggatggccttgctggtgctgtagacattgggagaattcccactctcagtttccttttcctggattgtacaaattctgcactgctgaaatct

SEQ ID NO: 52879 - DNA, 201 bp, Homo sapiens
tagtgcaaatctggctaagtgttaacggcgtgcccaggctcagaaacaatctgcaaatactgagggagatggattgttgttggttgtgttggttgctgcakattttgtgttttgtcttttatttctgtttttagtgcttggcattcaaaaacactagcttaacacaaagtaaggaaaagagactccagtgatcatcaacaa

SEQ ID NO: 52880 - DNA, 201 bp, Homo sapiens
ctagaacataagccctcccaggaagtcagtccacaagagtatggagtttggtcttgttcactcgtgtaggcaccaaaggagatttgctaaataagtaagtstaataatgaaggaggttgcagtaagtcattgatttaaggcagtggctcagggtggatacagggtgagaatcctgtgcgactttgagcacgtacagttcct

SEQ ID NO: 52881 - DNA, 201 bp, Homo sapiens
aaggcctggtagcaaaaactgaagacagtttctttgggaaattagggtgtttaaaaaaatgaatgcagggaagtttagaaagccgcatgcatgctcagggygaaacacatgccttgaaaagaacctaaactttcaccttgggctgatctctaggattagtgcaaatctggctaagtgttaacggcgtgcccaggctcagaa

SEQ ID NO: 52882 - DNA, 201 bp, Homo sapiens
cagacaacagcagagctttcagtggaaatcttaaataagtggggtcaatatcctgaggcatttatttgaagaattataggagaagataaaacatggatttmccagtataatcctgaagacaatgcataatcaaagcaatggctaccaagaggtagaagtgttacagtcaaagcaaaagcagaccagtcaagaacaaaggtt

SEQ ID NO: 52883 - DNA, 201 bp, Homo sapiens
taccttatacacaagcacttaaaaaattttcactgtgtctgaaactgttccacatagcaaaagacagagataccaaattccacaatacatttgtcacatcyatgtgtcctcagaggaaaaataaccagaataagaatcagaggctctagatgccagtatttgctctggcatgattgtatatgtgatctcagttgcttcatc

SEQ ID NO: 52884 - DNA, 201 bp, Homo sapiens; identical to SEQ ID NO: 9953

SEQ ID NO: 52885 - DNA, 201 bp, Homo sapiens
gcctggattaagaaaatgtggcacatgtacaccgtggagtactatgcagccacaaaaaaggatgagtttatgtcctttgtagggacatggatgaagctggraaccatcattctcagcaaactatcgcaaggacaaaaacccaaacaccgcatgttctcactcataggtggaaattgaacaatgagaacacatggtcacagg

SEQ ID NO: 52886 - DNA, 201 bp, Homo sapiens
tcctccgagtaagtagagggggatgggctgcccatggaggttgttcttagagttattgacaaaatataaaattatagtcttgagacttaccttaaatgtawgtggatgttaaaataatacttatttgaccaacaggggtattcttgagacagaataaaaataagcttaaataaaagtaaggcagtattatatgaaattaaa

SEQ ID NO: 52887 - DNA, 201 bp, Homo sapiens
tagaagatgtggcagatttttatgatgatctgaatatgagacaagattgaaaacggagtagaagattaatgctcataatgaataaaaactagagaagcatmgctctggaaacttagtcagatattattagtgctatgttatcgtctgaggattttaaatgatatgatacacctgggtttgtttttctagtaaattgtgtaa

SEQ ID NO: 52888 - DNA, 201 bp, Homo sapiens
ctagatcttttatgtgtatcttttatgggcaaagtgcttaatgaacaggcaactctacaatgaaaagcgttatttttttattttatagaagaataaacttyagctcagaaagatttaaagacttgtcccaagtcacatacccagtaagtagcagagcaaaataactcaacacaggggtttctaaattattactattattat

SEQ ID NO: 52889 - DNA, 201 bp, Homo sapiens
cagatattattagtgctatgttatcgtctgaggattttaaatgatatgatacacctgggtttgtttttctagtaaattgtgtaattttgttctatgatatwgatgattatcaaatattatatatcagtacttttttgtggttatatagaaatattacttttcctttttaagaagtaatcatggaggaagctacatagtaga

SEQ ID NO: 52890 - DNA, 201 bp, Homo sapiens
tctctgaaataaaatttcccttctagcagtaacgaacacatggattttaccaaaaattaataagattgaaaaatctatatcaaaaacaggctatactatgtttttttttttttttttttaagatggagtttcactcttgtcgcccaggctagagtgcaatggctcaatctcagctcactgcaacctccacgattctcctgc

SEQ ID NO: 52891 - DNA, 201 bp, Homo sapiens
ctccagttaaagcaaacattgtgaattgccctgattaaaaacaaatatttttcttcttttctcaaggaaattctggaccaaaaggccagaaaggggaaaargggagtggaaacacattaagtaagtatatagtattttgttttctgtgtgaattcttgtaataagtaagtctgtgatactagagatctgggcttgaggcaa

SEQ ID NO: 52892 - DNA, 201 bp, Homo sapiens
gttctagtagcctaatcacataatacactgaatgataagcattactcatgactgttgaagaaaataaatgctttaaccagagtaaccaaatggaattgttygtaagtctagatagtgacatgtatataatagacagcaaacagtataaggcagacctaaccgtagatcatatgtgaaggggagtacaacaattatctttgc

SEQ ID NO: 52893 - DNA, 201 bp, Homo sapiens; identical to SEQ ID NO: 10095

SEQ ID NO: 52894 - DNA, 201 bp, Homo sapiens
attttttaaaaattgattcttattttaccttctcatcttcttattttccaaattacagcatatatatatatatatatatatatatatatatattttttttwtttttttttttttttttttttaagttttgaagtgtagtcgagcttgggcaatttatccaacccatttaaaccaaaaataaaacttttcatgtattacctg

SEQ ID NO: 52895 - DNA, 201 bp, Homo sapiens
tttttttttttttttttttttttaagttttgaagtgtagtcgagcttgggcaatttatccaacccatttaaaccaaaaataaaacttttcatgtattaccyggtcatttcaaacaaaaatattttgatcatgaaaaagaataccaatattcttttgttctaaaaatctcttatgggattacatgttatatttttggtttct

SEQ ID NO: 52896 - DNA, 201 bp, Homo sapiens
tctctgaagaacaaagcatgggcccaagacaatgctgatgagaaaattccaagaaaggttgaaacaagttagagttgtcaatggtactctggttttatgcstacatgacattaaaatctccagaaataaaagggagagaagaattagccacttgttcagatactcctgactattagcaggctagcaacattgaatagccag

SEQ ID NO: 52897 - DNA, 201 bp, Homo sapiens
aagcatgggcccaagacaatgctgatgagaaaattccaagaaaggttgaaacaagttagagttgtcaatggtactctggttttatgcctacatgacattaraatctccagaaataaaagggagagaagaattagccacttgttcagatactcctgactattagcaggctagcaacattgaatagccagtttacacaaacat

SEQ ID NO: 52898 - DNA, 201 bp, Homo sapiens
tagtacctatttagacatataaaaagggaagttttttaatgaaaaattagattggctgaagagtgtggaaatcatcacatagggaagtggtcagcactgtkgatatacaccaaacagtattacagagacatactgaaaataaagcacactgacagaaagaaacctcattaggatagaattttgggagattggtgtcttgtt

SEQ ID NO: 52899 - DNA, 201 bp, Homo sapiens
gtcagggatatctaaattttaaacttcagattttgtacaaaaaaacctaaaaggactatattttaaaataagaagcatgtacaaataattgtaaaggaaaragtgtgagttttgtagtctccagttctgtgtcagtaagaatttgatgaggaatagccaatagcatttatgctggtccaggctggatcaaattgtgatcgt

SEQ ID NO: 52900 - DNA, 201 bp, Homo sapiens
gacattaaaatctccagaaataaaagggagagaagaattagccacttgttcagatactcctgactattagcaggctagcaacattgaatagccagtttacwcaaacatctagagataagttgtaactccttttccttggtttaattttgtgagacctcctgtcccattctgcactgcaagtcaggtagagtatgagcagct

SEQ ID NO: 52901 - DNA, 201 bp, Homo sapiens
cattaaaatctccagaaataaaagggagagaagaattagccacttgttcagatactcctgactattagcaggctagcaacattgaatagccagtttacacwaacatctagagataagttgtaactccttttccttggtttaattttgtgagacctcctgtcccattctgcactgcaagtcaggtagagtatgagcagcttt

SEQ ID NO: 52902 - DNA, 201 bp, Homo sapiens
ctacacccaacccaacagggtttttggtgcattatacattaatcctcagaagagcatttgggtgaaggactattatcccaatttctagaattataaactgwggcttactgctaataagtggaagaacagaaactcaaagccaggtctttaaatctccaaagtccttatgactccattcaatattcccacactagtattatg

SEQ ID NO: 52903 - DNA, 201 bp, Homo sapiens
atccatcacataacagaagtaatgacaaaaaccacttgatcatctcaatggatgcaaaaaaaggcttttgataaaattcaacatcccttcatgttaaaaaytttcaataaactaggtatcgaaggaacatacctcaaaatgaaaagagccatatgtgaaaaaccaacagccaatatcatactgaataggcaaaagctggaa

SEQ ID NO: 52904 - DNA, 201 bp, Homo sapiens
gcctcctcccagcttctacgggctactggcagtccttagtgttccttgcctctgtagctgcaccactcatctttcccgccttcttcgtatggtcttctctstgtagctatttgttcttttcttacaaagacatcagtcattagattagggttcaccctaatccaatatcacttcattttaacttgattacatctccaaaga

SEQ ID NO: 52905 - DNA, 201 bp, Homo sapiens
cacagaaatacgaccagacacctacaactatctggtcttcaagaaacccggcaaaaattagcaatggggaaataaatggtgctgtgataactggcaagccrtatgcagaaaattgaaactggacccctttcttacattatgtacaaaaattaactcaagatggattaaagacttaaatgtaaaactcaaaactataaaaaa

SEQ ID NO: 52906 - DNA, 201 bp, Homo sapiens
acagtgagggctgttacagacagaaatgatgagagtttgaagaaggaggagagagacatcgggagcagagaaaaagcaatcaaaatgtttgagagctattyaaaaggtagaatttacatttgtgatgataaattagagatgagaagatgactcctacttttcaggcttaatcaacctggcaggtggactatatctccactt

SEQ ID NO: 52907 - DNA, 201 bp, Homo sapiens
ctaattaagctaagaagcttctgcacagcaaaataaactatcatcagagtgaacagacaacctacagaatgggaaaaaatttggcaaactatgcatctgasaaaggtctaatatccagcatctatgaagaatttaaacaggaaaaaaaaaggcaagaaaaaaacaaataaccccattaaggagtacacaaaggacatgaac

SEQ ID NO: 52908 - DNA, 201 bp, Homo sapiens
gtagaaaaaaatagtttttaaattagaaaaaacaaaatagaatggaaaaaaagaagtgcaagataaaaatacagatttgtaatagtaaaatgaaaaggacrctctttcaaaaatatattatcctctagagtcctctccttctaatgtgggtgacaaattttaaaagtattcattttgccaatgtgaagaagtaagatgatc

SEQ ID NO: 52909 - DNA, 201 bp, Homo sapiens
tctagacatctatgtaacccatgaatatcactaagctttaagtgtcatcatgttctgttgcctggatctattctttgtaaatttgagaaagtcatacaccstttctcagtctcagtttatgtatctatgaaatggagataattatcattatttaacaaggttattataaaaagtaaatttagaaatgtatgtgaaaagacc

SEQ ID NO: 52910 - DNA, 201 bp, Homo sapiens
tatttattccaaatgttgaagataaagttggccttaagaatatgatgggccgggcacggtggctcacgcctgtaatcccagcactttgggaggccaaggcrggtggattacctgaggtcgggagttcaagaccagcctgaccaacatggagaaaccctgtctctactgaaaatacaaaattagccgggcgtggtggtgcat

SEQ ID NO: 52911 - DNA, 201 bp, Homo sapiens
aacctctctacagagactgtaattattctcattatccacataagaaaattcagacagctcagtattggagctggagttcccatccaagacttccgaaccckagttactctggtctcttgtctcccagtttaatcaagtctttataaaacaacatggttggccaataaaaaaacaaaaaagtcagctgggcacggtggctca

SEQ ID NO: 52912 - DNA, 201 bp, Homo sapiens
ggcgatagagggagtgagtctctgtctcaaaaaaaaaaaaaaaaaaaaacttaaaaaaaatatataatcaatatcaatccctacaaccctcaaattataarggaaatcatagatatatatatggctaggtatataggtggaaagatgagagagagagaaagagaggaagaggattagagattaaaaacatatctaagaaac

SEQ ID NO: 52913 - DNA, 201 bp, Homo sapiens
tgcttatctgtaatttgaaatgtataactaaatgatgcttcattgttgggattattacatataaaccaattagaatttgagtagatttcatcacctttatrcaaatcactgcctgcagtaccagcaccagggaccgcagcttctgataggctcgtgcagagtgcagacaggagtcggaaaataattcaaggttctaaccaa

SEQ ID NO: 52914 - DNA, 201 bp, Homo sapiens
agggcagggaaaggagagtgagtcactttttgccccgtatccaggctttcccagctattgtgcctgtggtctccctgcagcaaacttggatgagttttatyatacaacagtggtacctccaagaatttgttccaggtatatctgagcctgtatggatgctgatgagggaagtaagatctggagtaactattgcttcttctc

SEQ ID NO: 52915 - DNA, 201 bp, Homo sapiens; identical to SEQ ID NO: 9971

SEQ ID NO: 52916 - DNA, 201 bp, Homo sapiens
ggctcctcattgttacagtcaaattccattcccaattgttcttttattcccagagtaactcaagcaatactttccacatagtatataagaattaaatcatrgaattaatgaatgcatggatgaggctgtcaacccaaaacttggtccccacaatgaatttaataaatgtgatgagatacagttaagaaatatacttttatt

SEQ ID NO: 52917 - DNA, 201 bp, Homo sapiens
atcagtgatattccaaggctaattcaaagtagatatcccactaatatgacttagattttttattttatagacagggtcttactctgtcacctaggctggartacaatggtacaatcacaggttaatgcagcctcaaactcctgctctcaagcgatcctcccaccttagcctgcagagtttctcgggaccacaggcctgcac

SEQ ID NO: 52918 - DNA, 201 bp, Homo sapiens
agaacatttttcccaggttgaaaagtgtgggtttgaaatcattcttgcacctataaaatttatctccaaaagtaaaatagtaagatattctcaaggtcaayagctagatttttgcttttgttttctttgtttttcttttttgtttttctggagaagaggaaaaagaaaaaatcctcaactcttcatccctagagaattgaa

SEQ ID NO: 52919 - DNA, 201 bp, Homo sapiens
acataccataatcaattttctatgtgaaattttcaaaaaaaaaatgtaagggtaaacagaaggcaatcaaaaaatgcacctctatacctctgaactatccyttaatgaatgggagtaaatataatctcaaagataaataaatatatcaaagggtcacaagtcaaatttttacatactgctccttgcatgttgaatgtttta

SEQ ID NO: 52920 - DNA, 201 bp, Homo sapiens
caggaacatagtctaggcttggtacagtggctcacgcttgtagtcccagcactttgggaggctgaagtgggaagatcactggaataaatgagttcaagacyagcgtggacaacatagtaagatcctatctctaccaattaaaaaaaaaaaaaaaaaaaaaagccaggcgtgatagcatgcacctgcagtcctagctactac

SEQ ID NO: 52921 - DNA, 201 bp, Homo sapiens
aagacgagatttcctagaacgacacagttggcttgtttcacatggagtctccaagaaattcccccattatggcttagcctacagactcttaatcctttccyggatgctgtagttattttcattttctacttcttactcatatcctgcttaatccatgccaaagtaaaacattggaccctcaggtattttagggacctatat

SEQ ID NO: 52922 - DNA, 201 bp, Homo sapiens
ttagataatataatcaatgcagacaagctcagtataaaaaaaagaaaagtatcctaaaataccactagtctggatgaattattttgatgcttatattatgyagagatctgacaagtctgtatttagcattgtttctttaagacagtggttcccaacctttttggcaccagggaccagttttgtggaagacaatttttccac

SEQ ID NO: 52923 - DNA, 201 bp, Homo sapiens
ctgcttatatctctataaagtagggatttctggtctaaagaactggtaagaaaggaagataataagtatactgagatactaagaagaaaatggtttttttyaaacttaaataaggaatagaatgacagagtttagtctcatgtgaagttacttacttggctatgtggagataagtctctcaagttttcttgacataatttg

SEQ ID NO: 52924 - DNA, 201 bp, Homo sapiens
taaaatttgccagttatttagataatataatcaatgcagacaagctcagtataaaaaaaagaaaagtatcctaaaataccactagtctggatgaattattytgatgcttatattatgcagagatctgacaagtctgtatttagcattgtttctttaagacagtggttcccaacctttttggcaccagggaccagttttgtg

SEQ ID NO: 52925 - DNA, 201 bp, Homo sapiens
atatcataactaccattgtaataaatttaaccctaaatcctaattccaataaatgatacaaaaaggaaatcatgactatgagtaaacaataggataataastgttatgctcctcaaaagtcatttctatgttcgattatttctttccactgagtagtggtaattgacacatgcaaagaagaccttacatgttccctgactt

SEQ ID NO: 52926 - DNA, 201 bp, Homo sapiens
gtaagtctagatagtgacatgtatataatagacagcaaacagtataaggcagacctaaccgtagatcatatgtgaaggggagtacaacaattatctttgcrttgaataaatcatcttcacatttgcaagctatctcatttttaagacataaaaactcacactagtagtgagttatgaatcacaagcaaattggactatatt

SEQ ID NO: 52927 - DNA, 201 bp, Homo sapiens
tctttaccaataggtggtgctagaaagtttaatatttattccaatagttgaagttatttggaaaatgtgctaaacatttttttgtgtttaaaaaaaaagtsctgtaaagcagtatgtacataattagtccttgcttgccttttttttttttttttttttttttaactttacagctccatttacgaaagttcgactggtcgg

SEQ ID NO: 52928 - DNA, 201 bp, Homo sapiens
tggtttaaatttacagggtaaaaagtgatgtcataatttgttgcttttggtactgctcatttacacaaataggcattacccagttcctcataaaagacagrtcgagttcctggggtaatcaatgactcttctaggttatcaggttaccattttgtttggtgcactacaagaaaagtattcaaaataccaggcatctttcct

SEQ ID NO: 52929 - DNA, 201 bp, Homo sapiens
actttgctcagacacatcagaggaatcactctctgtgtcagttacagccttacaagatgtatttcttaagtaataagacttgaaagtaaaaattaatcctkgatccatgggctacacaatggatattgtgttagcaggcatgaaaacaacaccagtctttctgtccatctccatcagagctcttgggtgaccaggtgcact

SEQ ID NO: 52930 - DNA, 201 bp, Homo sapiens
ctcacctagactcacaatcatgatgcgaatatctgcaaaacctaagtggttgtcctagtagcctcaaataactaatacattaaatatagtagaattattaytcatatactagggtggatattatgtttaaatatgctttattccccaaataataacaaatttattttagagggctatttccttgaaagcatgctagggaga

SEQ ID NO: 52931 - DNA, 201 bp, Homo sapiens
gtaaacagatacagaatctctgaattcacagcgcttccaggatgataagtagtaatataagggaggcaaatgtcatgatcaaggattttttatctcatgtragtttcttttaaggggctgattttacccatgacaacaatgttttgaaggagaagcaactttcttttctaaaggaaactttgtgtgggccatctaagaagc

SEQ ID NO: 52932 - DNA, 201 bp, Homo sapiens; identical to SEQ ID NO: 10089

SEQ ID NO: 52933 - DNA, 201 bp, Homo sapiens
tgacaaaacatatccttaggacatcacttcttattaaaagacaccaatctggtagagatgtcagcagcagtgccaggtgctgttctagttgtactgcagastaaaagaaggaacagtacagtctctcctctacaagagtctgaagaaggtgctaaaattagaaataagtccgataattgtcaaatatgaaataagtaaaaa

SEQ ID NO: 52934 - DNA, 201 bp, Homo sapiens
tgaagaagaaaacccagagaacagagcatgaaaaaaggcaaacacagagtttcaaaggtggtcaagtaaggtgaagtctacaaaaagccctttgcacctgstgctgtggggatgttgccattgttcagagcagattctgtggggtggggtgataaccagattagggtatgcggagaagggaatggttgataagggttggag

SEQ ID NO: 52935 - DNA, 201 bp, Homo sapiens
aaaatgcataatgaagagaaaagaagccttcactaagctctaacgctagtcatagtgaatcgtctgttgtgttctcaccttaacgcggaagagtgatgttycagtcacacgaaatgattcctaccatacaatacaacacttgtgtgaggctctgtcctaaatatctcaattaccaatatgtggtttggtagtatttctcat

SEQ ID NO: 52936 - DNA, 201 bp, Homo sapiens
ggccaaggcgagcggaccatgaggtcaggggatcaagaccatcctgaccaacatggcgaaaccctgtctctactaaaatacaaaaaattagccgggtgtgrtggcacacgcctgtagaacctgggaggcagaggttgcagtgagctgagatcacaccactgcactccaccctggtgagacagcgagactccatctccaaaa

SEQ ID NO: 52937 - DNA, 201 bp, Homo sapiens
tgaagactaagtaagattcacacagcatataatgggaggttggcatttgcactgaccaggtaaaaatacttatagaaaaaccatagaactgagattacagrtgttttatgcagtgattagccgttttatgcagtgggtaagagctaatcttctgggagtagactgcctgtgttcaaattccagctcccctgctccctagtt

SEQ ID NO: 52938 - DNA, 201 bp, Homo sapiens
agatatgtcatgtggagggtatgcaaagagaaagagagggaaagagagaaagagatagatagagagagagaaaggcagaaaaggaagaaatttgtaatgascagtttggttttctagaatgggcctagtaatttgaagagctaaagagataaaaattcttacggcagatcaaattccaaataagcattctcagttattctt

SEQ ID NO: 52939 - DNA, 201 bp, Homo sapiens
acccctcacagtcattcatgagggttggaatcaacttcttccaaatttcagttaacctcaatactttgaccttctcccatgaattataaattattttaatrccatataggattgtgaaacctttccaaaaagttttcaatttactttgctcagacacatcagaggaatcactctctgtgtcagttacagccttacaagatg

SEQ ID NO: 52940 - DNA, 201 bp, Homo sapiens
tctttgttaaaatgctgtgttttagatgctattaatttgtcctctctcttaatgcccttggattttcctcttaattgtctgcaccattgctgttacccaaratgcctggctggagtagataaaaataagccgaagtccaaaaattggaatagaatggaaggaatggatcaaaggaaatcaggagtttttgtgcagtcagat

SEQ ID NO: 52941 - DNA, 201 bp, Homo sapiens
atgggcctagtaatttgaagagctaaagagataaaaattcttacggcagatcaaattccaaataagcattctcagttattctttatttgtttgtgtttccmccttcataactactccagctattgcctctagtctccctcctaaggatattactcagaaacatagtcttcctagaatgctcacaaagcttccattatcact

SEQ ID NO: 52942 - DNA, 201 bp, Homo sapiens
cctcacagtcattcatgagggttggaatcaacttcttccaaatttcagttaacctcaatactttgaccttctcccatgaattataaattattttaatgccrtataggattgtgaaacctttccaaaaagttttcaatttactttgctcagacacatcagaggaatcactctctgtgtcagttacagccttacaagatgtat

SEQ ID NO: 52943 - DNA, 201 bp, Homo sapiens
ggcttggtagtaagaatataattggagattaaaacaattttaattatggaagaagacaacactttctaacagtaggctgggcttttttgttttattagatsctaaaaacagcccttcccttcaagagaaactgaagtccttcaaagctgcactgattgccctttacctcctcgtgtttgcagttctcatccctctcattgg

SEQ ID NO: 52944 - DNA, 201 bp, Homo sapiens
acattgatatagttaaattcttaagatcctcaggtctttaggaatggactaaatggctagtatcatcacctataaaagtgtcttgaacttgatggagcttrtgttgagaagtaaaatttatattttgtgatttttaccttttaattgcttttttccacaaactgttttaatctccccatattttactaataatggaaaagt

SEQ ID NO: 52945 - DNA, 201 bp, Homo sapiens
tgagttttgtagtctccagttctgtgtcagtaagaatttgatgaggaatagccaatagcatttatgctggtccaggctggatcaaattgtgatcgtacttytagtcttcaagctgcctggttagaaattatgcagcttactttgatgcctgtcctactactactattagccttttagtggttaccttaagaataactgaat

SEQ ID NO: 52946 - DNA, 201 bp, Homo sapiens
tataattggagattaaaacaattttaattatggaagaagacaacactttctaacagtaggctgggcttttttgttttattagatcctaaaaacagcccttmccttcaagagaaactgaagtccttcaaagctgcactgattgccctttacctcctcgtgtttgcagttctcatccctctcattggaatagtggcaggtaac

SEQ ID NO: 52947 - DNA, 201 bp, Homo sapiens
ccacagcgacatcatattaaatgggcaaaacctggaaacattctgcttgaaaaccagcacaagataatgatgccctctccactactcctgttcagcatggkattggaagtcctggccagagcaatcaggcaagataaggaaatatagggcatctactttgggaggctgcagtgggaagatcacctgaggtaaggagttcca

SEQ ID NO: 52948 - DNA, 201 bp, Homo sapiens
caaactatgcatctgacaaaggtctaatatccagcatctatgaagaatttaaacaggaaaaaaaaaggcaagaaaaaaacaaataaccccattaaggagtrcacaaaggacatgaacagacacttctcaaaagaagacatatgtgtagccaacgtcatacaaaaaaaaagatcaacatcactgattttttgaaatacaaaa

SEQ ID NO: 52949 - DNA, 201 bp, Homo sapiens
cgtacttctagtcttcaagctgcctggttagaaattatgcagcttactttgatgcctgtcctactactactattagccttttagtggttaccttaagaatractgaataatactgttactttgcatctctcaaagaccgtgcgctgttcccgcatactttcttgcagacgtattgtcttctgaaggatggtgcccatgggc

SEQ ID NO: 52950 - DNA, 201 bp, Homo sapiens
gacaacactttctaacagtaggctgggcttttttgttttattagatcctaaaaacagcccttcccttcaagagaaactgaagtccttcaaagctgcactgrttgccctttacctcctcgtgtttgcagttctcatccctctcattggaatagtggcaggtaacgtaacccagagttttgaaatttagtaactcgtcccgtg

SEQ ID NO: 52951 - DNA, 201 bp, Homo sapiens
ttcacgaaatttgactatgttgccactgtaagtacagtacgaagacattttacttcagataaattaagaccttatggtgtttatttaattttattgttagmattttgacatctatatatataggaatagaaacatatcatagatacattaaattgatttttgaagggggttgtgattgtaaacattcagccattcagtcaa

SEQ ID NO: 52952 - DNA, 201 bp, Homo sapiens
cagctacttggggggctgaggcaggagaatcacttgaacctgggaggcaggggttgcagtgagccaagatcatgccactgcactccagcctgggtgacagrgtgagactctgtctcaaaaaaacaaaacaaaacaaaaaaagaaatacacagtatcaaaatagaaagagaaaaagtcaaactatctgtttgcagacaacat

SEQ ID NO: 52953 - DNA, 201 bp, Homo sapiens
agatcaacatcactgattttttgaaatacaaaatcagaaactgatctttggaaatacaatatcaaaaactgatcttttgaaatacaaaatcaaaaactgaycttttgaaatacaaatcaaaaccataatgagataccatctagcaccagtcagaatggctattactaaaaagtaaaaaaataacagatgctggcaaggttt

SEQ ID NO: 52954 - DNA, 201 bp, Homo sapiens
aaatattttccagaggtaacaattaacttctttttggccattaaaaatacactaaaacaaaaatccaaccataacaaccaaccaaccaaactattgttgtytgagtaaaaggacctgacacgtttggcattaaacaatttcctggtaaatcaaggttatctgtatgtttgtttatgtctatgcttatctgtaatttgaaat

SEQ ID NO: 52955 - DNA, 201 bp, Homo sapiens
atgtcttgtcatttctccagaaaatgatatatatattaaaatatactgatacatgcagagatttgatatttgaaatcctatggtttgaaataaatagtttytgagcttacatttactgcaaatacccaaaggaaagaatatgaaaatcagataaagacagggtacgataaccagtagcctggtatcacttaaatagaaagg

SEQ ID NO: 52956 - DNA, 201 bp, Homo sapiens
ggaatgcaaccccattcacaattgccacaaaaagaataaaattcctaggaatacagctaaaaaggggagtgaaggacttctacaaggagaactacaaaccmctgctcaaagaaatcctagatgacacaaaaaaatagaaaaacattccaagctcatggataggaagaatcggtatcattaaaatggccacaccacccaaag

SEQ ID NO: 52957 - DNA, 201 bp, Homo sapiens
cactgttggtgggagtataaattagttaaaccattgtagaagacactgtggcaattcctgaaagacctaaagacagaaataccattcaacccaaagattcygttactgagtatatactgaaaggaatataaattgttcagttataaagacatacagacacgcatgttcattgcaacactattcccagtagcaaagacatgg

SEQ ID NO: 52958 - DNA, 201 bp, Homo sapiens
cctgtctctaaaaaaataagaaaaagaaaaaaaaggaatagggtccctatcattgaggtatttttaaactacattttatttttagaacagttttacatttrtagaaaaactgcacagaaagcatagagagttcccataaaccacccatgcacacatggtctcctctactattaacatcttgcattagtgtggtatatatgt

SEQ ID NO: 52959 - DNA, 201 bp, Homo sapiens
tagagacagaaaattgattattggttgctgggaatgagtaggaatgagaattaactgtaaaccagcagttagagttacagagaggtaacagaaatgttctraaattagattgtggtgatagttatgcaatacagtaaatttattaaaaatcagataaatatttaaaacgggaattttctagtatgtaatttatatctaata

SEQ ID NO: 52960 - DNA, 201 bp, Homo sapiens
gacaaaaaataggcaaaggacatgaacagacaattttcaaaggaagacgtacacgtggccaacaagcatatgcaaaaatgttcaacatcactaatcattaragaaatgcaaaccaaaagcacaatgagataccacctcacacctgtcagaatggctgtttattaaaaagtcaaaaaattacagatgctgtggtgacgagtt

SEQ ID NO: 52961 - DNA, 201 bp, Homo sapiens
actgagaaagagacagtaactgtcatcaagaaagaaactgtaaaatataaacttaggagctgttaacagacatgttctatcaagtgaacaggagagcaaasatatctagcttgcaacaaaaaaagaataataaagcaacctacagaaagaagcttgagtacaagttggagactcctaagcagattcgggtcttgggtcagc

SEQ ID NO: 52962 - DNA, 201 bp, Homo sapiens
ctagagtgtgactataaagactgcttttaaagaagtattatggttgtacgccgggcgcagtggctcacgcctgtaatcccagcactttgggaggccgaggwgggcagatcacgaggtcaggagatcgagaccatcctggctaacacggtgaaaccccgtctctactaaaaatacaaaaaatgagccgggtgtggtggcggg

SEQ ID NO: 52963 - DNA, 201 bp, Homo sapiens
gagacagtaactgtcatcaagaaagaaactgtaaaatataaacttaggagctgttaacagacatgttctatcaagtgaacaggagagcaaagatatctagsttgcaacaaaaaaagaataataaagcaacctacagaaagaagcttgagtacaagttggagactcctaagcagattcgggtcttgggtcagctattgcaga

SEQ ID NO: 52964 - DNA, 201 bp, Homo sapiens
atagttttttttatttgttttatttactgataagaaattttacaacttttaccttatgtccccttcatttagggcattttgtgggggcgcaggtattttckaattatacatatatctcagggttcttgaatttctgcgtttgtgaaaatatctatctcctttacaaccagtaacaactgggaagagtataaaaatctgttt

SEQ ID NO: 52965 - DNA, 201 bp, Homo sapiens
aaatacattattattttggttttggtttaaattactttagtttctgtttctgttttttcaccaattaaaaaataataatacacgaaatcgtttaggcacayagtctatgcttatctgtgtttatttgatttgaatgtagaaaatgtctacacaaataaagaggaaacagctatccagaacacacacacacacacacatata

SEQ ID NO: 52966 - DNA, 201 bp, Homo sapiens
caatagtctagtttttctaaacctccttggctttaactaaagctctgtctttccatgtgtcttagtgcttttttttttttttttttttttggctgtaagaraatatcacaaactgggtaatttataaacaatagaagtttatttgggtcacagttctggagctgggaagtccaagaccatggtgctgacatctggcgaggg

SEQ ID NO: 52967 - DNA, 201 bp, Homo sapiens
ttctctgaaataaaatttcccttctagcagtaacgaacacatggattttaccaaaaattaataagattgaaaaatctatatcaaaaacaggctatactatktttttttttttttttttttaagatggagtttcactcttgtcgcccaggctagagtgcaatggctcaatctcagctcactgcaacctccacgattctcctg

SEQ ID NO: 52968 - DNA, 201 bp, Homo sapiens
gtgacagtgcgagactccgtctcaaaaaaaaaaaaaaaaaaaaaagaaagaaaaagtagcctcagcttttaggtatgatgaaaaacctggatgattcctcrtttctaggaagcaaaatcactgtctagtcacttaacactttatgctgaatgtctggaactacccgacatacttgcagcaatttttagccccctaaattaa

SEQ ID NO: 52969 - DNA, 201 bp, Homo sapiens
tagagtctcattgatgttggtgcaatgatgatggtgtgtgatccattaggttctctctagctaagtaatgctcctgtacaccaacctcacagcatctgtcrtccaaatttctttctcagctaaattgcaaattagtacatattctgaaccttccggtcattttttcaagtagtcaagcctcaaataccaacagtctatatt

SEQ ID NO: 52970 - DNA, 201 bp, Homo sapiens
ttaaaaggatcttttgaactctccaaaataatgatggatttgtccatttcttctgcagtgcctgttagtgaaataaggtgaattggatcttacttatatayataaataaaatatatgtatatatgctttctttatatatataggctttcagttttagctttacattttagatattttagttttagctttacattatagatt

SEQ ID NO: 52971 - DNA, 201 bp, Homo sapiens
caatatactaaaacagtaatcctcaaagtgtggtcggctgatctcttgtgttctcaaatctttttcagggggtccacaaggtcagaactatttttattatratactataatgctatttgactttttttattgtttcatttgcatgaatgtcgcaaagtaacaaagcaggtaacacagcttctgacttaacatgaatcaatg

SEQ ID NO: 52972 - DNA, 201 bp, Homo sapiens
tttgaattaatcagatttttctctaacagttagatacctccactttggatttcaaataaatgtccgaagctttacaaattcaaaaccaaatccttgcttcytaactagccacccgcatctgcctccccaaatctgttgcgttttcagtctttttgttggttttgtcattttccaactacctgctcactgcctgatcttgga

SEQ ID NO: 52973 - DNA, 201 bp, Homo sapiens
tgagacaatataattccagcacttcaggagagtgagacatgagggccttttgagcccagaagttcaagaccagcctaggcaaagtagcaagaccctatctytgaaaaaaaaaaaaaaaaaaaaattaaccaaaggaaaaaaactgaattgtgagtttgtctaaccactatgtaaaggaaaaattcagctgaggaataatgg

SEQ ID NO: 52974 - DNA, 201 bp, Homo sapiens
cacctaggacatgtgaataattatcagaccagctttatgtaagtgatttgatcactctggtctcatggaactgtctctaaaatgatggattctgacttgaygatgtctaacgtctctttgaacatcccatggctgagattccatgtaactgtacttatattgtccatgagttagaagcaggtgccagaccctttcccattg

SEQ ID NO: 52975 - DNA, 201 bp, Homo sapiens
tgtcacacaattagtgaattccagaggcaggattcttcattgttattcataaaaaattttggtataaaaatgaatgaattataaaatataaaaatgtttgkttcctggaaaacattgagattctacaatgcatttcttatgtaaataacactgtttctttattgaaatagttttctactagctgattttagaggccctacc

SEQ ID NO: 52976 - DNA, 201 bp, Homo sapiens
ctgacttctgttcacccgaggaaagtctctatatcccaaaggaaaatcgtttaaaaaaacacacaggagttataaactcctcacaatcataaatcatcackaacaatgatatccgtctttgaacaaagagagttgaaagactggcaaagaaaaaaaaagaagcaaagtgtaaatacccgtttaaccacaactggccagact

SEQ ID NO: 52977 - DNA, 201 bp, Homo sapiens
ctacactgcagttatcaaggaacagacagagagccctcggtgctgtcagccttgtgatggggaaatggaccctgcttccccaaaaggcatttgcaaggagsgatttgaaactggaaggatctcaagtgtttagtcgaaagaccatggcccatgtcagtcatcactgtcatatccacagataatagagtgttggaaagaagc

SEQ ID NO: 52978 - DNA, 201 bp, Homo sapiens
cattagtctgcctctaagagatagatctgctcactgagctgacaagatcagattttctaatgtctcaggcttctctgatcagagcctcccaccaaaagctygtatttggagaggctctcagtagccagccatatgggtttttttccataaaaacacttatgtttatgccagttaaatcaatctttccttcatgatttttct

SEQ ID NO: 52979 - DNA, 201 bp, Homo sapiens
tatataaatattattcagaaccactgattttaataatattttatgggtagagagtggaaaggtacaaagagaaggggcatagcataaagctttaagtagtkccagaagtacaggctgagatgaacaaagtagcaaatggaagagaagtagcccaactgaagaagaaaacccagagaacagagcatgaaaaaaggcaaacac

SEQ ID NO: 52980 - DNA, 201 bp, Homo sapiens
gggcccctaggctgatattccatcatgatttcacagacttctggttaagaatttgcttaatgcattttgctctggcttaaattaattgacacttttacaastttgaaactcatttaaactacatgggtctttcctacaattctgaagccatagttccctaaacacagtgcaatgtgcatttatgtttttaaaatagcacat

SEQ ID NO: 52981 - DNA, 201 bp, Homo sapiens
gtgaagtctacaaaaagccctttgcacctgctgctgtggggatgttgccattgttcagagcagattctgtggggtggggtgataaccagattagggtatgmggagaagggaatggttgataagggttggagatgtggtagactcaactctcaagctgcctcactatgcagaggaggaggaagagatgcattttttgttagt

SEQ ID NO: 52982 - DNA, 201 bp, Homo sapiens
ggggtgagatgtgggggcggggtgaggtgttctatagtcttctgattaaatctcagtcttttagtgggcccttgtccccggactgtgacctgtgaccttcrtgagcgtttctaaacttttttttttttttcctttttctctgccaagttgaactgcagctggaagactagagggagcgagcattgaatagttacccttcag

SEQ ID NO: 52983 - DNA, 201 bp, Homo sapiens
ttttgtttttgtgatgaatactattttctaaaaattccacaaagaaaattgttcaattttcaagtcaatttctatccactaagggaaaatcaagcttatgmatagaaacaattacaacctccttccttactaaatgaaaccttaaatataagaatttggacagtttaagaaccctgaaaaattaactatctgatgtctggg

SEQ ID NO: 52984 - DNA, 201 bp, Homo sapiens
agcgagcattgaatagttacccttcagctgcctagctaagataacgctctgataaactcttttcactggggagtaagcctttgttacaggaaatgctctaygtatattttaaaatcattagatttcccttctctctgccagggacatcaggtgatattttttggtatatactgtgagaaccaagttgtattcctggaagta

SEQ ID NO: 52985 - DNA, 201 bp, Homo sapiens
tgggtccaagacgtcattgatttttagtttctccagcttttttcgtggtgtcgagatatgagtgatgacttccaagctctttagatgttgaagctgcaacyagaagtcttccatgaactttcttttaaaaatagacagtatggcatagtgcagtgtttctcaaaagaaaataaatatattgatctctataccttattaagt

SEQ ID NO: 52986 - DNA, 201 bp, Homo sapiens
atactaaatattagatgagatgtcttctatttgccatgctgtaagtcaattgttgtgtctaggctgaatgtatactgatataatgaaaggattatgaagasgagtgtggaatccccacttaacttctcagaatcagaaggctcctccctccctctgtattcccagtagaaactacatgtgatgtgtgtgtgtgtctgtgtg

SEQ ID NO: 52987 - DNA, 201 bp, Homo sapiens
ttgatctctataccttattaagtgttgatatattattttattataattttatgttaaaatagagaaacacgaatttagacctaaacactgtaagcctacasttcttaaccaagtttttgaaatataatgcatatgttaattaaattttaaaatctcgcaaaaaaattaaaattttaactaacaccaccaatttaagattgt

SEQ ID NO: 52988 - DNA, 201 bp, Homo sapiens
acaataaataagtcataatgtattaactatatattatgactaacaacctgctgtaactttagacatacaaaaatacctcttaatgagtgtaaaatgttaamtcttcttttgagttcagtatacctgtaccacagtgagtcctaggacatttgaatcaattctctcaagccatttgcctatttgattatgaatctctgtttg

SEQ ID NO: 52989 - DNA, 201 bp, Homo sapiens
gtgcaatgagactacaactaggatgtgaattttgagtatcctatctaaaactcaaacaacgataggaaaaatccatttgttttttcatttgatttttactraggactcagctcagtcttaaatgaatactagtctttttccaaagcattgttgatcaaagtaaagcctgtgaggcaagggctttttttttttttcctttat

SEQ ID NO: 52990 - DNA, 201 bp, Homo sapiens
cctcttaatgagtgtaaaatgttaactcttcttttgagttcagtatacctgtaccacagtgagtcctaggacatttgaatcaattctctcaagccatttgyctatttgattatgaatctctgtttggtcactgggcataatcttacatggacctcattctagacacatatatccataagcaacaaaaataaagtaattggg

SEQ ID NO: 52991 - DNA, 201 bp, Homo sapiens
tttgctcagacacatcagaggaatcactctctgtgtcagttacagccttacaagatgtatttcttaagtaataagacttgaaagtaaaaattaatcctggmtccatgggctacacaatggatattgtgttagcaggcatgaaaacaacaccagtctttctgtccatctccatcagagctcttgggtgaccaggtgcactct

SEQ ID NO: 52992 - DNA, 201 bp, Homo sapiens
taagtaataagacttgaaagtaaaaattaatcctggatccatgggctacacaatggatattgtgttagcaggcatgaaaacaacaccagtctttctgtccrtctccatcagagctcttgggtgaccaggtgcactctcaatgagcagtaatattttaaaaggattttttttctcagcaataagtctcaacagtaagattaa

SEQ ID NO: 52993 - DNA, 201 bp, Homo sapiens
atttcaatattgctgtgtctcagggaatagggatgcctgaggagaggaagagagacagaagggggaacagccagttggtggagcagtcagaatacacacarcatatatcaactaagtttgccatcttttacgggcatggtttgtggttccccaaactaatcacagtagtaatctcaaaggtcactgattgccataacaaat

SEQ ID NO: 52994 - DNA, 201 bp, Homo sapiens
tttatgatctacttcactggatattgtattttaagagacaggcttacattattcactgattggggattagacatggcaaacgaggtttttatggaaagctrtttaaaacattcctgattttttcactcctccaccttaaattcacagtttcactcaagaggaaaagaaaaagcaattttaaatacagagtagagacaagaa

SEQ ID NO: 52995 - DNA, 201 bp, Homo sapiens
ggtatctatttaaaaagagcccctatcagagccacataaatattgctaaaatggaaccaagaacacacatgaaatttatgatgaaacttgtttggaagaakggtgaaatcaccgatactttatgaaaagtttataggcacaatgtcccaaaggaatcagcagttgacaaaaagagaactcaattttacaaagggataagaa

SEQ ID NO: 52996 - DNA, 201 bp, Homo sapiens; identical to SEQ ID NO: 9954

SEQ ID NO: 52997 - DNA, 201 bp, Homo sapiens
aaacatggagtctttttttttttttttttttttgaggtggagtctcactctgttgcccaggctggagtgcagtggtgcgatctctgctcactgcaacctcygcctcctgggttcaagcaattcttcagcctcagcctcccgagtagctgggattacaggcgcatgcctggccaatttttgtatttttagtagagactggtt

SEQ ID NO: 52998 - DNA, 201 bp, Homo sapiens
agaataattatgagaattttaaaataataaagcaaaatgagctgagagaaaaaaatagaaccaacattatttgttctgaagaaaatgatttgaaaagtaarttttatgatctacttcactggatattgtattttaagagacaggcttacattattcactgattggggattagacatggcaaacgaggtttttatggaaagc

SEQ ID NO: 52999 - DNA, 201 bp, Homo sapiens; identical to SEQ ID NO: 9956

SEQ ID NO: 53000 - DNA, 201 bp, Homo sapiens
cttatttggcagttcgcaatgacaatttgtatgtgcatcatttctgagaactgttttttctgaatcctatgttgatatggacaaggactatgttctctaayggatttaaacattgtggaggaagaggatggaggaaggcaggcatagttcccaaatcctctcttttgtcagatagaggcaaattaaaacaattatctggga

SEQ ID NO: 53001 - DNA, 201 bp, Homo sapiens
atgctttacaactatgatcagtaactgtaatttttttaaaggtcctcctggacccccgggtgaaaaaggagatcgaggtcccactggagaaagtggtccaygaggatttccaggtccaataggtatggtaattttagctatttaatcatatactgtgaagatagatgatatacatccaggtacatgtgtaggggaggattg

SEQ ID NO: 53002 - DNA, 201 bp, Homo sapiens
ggaaggccaggtattacaataatgtgtattttctttatagaatatgtagaagaaacaccagataattttatatatatatatatatatatatatatatatayacacacacacatacacacacacataatgttatatatgtagtatacatatttttaaattcttggatgataaaaagtggtcattgtgtgaatactagtattc

SEQ ID NO: 53003 - DNA, 201 bp, Homo sapiens; identical to SEQ ID NO: 10099

SEQ ID NO: 53004 - DNA, 201 bp, Homo sapiens
agataaaaatacccaaatggaaaaaaaaaaagccctatctgactaaatatattagcttgttgccaaagaaacgacagacattctttacatctttgtgacartgaattagctactttcagagaagttttgatccttcagtcttacagagaaaatcctatgatcaaggttgatgacaaaatgaacttttctacatcaccaaaa

SEQ ID NO: 53005 - DNA, 201 bp, Homo sapiens
caagaccagcctgaccaacatggagaaaccctgtctctactgaaaatacaaaattagccgggcgtggtggtgcatgcttgtaatcccagttactccggagkctgaggcaggagaatcacatgaacccaggaggcggaggttgtggtgagccaagatcacgccattgcactccagcctgggcaacaagagcgaaactccatc

SEQ ID NO: 53006 - DNA, 201 bp, Homo sapiens
tttttttttttttttttttaactttacagctccatttacgaaagttcgactggtcggtgggagcggccctcacgaggggagagtggagatactccacagcrgccagtggggtacaatttgtgacgatcgctgggaagtgcgcgttggacaggtcgtctgtaggagcttgggatacccaggtgttcaagccgtgcacaaggc

SEQ ID NO: 53007 - DNA, 201 bp, Homo sapiens
agcttgttgccaaagaaacgacagacattctttacatctttgtgacagtgaattagctactttcagagaagttttgatccttcagtcttacagagaaaatsctatgatcaaggttgatgacaaaatgaacttttctacatcaccaaaacagagcagttgaatagtaggtgaagccaactctcaaatgagtctactgaccta

SEQ ID NO: 53008 - DNA, 201 bp, Homo sapiens
aagccagggtggggaagacaaagccccaaggggttgtaggttgaaaatggatgttcaggaacagtcagcttgcttgcttgcttgctttttctttctttccyttttttttttttttttttttttttggagacagagttttattcttgttgcccaggctagagtgcagtggcctgatcttggctcactgctacctctgtttcc

SEQ ID NO: 53009 - DNA, 201 bp, Homo sapiens; identical to SEQ ID NO: 9960

SEQ ID NO: 53010 - DNA, 201 bp, Homo sapiens
acagacattctttacatctttgtgacagtgaattagctactttcagagaagttttgatccttcagtcttacagagaaaatcctatgatcaaggttgatgayaaaatgaacttttctacatcaccaaaacagagcagttgaatagtaggtgaagccaactctcaaatgagtctactgacctattgagacgcctttcctctat

SEQ ID NO: 53011 - DNA, 201 bp, Homo sapiens
taatcaccatggtagtcactaacaaaatatctaaaaatatattcacaaaagggaataagaagaaaacaaaatggttcactacaaaaaaaagtcaactaaawacaaaagaaggcagtaatggaagaaatgagaaccataaaggtatgatgcatatagaaaaatgttggaatgtcaaaagttagttcctgtcagaattacatt

SEQ ID NO: 53012 - DNA, 201 bp, Homo sapiens
cagacattctttacatctttgtgacagtgaattagctactttcagagaagttttgatccttcagtcttacagagaaaatcctatgatcaaggttgatgacraaatgaacttttctacatcaccaaaacagagcagttgaatagtaggtgaagccaactctcaaatgagtctactgacctattgagacgcctttcctctata

SEQ ID NO: 53013 - DNA, 201 bp, Homo sapiens
ggtcaaggctgttggatcacttaagcccaggagttcaagaccagtttaggcaacatggcaaaaccctgtctctacaaacaaacaaaacgaaaattaccccsgcacggtggtgcatacccatagttctagctacttgagaggccacggcagaaggatcacctgagtccagggaggtcgaggctgcagtgagccatggtcgtg

SEQ ID NO: 53014 - DNA, 201 bp, Homo sapiens
agaagttttgatccttcagtcttacagagaaaatcctatgatcaaggttgatgacaaaatgaacttttctacatcaccaaaacagagcagttgaatagtargtgaagccaactctcaaatgagtctactgacctattgagacgcctttcctctatattacttcagagatggtcaaggatcagcaatgtgtggtcacctgtc

SEQ ID NO: 53015 - DNA, 201 bp, Homo sapiens
atacccatagttctagctacttgagaggccacggcagaaggatcacctgagtccagggaggtcgaggctgcagtgagccatggtcgtgccactgcactccrgtctgggggatagagtaagaccgcaactcgaacaaaacaaaaacagatagatagatagatagatagatagatagatagatagatacatacatacatacat

SEQ ID NO: 53016 - DNA, 201 bp, Homo sapiens
tgatttggggtggagagttctgtagatgtctattaggtccacttggtgcagacctgagttcaattcctggatatccttgttaattttctgtctcgttgatstgtctaatgttgacagtggggtgttaaagtctcccattattattgtgtgggagtctaagtctctttgtaggtctctaaggagttgctttatgaatctggg

SEQ ID NO: 53017 - DNA, 201 bp, Homo sapiens
tctagctacttgagaggccacggcagaaggatcacctgagtccagggaggtcgaggctgcagtgagccatggtcgtgccactgcactccggtctgggggayagagtaagaccgcaactcgaacaaaacaaaaacagatagatagatagatagatagatagatagatagatagatacatacatacatacatacatacataca

SEQ ID NO: 53018 - DNA, 201 bp, Homo sapiens
gcagcactatctgtttctgatataatatgtctcctcttctaaatatatactgcaatcatctaggttagtggttctcaaagtgtggtccctggaccaacagmattagctgttgggagcttgttctgctgcatattattctttgagaaccactgctccaggacaagcaaggctcatttatgacattttggaaggagtaagagg

SEQ ID NO: 53019 - DNA, 201 bp, Homo sapiens
catagctcaggtcactcaatttcattacaggaaattgtcagtaatctaataactttaaatgttattaaattactgttaaaacagtaataagcataagttamaaacatttgttgaaacagtaatctagtaactttaaatgttattagattaccgttctaacaaaatgaattcaaactggagaaaaagaagttactgaatatt

SEQ ID NO: 53020 - DNA, 201 bp, Homo sapiens
ttatccatttcctctagaatttctagtttatttgcgtagaggtgtttatagtattctctgatggtagtttgtatttctgtgggattggtggtgatatcccytttatcatttttcattgcatctatttcattcttctcttttcttctttattagtcttgctagtggtctattaatttgttgatcttttcaaaaaaccagctc

SEQ ID NO: 53021 - DNA, 201 bp, Homo sapiens
actttaaatgttattaaattactgttaaaacagtaataagcataagttaaaaacatttgttgaaacagtaatctagtaactttaaatgttattagattacygttctaacaaaatgaattcaaactggagaaaaagaagttactgaatatttcttcaattaattgagctccaaaaacccattccttaaaactccattttcac

SEQ ID NO: 53022 - DNA, 201 bp, Homo sapiens
ggtctattaatttgttgatcttttcaaaaaaccagctcctggattcattgattttttgaagggttttttgtgtctctatgtccttcagttctgctctgatyttagttatttcttgccttctgctagcttttgaatgtgtttgctcttgcttctctggttcttttaattgtgatgttagggtgtccactttagatctttcct

SEQ ID NO: 53023 - DNA, 201 bp, Homo sapiens
agattaccgttctaacaaaatgaattcaaactggagaaaaagaagttactgaatatttcttcaattaattgagctccaaaaacccattccttaaaactccrttttcacattagagagatatttttgttatgaaaattacatcttttttataatataacattcctcaaacttatatttgaaaagctatcttttgtttacgta

SEQ ID NO: 53024 - DNA, 201 bp, Homo sapiens
atctttgtgtcgttctctgtatttcctgaatttgaatgttggcctgccttgctaggttggggaagttctcctggataatatcatgaagagtgttttccaasttggttgcattctccctgtcactttcaggtacaccaatcagacgtagatttgatcttttcacattgtcccatatttcttggaggctttgttcatttcttt

SEQ ID NO: 53025 - DNA, 201 bp, Homo sapiens
attccttaaaactccattttcacattagagagatatttttgttatgaaaattacatcttttttataatataacattcctcaaacttatatttgaaaagctrtcttttgtttacgtagaattacatttattagtttttatgattattagaaaatattatttttatttaatattaactaaatttttaaaaataatttttcatc

SEQ ID NO: 53026 - DNA, 201 bp, Homo sapiens
agtttgctggaggtccactccagtccctgtttgcctgggtatcagcagcggaggctgccgaacagcgaatattgctgagcagcaaatattgctgtctgatygttcctctggaggtttcgtctcagaggggtacccagccatgtgaagtgtcagtctgctcctactggggggtgcctcccagataggctactcaggggtcag

SEQ ID NO: 53027 - DNA, 201 bp, Homo sapiens
tgtgtccatgggataggtaacacaaacagggtgatcatatttaatcatcaggggtctgttttaggcagataatggcaaatccttttatgtaccaaaatctrgcagtttttatttgtaatcattatctagaaatatacagtagcaatttatctgccctacaaaacctaattattttaacctaatattgtgtaggtatgacat

SEQ ID NO: 53028 - DNA, 201 bp, Homo sapiens
gtctgacaagctccagtgagatgaacccggtacctcagttagaaatacagagatctcctgtcttctgtgtcgctcatgctgggagctgtagactggagctsttcctgtttggccatcttggacttatcaccatttgattcaagtgttttgagaagcttaaatgtatttttagaaggaaattattttattcaatccagtgat

SEQ ID NO: 53029 - DNA, 201 bp, Homo sapiens
catagatttgataaatgaggatgtttacagctaagtgtcttaggattgagtgaatactttaaaatagatcaatgctaaagatcataaagcatatcacatawccacattacatatctaataaagagaaatagaacatgacacattttcatgtaagaatctgtttattcatagtgcccatgatgtggtagagactgcatgcca

SEQ ID NO: 53030 - DNA, 201 bp, Homo sapiens
ctgggcaacatagtaagactgcatctctagatgggcatggtggcatgcacccgtagacccagctactcaggaggctgaggtggaagaatcacttgaacccrggaggtcaaggttgcagtgatgtgatcacacggctgcactccagcctgagcaagagagcaagaccttgtctcaaaaaaaaaaaaaagaaatgtcacggtg

SEQ ID NO: 53031 - DNA, 201 bp, Homo sapiens
attacaggcatgagccaccaagcctggcccacctgctgtgtactttttactcgacttacttctttctttctccttttcactccatttactttcagctgagytcctcttaaaaagttctccttcttatccttatgttatctttatctctgcctttattttatcttttgtttttatctccttttcctgaggctttctctgagc

SEQ ID NO: 53032 - DNA, 201 bp, Homo sapiens
catgccctccctcctcatgcagagtatataacaactgcataatgctttaaaaacaaagaatgatatacataaacatctaatgtggtatattctgcttttcrcttatgttaatatgtcagtcatctgtccatatcattatatatgtcactacctcttttctctcaatggctacacattattctattattcagctacaccata

SEQ ID NO: 53033 - DNA, 201 bp, Homo sapiens
agcaaaatgaaaatgcaagaagctgaataaatgtcatggcaaaaagagagatgctcgagaaaaagaaaagattttatattagatagagcaatgcaagtgtraccagattgcaaatcaatgagtttgtctgagtcgagcagaagagcattagttataaataaaagaagctactaaacagagtgcacgccggagggcagaagg

SEQ ID NO: 53034 - DNA, 201 bp, Homo sapiens
ggatgtagtggatgagaaaaggcgaggaaaagaagacctctaggtttgcaccatattagaattctaagcaggggtgttgttaggcagtgcatatatgggtytgtagttgagagacgagctatgggcaagagataaagacttaagagtcatcagccttctagattatatttaaagcaatgaggctagtgagatcaccaaggg

SEQ ID NO: 53035 - DNA, 201 bp, Homo sapiens
gcaaaatgaaaatgcaagaagctgaataaatgtcatggcaaaaagagagatgctcgagaaaaagaaaagattttatattagatagagcaatgcaagtgtgrccagattgcaaatcaatgagtttgtctgagtcgagcagaagagcattagttataaataaaagaagctactaaacagagtgcacgccggagggcagaaggt

SEQ ID NO: 53036 - DNA, 201 bp, Homo sapiens
taaatatctcaattaccaatatgtggtttggtagtatttctcatcattctttgctcaagtgcaatgagactacaactaggatgtgaattttgagtatcctrtctaaaactcaaacaacgataggaaaaatccatttgttttttcatttgatttttactgaggactcagctcagtcttaaatgaatactagtctttttccaa

SEQ ID NO: 53037 - DNA, 201 bp, Homo sapiens; identical to SEQ ID NO: 9938

SEQ ID NO: 53038 - DNA, 201 bp, Homo sapiens
ccattttcacattagagagatatttttgttatgaaaattacatcttttttataatataacattcctcaaacttatatttgaaaagctatcttttgtttacstagaattacatttattagtttttatgattattagaaaatattatttttatttaatattaactaaatttttaaaaataatttttcatctctgcctttcatt

SEQ ID NO: 53039 - DNA, 201 bp, Homo sapiens
tctcgttaatatttttttctaaagaggaaaaacacaaaaatctttgttacagaatccaggaacctcacaacaaggaaagtctttgctatttctaaatgaakgttgtcactatagttcccttgtttcccttgggaaaagatatgaagtttgatcacctatttttgtgtttatgatattctaaaatatctgctcctcgccctc

SEQ ID NO: 53040 - DNA, 201 bp, Homo sapiens
tggatctattctttgtaaatttgagaaagtcatacaccctttctcagtctcagtttatgtatctatgaaatggagataattatcattatttaacaaggttwttataaaaagtaaatttagaaatgtatgtgaaaagacctagcatattaccttatacacaagcacttaaaaaattttcactgtgtctgaaactgttccaca

SEQ ID NO: 53041 - DNA, 201 bp, Homo sapiens
ggaaagtctttgctatttctaaatgaaggttgtcactatagttcccttgtttcccttgggaaaagatatgaagtttgatcacctatttttgtgtttatgayattctaaaatatctgctcctcgccctcctatagtattgaaaatctctgcattgtatgttgataagtttgtatgtttgtatgtcaagaaaataatgaacca
